United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 15

SEQ ID NO: 49749 - DNA, 478 bp, Triticum aestivum
  Clone ID: PAT_TA_49749
gtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaaagagggttccgttactaaccatgttacttccattgtaggtaacgtaatttggtttcaaagccctacgtgctctacgtttggaggatctacgaattccccctacttattcaaaa

SEQ ID NO: 49750 - DNA, 559 bp, Triticum aestivum
  Clone ID: PAT_TA_49750
atcgggagaagtgtccgatggagagagacacggcgacgacggcgacggcgacagcggcggcgagggtgtgccggcggtgcaaggcgaagtactccccgtcggacacacgccgcggtcctgcaggttccacccctccttcttcgtctgccgccgccacgacgaccagaagaggtactacgagctcaaagacggcgatcctccgtacgccgccaagttctacgactgctgcggcgccgaggaccccgacgccgccggctgcgccaccggattccacctctcctacgacgaccccgagtaaagaaagagccaaccaacagtcgagtacgcttgctttgttcctctcctctgaagcgaacccagtgttctgttactttgtacagtcagtagagcaaacacccacctgaattgtgtgtataaatcagggttcagaataaaaatcctatcctgtaataccagtggttgagaataaaatcgtcagaatgaattatggctgcgagcaataattcagacaaggggtatttgcattaatttggacaaattagctttctcaacaggtctg

SEQ ID NO: 49751 - DNA, 490 bp, Triticum aestivum
  Clone ID: PAT_TA_49751
aaaaaaaaaaaaaataaaaaaaaaaaaaaaaaaaaaaaaaaaaaaaaaaaaaaaaaaaaaataaaataaataaaaaaaaaaataaaataaaaaaaataaaaaaaaaaaaataaaaaaattaaaaaaataaaattataaagggggggccctttttaaagtttcaaatttttcttccccttttttccaaatttttatttttttttttgtgccacttaatttaatttaattgcccgggtttttaaaatttggggtttggaaaacccttggctttcccaaatttattccttttgaaaaaattcccttttttcccagttgggttattaccaaaagggcccgacccatttctttttccaaaaatttgccaacttttattggcaattggacccccccttttaccggccttttaagcccgggggttttggtttttccccccaggttaccctttatttttcaaggcctttagcccccgtttttttggtttttttccttt

SEQ ID NO: 49752 - DNA, 172 bp, Triticum aestivum
  Clone ID: PAT_TA_49752
gcactagcattacgcgagacgctgagtgtgaaaaaacaggtgcagtcatgctctatttccaggagcgggcgaaggtgatagaccatctaggtggaagggggatgggccagatctttgaggacactataatgcgaagcatggcttcctagctgctccttggcaacacctcata

SEQ ID NO: 49753 - DNA, 561 bp, Triticum aestivum
  Clone ID: PAT_TA_49753
atatcccatgcatacccgtgatcacggggtgagatcgtgttctcgcagcaagagatgctcatctccacagcactcttcccctatactacttgtgcttgagggctggctatagatcaaataacccagcggtgctcccaacaaactggcccacactgcacatgttcccttccttcgtggccaacctccacaacttgcatgattatttcgcccttgtcctcgctggatcaggtcacaacttcagggcgcacggccctcctgggaccgggatgcggttattcgtcacatgcgaccctgcgaacatccggcacatcttcacgaccaactacaccaactttcccaagggtgcggagtttgccgctatctttgacatcatgggtggaagcctctttactattgacggcgagctgtgtcgtcagcagcgcgccaaagtcaagggcgtacttagcagtccatggatggttgccaggattgccgcttgctgccgcgaccaggtggagaacaacctgctccccttggtaccaacatggagagcattggcactccgttcgacatgcaagaaat

SEQ ID NO: 49754 - DNA, 197 bp, Triticum aestivum
  Clone ID: PAT_TA_49754
cacaagtacgactgtaccgagcgagaaccgaccggagcgaggaggaagagcacaggatccttatctcctccgggaggaagcgcgccatggccgccgcggtcgtccacctctccgtccacggccgcctccgccgctcgccggaggccgtcgtctctcaggcatgccaccgcccttccctcctgcgctgccgcgcgttc

SEQ ID NO: 49755 - DNA, 319 bp, Triticum aestivum
  unsure (1)..(319): unsure at all n locations
  Clone ID: PAT_TA_49755
gctactactacaagtctaccataacactcgctgtgtctccgactgcctagcactactacgtgccgtagtagggacgccaccacggagggaatggccagcggcggcgtcttcctgctcctactcctcctcgtcgccggtgtcgtcgccgtcttttttcggatgaggcgacggcgaggggacgggagcagcagcgcgccgagcccgccgtcgctcccgctgctcggccacctgcacctgctcaagaagccgctgcaccgctcgctggccgcgctcgccggggcggcgccgntcctgtcgctgcgggtgggcgcgcgccggg

SEQ ID NO: 49756 - DNA, 468 bp, Triticum aestivum
  Clone ID: PAT_TA_49756
ccaggctcatgggccgcgcccagggcacctacatcgccgccggcaaggaccagctggcgctgctcatgctcatgaacttccttttcaccgccggcaagtacaacggcagcagcgtcgccattatgggtcgcaacgccgtgttcaccgaggtccgcgagatggctgtcgtcggcggtaccggcgttttcaggtgggctccagggtacgcgcaggccaggacgcacaccttggacctcaagaccggcgacgccaccgttgagtacaacgtattcatcatgcactagtctcggccctgctcaaattttacccagagttaaatagcatgaataaggattttatatgctctggctgctgtttaacttggtttaatttcatataatggagctgctttcggtgatccgttttccataattcgtgtgatgtcaatgacaatgaaataaatggtggtgctgtttatgtgttagtgtt

SEQ ID NO: 49757 - DNA, 414 bp, Triticum aestivum
  unsure (1)..(414): unsure at all n locations
  Clone ID: PAT_TA_49757
cccactcgtacgtccacgcgtgcgtcgtngcggtgggctcacctaccctcacccttccactcctatcgcaaaacccctccaatctaaaccctcaccaccgcaatggcaatggccgccaccggacggggccttctactctcccgcccctcccctctccgcactacgcgtgctccgcggcgggggggcaccgccgaccccccttgctcccccgacctcgccggccccgcgccccctccccgacacgagctcctgctagagcgcctccgactgcggcacctcaaggactcgccgtcccccggccccccgaagccgctgagggagagggccaggaacggcgagaggggctacccaacgccgcagaaccagcagaggagcgttgaggaggagagcttcgaggagctcggcctcgaagag

SEQ ID NO: 49758 - DNA, 382 bp, Triticum aestivum
  unsure (1)..(382): unsure at all n locations
  Clone ID: PAT_TA_49758
ntcactttccctttcgcccacgcctncatccttccttactactaccacatccaaaatcaactaccaacaagatactgtctttcaacatccacgactacttcctgcacgccatcatacctggngaactcccttcctcctcctaacccaagccgaatacaacaacctctttcantgcgagggcggtgggcgacatcaanatncacctctccaccaccaaatactntccatacctncanaacnaaccttcccccttncacacaacaacaattntnnanaantncactcttaanctnnttnatnaatacaaacacatnttntnccanncnaatnaacctctatctacattcctacantacataacatatnnacacatnatccataa

SEQ ID NO: 49759 - DNA, 247 bp, Triticum aestivum
  Clone ID: PAT_TA_49759
gcgagcctgcgttcgcacagtcttaggcaccacatcacacacacaactagcattgtttcctgttgtctcagcccgcagagatggaagcggcattgcctgcaagcggctcatcgacagatactgactctgtttcaatgagctcgcgggcgatgtgtagcactaactcgcctaattcagcagataagcgtgatctatgtacgcaggctgtgatgaggccaagaggcgtggagacaccacctctgaggtt

SEQ ID NO: 49760 - DNA, 430 bp, Triticum aestivum
  Clone ID: PAT_TA_49760
cggtcgaccacgcgtccggcaggggtgcccgcagacgaggagtccggcctcctcccccgcgcgagcccgccggcggcagcagccgccggacggaggccttcctcctcctcctcctccgcagcggccctgcgccgtgcccccccgccggcggactgcgcgacggtggacgggcccctggctatgccgctgcaggaggttgaggtgcacccgcagttctctctcatatgaggatacacactgggtacgttatgtccgtttattcctgctttgagttctacgtgttgattatgctctagttttggacctgcttaatatttacctagtgtttatttgtatgtactaggtttctatatttctttgttgttgtttaactttgtttatatttatattttgtatgtttttttatatatactttttttatttctgtttt

SEQ ID NO: 49761 - DNA, 467 bp, Triticum aestivum
  unsure (1)..(467): unsure at all n locations
  Clone ID: PAT_TA_49761
gagctcttgcctcgcagtaggcgataaatagctctggcggtagaaaagggcatcggcctagattgggaagacccgcaacaaggccgtagccccgtcgccgtcaggcacggcactggtcgccggcgccgcccacttcgactctacgccatgggacggacgcgccacgggcatcagtcggggaaaagcttgctgtgctgcccccaatctctcgtccatatccggtttcgaggcggaggccgattgggaggggacggaggtgctgcacctcgcggacaaatcgaggaacagcgccgagagttagatggagtactgggcaaacgctaggaggatatggcatgcatttaccagcggtagggggctgcgctcggacttgaatcatcgtggccaggatgagaagcagcgcaaagaaccatgtcagctntgtagcactacttttctgagaacatgccgagcaactgaagctgatt

SEQ ID NO: 49762 - DNA, 148 bp, Triticum aestivum
  Clone ID: PAT_TA_49762
ccttctcggaggagggtatatacctacatagcacattccttccccccaccctgatcaccttgactcccacctacactcactccttaccagggcctcaactccaccgcccgcctacctatcagtccactatccaactcagctagcctcc

SEQ ID NO: 49763 - DNA, 637 bp, Triticum aestivum
  unsure (1)..(637): unsure at all n locations
  Clone ID: PAT_TA_49763
cccacgcgtccgattcatcgctgatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgngtatctgnggaggcaagggtcaaggaaaatccttccagtgtgagcttgtcttcggcaagatgggcatcaacccaatcatgatgagtgccggagagctggaga

SEQ ID NO: 49764 - DNA, 433 bp, Triticum aestivum
  Clone ID: PAT_TA_49764
gcacttgctgtaacgaaccgagagcgaggccgccgaccccctctgcttcctttacctccttcctccccagatctgatccagaagagagaattgagtagatccgcgccgccggcggctccccacgcgcgttcgccgccataggcatacccgatctacctcaccgcgcgcctgctgcctccgcgccagccccctatttcggacattcgaggtacgagcatttcgtcgttccatcccagcgattagtcaaaccccaccgagctccacggattcgcggcgcggcgcccggtgagcgcacgccgttccagatccgccccctgagttgcagggcctggtcgttgggcccttggagaaatcacttgaggttgcgggtctcggatgcggccatgagtttgccgggaaagaaggccgcggccggggctgggggaatccggcg

SEQ ID NO: 49765 - DNA, 579 bp, Triticum aestivum
  Clone ID: PAT_TA_49765
cgcaaccatgtacgcggatcggttcccgtcggctgagttgcagcggcggccggccgactaccagctcaaaacctgggactatgactccatttgctccatgcagcagcaggcgcaacaagaccacgagcatagcaaggaaagctcactccaatcaagcttgaagcagaaagtgaggcggcttctgctcgaggaggaagaagagctggctactaggctcataatcatggatcaactgcaaagtctcggtgtagcgtaccatttcgaggaggagatcagaaacatcctcatgtccatgcatgtccatgatgcacaccatcaactcaagcatgacctctcatcaacagcactgctatttagaatgctcagaggatatggaatctctgcgtccacagatatgttgagtgcattcagggatgagaatggtgatttcaaagcagccaaccccaaggatattgatggattcgttgcactccatgaggcttcctacctggccttcccaggagaggccatgctcgacgaagcagagcattcgccgtcaagaaactcgaacaactgatgccgtccatgttcatctccatg

SEQ ID NO: 49766 - DNA, 472 bp, Triticum aestivum
  unsure (1)..(472): unsure at all n locations
  Clone ID: PAT_TA_49766
cttccgcttcccttgccttccccacgaagtctcctctcatctgtaatccatgatgacacggcaggctcgatctggtcgtgcgctcgtctcccgcccccagaacctgcagatcctcgtcttcccaaccggtgtatgtcctagagcggtggtagcatcggactctctgtctcgtggggccaggcctcccgtctgcaccgcgatgccgccgacatggaggcccgggctcgggcaactgccgcggtgtcgggtacgccggtgaggtctcgggcaactgtctgggaaccacgagggactggcacggataccggttgtgggtttcagcgacgccgggttgtacatctagccgcaggtggcttgcagggttctaaatacggngccctaaattcgatgatgctgaggaggaggcagaccggcagggtggttctattgggctgggntgaggcgcaggcggagcgggccggacacacagatg

SEQ ID NO: 49767 - DNA, 373 bp, Triticum aestivum
  Clone ID: PAT_TA_49767
cttaatccaagagctatagggagggactgatctcaccacactacagtacactacacgcaggtagatggattgaaagctccagccaaagcatactcaatcgccttactacaccccacagtatgccaacatataggatactagatatctccatcagaatatcacgagtgagtcctaaccctggggctccggcctaagaagcaggctctgcagcagctgcccaatctcatactcgtacatggacaactgctcgcactgatggacttaccaggctgtgatcgttacaaaggacgacgctatcacatctagcctgttgctgtggaagacagccaatggatcttgtttggagcttatgcattcgacctatttgaagagg

SEQ ID NO: 49768 - DNA, 474 bp, Triticum aestivum
  Clone ID: PAT_TA_49768
gagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagggggttccgttactaacatgtttacttccattgtaggtaacgtattttggtttcaaagccctacgtgctctacgtttggaggatctccgaattccccctacttattcaaa

SEQ ID NO: 49769 - DNA, 480 bp, Triticum aestivum
  unsure (1)..(480): unsure at all n locations
  Clone ID: PAT_TA_49769
gaaaaggaacatttgaagttcttgcgccttcttcttaaggattttatgattaaatatggcattgacactgagaattggattctgatccaatttgcaacagctcggaagattatcgttttatgcccctggagcatcagccagatgaaggccgtcgaaggtcacaaaggcagcttgctattgtacagggcttcaacacataagggaagcttgttacatttacagaaactcatgatgttggcaatgctatttgcagtctgacatacatctgcatatacaaaactcagagaagtcatggtaaaaacttgttgttaagcgacgatatgggcgtcataaagaactccagtcatttgattgaagcgcagatctgtacacgaagaccttagaaacaaagcctgggttaggtgggtgagcatggaaatctaagctagcctgggttnggctctgcantgggggattggacttnaaaatttagcaccgttt

SEQ ID NO: 49770 - DNA, 439 bp, Triticum aestivum
  unsure (1)..(439): unsure at all n locations
  Clone ID: PAT_TA_49770
atcttgattgagcttgcgtgtacatcgttttgtctgtcgtacctgagcatatgagaaatatcatatcatcttgacccagttctatgtactacgtttggtgtatcttttgtttgcacatcttgattgtacaaggcctaatgtacatcgttttgtatgtcgtacctgagcatttgaaaaatgttataacattttgacccagttctatgtactacattggtgtatcttttgtttgaacatcttgattgagctggcctttaggccccgttcgggaatccaccgctcctaggatccgcagagcggctgtttgctggctcctatattttgcactacagctccgtccgctcccggagcggagccgtggagcggagtgaagccgaacggngccttaatgtacatcgtttttgtctgtcgtacttgagcatttgaataatatcatttt

SEQ ID NO: 49771 - DNA, 545 bp, Triticum aestivum
  unsure (1)..(545): unsure at all n locations
  Clone ID: PAT_TA_49771
ccgccgctcgcatcgtcgccttctcctcagctcttgagctcccacccctctcgctcgccagtcgcctgtgccccgagcccccactagcccgaccttggagaaggctgcggtcgccggatccagccatggccgtcaccaacgccctcctctccatcgccgcaggcccatgttggattcagccggcgtgccggccgagcgcgcaaccctaacctcaattaggagcccgagggagggggagcgggactggagctcgattcagccgccgtgccttggattcagccgccgtgctatacccgggggaggggggagcgggactggagcttgatttggacagggggcggtttgtggctcccgtgcgcgttgaagattcggcggcggtcgcgtcctgcatcaacggcgcgacgaggaatcataggacagatgggagagatgaggagatgggaggaggaaggaaggaacggggagggactcaccgacgcgggggcgctcgccggaggctggctggcggcggggtacacgaaaacggngggacgcgtgtggcaccc

SEQ ID NO: 49772 - DNA, 489 bp, Triticum aestivum
  Clone ID: PAT_TA_49772
gcccgctccatcttccaccgcgacgtcaagtccggcaacatcctcctcggcgccgacctccgcgcgaagctcgccgacttcggcctctcccgcgccgcgcgcggcgccgaggacgcgtcgcgctcccacgtctccaccgcgccgcagggcacgccggggtacgtcgacccggagtaccaccagagcttccacctctccgacaagagcgacgtgtacagcttcggcgtcgtgctgctcgagctcatcaccgccatgaaggtcgtcgacttcggccggccggcgaacgaggtcaacctggcatgcctcgcgctcgaccggatcggcaaggggagagtcgaggagatcggcgacccggcgctcctccgtcacggcgaggagtgggtcattggagcggtccggcacgtcagcgagctcgccttccagtgcctggcgttcgacaaggacgtccggccgtccatgagcgagggggcccgcgagctgtgccgatca

SEQ ID NO: 49773 - DNA, 682 bp, Triticum aestivum
  unsure (1)..(682): unsure at all n locations
  Clone ID: PAT_TA_49773
ctcaatcggacattaggagagatggggaggcgccgccggttcacgcagcagcccaccagcgacgacgacgacgacgacgacaaagccgtcccgcagccgctcagaaccaccaagcccacagcccccctctccccgggcgccaagaagcagcagcgtcaccgtgccgacgaggacgacctggaactcgaggaagaggaagaggatgagaaggacctggcggagttgaggaagaacgaggaggaagagagacgggaggagacgcagacccgccgccgcaggggccgcaaacccaagcgccccgccgaggagagcgacgaggatccggaggagaaaaaggcggaatcagaggaggaggaggagtcccgcgaggaggatagcacggaggcggtacccgtcggggaacctttgaaggtgaccggcaaggggaagaagcagcggaggcattacctctcctttgagtacgagggcaacaccttcgagcttgaggacccggtgctgctcacgcccgagcagcagaaagagaagccctatgtcgccatcatcaaggatataacagaaaatgatgggagcttatcggtaactggtcagtggttttataggccagaagaagctgacaaanagggggggtgggaattggacaggaagtgacacaagagagctattttataggttttatatagat

SEQ ID NO: 49774 - DNA, 590 bp, Triticum aestivum
  Clone ID: PAT_TA_49774
agcacgatatattcatacgatagcacacggcatgggacagagagcacatggtctcgttgttcaactccgactctcatttccaggggcatgaagtatcagcgacgagctgatgcgacgacaagcgatccaagggggctaggctagaccgcgtgcgctacggcggaaggtataaagagcctgcaggtgtggaccatggaggacatcaagatcatcgagaccgtgttctactgtgccatcgctcagcacggaagccatgctcatgcagggcgactacctgatccactacaagtgggagccttgcctcgagttcagcaaggttgggcaatctagcgtgagcacaacgcatccgctgggtactatgatggccgggactggacaacgcggaagctgactatgttcgggtgcaccgacgccacacaagagatcaacgaggtggaggaggctatgaaggagtaccctgacccgtatgttcgcatcatcggattacacaacatgcgccaggtgcagggcgttagcttcatcgccttcagccaccgggctgcgaggaggccggcaaggcctaaacagctcactcacgaaaggccatatat

SEQ ID NO: 49775 - DNA, 443 bp, Triticum aestivum
  Clone ID: PAT_TA_49775
cgcttgacatgaattcctaccaggctggccgtgtggtcgacgctgcacacacacctcgatacagataaaagaacgcagagagtggtactcgtccgcgaggtctcctagatcttctggttcggacgagagcgaaggatgagagcgaccctataacctacaacgccacgcacaagctgatcaccaagacgatacagaacctgccactatccttcagggaatgtgctacagcagagcaaagtgagggacatagtctagcaagactgagaatgtggtgaacgacactgcggtcttctacaggaggggcgacgcccgatctgatgccagcgtcaagacctactatggtgaatactcccactgcgcggacaagtcatacagacatcatgtcaaggactacatgtactgagctgacgatcgctatgcggtttgagcatgactgcttacta

SEQ ID NO: 49776 - DNA, 602 bp, Triticum aestivum
  Clone ID: PAT_TA_49776
taattttgttcatatgtgtcagtctgaaaaggttgcatgagatattgatgttttacttccgcaaagaaaacaatatatttgtttcgcctacttttatcttctgtcttaccacttgtattcttccttacggtgccacgaataatggattttcctttggcatgtccgacgacaaactcttcatcttcaggcctttgtaatcgttattgcagccggacttctaccactgtaagtgctattgatctgcgtcctttctaatccaaatcagctcttgtactgttcctgatatttttatattacttgtactactggaacttctctaaaaatcaatgcgatagaagaattgtcaccaagaacataaaactcaagaaagtgtatgtgtgaatgtatttcaaataattacaatatgacatgcttttcatagtgctaatgtctcgtccttatactggtatatactatgaataaagcattctattttttcccttctattggtagatatataaatatagcattcatttttttctggagtaacgatatagtgctataactttcaatcttacaatataattactatcctttttatataacttgggaatacaaatagg

SEQ ID NO: 49777 - DNA, 505 bp, Triticum aestivum
  Clone ID: PAT_TA_49777
cccacgcgtccgcgatcctcccgcgggccaggccaccgaccaacatggcagcgtctctccaagccgcggccacgctgatgccggccaagatcggcggccgggcctcctccgcgcggccgtcgtcgcacgtcgcccgggcgttcggcgttgacgctggcgccaggatcacctgctccctgggtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctaatggaggtgaagggtaccggcaccgcgaaccagtgcccgaccatcgacggcggcgtcgactccttccccttcaaggccggcaagtacgagatgaagaagttctgcctggagcccaccttcttcaccgtcaaggccgagggcatccagaagaacgagccgccggcccttcagaaaa

SEQ ID NO: 49778 - DNA, 407 bp, Triticum aestivum
  unsure (1)..(407): unsure at all n locations
  Clone ID: PAT_TA_49778
caccaaccgcgcgccactgattcatcaactccgctccactagctaggtaccttccgaccgagcagccagagagatggagaggatggtgatgaggctgatgaggaccatcccgctcccggggtgctcaacatccgggacaccgccgcccacctcatcgggcggacgccgctggtgtacctcaacagggtgcggaggggtgcggnncccncntngncgncnngctcgngnncctgcngccttccttcagcgttnnggcccggccngcnntctccntgntcgnngntgcggngnngnnnggggctgtnnnccccggcngggcgncgctgntcgngcctncntccgggnncctgggcgttggcctggcgttcctggctgccctcnnggggtccgngctcgngcttgccgtg

SEQ ID NO: 49779 - DNA, 501 bp, Triticum aestivum
  Clone ID: PAT_TA_49779
tgctgagctcccaagcagtgggaggggaaagtgatctctgaccgccgtcgtcatcaaggggcttgctgaccacaaggatcaactcggagctcctctctgcccctgcaggcattacgacgacaaggccgccgaggccgcgcaagggttctggaactgcccgtgcgtccccatgcgagagaggaaggagtgccactgcatgcttttccttacgcccgacaacgattttgccggagaggaccaggctatcagcttggaggagatcaaggaggcgacgtccaagtactaaccacacaacacctgttttgctcgagagggggctatagtcagtcagtcggtcgtcgttgtcgggacctgtgtatgtagtatctctgtaacaagaggaaataagaaatgtctgtctggaatggtgtctggtggcatccatccgtcttgagagaaattaaggcctgatgggtgcactcccgactcgtcaatgttgcgatttattggcgtgtttgggct

SEQ ID NO: 49780 - DNA, 310 bp, Triticum aestivum
  Clone ID: PAT_TA_49780
gcctgcgtaccgtccgatcccgtcgccccgcgtccgaggggttgcttctcctccccactcagtcctcggttcccggtccgcccgtccgttcgtagggtttagtagtagcgggaagaggaaggaatgcggacgtgagtaccgtgcttcgcgcggctgctggccacgacgaccagccctcaaacgccttctcaggcgggcgcatactcagacatcatgcaggagacgccgatccccgttcggttcgcactcgcgtcgcgaggcagccagcatcgagcagaacgcagacgacggcgacatacctcacgagcgc

SEQ ID NO: 49781 - DNA, 665 bp, Triticum aestivum
  unsure (1)..(665): unsure at all n locations
  Clone ID: PAT_TA_49781
cagaaacacatcaggtatgcttaagagccgggtgctgaacgtcgcaaaattctatggaaggctatgttggaaggcacacctcttacgctgaccctttaccaccaccagaaaccggtgcccttatttctgcaaggcctgtaaccctcgcgatacgaacaggcgaagccggcaacgctgccgtagcagcgtataacctacttgcaaaggtgcaactaagctttctttatgtcataggcctggtagtgatggcgtttgagcacatgaggaacattgtaagagtaacgaagcccgtgagggtcgcggcgatcgagtcatcataaagaaacaaaagacatgtaaattatacccccgaagccggcgaggagatcatatttcatgtctcctccgtataccatccgcggagatgagacggatttagagtagcatctccgcaagaatcgaacctattttccctcctcccttgagaaaggcccctctgctctcggcagaaacaacgtttcgagactgaagaacagaggagctgtacctgcgttgcgcacctgggcagaagcgtcacggngcgtggtgattgagatgtgctgccatacattgtattagctcggagagagcaaatggatcggatgtacctttgtgtggtgagtgtaattaagctgtgaccaatntgt

SEQ ID NO: 49782 - DNA, 443 bp, Triticum aestivum
  Clone ID: PAT_TA_49782
cccacgcgtccgcccacgcgtccgcgcacctgctaagcccagcctagccgctcgattgccccgtaattcacggagtagttggaccttgcacgagggaatggtgaaagcaggggcaatcgatcgtgggttgccaggagcgttcgcgggttggctgggcgtttttttaccgtcctcatttgcacccagcggcggcgcctccgcttcagcctctgttgctggtggactgactattttatatgcactgaagctgcaactgagggtagtgctactctatgttgggcagcagtaagttaggatttaattgatggagtccagctgataaaggacgtgaacaggatgtcctatcgctggatgtttactgtccgaattgcaaggatctgggaatacatgagtacagaccctatcgaattctatagctctattcattggcacaccagttgatc

SEQ ID NO: 49783 - DNA, 524 bp, Triticum aestivum
  Clone ID: PAT_TA_49783
cccacgcgtccgcccacgcgtccggacccacgcgtccgcggacgcgtgggtgccgatccagattactcatcatataaggctctggaatttgccaatggcttattctcaacattcactccatcggcgggtctgaagattatacaactgtacagggaaggatacaggcaggactgggaactatcatttgaaaagaacaccaggacaaaaggcggatggtatcaaggggggctccttgttgcaggcccaggcatcgacaacatctcctacatccacaaggacaaagaagctggagatgaccctgaaatggaggatgttttgacagcttgttgttcctagatctttagcgttgctttgatctcagattagaaacaaaaatagtactcctttagtatccccactgtggcatgttctcgtgtatagtcgtactagtcgagtgcatagatgaccagtccagcatcacttgtccagcgccggcaaaaacaagatatgttcatatgaactagggagcatagcgagcgcaatgc

SEQ ID NO: 49784 - DNA, 466 bp, Triticum aestivum
  unsure (1)..(466): unsure at all n locations
  Clone ID: PAT_TA_49784
acccgggtcgccacgcgtccgttaatgtgagatattctttattcaagaagtttaagggaagggacttaatgtcaccacaaacagaaactaaagcaggtgttggatttaaagctggtgttaaagattaaaaattgacttactacaacccaaaatatgaaactaaaggatactgatatcttggcaagattccgagtaagtccttaacctggggttccgaccgaaagaaacaggggcttgaataactgccgaatcttctaatggtacatggacaactgtttggactgatggaattaaaagtcttgatcgttacaaaggaagatgctatcaaatcgagcctgttgctggagaaaacaaccaatggatctgttatgtagcttatccattagaactatttgaagagggttccgttactaacatgtttacttncattgtaggtaacgtatttggtttcaaagccctacgtgct

SEQ ID NO: 49785 - DNA, 515 bp, Triticum aestivum
  unsure (1)..(515): unsure at all n locations
  Clone ID: PAT_TA_49785
gctgcggcggcgcgcgcataggangggaggcagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcgacaagacagtgaggagggtccgtgttcgtggaggtaacgtgaagtggagggctctccgtctggacactggtaacttctcatggggtagtgaaggcggtgacccgcaagacccgtctcctggatgtggtttacaattcgtcaaacaatgagcttgtgaggactcagacccttgtcaagaatgccattgtgcaagttgctgctgctgccacagaggaagcaaagaagagcaacaatgtccagaggaagcttgagaagcgccagcagggacgtacactggactctcacattgaggagcagttcagcggtggaaggctgctggcctgcatttcgtctc

SEQ ID NO: 49786 - DNA, 484 bp, Triticum aestivum
  unsure (1)..(484): unsure at all n locations
  Clone ID: PAT_TA_49786
taattctatgcttgtgtgtggtgcttgttttcttcacaataagaaagaaatcaaaagatcggtccaaaaccatgggaggatttcaacttatggatgacaattatcctagagttacttatgctgaattggtccaaggaacaagtggctttgctacagacaatttgattggtagaggacgatatggatcagtgtataagtgtagtttgctgctaaacaccatgatgaccacagtagctgtgaaggtgtttgatcttcagcagtctggatcttccaaaagctttctagctgaatgtgaggcacttggtaggatccgccatcgaaatttgattagtgtcataacttgctgctcaagctctgactcagaccaaaacgacttcaaggcccttgtgttggagttcatgcctaatgggagcctggataggtggntacacattgatgtacatgcatcacagcaactgcaaggtttgacattgatgcagagatt

SEQ ID NO: 49787 - DNA, 236 bp, Triticum aestivum
  Clone ID: PAT_TA_49787
gagagaccacagcagcacgaagataagagagaagcaaagcttgagatggcgccaaccatggcgtccatgaccggcctgtcgcatggcgtgcgtctccctggcccggccggcaggcgcgcacagcaggttcaccgtgagggcgtcgtcggcggaggccgaggccgacggacgacgtgcggtccttgccctaatggacagcggagtcgtcgacagcgcgtacgatcaggtggtgcacg

SEQ ID NO: 49788 - DNA, 317 bp, Triticum aestivum
  Clone ID: PAT_TA_49788
ttgatcctacgatgtaccaagccaaggagaggatggtatcgtctcatccaagccgcgtgccatgctgatgccgtgcaagatcgggggccgcactctcctccgcgcgggcgtcgtcagacgtgggccgggcgttcggagttgacgctagcgccaggatcacctgctgcctgcagcccgacatgagggaggtcgcaagcaagtgcgccgaccacgtcaagatgggcggatttgccctgggcacctgtgacatcctggtatgatgagcgagcgcagaggctgctcccaagaggctgacctgctacgagatccagagcaag

SEQ ID NO: 49789 - DNA, 440 bp, Triticum aestivum
  Clone ID: PAT_TA_49789
cggacgcgtgggtacatgctcagtttgctaaagctaatctttggataaaaaacctggacctgggaatacaacagtgccagtcatggaaaaggaaacgaatgaactcttacaagatgaaacgcagcaccgatctagctcttggggatgttcttgccgacaatcttcgcgggcgtgatgcggagaaggttcccctgcttcccaggaatggcccccttgatcatcacaactttgagatcattgtcgatcctgacaatcttgagcttcctgatcttggtcttggttccgcccatcctcccgggcatcttcttccccttgtacacccgccctggggttgtccccgcaccgatcgaacctagggctctgtggctcttggaaccgtgggtcatcagaccacgcttgaagttgtgcctcttaatttcaccttggaatccctttccgat

SEQ ID NO: 49790 - DNA, 461 bp, Triticum aestivum
  Clone ID: PAT_TA_49790
ctcatactgtcgctctagatggagatcacgatgatcatcgcgcacctcatgccggacgtctaccggtacgagtccatcatcgagtcatggatagccctcatgggcgctcgccatggagatggagatggagagcatgttggagctcatgtgggagctgacgtcggaccatcaaacactccattaaacactctagttcaagcccaaggttacgcagaccgatggaatgactgatgaagggacagcgcaagttctaacgggggtcatgatcgagggcgtactgaggcttgatgactggatgcttaactgaaatcataagtggcatgagtagaggcttgagaacagggccgacatcaaggctgagatcgatcttgccgtgagctgtacggtgtgctgagaggattaccaggcttacaaggagcgttgcatggctgagatcattatagatgtagcactcactgatg

SEQ ID NO: 49791 - DNA, 213 bp, Triticum aestivum
  Clone ID: PAT_TA_49791
ggggggaatagcaggcgcgggcctcgatgtctttgagatggagcctgaggtgccggcagagcaactcccaggaaaagtggtgcttcaagcgcaagaggccgtcttcacttgtggagtcggcccctgaactttcaacctaatgatcggaaccttgaggcgttcttccaaggtaagccaatgctcacgccggtgcttccggaagcaatgctgtag

SEQ ID NO: 49792 - DNA, 391 bp, Triticum aestivum
  unsure (1)..(391): unsure at all n locations
  Clone ID: PAT_TA_49792
cgagccaacggcgtcggcggcgatnccgcccccacgtgctacctcctcctgaacccttccagggcctgccaccgcctcctcccgccgtctccgcgcctccccgcccgctgcgcccgcctccgtgtctcctgcgacgtgccgcggcaggggggtgacgacggctgcgggcccaagcgcggggtcatccccgccggagccggaaagggcaagaagcaggtcgtgttcttcgacgccgcgccgccggtggcccagcagggagacggcgaggatgggaaggggaaggcgccggaggtgaagcaggacggcgcggcgctgcgggcgctgaggcgcgcgaccaagcgaacgctgtcggtcctgtccaacctnccgctcgccatcgccgagatgttcg

SEQ ID NO: 49793 - DNA, 560 bp, Triticum aestivum
  unsure (1)..(560): unsure at all n locations
  Clone ID: PAT_TA_49793
gtaggagcaactggtgcttgtgggactggtgcttgcagttgttgcagctgttcttgagggccgagctgaatgtantctgagaaaggtatatttcctttatcactcccccagcagacatgagttctcgtggcggggtctttcatgccgtcatgttaggaatttattattggattgcatatgaggttcttcttcaggtttccacttgtttcttactccctccgtccgaaaatacttgtccgaggaatggatgtatctagatgtattttaattctacatacatccatttgtatccattttgacgacaagtatttccggacggagggagtacttaagttagctatccattctggatttaacgtgaatattgcctttgtattccatatgaaattctactatttgttttagcttctgtagttttctattcattatccctagacattatcatgtgtgtgtcgatacgcttcgtggatggtgaggtttaatatcgcttgcttgtcgccttctctgccctcgacatgcggaaggccaataaaggcggngacgagtcatggatcctgctg

SEQ ID NO: 49794 - DNA, 499 bp, Triticum aestivum
  Clone ID: PAT_TA_49794
ccctaactaaacccacccaccctcggtcgattccctaccaaattcaggccaccgtcttcaaatccccctcccccaaacccctcggtcatcagtcggatcgatcgatgcgacctccctccccctcgattcggcggaggcggcggcgcgacccgcaaccctagcacccaaccccgccccggatccgcccgcgcgggcgggtggaggcatggccgccaacgcccacgccaacctcgccggccgctccgcgcccaacgagctcgacgtgctgcggttcctcgaggagaccggcgaggcgtaccagggcttcgagggcgcctccttgagtagccgcggctgcctcgtcggctccggcgttgtcaaggatttggtcgcgttcgctggtgatgccgatgacaagccgctctccgcgaggccgctgcccaggtttccggtgcggcacgatccgacgccgtcgcggccgtgtgttagctttgcggcgctgggccgggggagcgggatg

SEQ ID NO: 49795 - DNA, 597 bp, Triticum aestivum
  unsure (1)..(597): unsure at all n locations
  Clone ID: PAT_TA_49795
gaattaactagttgatctggatcaagacgacaacttattctcatcgcagggtgggggtgaagacgacttgggcagccatcatacactaagcatccaacttgtgcaggaagtggagagcttgcacccagtggtggtgaactagtgatcttgttgaggaacctcctagttttgctctccgaggcaaaattcagtggcagtggaagatctggcgagcaaggaagattcagcaacgattgtggcggtgatggcctccagcatccatgaatccactgcagaacccctcctggtaatcatgaaccccctgctcctatcatcagcatgctctggctcttggcaggacttggagtttctgctcaacaggggaatcgatcaagtgcaacgttccattatgcctagtcaagcatttcttgacctgcttatggcctacggctccgacagctgcatcaacaaaagcgcgtcaacgcagcgagtttccgatgatatcgaagcatttcttaacctgccttcaactgtgccgtcactcctggatggagtcaccactgaagggggcaccgtactccatgtggnggccacatatggcgacagtgatggcttctt

SEQ ID NO: 49796 - DNA, 389 bp, Triticum aestivum
  unsure (1)..(389): unsure at all n locations
  Clone ID: PAT_TA_49796
cggacgcgtgggcggacgcgtgnggcnacgcgtgggcggacgcatgggcggacgcgtgggcggacgcgtgggcgcggcgagggccatcggcggctgcccgatttatgtcagcgacaagccggggaaccacaacttcgacctcctcaagaagctggttctccccgacggctccgtgctccgcgcgcagctccccggcaggcccacgcgcgactgcctcttctccgacccggcgcgcgacggtgccagcctgctcaagatatggaacatgaacaagtgcgccggcgtggtggggggtgttcaactgccagggcgcgggggtggtgccgcatcgtcaaaaagacaaggatccacgacgaggcacccgggacgctcaccggctcggtgcgcgc

SEQ ID NO: 49797 - DNA, 495 bp, Triticum aestivum
  unsure (1)..(495): unsure at all n locations
  Clone ID: PAT_TA_49797
cccacgcgtccgcattgctcaagatagcctnggcanagagtattctcaactcccggctcagccttcccttcccttccctctcctgcctccgcccactccactcagtgctccagaagctcggatggcggcccagaaggtggtgctcagggtcccgaccatgaccgacgacaaggccaagcggagggccatcgaagcggtcgcggatatctacggcattgattccatagttgcggatctgaaggacaataagatgatcatcataggcgagatggacactgtggcaatcgcaaagaaattaaagaaggttgggaagattgacattgtgtccgttggacctgcaaaggaagaaaagaaagaagagaagaaagaagaaaagaaagaggagaaaaaagaggaaaagaaagaagagaagaaagaggagaagaaagaggagaaaaaatgataaagcataccacaccatnccatggcctntctcctctgtgcacttctaatagc

SEQ ID NO: 49798 - DNA, 358 bp, Triticum aestivum
  Clone ID: PAT_TA_49798
gagaagtaaggagaggaaggagaaagagagaggaaagaggagagggaggtgcagcgttgaccgatggctcgcgccatggtagcggcagacggccatttcgatgagatccaccacctgtcgaggctctcatgtgacccaggttgcgacgaagccgagttaggtggagagatctcgatgcgaggacggtacggcggtggatctcagccagcgtgtcttcagacgaacgagggtagcaccgcatgcaagctaggatgcggatctgtctcgcacaggcatggagctgacgctgcggactcacgagcgacctgcttaatcttcatgtcgatatgcatgagctgacttgtggcattgacgctgg

SEQ ID NO: 49799 - DNA, 212 bp, Triticum aestivum
  Clone ID: PAT_TA_49799
ggatggagtcctctcctacatccagaaaaacattaaaaaatcttcacttccatctaaaaaaagtaaaaagaaaaaaaattaccaacgcagcgtaccagcaagggccactttgcgtagccgttcatttaaaaaatatgtggggtcatcacctccacctaaaaagggagaaaacatttaaaaaaatcatcacctccatctaaaaataatatccg

SEQ ID NO: 49800 - DNA, 340 bp, Triticum aestivum
  unsure (1)..(340): unsure at all n locations
  Clone ID: PAT_TA_49800
ccccctctctcgctcgcatcacagcagacgcgcgctctcctcgcccagcttccggaactcgccccccgtccccgtcgccaccggcatggcctccgccgtctccctcgccgcctcctcctcgcccctcgccgccacctcgccctcgcgcgcgccgcgcccccaccaggcgctcccgcccgcgcgcggcccgcggtcccaggcccaggccctccgcgcggtctccggccccgacgcaagcccgcggccagccgtnacgcgtacagcccaaggtacacgccagaggaagggtctgagtctgatcaccgatactccggcggaaccaacgggcccttatttgggc

SEQ ID NO: 49801 - DNA, 556 bp, Triticum aestivum
  Clone ID: PAT_TA_49801
ggagaacgcacaccatattcttcttgattagttcagcgatcgaagccagccatggcttccgggatcgccagcatgtcctcctctcttgcggtgctcctcctcggcgtgctgctgctctcccgcagcagcgtcggcaacgcggcgcggcacctggacgtgccgccaccgttgcctgtaccggaggtgctgccgaagccggggctgccaccgctgcccacacctgaggagcagcccaatccggagctgccgccgttgcccacaccggacgtgttgccagagccgccgttgcccgcacccgacgtgctgccgaagccggggctgcccacacctaacgtgcagcccaaaccggagttgccgccgttgcccaaaccggaggtgcccaaacctgacgtggaaccgaagccagagctgccacccgtgcccaagggtgaggagccaccgaagacggagctgccgccgccgccaacaggtgggatcccaccaaagccggtttcgccgcctcttcctacaggtgagcttccgcccaagccggagcccgagcgggtgcccaagacag

SEQ ID NO: 49802 - DNA, 469 bp, Triticum aestivum
  unsure (1)..(469): unsure at all n locations
  Clone ID: PAT_TA_49802
ctacgtatggccggtactggacaatntggaanctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagcgggggggctgcgaggagtccggcaaggcctaaacagctcactcaccacgggccacatataaagtgccattgcggttttgtcaactctgacattgctttgggttttccttttccatttatctttcttgtttgttcctaagataagaatatgtgtatgtccatgttcccgacatgactcgagaaagcatgctcgtatgtgaatgctaccgatggctatgtatatgcacatgcacataatattataagtacaatctgtcgactatgtatttgggtaattaatgagaaacatcttt

SEQ ID NO: 49803 - DNA, 542 bp, Triticum aestivum
  Clone ID: PAT_TA_49803
gtggctccgtcccaagcgcgaccaaaagcttcaggaggcggcggcggccggtggcgcagtccagcaggcattagttaatcatggtgttcagcaaggtggaagtgaacctgaaaaggctgcttgaggcggccccccgccagcagaatcaggctaagcttgtccattacataaccacagccagggagctgttggagcagcttggagctgaaattacaccagaaggaatatcaagtgtttcaaaagctaagctcagtgagtattcagaaaagattgaagcactagctgccacgcttgcttctctagtgccagaaaatgaaaatctggttgatgagagtagagagcaagacaactcttatgaaagagaaaaggttgggagtccaatatccttatcatcaggattgcggaggagatcgacggctcagatggaggttggaccaagcagtcatgaaagaaaagaaaaagacactggagcacctattaaattggatgcagaagctcaggctcatattgagaagcataggaagctgcaagaagatctaact

SEQ ID NO: 49804 - DNA, 490 bp, Triticum aestivum
  Clone ID: PAT_TA_49804
atccaaatctcatcgccaagcaatcatcactctagccctttgccctccccacccgcagcagcatggcgagcccgcagtgctgcgcgaacccaccggcgctcaaccccgccgccggcgagggcaaggtcgtggacagcttcggcgggatcaaggcgtacgtcgccggcgcccaggactccaaggccgccgtcgtcctcatctccgacgtctacggttttgaagcgccgaatctgaggaagatagccgataaagttgcttcgtctggatattttgttgtcgtgccagatttcttacatggggatccatttgtacctgaaaacgctgaccgaccaatagcagtgtggataaaggagcataccccgggaaaagcatttgaagaggcaaaacctgttattgctgctctaaaggaacaaggagcgtctagtgttggggctgcaggttattgctggggtgcaaaggttgttgcagagctagggaaagctaatgagat

SEQ ID NO: 49805 - DNA, 507 bp, Triticum aestivum
  Clone ID: PAT_TA_49805
gagcgcgtccggtactgtgaaaacgataagggtcggaccagccaagccggcagccacgagccaatccatgtcgatccccagcgccgaggagctcgtatgctgtcactaggcgtctgccaccgcctcgcatgctgatgccagggcgcggactcctggtcgaccctaagttgccgatcagcacctcacacagataccccgagcggccgccctccatgcatcgaagccacggtgccgcctgccgtccaggaggctgtgcaaggacgtgctatactacagactgaccacatcaggcgcacaaaacctgaccgactcgagctctgaacatgggcagactgctcggtggagctgcactgcggcaagcaccatacaggagtacgtggacagtgtcaacaggcaatgatgcatcagtcagctgtactgtcacactgttaaggacctgatgaaggatgcctacaacaacggcaacccgctgaccaagtacaacgacgcggtcgaggtctggaacca

SEQ ID NO: 49806 - DNA, 208 bp, Triticum aestivum
  unsure (1)..(208): unsure at all n locations
  Clone ID: PAT_TA_49806
cccgggtcgcgcccgcgtccgcccatgcgtccggtcgcatttgttntttgtcttnggacaaacccccaacaacccctcttcgaagccgncatcatcctcacctccagcgcgacttcctcttctccaccacttgacccagctcatcagcaaggcgcgtgcacgggacgatgatgggaagcaacaacccttgcgcggcgggggggggggg

SEQ ID NO: 49807 - DNA, 499 bp, Triticum aestivum
  Clone ID: PAT_TA_49807
cccacgcgtccgcccacgcgtccggctgcgacatggccgtccttcctttcaggctgcggctgcgcacggcggccatttccggcttgagcccctcgacctctgtcgtctgtcctagcaggcagcacagagacggcggctccttctcctgccgtgccgcggcggcagccggcggaccgatcatcgtctccggggatccgcccacgttcgtctccgcccccggccgccgcattgtcgctgttggggacctccatggtgatctccaccaaacgagagctgctctggtgatggccggtgtcctgagcgcggaatcagattgtcatgtgtggacaggcgggcagacggttctggttcaagttggggatatccttgaccgcggagaagatgaaatcgcaatactgtccctgttgagttcactcaatgtgcaagcaaaatctcaaggcggtgctgtgtttcaggtaaacggaaatcatgaaacaatgaatgtggaaggcgatttccg

SEQ ID NO: 49808 - DNA, 499 bp, Triticum aestivum
  Clone ID: PAT_TA_49808
caacagctaggaagatggaagagcggggacgcgcggccgtcggcaccaacagccggagctcctccgttgcatcgcaggaggcggcatagttgcaaagcagcgcccattgaggggagccatggtgagcaccaccacagcagcgggggaaccgggaggtgctgccggcgatacgaaacggcgctcgttgacgaacgccggtgctgcaacgcaccaacgcgtcgatggccgccatactcgagcgacggcgggggagctgcaatggagcgctcgacgccgacggcggagctgcaatggagatgctcgacgcaggcgcggagctgcaatggagcgctcgacaccgacggcggagctgcattggagcgctcgacgcaggcggcggagctgcaatggggctgcaagtcgtcggctacggagctgcaatggagcgcgtcgggtcccggtgctgcatcgctgcgcttgcggctggcttggtgcagcgtcgccggcgcctctttggggg

SEQ ID NO: 49809 - DNA, 460 bp, Triticum aestivum
  unsure (1)..(460): unsure at all n locations
  Clone ID: PAT_TA_49809
acctgtccctaccttacccccatgtcactgatgaccaccgtgctccctccccacatccgccactttgtcgccctcggcgtttccgccgcgctcgtggaggaatttgggaattgaggatcctctgtttcgttgttttagaagacgacgcggaggccgggtttttctttttggggcgggggaggtggatgagtcctcgccgtcgtcgcagctgtcctcgccctcatctctttcctctgactccattgacctcaacttcctgccgttcctgaggagggagcccaagtcggagccggcttcccctgagcatggccctctgccgccaccgctgccgctgccgncgcaggccacggctgctgttgcggcggcgttcgcggcaccgacaacgcctgacctgtcttcgcctgaggtcctgccggctctgcagttgctgccaccaaaccccgacgaggacgcgctcttc

SEQ ID NO: 49810 - DNA, 510 bp, Triticum aestivum
  unsure (1)..(510): unsure at all n locations
  Clone ID: PAT_TA_49810
tagctgtctgtacaccagtcagaggcgagtgggagagaagaagcagcagaagcaaggaactgtgcctagtaaccggtttggtgtgatcttggagtgggagggagttgttgtggaagatgatgaccctgacctggagccccgagtgtggtacgtactatcacttgaagaggcaaagggggggggtcatgatgaaatgctgaaggaaatcgagggaatgagaactgatcaggctatctcagaagtcttatgttggtcgacagatgcaaaagaaattgaaaggttagcagcacgcaaggaggtaatatatcagaaactccgaggcactttctaccagctgcgaccaggtgttctcgactgtttgaacgcccttgtggattctgacattccaatagcagtaacagcttcttcgccaagaatgagcctggaagaaggcattaaagctgttggtcttcagggttattcgatgtccnagtggccggggaggattccngcnagggaaccccngggcga

SEQ ID NO: 49811 - DNA, 446 bp, Triticum aestivum
  Clone ID: PAT_TA_49811
gcgcccacgcgtccgcccacgcgtccggcatcagtagggagggagggagggagggagggagggatggaatggaatggacctggtcccattctccagactttgtcttgcgtgcccttctctgaattctgcgcttgaaaaggtctccagagctcacatggcccctctcgttccatttcctcttgacggcctgcctctctcttgtggttgtggccttgtgggttccggcgggctgagctggccactcgagacaagcacgaggagataggtcccagagatggagcctctgcctctctcttgcagttgctcccatggccatgggctacgatttccatgcccgtatctctgaggtggattaaccggtagcggcccatggaggaggaatcccactgcccgctccggtgggagagcacgggcgaccagtggtggtacgccacgccgatcgactg

SEQ ID NO: 49812 - DNA, 363 bp, Triticum aestivum
  unsure (1)..(363): unsure at all n locations
  Clone ID: PAT_TA_49812
gtccgccctccctcctaacccagccccagccccatggcgtcaccgccgcgccgccgccacctcgtcgcccgccgcgccgcgtacgcgtacgtagacgagccgctccggggcgaggggctcgcggccggttgccagactgcgagatcgcttattgtcgaagtttactcctacgcgcgagtatttagacanacactggagaagattgtagagaaacacaggaagaggggtaggaaatagaccttgacatgnaaagtaactataaacttgaagcactcaaattttntgttggagaacatcagcttngntgaaggtagatggctcaatagtgaatgaatgtaatatatatcctgcactgaatgttat

SEQ ID NO: 49813 - DNA, 487 bp, Triticum aestivum
  Clone ID: PAT_TA_49813
tgcagctctaaaatctctcctgtactccaccaccgctgctcccctccccagagccgccgccgcgcggtagctccgcgccaccgccgacgccccgcgcccccgcagcctctccgccgtcgctgccgtcgccgcgcctcatcgcgacgtcgcgtccctgctctctccaccccgtcagcgatctcgggcgttggttttcgaggtattgtggagagctcttcaatttcatccggctctgttcttctgagcaaagggtgagaagaatctttcgccggattgtccccaaagatgccaggaatcatagtggatggagttgtcacagaggagattcagcatgaggtgggttcctctcaaaacaaggagaatttgacggccccaaccatggcgccaagcatgcagagtgaggcacttgagatgcacgttgagaattctggtgccggggagccctcgattgagcagctctacaacaacgtgtgtgagatggagagct

SEQ ID NO: 49814 - DNA, 177 bp, Triticum aestivum
  Clone ID: PAT_TA_49814
cacacgcagtacgaagaaaagagcgagagtgataactgagcagaggtctggcgcgctcaggagatggcagagtcgtcctaggatgaagacagccctcaggcgatgcgatgagtgcgtccaggcgctgtgtagttggcctgcggcagctgaccatgggggcttatgctgcaaccacgc

SEQ ID NO: 49815 - DNA, 529 bp, Triticum aestivum
  unsure (1)..(529): unsure at all n locations
  Clone ID: PAT_TA_49815
aagagatattcttaattcaagaggtatggcggggggcttatgtcaccacaaacagatactaaagcaggtgttgcatttaaagctggtgttaaagattataaatcgacttactacacctcacagtatgaaactaacgatactgatatcttggcagcattcccagtaagtcctcaccctggggtggcgtccgaagaagcaggggctgcagtagctgccgaatcttctactggtacatggacaactgtttggactgatggacttaccagtcttgatcgttacaaaggacgatgctatcacatctagcctgttgctggggaagacagccaatggatctgttatgtagcttatccattagacctatttgaagagggttccgttactaacatgtttacttccattgtaggtaacgtatttggtttcaaagccctacgtgctctacgtgtggaggatctaccaattccccctacttattcaaaaactntccaaggcccggctcatggtatccaagttgaaagagataagttgaaca

SEQ ID NO: 49816 - DNA, 459 bp, Triticum aestivum
  Clone ID: PAT_TA_49816
caatagatactgctcgctagctaatacaccagcgatgcaattgggagaattagtctaccagcgccagaggccgcaccgatggaagcacagaccgaacctacagcaggtgacggatgtaaagatatggacaaagactataaacgagactgactacaaccgacagcatgaaactaaggatactcgaaatgtatcacaaaatgaggagaagcaccataagcacaaggagcacctcgaagagacaggcgctgcagtagctggagaatcttctattgacacaaagaacgatgcgaagaactgactggacagcaccaggcacagagcacatgcacagagacggaggtatgcacatcgagccatgcgctggggaagacagtcaatggatctggtatgcagcttatacattagacctaactgaagaggcttcgagtactaacatgattactagcattagcggtaacg

SEQ ID NO: 49817 - DNA, 229 bp, Triticum aestivum
  unsure (1)..(229): unsure at all n locations
  Clone ID: PAT_TA_49817
gactcactcggccggctcacagcctgcggaggactgctggctcatccaccaataagatgagcgtgctcctctcgctccgaaggctctgctgtaccttgtctagctcgagcatgtggcctgatggtggtgacatacaaaacagcgagaagatgaagacccagatcattgcacggctgttatacccagggtgttgagaaagtaggncttaggagccaactacacaagctcg

SEQ ID NO: 49818 - DNA, 469 bp, Triticum aestivum
  Clone ID: PAT_TA_49818
gagaaacacagggcaagaagagaagagagaagctaagcttgagatggcgcaaaccatgtcgtccatgaccggcctgtcgtagggcgctgcgtctcccaggcccgaccggcatgcgcgccagcaggttcaccgtgagggcgtcgtcggcggaggcggtggccgacggtcgtcgcgcggtccttggtctcatggccagcggagtcgttggcagcgcgttccgctcaggtggtgcacgccggcaccgtcgcggtcatcaaggttggcccaccgccgacgctctacggtggacttccatgcacggacaactatgacgaggcaagggacttcgacctgcccatgtagatccgactgtacctgcatatgctgtcaccgtcagaggcggcagtacgtgccatggagtgcatccaggacattctgaatctctagtctatcattgtcatgtatcaatggccatacgtcatcaacgacc

SEQ ID NO: 49819 - DNA, 555 bp, Triticum aestivum
  unsure (1)..(555): unsure at all n locations
  Clone ID: PAT_TA_49819
ggagcatcggcgccgccgccgacctcaatcggctccgtcggcggcagccaccctcgaatcgagcttgttggcggcggtgtctgatcggaaggagaggggaacaacctgtcatccccctctgcaccgtgtcaccggccaggtaatggtctccctcctccctccctcccgcgcccgcccatccccgcctccctcagctgcccctccggatccctccctccctccggcccctctccacgacgccgccgcgcctgtctgccgcttctccttcggatcccgcgcctccgtcgtcctgatccgcgcgcctccgcctccttcacccacccaccgccgacggcgacgccctccgctgctccactcagggctcccgcgcccttcatccgcgcgagggcgggtccgctcttccccggcatcagcagatcttcaccagcgacagcgagttgctgaagttcaaattgggcaatggatctggacacagagaatcgtctagcttcattactccttgaagaagcacggagattacagntagaggctgacagggaaggtgttcatgcatat

SEQ ID NO: 49820 - DNA, 524 bp, Triticum aestivum
  Clone ID: PAT_TA_49820
cccactgcgtccgtccacgcgtacgtaggaccacacgcgtgcgcggacgcgtgggcgctcgcccgcccgctccgtcgctgctttctagatgctcaggagctccgtcgtcgtaggcgcgagggtgtgcatcaagagccactagcactaagggcgtactgcaagcgttggcaggatcaggtgcatggagggcgacagcatgaagatctgctactgtactaggctgtagctgacggccaggagtcgatcacatacattgcgtagaactagagttctagcgtgcgaatgaataacaagtgtgaatctgatcagcaggtgtgtgctatcagagggcattaagatggtcgagaccgtggcctacttgccagcgttgagtacgtaggcccttctcaagcaggtcgactacctgattcgatcctagtgggtgccttggctcgagttcagcaaggttgtgaatatcttccgtgagcacaacggatacgctgggtactacgatggccggtactggacaatgtgtaagctgccta

SEQ ID NO: 49821 - DNA, 489 bp, Triticum aestivum
  unsure (1)..(489): unsure at all n locations
  Clone ID: PAT_TA_49821
cagctgtcctactgtcgcatacacacggaagtgctagctagctaatcgatcagccggcggccatggcggaggagaagcaccaccaccacctgttccaccacaaggagggcgaggacttccagcccgccgctgacggaggcgtccacacgtactggtactcctaccgagacggtggtgaccgccaccggcaacgagggggagtacgagcggatcaccaaggaggagaagcaccacaagcacaaggagcacctcggcgagatgggcgcctccgccgccggagccttcgccctctacgagaagcacgaggcgaagaaggacccggagcacgcgcacaagcacaagatcgaggaggaggtggccgncgctgcagccgtcggcgccggcggcttcgtcttccacgagcaccacgagaagaagcaggaccacaaggaggccaaggaggccagcggcgagaagaagcaccaccacttcggctagatcaccggtgac

SEQ ID NO: 49822 - DNA, 376 bp, Triticum aestivum
  Clone ID: PAT_TA_49822
acgccgtccggcgttgataccacacccacaacaccatggacgacagctgagcggacagagacacctgcatttcctgctactgccggctgattcatccgttcctccacttgaagcctctactgaccctccagactcccaccgggggcacgcccatggcgaggagctagtatgcctttcctaactccgccttatgggggggggggaccataccatatcagacgagctaggcacccacgaccagcaaggcactaatttccactaagccgtacgccgacaggagcagccaatgcagtgcgcatccctaactcttgacgtcggacacactaacaactacccgatacccgatgactggcctagcaccttctgcgaccaacta

SEQ ID NO: 49823 - DNA, 454 bp, Triticum aestivum
  unsure (1)..(454): unsure at all n locations
  Clone ID: PAT_TA_49823
cgacgcctcctccctgttgccacgaggggnccganggcctactcctccacccctctgcctcgccccgccgcctcctcgccgcacgacggcctcgcctcgctagcaaccccgccggtcttacctagataaactctgccgctgccatccccatgtcccagcgcagacctagacgggagcgggaggggcatgctggacacgatgcgggagcgggcatatcatagcggaccgagatccagtgcgtctacatgcccgccgtcatcgttggcccccgtgcttggctcccacactcgctccgggtaggtgctcgcagctcgcctactgctcggctgctccagttaaagcacaacgtgaggctgcagcagaagcttgaggaatgcaggggctaataatagtactcatcaaccaaaaataccnggcgttgtcaaccatgctttgaacttttggagatcaagct

SEQ ID NO: 49824 - DNA, 425 bp, Triticum aestivum
  Clone ID: PAT_TA_49824
atcagggaggggatccacccatggaatggatgatcaacacgctttaggccgggcacgggtcaattaactaagtggcatgcgcgtcacgttctcgcctccctcccctcccatcccatgattaggatttaggatgatgcttatagcgaggtagtggtacaagtagaggctcccggggtcgctgggggtggtggtaggcagctggagactgcggaattgttggcgggcgcgctcccgtgtccgagaggaaccccttttctcttggcattatccgctgaggagtctgagataattggaggtcactactagattgattgatcgataaggctaggtgtgcgtgccgggcggccatgggttcttgcgtgtcgaccacgaggcggcgccggaggtcctccaggaagctgtcggccacggcgaccaggttcccg

SEQ ID NO: 49825 - DNA, 477 bp, Triticum aestivum
  Clone ID: PAT_TA_49825
cccacgcgtccgcccacgcgtccgagaacccaaaaccctacgccccagccactcaccggagatggccggcggcgatattctcctccgcacccacggcggcctccccgtcctcgccagggcctccccttgcagcctccgcctccgttttacagccagcggccgtcgcgccccttcctccctggccgccgccaaggtcgacatcggcgacgtcgtcagccagctcaggtcgggaagcgcccgcggcgcggccgacacgaagaggcagcggagggtctcggagggcggacttgcgtttcctagggttgtcacgagcaggataaggggtgccgaggaggaagggaaaggggaggctccgcaattgaacgcggagaagattggtggcgaggcgggaggcgtggatggctcctacctcagcgagacacggtttgatcagggtgctatttctgaattatcactgaaaggtgtcaaagatgctgg

SEQ ID NO: 49826 - DNA, 552 bp, Triticum aestivum
  Clone ID: PAT_TA_49826
acccatcccggcatggtcaagctcctcgccgacctcctccacgacgtcccgcccgcccgccgccgcccacggctcctcgctcctcctgctcctgcttccccacaccgtctccccgctctggctctccctccccgcgcttccctcccaatgcccacgccgaccgtctcgccatcttccccgcacgccgcatcactccgaaccagtatgcggcttcccacatatcgttcccccttgtcaggtttcgtcagctcacccttgcccgtgtcctgttcgatgaaatgccgcagtctggtgttcgcctggacgagtatgtttacacggctggggttcaggattacaaagcggcagggaatctcacggcgcggagaggctcctggcgaggattgggggtcaaggccagcatggtgtcgtatgtactgctgtgtggattgtgcaagaatcaacgcattcaggaggcagcggagccgcggaggtaaaggataacggggtggtgactggtgaggagttgcagctgatgaagtgacttaccgggagctgctgatgggtttttgg

SEQ ID NO: 49827 - DNA, 176 bp, Triticum aestivum
  Clone ID: PAT_TA_49827
ggtgcgcaccaccctcgtgctgccgctgcctcaactagtatagctcgctagctaacccacgaacgagctctggggattcatggagtcgctggtctccggctcgagctcgctctctagctagtggttcgttgtgctgtgcgaggacgggagggagggaggaggaagaaggggtgtga

SEQ ID NO: 49828 - DNA, 297 bp, Triticum aestivum
  unsure (1)..(297): unsure at all n locations
  Clone ID: PAT_TA_49828
tgcacaggatgcagcccatcgagcgggcggaagggagctncgtaggcgagtcgacgaggcactagctgcggactcgctgaggctagggcacgtgtacataggggagcgagaagaaggatcgaggagatgagcggcggcggcggaggagcggcggcgacgcaggggcagcaggatctgcgggtggcgccggggttccggttccacccgacggacgaggagctggtgatgcactacctctgccggcggagcgccggcctgcccatctncgtgcccataataggcgaggtcaatctctac

SEQ ID NO: 49829 - DNA, 553 bp, Triticum aestivum
  unsure (1)..(553): unsure at all n locations
  Clone ID: PAT_TA_49829
ctccggatctaccgagaaaatgtgaagcgggcggaagacaagcgcccctcacgctccttcaagatgcagatcttcgtgaagaccctcaccggcaagaccatcacccttgaggtcgagtagtctgacacgatcgacagtgtgaaggccaagatccacgacatggagggaatccccgcggaccagcagcgcctcatctttgccggcaagcagctcgaggatggccgcaccctggctgactacaacatccagaaggagtgcaccctccacctggtgctccgccttcgtggaggcatgcagatctatgtcaagaccctcactggcaagaccatcacgctggaggtggagtcctcggacaccatcgacaatgtgaaggccaagatccaggacaaggagggcatccacgcggaccagcagcgcctaatctgtgccggcatgcatctggaggatggcctgactctggctgactataacatncagaaagagtctaccctncacctggtgctcaggctccgtggaggcatgcagattntcgtcaagaccctcaccggcaaga

SEQ ID NO: 49830 - DNA, 533 bp, Triticum aestivum
  Clone ID: PAT_TA_49830
gctacgcaaccgtagtcgcgccccgtgcccgctcctccaccatcgtcgccagcctcggcacccccgcgccctccaactcctcctccttccgccccaagctcatcaggaacacccccgtccaggccgcccccgtcgcacccgcattgatggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtcccctcctactgcaagaacaagtacgccggtgttggatcggccatcgaatacgccgtctgtgctctcaaggttgaggtcatcgtggtgattggccacagccgctgcgggggaatcaaggctctgctctcactcaaggatggcgcagacgactccttccacttcgtcgaggactgg

SEQ ID NO: 49831 - DNA, 563 bp, Triticum aestivum
  unsure (1)..(563): unsure at all n locations
  Clone ID: PAT_TA_49831
ctttcttcctccttgtcttcgtatcaatctccagctaaggctccgatgaaggaccgcgccggcttccacttctccatcggctgcatgtcgcagtccgccgtcgccgtcgccgacccgctccgcaagaagccaccagcaccggcgccgcagcagcaggccgataacccctcctcctcctccatcaccacacaggacagagcaccccgagaggaagggaccggcggtgatgagaaggcaaaagaagggatcgtcgcagcaggggtgcagcggctgctcaaggggatcaagaccttcttcgcggcgtacgacggcgaggaagaagaagaggaggaggagcgggagatcgtgatcgggtaccccacggacgtgcagcacgtcgggcacatcggctgggacggtctcaacaaggtgggcggcatgggcatggtcggcgccttctctgtgccctnctccctccctctccgccagctcgagatcgccatggaccccggcgccgcaaccaccacctgcaccaactgatccctaattctccattggcgcataggagacctcaagctcaagca

SEQ ID NO: 49832 - DNA, 259 bp, Triticum aestivum
  unsure (1)..(259): unsure at all n locations
  Clone ID: PAT_TA_49832
caaccacntacgcacatacataaggatggtgaactgtatacaagtgctaagaaaacacttagtcgcccgtctggcgacaaactctttttttctngagggggggggtgccgacgataacactggcactatcataaacctctgactaagtggtgatgacgatacaccggacaggaagcataagcagctgaagaagcaccattcagtggtgatagtgcacctcttcaccagagacatcattattactaaggagctccaagag

SEQ ID NO: 49833 - DNA, 548 bp, Triticum aestivum
  Clone ID: PAT_TA_49833
cggcggcggcggcgagcgtgcgacctacgaccaccagacgacccactgacccacaccaccggagagctctcccttttacgttaatcaatcgaacccagttaaagaacctcttaattgcccgccaggagatctgccaggcttatcttctccgtctcctccgacctcaccttcccctctcgccccgcggcttctgggctccttggcgccaaaatcctcgcttccgatcccaggccttcaggaaccaggggggctttcattgaagttcacgatggggggctgtgtgggcaagggtcgtagcattgtggaagaaaagcttgatttcaaaggtggaaatgtgcatgtcataacaaccaaagaggactgggaccagaagattgaagaagcaaacaaggatgggaaaattgttgtagcaaacttcagtgcttcgtggtgtgggccatgccgtgtcattgcacctgtttatgctgagatgtccaagacttatcctcaactcatgttcttgacaattgatgttgatgacctaatggatttcagctcaacatgggaca

SEQ ID NO: 49834 - DNA, 587 bp, Triticum aestivum
  unsure (1)..(587): unsure at all n locations
  Clone ID: PAT_TA_49834
cccacgcgtccggctatccttctcctggactcctcgtcatggcaccactgaggggggccaagcgccggaagcggcacccggagaaagccctgccggcgggggtgatggcgcccttgcccccgcccgacgccgccgattggtgggactccttctcccgcaggcttgcagcaggacattactccaaagactgccaaaactttgagtcagtcttcaagatgtcgaggaagacattcgactacatttgcactcttattaccggggacttctcaagaaagacgcagggtttcagaaatttcaggtttggagacaagacgattcttgcgttggaggatcaagtagctgttgctctgttgagactgacgactggtgagtcacttctgagcatagggaatcgctttggaatgaaccactcagcaatctcaaacantcacttggaagttcatcgagtccttggaggatcacgcgatcagtcatctgaagtggcctgaccctgaggagatggcgaccatcaaagcanagttcgaaaagctccagggcctncccaactgctgcggcgccatagacacaacacacatnctcatgtgctc

SEQ ID NO: 49835 - DNA, 530 bp, Triticum aestivum
  unsure (1)..(530): unsure at all n locations
  Clone ID: PAT_TA_49835
cccactgtccgcccagcgtgcggggctcgtccgttaaatcccagaaaggcccagttagagcaacttcctcttatcctcctcgttgcttggctcgcctcgcctccgcagaacgctccgccctctctctccaatggaggccactgccacactcacgctctcttcgtctcccgccgggggggggcgtcgccnnccaggcccaccgtggcctcccttcacctccgccgcgtgcccactctctcattccacctccgcggggcccaaggtcccgctgccttccgcgccctctcttccccgttcccgggatgcaggaggaggaggagaagcgggatggttgtgagggcggagatgttcgggcagctcaccaccgggctggagtccgcgtggaacaagctgcgaggcgtcgatcgactgacaaaggagaatatcgctgaaccgatgcgggatattagaagagcacttttggaggcagatgtgagtgtgccagtagcaagaagttttatcgaggctgtaactgaaaaggctataggcac

SEQ ID NO: 49836 - DNA, 543 bp, Triticum aestivum
  Clone ID: PAT_TA_49836
cgtcctcgttcaccccctccctctcgatctcctcccacctcacctcctcctcgcctcttgccgacgtttcgtcaaggttccggcggcgatggcggcgaggctcgcgcagcggcggcgcctactacaaggaggcgatggagaagaacaagcagtacgtcgtgcagcctccctccgtggagaagtgccaggagctctccaagcagctcttctacacgcgcctcgcgagtctaccaggccgctatgaagcattgtggaaggaggttgacggtgtcaagcagctttggaagaacaggaaggagctcaaggtggaggaccttggaattgcaacactgtttggggttgagctttatgcatggttctgcgtaggcgagattgcaggcagaggattcaccttaaccggctataaggtctgaattagatgtcgaggcgcgccttataatatactcttagctgatgcttgtcgaaattacctgtcttggttacaattttgtttctgaaaagttccagtgctgaatgccagcaagacgagcacacaattgcaac

SEQ ID NO: 49837 - DNA, 495 bp, Triticum aestivum
  Clone ID: PAT_TA_49837
cggacgcgtgggcggacgcgtgggcgcgtgggcctcctcctcgctccctcctcctccctcgccctaaacccacctcgtcctcgcctatgccagactgtacaacaggaaattctgcaatcagatattcagtccaaggcggataaaagtcctgtgacagtagctgactatggatctcaagtattggtaagtctcgtgttaaatatggaagtaacttctggttcattttctatggtggccgaagaggactcagaagacttgagaaaggatagtgctgaagaaattctggaacatattactgatcttgtaaatgaaactctcgctgaggatggttcatacaacattactttatctaaggaaggtatcctctctgcaattgatactgggaagtctgaaggaggtccatctggccgacattgggttctggatccaattgatgggactaaaggtttcttgagaggaggccaatatgcaatcgcactggcactgcttgatgag

SEQ ID NO: 49838 - DNA, 466 bp, Triticum aestivum
  Clone ID: PAT_TA_49838
gggctcccacccgcgacgaccgtatcggtgtctgcaagtgggtgacctctaccggtatcgagaacattggcaagaagctggtgaactcgcgggacggaccagtgacctttgagcagccaaagatgacagtggagaagctgctagagtacgggcacatgctcgtccaggagcaggacaatgtcaagcgtgtgcagcttgctgacacctacatgagccaggcagctctgggtgatgctaaccaggatgcgatgaagactggtaccttctacggttagaacattctccatacacacccaccaagaacttcgacccaacggcgaggagtgacgacggcagctgcctttacaccttttaagcatgccaatttaatatctgatgttttatcctttgtacctaagtaccgcatcgcatccaagcgattgctgggcatgttttgtaatatataaagatattgagtatacctatt

SEQ ID NO: 49839 - DNA, 269 bp, Triticum aestivum
  Clone ID: PAT_TA_49839
cagcgctccctctccgttcccccgaactcttcgctcccgttccgcgctgtccgtcacacacaggatggcgtccgccatggagctctccctcctcaaccccgcaatgcaccaccacggcatcgcggccaagacggcctcccccctcccggttctccccgcgcgccggggcgccgtccgcttccgcgtgagggccgccgacgcggcgccgcccgcacccgccgcgaagcccggctcgcccaagaagcggggcaagacggaggtcaacgaag

SEQ ID NO: 49840 - DNA, 275 bp, Triticum aestivum
  Clone ID: PAT_TA_49840
gccacgcgtacaggcaattgaaatcttaagtcatgtttgagggcctgatgctggaactggagcttgcccaatgcgctctatcaagcatggtgaacgtgcttgtgaacttgctcttacggcacctctccagactctcatgcaaaatggattgatacatagggtggatctgagggtgaatagcggactcaagagtcgtctagatgttctcatggctgctgacatgggtgcttatgaatatggctctgggactgctactatgatagctactggacgcg

SEQ ID NO: 49841 - DNA, 329 bp, Triticum aestivum
  unsure (1)..(329): unsure at all n locations
  Clone ID: PAT_TA_49841
cttagccacagccatagccatagccactcctcctccttgctttctgtgccctccaacaatatatcttctcccggaaggcagtggttcctctgtcttctagctagccaagctcagagctgcctgcctcgacgcttcgtctgctagctagctcaggctcggagtgtttaacaaaggagggttaggaggagcagtgggattcggtagcggctgctaggtgtcgccgctgcgttgtatctagctntgtttcttactccttctcctcatcttcttcttcctcgcgtcgatatatcaatccatcttctcacctgatggggagggcgccgtgctgc

SEQ ID NO: 49842 - DNA, 296 bp, Triticum aestivum
  Clone ID: PAT_TA_49842
aatcgaatgacgaggactcctcttgagtgattgatgtccgaacaaatattggacatatatcatgcccaagcattcaggtaaactccattctcagtatctatgtatggcccaagcagttaattaaacttcattgtcaggatgtacatatggatggggctaacaggtacaactcctgtgtgctgacgaaatgacaagagtgattggccagggctatacgaccgtttttgatggtccacaacattcttgtgatctagcaacagaattcctagcacgatagatgctgggggtttgggttt

SEQ ID NO: 49843 - DNA, 414 bp, Triticum aestivum
  Clone ID: PAT_TA_49843
cccacgcgtccgcccacgcgtccggccatcagccatgggaggaggcgtcatgcgcaccgccgcgaaggtcggcctcgccgggggcgccgcggcggcggcgggccgcttccgcaacgtcgccccgtccttcgccacggcgcccgccgccgaggccgcgtcggcggcgccgctgctgtccgcggccggggagatccccgcggtggcgccggccgggtcgcagtgggcgtcctgggaggtggacgactgggagttcgcggactggaggtccgagtcggcgtccgaggcggacgtggcggtggtcggggggccgaggctggtcttcgccccgccgtcgcgggaggaggccgaggaggccaccgccgagctccgggaagctattgacagggtttattttaaagagactccagtagaagt

SEQ ID NO: 49844 - DNA, 305 bp, Triticum aestivum
  Clone ID: PAT_TA_49844
gcgactcgtccgattaaggttgatgcttaccacaagaagaagaggggctttcacggatggttgttgatggacacctacaccacatgaaccaacggagcttcggtctgactgggacgttgcgaccacattctctttaatacagatggtcggggttacaggagaattcgagagaaaggtagagtgctaccatgctactctatctggggattgctgacatcatgagctcgagactgctcgccttcgtgatattctggggaacatctgagccaacactggtgacccacccgctggatgggacacggatg

SEQ ID NO: 49845 - DNA, 319 bp, Triticum aestivum
  Clone ID: PAT_TA_49845
cccacgcgtacgcgaacgtattggctgtcacgtgagttacataggataggacggactcggtcgcggtggtggggtggattgcttcactaaggatgatcttaacctcctaactgaagacgctgttctgacccagctcaaggatgtatatgctgaggggaaagatctcgcactgacagttatgtgggccatggtggaagagcacatctgcgcggtctgggacgaaaggcccaggtaacttccttggagcgagggccaatgtacacagagggatccattgtgtgtccactttagctgaacaaagactaggtaaaggatgaat

SEQ ID NO: 49846 - DNA, 365 bp, Triticum aestivum
  Clone ID: PAT_TA_49846
ctccctcgtccgtccgcctccggcagatcctcctcctgctcctccataccgcccgaagctccgtcctcctcctcccgacacttcgagatctccgccccggacccgtttcttccccaccaaggcccagcgcagccgcccggccggccctccctgctgcagccgccgccgccgccatgtccaagtcgggagccctggatctcgcgtcgggccttggcgggaagatcgacaaggaacaagtcaaatccgcggtcgatgagtatgagaaatatcatggatattacggagggaaggaggaatcgaggaaatccaactacaccgatatggttaataaatactatgatcttgctactagcttctatgagtat

SEQ ID NO: 49847 - DNA, 273 bp, Triticum aestivum
  Clone ID: PAT_TA_49847
agcactgcctactgggcggaaattttatgcaaacctgctggatgctggaatgagctaagttggcggggaagaaagctctgtcacgggttctgaccacatccgcgaaaaggatggtgttggggctggcatagcttggctatctatactaggttacaagaacaacgacaacgttgcaagagataagatcgctacgggtgcagacattgcatttcatcactgggctacgtattggtcgccatattctacaccatctgactatgagaatgttgatgc

SEQ ID NO: 49848 - DNA, 235 bp, Triticum aestivum
  Clone ID: PAT_TA_49848
cctgcgcatgcgccataacgggtctggaagctcagcaaggatgaaagggcaatccacagttatcggtttaagcgcgacgggaccattgtgacctgtgtttactatatacgtgtacaatgtagatcaaggaaatgaatcagggctgggcgacatacaggtccatgcttaggaacgcgcacttgctgacgcttaactgcatttgagtgcaggcgtacatatcatcattggacatcgc

SEQ ID NO: 49849 - DNA, 412 bp, Triticum aestivum
  Clone ID: PAT_TA_49849
agcgcgcgcgcagccatggccaccgcaacctccttatccctccacgggcatggcctcggactccgttccccgaccgccaagacgccggggcggaggctgctccccgtgaccggcagggccatggcgccggtcagccccagcaaaggtgaagctgctgctgtggagtgctccccttccccgcggcggcaggtgctggtggcgggggctgccgtggccgccgcggcgctcgtctcccggcccggtccggcggcattcagaggcggcggacggcaagttcatgccggtcatcgaccggaaggccggatactacttcggatacccattccgatggcaagaggtgtatgtgcaagggcgtgacaaggtgtacaaggacgtgatcgagccgctggagagcgtcagcctccacatgatc

SEQ ID NO: 49850 - DNA, 372 bp, Triticum aestivum
  Clone ID: PAT_TA_49850
gaggcggagctcctcgtcctatccacgcggcctgtccaaatcggagctccccttcctgctctgctcttgtccttcttcagctgctttcagctcgcaccgctcaggacggcgcctgcgacctgtttgatggagacagtagcactggaagaagttcagaactgtgcggtgaagctgaggagcaatcctcaacggcgcaagaatcaagtatatgttggctgtggggctggatttgggggtgaccggccgatggctgctttgaagttattggagagagtcgaagaacttaactacatagtacttgagtgtttggcggagcgaacacttgcagaccgctaccaagttatgctggcaggagggaaaagatttgatccc

SEQ ID NO: 49851 - DNA, 303 bp, Triticum aestivum
  Clone ID: PAT_TA_49851
cccacgcgtccgcccacgcgttcggatgccaacacccctcccgccatgctgcccttctgctcctccgccgcgcccaccccatgctcccccctctgcccggtgaccgacggcgcgcgggcgctgtggaaggtcgaggccggcgctctcagaaccttagaacgggacccggtagctgcgcaggcggtgtcagaccgcccggaattaagcgaatgcgggatgcggtgctggaacgggaggtgaccggacgacagctgctgtgaagttatcggagacagtcgaataacttaactacataggacttga

SEQ ID NO: 49852 - DNA, 273 bp, Triticum aestivum
  Clone ID: PAT_TA_49852
tcaaccggacggcctaacaacggtggacaacgaagcgatgttatctgtcctcgtcgcccaaccccatgggcatctcctaagattgggctctccggctgaaaggaatcacatactattccgtagacgaagacttcgcctacaatagagacacgctgctctgctacaacctggtgaccaagatggcgccggtgctgatccacgacaggaagacgatcgtcgagtccaccattatcatggagtacatctactaggcgtggaaggacggctacccca

SEQ ID NO: 49853 - DNA, 240 bp, Triticum aestivum
  Clone ID: PAT_TA_49853
aagttggcaaagaagacggagggctggtcagtcactgagtctggcgaggcaagcttcgtgggattgaaaaggaaaaagaagaaacttgtggaacttgatccatctccagcctcaacaggtgatggtgaagacactcttgatgatcaagtgggagaggatgaacaaggagaggggattgttgctggtgggagcacccagtacccatggggagggactgatagagattaccaatatgatgag

SEQ ID NO: 49854 - DNA, 107 bp, Triticum aestivum
  Clone ID: PAT_TA_49854
cgcatagaccggcgtattgacacttggctatctattgcgcttgcgagctttggcttcggggcatggatacagacacgaactatacacgagcgcatcgaaccgcctgc

SEQ ID NO: 49855 - DNA, 265 bp, Triticum aestivum
  Clone ID: PAT_TA_49855
ggcttcaagaagatactggtccttccggtgcacttctcccaggtcctgaacccccactccgtcaggcagcctgagtgggaagggtcccccaatcttatccaaaagtccggcctcatctccaccctcatcaacacccctttctccaccgcggtccaaaagcccatgccccgccctgcccaacattccactgacttggcggtgtacccccgcggccccccccccccggtgcaacccccaaagcttctcaagttttgggacccccacc

SEQ ID NO: 49856 - DNA, 349 bp, Triticum aestivum
  Clone ID: PAT_TA_49856
acaaatgatacaacacacgctttcaccctcgtgtccggccatctcctccgacccatttggtgtcagttgggtccactctgtttcatgccaaagacaatgctagccgtgaaagagtgtgccaaggctggaagaacaaggagcactgcctttccgagaacaatccgtagttctgttgcctacctagggggcaacccgagcacatataggttggccaccgaaaccccacctgctttatttcggacgagggatggggaccaacctgacgagactaaattggtgatatgaaatttgtctgtctggcaaaacaagaattaggtgctgtggaacactacctagacgcccatttctt

SEQ ID NO: 49857 - DNA, 463 bp, Triticum aestivum
  Clone ID: PAT_TA_49857
ctctccgtatccaagcacactcctctgacactcagttgccactgcgagcacgaattgtatcttgtatcctgtgtatgatctggttagtgcatgcctcatcaacccataatccaatagttcgatttactgtcttgcaatttaatctgcagtatgttaatccaccctttcctagccacttccccttcatgtaagcacatactaatacttccatgtttgtttctgtccccaattgaccttgcttcctcctgatccatacaagggaaaatattttttcggttttgtttgcccaattactaagaaacgagttttctgaataacccactggttttaatactgcagtgctctaccttggagttgcacatttctgagcccttcgaggactcacagttctcacatgggggttttgtggcttgctctccctgtacataaaatctgatttaagagctctgcaaatctcactaca

SEQ ID NO: 49858 - DNA, 296 bp, Triticum aestivum
  Clone ID: PAT_TA_49858
cagcacagcacagcacagcggagaagaggaaggagagcagagatgactgcgtccgtctcctacgggctgcgagcacttccgacgtggtccagctctgtgtccggtgacgaccactgctcggacgccggcgaggatgggcaatgtaaacgagggcaagggcatcttcgcgcccctggtggtggtggtgcgcaacatcgtcggacgcaagcgcttcaaccagctcaggggcaaggccatcgcgctgcactcccaggtgattaccgagttctgtaagaccatcggcgctgaccccaagc

SEQ ID NO: 49859 - DNA, 354 bp, Triticum aestivum
  Clone ID: PAT_TA_49859
ggcagaggacggtgggctaggccttgctgccttgacggagttcaaccttcgcctatgggcttgggagacaggtccggagggtgttatggaatgggtgctgcgcaggaccattcagttggatgcattccttccaccgaatgtgtcatcagtgccgttggtaaataatcattctgccagtgggcgtccggtcaggatattgggtctcattgaggacgatgatatgttttttatgtggacgagagagggtgtctttgcagtggagctcaagtcaatgtggtgcaacaaagtttttgaggctcaagtccctgcaactatctttccctacactggcttttataccacaagtgatgtgga

SEQ ID NO: 49860 - DNA, 355 bp, Triticum aestivum
  Clone ID: PAT_TA_49860
gcaccgcgtccgttatccgtgataaaatagacaatagtcattcagcaataaataagcaacaaccatgtgacgtgcagtacataagaaggtgaactggatacatgtgctaataaaacactcagtcgcctgtatggcgacaaacgcaggcctacggaagcacgccgctgccgtatatgactcgggcactgtcataaacttctgactgactgataatgacgatgcaccggacaggaagcaaaagcagggtaagaagcaccaacgagtggtgctcgtgcacggctttgccggcgacggcattatgacgtgagtgctccaagatgagcgcccatctcaatcggggctacaaacattacgt

SEQ ID NO: 49861 - DNA, 445 bp, Triticum aestivum
  Clone ID: PAT_TA_49861
cgcgtccgccacgcctccccccgccgaagctccacgggatcgattctcctctcgcggccggccggccggattcctcctcctcctcggctccactggactggcgcgcggcggagacccgcccgcccagggatttgattccttttgccggtagtggaattggaacccctgcggtgctgtagttcgtgcggtgtcgtcgtcctggcggtacagtaataaatcaagatgggcgacggggtggcttttgaggctgccaggaagatcatcatgcacccgctctacgcgtcgaggtcctcgccttggctcgacctcaaggtgttctatgtgagggtcagcaactgcatggtggacgagtcggcgccggaccatctcacgctcaaccatatcccgctgtctcctgacacggtcatcgaggtcaacgggcggcggagcagcatgcacaccgagt

SEQ ID NO: 49862 - DNA, 323 bp, Triticum aestivum
  Clone ID: PAT_TA_49862
gctattaataggcctgagcgtttctgccgttgtgataatatcctcggcatgctttttggctatgcaattacaaaggaaaaagcacaagaaggagaaagacgagtatttcaaacaaaatggagggctcatgttatatgatgagatgaggtcaaggcaggttgacacggtccgcatactcacagaaaaggagatcaagatagccactgacaactacaacgaagatcgagtgcttggatgtggcggccatggaatggtctacaagggtactttggatgacctcaaagaggttgctataaagaagtccaaagtgatcaatgatgatt

SEQ ID NO: 49863 - DNA, 178 bp, Triticum aestivum
  Clone ID: PAT_TA_49863
ttcctcggttgtttcaaacggaagaaaactagaacagcgcgtaattaccatttctgccctccctctccctccccaactcgccgtcgcgacggcgacgcacgaagccgtcgcgccgtcatcgccgagggcgaagccactcgcggtcctagcaatcacgaagccaactgcgtgaatcgca

SEQ ID NO: 49864 - DNA, 296 bp, Triticum aestivum
  Clone ID: PAT_TA_49864
acgcgtccgcggacgcgtgggcggacgcgtgggcggcaaggcaaaatttcaccacgccggctcacctcgcaagctgcagagatgcttcttatcttgatcgccgtgctcgcttcggcgtggcccgcggcggcatcggcatcgcaaccaccgagcggaacatgccagcggcggtgcggcgacgtggacatcccgtacccgttcggcatcggccgcggctgctacctctacacgggcgagaacgacgtgaccttcgggctcacctgcaacctgaccgccgacggcacctacaggccctt

SEQ ID NO: 49865 - DNA, 233 bp, Triticum aestivum
  Clone ID: PAT_TA_49865
atcagaaatatgttgagaagaggattcataagacgctgaatgatgcgctggctgttgtcatggtttttgacgttatatctgaggttcagagggaaggcttgcctcgaggtttgcctagtgctattgtaaatctgcttgcagatcttgccgcagttcttggcaggattgaaagaaggagtgcttatttgcatgctctactggatgagcttctaggtctgcatctctgtatgcac

SEQ ID NO: 49866 - DNA, 196 bp, Triticum aestivum
  Clone ID: PAT_TA_49866
gtcagtctcttcttcttctctagcgagcgagcaagctaggcttggaggtgaccgaaaatgccggtgacatgatcgtcttgggtgccaccggaggtttacagaggtcccctgaaggtggcttgcgttcatttcctattatatattttcgcgacttgcgcttatgctgataaaatagcattgttattagtgatttttc

SEQ ID NO: 49867 - DNA, 339 bp, Triticum aestivum
  Clone ID: PAT_TA_49867
cccacgcgtccgcccacgcgtccgcccacgcgttcgagcaaaccttgcatctccgtgtagcgtcggcggtagatgcactccctcgccatgggcaagattaagatcggaatcaacggtttcggaatgatcgggaggctcgtctccagggtcttcctgcacagcgacgatgtcgagctcgtcgccgtgaacgaccccttcatcaccagcgaggacatgacctacatgttaaagtacgacaccgttcacgggcactggaagcacagggacatctagctgaaggactacaagactctgctctttggcgagaagccagataccgtctttggcgtcaagaaccct

SEQ ID NO: 49868 - DNA, 175 bp, Triticum aestivum
  Clone ID: PAT_TA_49868
agtagacacgatggacagccgtctcgagccatcatacatcctgtctagctagcaatcggcgatgggcgggcaggtgccgctgctgacgacgacggagcacaagatgatggcggccatctacgagagcgagtgcaggcactacacgctcgagtgggccctgctgcaacctcgcgcc

SEQ ID NO: 49869 - DNA, 138 bp, Triticum aestivum
  unsure (1)..(138): unsure at all n locations
  Clone ID: PAT_TA_49869
ggttttacancataaaaagtctaccacgcctatcgggctgtgatggaccatctgggcgtgagcgtgcactagtacacgggcaggccccactttccctccccctactgctacgaggaccacgacgtctcctccctcgtc

SEQ ID NO: 49870 - DNA, 263 bp, Triticum aestivum
  unsure (1)..(263): unsure at all n locations
  Clone ID: PAT_TA_49870
ccgcagccgctgctgctactgcttctcgtcacgctgctgagcgcctcagctgccccgtcgngccgacgcgtggtgcaaggagggccacattatggtctgcaagatcgccgagaggcacctgtctgaggacgcggccgctgtggttcaggagctgctgccggactctgccggcagagagctgtcgactatgtgcccgtgctctgacaccatgcgcttctcctaccactgggccaggccgctacactacgtcaacacgcccaacg

SEQ ID NO: 49871 - DNA, 224 bp, Triticum aestivum
  Clone ID: PAT_TA_49871
cgtccggtcctcaaccccgatgacgaggccgagacggagcacctcctggcgctcgccgggggcgacgaggcccgcgtccgcttcttcccgtgcgacctcctcgacggcgccgccatgctcgccgccgcgcgcggttgctccggcgtcttccacctcgcctcgccttgaacggtcgaccgggtcctcgacccgcataaggagctggtggtgccggccgtggaggg

SEQ ID NO: 49872 - DNA, 286 bp, Triticum aestivum
  Clone ID: PAT_TA_49872
accattccccccctaccctcttccccaccctctctcccgcacccagacctagccaccaccaatgtgagcggcgccgccgccgccccgtcgccggacgaggtccccctccgcctgccgcccgatggcccagtacgcctactgcgcgcctccatggtccgcaagacctggagccacaccgtctcgcagccgggattccgacgccgcctccgcgagctccacccggcacccctcgcgctcgggttcctccacaaccgggccgacgagcgcagcccctgcttcatcccca

SEQ ID NO: 49873 - DNA, 270 bp, Triticum aestivum
  Clone ID: PAT_TA_49873
ggcatcggtaagtcagaaacgcaacaattgatcatgggtaagacaagaataacgccaccgggggggagtgttcttaaacatggtgcatggttatccacctgatggaggatacagataccctcctcaaggttacccgccaccgggggttccctacccttcttccggggcgtattcttcttcaccacactatgggtaccgttagcccggctgctacccacctcacggaggatatccgggggttggctaccctggatactgtttctggtcacg

SEQ ID NO: 49874 - DNA, 158 bp, Triticum aestivum
  Clone ID: PAT_TA_49874
ctacaccgtagtgcggacagcttagaagagttatctaatttaccgcttcatgcagctgcgcccaggtctggcgacgacggcttagaagccgaagacgacgatatgctgctatgatgatacgatgtcgaactacaatgcggggtttattgtcctgtcca

SEQ ID NO: 49875 - DNA, 437 bp, Triticum aestivum
  unsure (1)..(437): unsure at all n locations
  Clone ID: PAT_TA_49875
cctttctcgagattcctgaggagctacttctgtcgcaatagtgactatcaaatactgtcagacaccttattagttgtgctgtccacgagtgcatataagaaactatagtaaagactatcctttattgtgctgtcaacattggtatgtgagagctgattgctgttgacacttttaactctttctctgtccataagatgctgagtttttttaatctatttatagaagttacttgatttccactttgcagggccgacttaaaattgcagactttggatgggcggttcgatcaaatgctaaacgtcacacactctgtggcacaatagattacctggcaccagagatggtagagaaaaaggctcacgattacgctgttgacaactggactttatgaattctgngctacgagttttttgtatggctcggccaccccttgaagc

SEQ ID NO: 49876 - DNA, 265 bp, Triticum aestivum
  Clone ID: PAT_TA_49876
gacacttctcaactccatagtagtcgggagaaggttatataggcacataaaggtgctcgagaagatgcaggatgcagaggtgaatgtccagaccatctattgctttaataccttcccgaccatgacactagaggtcctgatgaacctgttccatcgcatggaccgcatgatcctgcacggcccccacttgaaccacatgatgtggggcgccgccagattcatagtggtccatacactactgattggactgagggacttaacatgg

SEQ ID NO: 49877 - DNA, 196 bp, Triticum aestivum
  Clone ID: PAT_TA_49877
gctcttctttccatcccatggttatagcggaacacaaacatcatgcgcgaggtgatccattacaaggcggctattcagactttctattgcttccaacactcccagggcaagacagtagagatcttgcccaccatgtgctttctccacgacggccaaatcttgctcttcttccactaataagacatgccctgtctca

SEQ ID NO: 49878 - DNA, 402 bp, Triticum aestivum
  Clone ID: PAT_TA_49878
gacgtcgccggcgacgaggagctgcgggcgtggtgggaggaggtgcgcaccaaggggcacgcggacaagaaggacgagccgtggtggcccgtgtgcgactccaaggagaacctcgtccagatcctgaccatcatcatgtgggtcacgtccggccaccacgccgccgtcaacttcgggcagtaccattacgccgggtacttccccaaccgtccgacggtggtgcggaagaacatcccggtggaagaaaaccgggacgatgagatgaagaagttcatggcaaggccagaggaggtgctgctgcagagcctcccctcgcagatgcaggccatcaaggtgatggcgacgctggacatcctctcctcacactcccccgacgaggagtacatgggagagtacgcggag

SEQ ID NO: 49879 - DNA, 251 bp, Triticum aestivum
  Clone ID: PAT_TA_49879
cgccgccatcgttcccgatgtcgatctaaatctgagggtatggtgcaactacgtcatcgagacccagaccagagacgaccgcacctatcttatccatcacagccatgctacaacaatatgggtaccggatgcactaatccgctatcgggaggagaacgacgacaacgaccacaatcgcttgctggagactaaaggggacggacatgattacctgcaggtgacgcggatgctctgcaacgggcgctgcgagg

SEQ ID NO: 49880 - DNA, 159 bp, Triticum aestivum
  Clone ID: PAT_TA_49880
ccggccaggaaggcccaacctgggtccggctccgggaggaagcggagatgcagggacgccggcgccgaggtgggcctacctgacccggccgccgccactgtcggcggcatcaggctcctggccgggtacctggctcacgaattctttgcttgcggcacg

SEQ ID NO: 49881 - DNA, 328 bp, Triticum aestivum
  Clone ID: PAT_TA_49881
cacacacatcggtatagtaagcatacgaacactggccgtccagcacgcacagaacgcaggaggaccggggagccatcgatcgacatggttgtcaaggatgagtttgacgagcatgcggagaagggcaagacactaacgcacaccaccaccaactagagcaagctctgcctctacagcctgtacaaccaggccatcgtcggccccgtcaacaccgcccgcccaggaggcctcttggatatggctggcaaggccaagtgtgatgcttgaaaggccgtcgaagccaaatccaaagaggaggccatggtggactacatcaccaaggtgaagc

SEQ ID NO: 49882 - DNA, 435 bp, Triticum aestivum
  Clone ID: PAT_TA_49882
acctaccgcaacttcatccccgcctacccccgcgcgcttatctactctccctccgtcatctgaggggcacatggcttctgatggagctgctccctttctcacaacaaaatgtgtccttcaaggtgatcctcacctccgaccccaagcttcccttcaaagtgttcagtgtgccggatgcggcgcccttcactcatgtgctcaagttcgccttcataggaattcaaggttccaccccataccatctccaatattaccaacgatggagtcttcattaacccacagaaaagtgcatgctccgtcttcttgaagcatggttttgaactgctcctcatcccccgcaacaaatttggaacgcctctggctttctttctagtacattgtagaatcaactttgatttaattctatattacaggaataaatacattttcattctt

SEQ ID NO: 49883 - DNA, 104 bp, Triticum aestivum
  Clone ID: PAT_TA_49883
gctagggttttgggattttagcctccagctccgatcgcctttctccagcgaattcgacaagcccgggagctcgtctgatccgatatccgacacgttcttccacc

SEQ ID NO: 49884 - DNA, 207 bp, Triticum aestivum
  Clone ID: PAT_TA_49884
gcgacccacgcgtacaaccacacttacaatattaaatccacgcactttttcctttacccgcttccacccgagagaagagggctcactctcttttatcccccccccctaaacatcattttcttcctcatcctcatataccccccccctactcctttcaacaaaaaacatatttatggccctctcatagcttttttgcctaaccctcac

SEQ ID NO: 49885 - DNA, 305 bp, Triticum aestivum
  Clone ID: PAT_TA_49885
accacacgtacgagctcaccaaatttctcgcgattcctcttccctctcctcctcgtactgcatctcctaagagatcgccggagaggaattgccaccagggctttctactatcagcttaatccacgccgtggcgcacatggagaccggctggcactctctggagggccccattctttgcgtctataattgcggcttcttcagcatcgccatgaccatgaacatgtgctccgagtgccacatggagatggcgctgaagcaggagcacgcatagcttgtcgactgctctttcgacagcatcgataacg

SEQ ID NO: 49886 - DNA, 321 bp, Triticum aestivum
  Clone ID: PAT_TA_49886
ggccaccactgtccactctgccaccgacggaaaaagagatcgagtgagataagtatggcgcggccggtggtcgccgcggcggcgctggccgccgggctggtgtccgtgctggccccgcggttatgcgcagatggacagctgcacgcgactgccgtcgcgctgcgaactacttgctgctgcacccgtggacacttgtcctcgacacagacagacactgctggtgggtgcacattcgacggtggtggatgcttcgacgctatgtcgtcacctgtgctgtggagagctccatccattctctcaacgtcagccgtacgggtttta

SEQ ID NO: 49887 - DNA, 399 bp, Triticum aestivum
  unsure (1)..(399): unsure at all n locations
  Clone ID: PAT_TA_49887
cccatgcgtccggcatcgaggctcttacggaagatgtttgggagaagcaagcttcggagaggtcttcccatttccgttggcgttggcggcggaggaggggtcatcagacctgcgggacgaggcagacggcagccggctgcgcgtgcgcctggctggtggcgccgcagcagccgtggagctcatgtatgcgattctggcgagagctcggcacanttagggtggcggcggcggcggcggcggccggcgagattgaatggtgtttctactccccctcctcctcgcttcgatagcgtggggtatttcttcttcaagccctctgggattaaaatatttggtgaacccgtgatgacattattttttggaaggggccttctcctttatttagtcgaggaggggttc

SEQ ID NO: 49888 - DNA, 292 bp, Triticum aestivum
  Clone ID: PAT_TA_49888
cttctggctgcttcctcgcgcaggtgctatttctgagcttccgaggcgacagagctgcacaagagcagagcagagcatatggagagagagagagagagagagagagatgagggatatcataagcatccacatcgggcaggcgggcattcaggtggggaattcctgctgggagctctactgcctcgagcatggcatccaacccgactgcctcatgcccagtgacactcttgttggtgttgccaaggatgcattcaacacgctttttagcgaaacgggttcagggaagcacgtt

SEQ ID NO: 49889 - DNA, 370 bp, Triticum aestivum
  Clone ID: PAT_TA_49889
gtcttcctgacgccacccaaggatctgaccacctcagttaggtgttctccacccagataggattgggtgacaaggacattgatgctctttctggtggtcacaccctggtgtgcatgtcttatgtttggcgccaagtttgtacgcttactgccgctacaaagaatgctgacaaagcttccagaataatgctatattatgctgcgagaagcacaagttcctctcttatcctgtctgttatccatttcttttgctcgaggagccaaccgtgctgacaaaacactagaaggtatgaatctgaatttcttacttctgtatacatacagaaaactacattattcatgacatcattacatttctttgttgcacattg

SEQ ID NO: 49890 - DNA, 365 bp, Triticum aestivum
  Clone ID: PAT_TA_49890
cgcacccctctcgctctccgctccatctggtccgattcgattcgattccatctcggagtgctgtgaagccacgcgagaccagccatggccgccaccatccactccgagaaggcccgccagatcttcgacagccgcggcaaccccaccgtctaggttgatgagtgctgctcatatggaaccttggccagggccgccgtgcccagcggcgcatcaactggtgtctatgaagctttggagctgacggaccgtggatctgactacttgggcaagggtgtgtccaaggctgttaaccatgtgaacttcattattgcacccgctgtggtcggggaggaccctaccgctcaaactgaactctacaactttat

SEQ ID NO: 49891 - DNA, 336 bp, Triticum aestivum
  Clone ID: PAT_TA_49891
tgcatgcgtaacaacgatatttactgtcactgctgtcaacggctccttgactggaaatatgcgaacgcctacctcttaaaccagaagtacaaaaagagacagttcatactaaagaacaacatgatgctgcaagaaggacgtcagctggcggaaactgatgatatgatggcaaagtctgcgcacgctcacatttacaacttgagaactgtagctaaagattctgtgatactgattaactgaacatttattactgtggtgacggccatcaacacgaaaatgcatttgtgaaatctgtagccccctgttaaatttgctcagatggactctgaaatcgaa

SEQ ID NO: 49892 - DNA, 205 bp, Triticum aestivum
  Clone ID: PAT_TA_49892
gaccacgcgtccgcgggatctctcccccaccaacccccgaatccatccaatggcgaccgcctagctcaagctctggtaggcgaaggccgtcgcccagtcgccgctgctccttctccccaccgtcaagaggaagatgatcctggcactgggcattcgggccgcctgcgatgtcgtgcagaccggcgtcatccaggccatcgacatg

SEQ ID NO: 49893 - DNA, 346 bp, Triticum aestivum
  unsure (1)..(346): unsure at all n locations
  Clone ID: PAT_TA_49893
cccacgcgtccgcaacttcaaaaatattgttaaggtaaccacagaaccactggtcatgaaataacacaaatgtacgtacgcaccagatgatttcggacgcgaagaagacgctgctgttcctgggacagccgtaccgcgccggcgaccagccggacccgggcgcgggctccctggagaacgtgccgcacggcacggtccacgtctggactggcgacccggcgcagccgaacttggaggacatgggcaacttcttctcggcggcgcgcgaccccatcttcttcgcgcaccacggcaacatcgaccggctgtggcacgtctggcgcnncgcttcgccgagcaacaccga

SEQ ID NO: 49894 - DNA, 379 bp, Triticum aestivum
  Clone ID: PAT_TA_49894
ccagtgtgatacccagatcatccttggcccatattctgtgcgctgaatctttcgcctaacgcgggtgggctacggcctgtgcgcccctgcggcctccgaagtcgaaggcgaacggtgcatggtgttcggaggacgaaggaacgatgggagggccgagtgccgggttggggtcgagaggaacaatactagccatataactatgggagatgaagaagatgcttctgggtctgaaggagtgccaatgggccatcaagaccaccctcttggggttggggaagcatttaaagcacacacaagagatgctgaagctcaagctcggtggaggcgcctatagaacggaagagctacagacgcgtgtcctcaatgttatgatgatggc

SEQ ID NO: 49895 - DNA, 440 bp, Triticum aestivum
  Clone ID: PAT_TA_49895
gggtccttttactcataatccatgataatgagacataagattaaaaatagcaagtgtattaagttttgtaagttgtgtttctcaagataatggtccatgtgagagatgaattgaaatgagaaaatgacacacatctttataaacctctcagacacagatgtataatcgatgaagtattttaacaccgacttataggctatcatattatgcaatgaatcaacatgatttgatgattggatcaactgtgtatattttctaccaattgaggtcccacatctagttatgatcagccatgaaaatcgattttagtaatttaaagataaagactggctttcaatgaagctgtcatcttaaaggaagtttggttggtatttattcaagttaaaaggtttttttctgtttattttagaaggcaaggttgtacttaagccgaacggggc

SEQ ID NO: 49896 - DNA, 294 bp, Triticum aestivum
  unsure (1)..(294): unsure at all n locations
  Clone ID: PAT_TA_49896
ggtagaggacaccgaggagggtgggctgtgccattctctcgagcccggcagtccaaagcggaaggagcacaggagccatgatcacagcagcgagagggaccttaagaggttgaggccataaaaggaagtattcataaccaccctgggtagaatgatcggcagagtggcattgggggctaaatgcaacaaccagggtgaaaacctattgttttttctgtgttgcangagctgctatctcggtccttgctggccattttgggacatctgaaccgtgattcgagaatatggtttccc

SEQ ID NO: 49897 - DNA, 166 bp, Triticum aestivum
  unsure (1)..(166): unsure at all n locations
  Clone ID: PAT_TA_49897
ctcgcactgcacctcgccggccggccggctccctccatggcaaccaccagcggcgcctgcctgcctctcctgctgctcctcctgtcgccgcttatcatctcctcgtattcatcgtcagcggcggctgcntangcataagcagagcagccggtacaggtacacggtc

SEQ ID NO: 49898 - DNA, 294 bp, Triticum aestivum
  unsure (1)..(294): unsure at all n locations
  Clone ID: PAT_TA_49898
atcaaagaaatgctgattatgtgaatatgtagcgttaagaccatctccgaacccgcaatgaactcagaccagctactagtacaaatgattgtgagtgtctgctgccggtaactagtccaggaaacttgaaaccctttgcttttttttccttccctttttgttatgaaaacgaaggttaaacctctcagccgtaaatggcagatcacggattttcatccaaaatgtgaagtggtgttctagtcaccatcttgatagcgcanaaaaaaaaaaaaaaaaaaaaataaaaaataaaaa

SEQ ID NO: 49899 - DNA, 145 bp, Triticum aestivum
  unsure (1)..(145): unsure at all n locations
  Clone ID: PAT_TA_49899
caaaaccaccgtcgccaccgtatgggaggcngatctcatggggaagaaagtgttcgggcgcgccgacctcaacgtgccggtcgacgactcccagatgatcaccgacgacacccgcatacgctcattcatgctcaccattaagtac

SEQ ID NO: 49900 - DNA, 425 bp, Triticum aestivum
  Clone ID: PAT_TA_49900
cggacgcgtgggtgggcagccaggctcgttctagctctaggggctgaagctaagattgacgtcgttgcaggatgggccgaatatgcacttcctttcacaactttggaacatgctttgaaagttgaaagtgaattgaaaatgttagaaaggagaaagtttggtaagaagtccccacctattcaggtggccattgtgggactgggttactctggtgttgagctagctgccactatctctgagagattaaagaacacagggactgtcaaagcaatcaattttcaaacaaccatctgtcctaacgcaccaccaggaaatcgtgaagctgctctgaaggttcttgagtctcaaaatatccaactttttttgtgatattcggtgaactgcatcagataggtttatgcatctgaggattcaggttgcatggt

SEQ ID NO: 49901 - DNA, 369 bp, Triticum aestivum
  Clone ID: PAT_TA_49901
cgcgtacggacacaacgccctatgatggcgccttccagttcgtccgcacaggaaaccgcccggagtccgggcaccccgcccaccacctgttcgtcgctatgcctccccggccgccgccgtcccgccgccgcctcctccgccacggccgcttcccccggcctctgcctacgtgcacctccccttctgccgcaagcgctgccactactgcgacttccccatcgtggcgctcggctcctccgcctcctcccccggcggcccgggcgagggcaaggatccttggatctgcctacttacttccgccttctttttcccttatgtagtcacgtaggagtggtgtacatgctaccattgatgcaaatgcaagaacag

SEQ ID NO: 49902 - DNA, 202 bp, Triticum aestivum
  unsure (1)..(202): unsure at all n locations
  Clone ID: PAT_TA_49902
ctcgatagttcttcaacaatggcgttctcggcggatcctaccgcacagccctacttgggggagnagttccgtttggtgctgcatcttctcaccgaccgtacagtcgtgcgctctgcggccttgcccttccctgncnacggcaacgtcgcatataacgaccactgccgctttttgtgtatggactccgtgtacaacaccagcc

SEQ ID NO: 49903 - DNA, 253 bp, Triticum aestivum
  unsure (1)..(253): unsure at all n locations
  Clone ID: PAT_TA_49903
atgcgtccgtctgagtttctcaggtgccgcggctgctcgcgctctgtaccttcgcttccacggtcggcgctcggggccgtcgccgacaccaccacctctacctctnctcccatcacacaagccagcggttcccgctctacactccgctggcgtataaccgtatgtaccgttccccaattcttatttgttgacgcatgttcaacaacatttacctcaacttctacgccctcaacggcgacaagtaccacggcgg

SEQ ID NO: 49904 - DNA, 284 bp, Triticum aestivum
  unsure (1)..(284): unsure at all n locations
  Clone ID: PAT_TA_49904
gcaccacgccgcccgccagccagccacccgacccgagccatgtccctccctggggcacgggtggccgaatccaaattccactccancccgcctcatgccgcctcttcccctttccaccgctccgctgccccgtgcttcttgccatggccgccgcctcgcccttacgccgtcggtgtgccgccgcggcctcgtgcgcgtcagggcgtcnggggataaagcccagccgccgccctccagaacccagatgatcatggacaagatttcctcagccggcgacgaggtct

SEQ ID NO: 49905 - DNA, 151 bp, Triticum aestivum
  Clone ID: PAT_TA_49905
ccttgtaggctaggctagggtttatcttcggattacgagcgaaatcactcggccaatggcgtgggtgcatgtctgctgtgccgcggccattggcacctccgtgttctccgggaaggtagcgtccaacgcgcctagcgctggcggtgtacgc

SEQ ID NO: 49906 - DNA, 261 bp, Triticum aestivum
  unsure (1)..(261): unsure at all n locations
  Clone ID: PAT_TA_49906
gtcgccacgcgccgggacgcgtgcgattagggcgctcactacggatccgctcacctcctgtcgtatcgaccatgtctacgcgtgcctggggaagacatcacgtcgnccacacatgcctggacaattcatgcctaatgctgcacaccaccgacactaggactcagtatgtgcacgacacctctattgagctggagagggggtcgtgctggaccaccatgaacctcaaaatcatggttcctggaacttgtgacaccattggac

SEQ ID NO: 49907 - DNA, 320 bp, Triticum aestivum
  Clone ID: PAT_TA_49907
cccacgcgtacgcacacgcttctgcacaaacacacacatacacacacacacacacacacacagatggcggtagcgtgctaatgccaataactccctaatcttccctgtgatacacgttaacaagctcgacaccgctgaatggagcacaaccatgggggttataacgagatgcctgcgataactgacgattcttcgagctgctgaaccatgtcattttgctcgatctgatgtacgatgtggatcttttgagcaaggcgcactacccgtcttatctggaggagcacttcatggagttcgcggctaacacgctggatgccgtc

SEQ ID NO: 49908 - DNA, 176 bp, Triticum aestivum
  unsure (1)..(176): unsure at all n locations
  Clone ID: PAT_TA_49908
ccgaggcgagccgggattggagacagaggccataaggcaacaacaacgtgtgcgcaacaaatacgcgtggcgtgcgcgtcatatttagagagaganacagacacacacccatggtcgtgctccttcagccccgccctccgggaggcgtccttctgcgatctgctggggtcgcatct

SEQ ID NO: 49909 - DNA, 443 bp, Triticum aestivum
  Clone ID: PAT_TA_49909
atgacagcttctttctcctacaaaaaagcgttgctgctaagactcctgtgtctgacagcagtgttttgtcctattttcacatatcaatttaaactataaaagtaatactagtttcagcatgacctatctacaactagtagtatagctctcaaataccattgtcttattgtaccttcaattgttattgtcttatttccagctttaaattacttttcaggcatggatcaactatatttgacagaacaggatttgcctccttgacagtatggcatatgaaaacatggaagcctctgacagtcctccctcttggcgaggatccacctgctattacttcactttgctttaatcacaatgggaagatcttggcagcatctgcaacagatggcatgattcacatgtttggtatccttttattatggtaactgcctttgacttggtatttg

SEQ ID NO: 49910 - DNA, 216 bp, Triticum aestivum
  Clone ID: PAT_TA_49910
cccacgcgtccgcggacgcgtggtcggacgcgtgggcggacgcgtgggtgcaagcgcagacagacagagcttgagagagcgcgcgcgagatggccgccctccattaatcaacttccccattggtggccccaccaagcgtcccttccttttccggccgggtttcttctttcgccgtcgtttgaagcggtggcaagaaaatcaaggtcgacaggccct

SEQ ID NO: 49911 - DNA, 159 bp, Triticum aestivum
  unsure (1)..(159): unsure at all n locations
  Clone ID: PAT_TA_49911
cggataaaagtgcgagcagttattaagtactaatatatgcatcaaccgttggtctgctctggggacggggattttttcctggaagtnctagtagatttctctctttttcctgtgggctcaaaggccggcctgcggcagggcgcgggtgccgtcgagggg

SEQ ID NO: 49912 - DNA, 165 bp, Triticum aestivum
  unsure (1)..(165): unsure at all n locations
  Clone ID: PAT_TA_49912
gcgtccgccgcgtcactgatcggcggcagccatgagtaagctccaaagtgacgctgtcaaggatgccatcagccatattgttggggaggccananaaaacaagcgcaagttcactgatactgtggagctttagatcggncttaaaaactactacccacataagga

SEQ ID NO: 49913 - DNA, 231 bp, Triticum aestivum
  Clone ID: PAT_TA_49913
cgagtgctgccgaacgcagtgaccttcctgacgggcaacgccaataagctggaggaagttcaactcaagaagcaggtgatctatgccgttaactaccatagactggacctgacggagttgcaaggggagccaaaggacatatttaaagagaaggcccgaatggcttcatctagtggaaaggtcttgcgtacgatatctgcgacgaccagaaggacatcaccagagggaagg

SEQ ID NO: 49914 - DNA, 314 bp, Triticum aestivum
  Clone ID: PAT_TA_49914
accacgcgtacggccacgcgtagcgactaacaaaaccgatcaaaaaagggcgagcgaagtaggtgatcgaaaaactttgatgttagctcgtgctatctataacaggagagcatatgaaaaaagcaacctattctttcgttgttttagctcactgtccatccgctggcagtatcggccttaataccgatatttcatgcaacagatctaataaatgataactgttagggatggagtgttgattattttgggaaagggagagtgtgcgagttgtatatctcaagaactagatggatctatccggctgcactttataa

SEQ ID NO: 49915 - DNA, 298 bp, Triticum aestivum
  Clone ID: PAT_TA_49915
cgcacgcgtgggttgacctgaatcgagcctcaaatgagagtcagcggtatactccgggcgtctcacctagagcgaggccgatggattatcatggcgtgatctgaagaggagaaggctgcctgcggcaatggggagcatcgtctgcaggagggagaggacgagggcgcgctgccggacgagatggatctcttggaggcaccgggggggcgggcgctgcacccgccggacacggtgtatggggagccagtggtgtacagcacgagcaggatgggggccgtgcggtccctgaactccatct

SEQ ID NO: 49916 - DNA, 409 bp, Triticum aestivum
  Clone ID: PAT_TA_49916
ccggacacctgccaaaagcgcgagagagccgtggcagatcgcatcgccgcgtaacgtgccgccgcggagcaaccggcgagcaatggaggccggcgtggggctggcgctgcaatcgagggccacggggttcggatccggacgccgaccgagcgcgatacacggtgatgagagccgtactcggaccggagctacgcatgtcaattatctggtattgtcgtcgagactgctgcgcgcgcacgcggccaagcgctctatatatctcacaggattgaaacacaatggagggagtcatgatatcttagctacactcaacgacgattcactcatgatataagaagactttatattgggactttttccagttgaacggtcggtgcatctacctagttggaatgatggggggcgggca

SEQ ID NO: 49917 - DNA, 395 bp, Triticum aestivum
  Clone ID: PAT_TA_49917
cgcaagcctcgctcgccctgatccgatccccaaatccctcttcgccgtcgacgccccgaatctcagctccggtgaggccgacccattagcagggcgtgacctcggcgcgcccgccctccctcccgcccgccgctccctcctctccgcccgccgtcgtcccggtcgccggaacccgacaagttggatatctaggaggcaccgcagcgttgcggcgcccaccgcgcggacaccatgtctgcggcgccagccgcgtaccccaccaccagcctccgcgccgtcgcgtccgggaactccttcttcccctgctcgcaccgcctcaagctttcctcctcgcatcgttttagtagtagtagtattggcaatcgtagtaattgcctctgacgtttgccctcccc

SEQ ID NO: 49918 - DNA, 394 bp, Triticum aestivum
  Clone ID: PAT_TA_49918
cacaacacaacgcagaaccgccgccacacctccactctgccggcgacggccaggagcacgaaaaaccaacgctttgcgaaaatcatgaccattcttgcgtacaaaaccattgaaatcttgcatgatgagaccgtgaatgtgtaggctaatattatctccgtgacagtgccgaccgcaacactgaccctgaacttcctgcacctcaacctctgactcccaacgtgctgaatgcaggcggaagctcaaggtgaacccctttttacatacctgaaacatcttatgcgcatttcctaccgatatatcttactttcagaaccttatcaccggcattagcaacggctttcggtacactattgccttggtgtactcgcagttgctcattgacccctccatg

SEQ ID NO: 49919 - DNA, 129 bp, Triticum aestivum
  Clone ID: PAT_TA_49919
atcatctcccgcgctaatcttactacactccccatggctgccgttgtcttcacctccccggcaggaggaagaagcaacgtttcgccgacgaatattaactaacttacgcgcccaaacaatacatattgt

SEQ ID NO: 49920 - DNA, 316 bp, Triticum aestivum
  unsure (1)..(316): unsure at all n locations
  Clone ID: PAT_TA_49920
taccgtccgtantcccgttcgaccccgcgtccgcagccccagtcccatggcgtccaccgccgcgccgcccgccgcatcgtcgcccgccgcgccgcgtccgcgtccgtggccgccgcgccgctccggcgcgcggggctcgcggccgggtgccagccggcgcgctcgctggcgttcgcggccggcgccgacccgcgcctcgcggtccacgttgcgtcgcgctgccgtgccgcgttcgccgcgcgcgggacccgcgccgtcgtcaccatggttaaaaagagcgtatgggacctaatcgcaggtgaccatgatggcaagc

SEQ ID NO: 49921 - DNA, 381 bp, Triticum aestivum
  Clone ID: PAT_TA_49921
ctgacgcgtgggacttgagagccgggtttatttcacaagacttttgatccgaataactcgaacgtttcttggccaaacggaggagaacattaccataaaatggctgtcaacgaccatggcggatccctgcgtacctgaaacggcgtattaccacctgcattcggcaaccatccaatagtcggcaggaaggcaatagcacgggcagcaaccgataagctgtaattatcgcctccatctaagaaggaaactaaaggtgcttcgcttgaaactatcgagaatgggagctctagcatcagacatacaatctctacactggaggttattatagatcaagaattagatccggatgcacatattggggactgaaaacagggtgaccgt

SEQ ID NO: 49922 - DNA, 257 bp, Triticum aestivum
  Clone ID: PAT_TA_49922
taccgcctcgcctccgacagaaccggagaagctagatgtcatgaggaacggagatagccgatcttggatcgagggctgagcatctgggtaccgagatagggaattatagaaacccggatccggacacgcggccgcgctcggcatcggcggtaccattcactgtgaactgataaccttttgaggatgtgcttatgtgatgaactggcgaatcttgggatagctgttgtagagatctggtgcacgatgcacccgtgggc

SEQ ID NO: 49923 - DNA, 351 bp, Triticum aestivum
  Clone ID: PAT_TA_49923
cccacgcgtccgcccacgcgtccggtttcagggccacgagccgggcttcagaaggaagccatggcttttcaggaactctttttgtcagatacatgtaaaagcttgattcatgtgttcttttcacaacgtgcaacattaaaggttcctgggatcacagacttaggtttgatgccaaggaaggtatctaaagttgccattgttggtggtgggcttatgggttctggaatcgcaaccgcgctgatactgagccattatcctgttatactcaaagaagtcaacgaggaattcctaaacgcaggaattgacaggatcaaagaaaacttgcagagtcgtgtaaggaaaggaaaaatg

SEQ ID NO: 49924 - DNA, 329 bp, Triticum aestivum
  Clone ID: PAT_TA_49924
cccacgcgtccgcggacgcgtgggttcttattatgaattattgatctgtaaatttgtgcaatttgactgaattcaaattattttattaaggaggctataaaatccatgactaaaaataaataaataaatttaagttggtcatccgtaggaacgcacgagcatttttgatagaaagagaaaacaaaaaataaataaatgaaaaaaaatcgggaaaaagaggaatgaactaaccgggaacttaccgagtacatcagtagggttgcggcgccctgaagggaacactcgtctcgtttaggattaggaacccgtgaaaagcattgtttcttcgc

SEQ ID NO: 49925 - DNA, 271 bp, Triticum aestivum
  Clone ID: PAT_TA_49925
accagacgtacgaggagatcgatagggacgggaggaggaggacgaacctccagagttcatgcgagcgagagcggatcgagtctgcgcgtcggcgcgtcgatggatcgggtccccgtctccgcgctgctgctcggcgtcctgctcgcaggatcgctgctagcgctttgtgctgcaaaggaggaggccaagatgctcggtaccgcgatcggtatcgatctcgggaccacctactcatgtgttggagcgtacaagaacagtcatgtctagatta

SEQ ID NO: 49926 - DNA, 319 bp, Triticum aestivum
  Clone ID: PAT_TA_49926
cggacgcgtgggcggacgcgtgggcttgcacttgctcctacaagcggtttgtactaggcgcaagacggcccatgtagcaaagaaaaaactttagcgtggctgcctggatgacacgctgacggcgacaaacggcgccgactaccgcggcgggctcatcccgccgctgcccgtccagaagcgggtactgctgtcgcacggcggctcgcagaggcgactgtaccgtgggcattggttcccggagtggcacctgtgggccctggcggctgaccgtgaccacttctagcccaaaccaacggacatattaatggagagctgcccc

SEQ ID NO: 49927 - DNA, 360 bp, Triticum aestivum
  Clone ID: PAT_TA_49927
gtctgcattactatcggaacgtgaccaacgagggtttcacagatcctgctcaacttattcaacctgccatgtgagatcagccctcgccacgctcagaaactctgcctggcctgctggccctgaactctggtctgtcgcagatgttagaccgaggaagggggcctcctatgttggcgggcgactggcctagatgtggggacagggctggcttccgggaatgcgctggtggctctcctgcggactgctgtggtgagtaaggctgagcctctgcatagtggcagccatgattcaggagctctggtggtggccgctttcgccgttgcgttggtaccgatgtctttgacctagtcagccgcaggg

SEQ ID NO: 49928 - DNA, 307 bp, Triticum aestivum
  Clone ID: PAT_TA_49928
gacaagaaccaaaaatggacaggagggcggcgtcgcaaggggattacgacgagcaagaccggcgagtgaaaggcgccgaggtgttcgtcggcgggctgccgcggtcggcgacggaggggacactccgagagatattttctacttgtggtgagattgtcgacttgcgcataatgaaggatcagaatggtgtttccaagggatttggatttgtgcgatttgcagaaagggagtgtgcttacattgctaaaaggcaaaagaatgggattgagcttcaaggaaagcgactagcttgtgatctttttttgga

SEQ ID NO: 49929 - DNA, 273 bp, Triticum aestivum
  Clone ID: PAT_TA_49929
cacctaggtgcactcgcatgcacatcgatgtacgatggcgtccttggccagcatgccgcccgttagatggcgctcctgcagatccgctgctcgtcgtcgtcttcgcggtgatcatgagcagctccgtctgccacggagccgggatcggtcctggtgctctggaccctagccgccgacccatatgcggaggcagaccgtgcggacagcctggcctgccgtacggcggtcgtcctcggccctacctttacctgtcgcagcccggccccgggagcc

SEQ ID NO: 49930 - DNA, 300 bp, Triticum aestivum
  Clone ID: PAT_TA_49930
accggatcgccgccgatgaccatgggggcggagcgcgaggccggcgaggaggaggagtcgcggcgcccacttctcccatcctctccgtcgccagcggcggagcaccaacatcagtaccagcacctggggcggagcagctcgtcggcgctccgctgcggcggaggattgttgggctttttctccacggtactgttactactgcgtgtctcgcatgttcttttttgccccgacccatcaacacattcttcagcacaagcgcctggtctgttttctgtagttactgctcttcatttttactgg

SEQ ID NO: 49931 - DNA, 284 bp, Triticum aestivum
  Clone ID: PAT_TA_49931
cgtctccgcacgcctaatcgcagcacactccgcctacggcgcctcgccattactcgccacccaatgttcactcgaaccatctgacgacccagcctgggaacccagagggcatggcggcgaccgacgacaaccaggccgtggatgccttcctggcgtcgtgcgccgagtcgggcgacgccgcgtacggcgcggccaaggccgttctcgagcgcctccaggcccccgcctcccgcgccgaggcccggcgcctcctcggttccgtccgccgccgcttcgccgacccc

SEQ ID NO: 49932 - DNA, 313 bp, Triticum aestivum
  Clone ID: PAT_TA_49932
ggatgaatgactatcatgatcagaaatttactcgatatgtaccaacaaataaaattcttgaatctttgagggatatttggttatgtgtggatgaaatggaagacttgtgcattacctttaagccctttcgctttacagaaggttgctcatctcgagtgcaaggtagcttgaatcaaacatgctctactgggagaagtggtgacaaaaggaaacgtaaagattttgcatcttccatccctaagccacaagaattcatcgaggatgaacatacaccagaattcactgttgatgaacataagcatccgactattca

SEQ ID NO: 49933 - DNA, 157 bp, Triticum aestivum
  Clone ID: PAT_TA_49933
cccacgcgtgctggcacgcgttcgcccacacgtaggtagaccttggctcgcacgacaagctggacgtgaactacaaaggcccaaaacttaacacctggttatcttaagtgctggttaattggttgggcttttacctccggaaggccgaaaaaaatga

SEQ ID NO: 49934 - DNA, 351 bp, Triticum aestivum
  Clone ID: PAT_TA_49934
agcgcgcggtggccggcgaaacgacagagctagcaacagctgtctatacataggcgatgaggacggcgggccggacgccggcgacgaggacgctctcgtgtgtccttttccttctcgtcgccgtcgcgtctctggcgtccgccgccgccatcaccaagggcgacttcccgccggggttcgtcttcggcaccggctcctctgcttaccagattgaaggtgcggttgcagaggacggaagataacccagcatctgggacacattcacgcactcaggttactctgccgatggagccactgctgatgtgactgcagatcagtatcataagtacaaggaagatgtaaagcttttga

SEQ ID NO: 49935 - DNA, 272 bp, Triticum aestivum
  Clone ID: PAT_TA_49935
aagctccgtccgaagcgactacagacagcgctcgcgagatggcaggctagatggccacctcggtgattacctcgccgagggtcgtgccgaccatcgtgctgcgcgtctcccgccggtgctactgctgcagcgtcggctgcaacagcaacgacgatatgaccgtcggcctgccagtcggactgacaggcggcatgaccgcctacgtcaacgtggacggcatgaagggcgtgaacaaggtcgtggaccagtacggtgacaactacggcggctac

SEQ ID NO: 49936 - DNA, 506 bp, Triticum aestivum
  Clone ID: PAT_TA_49936
agagagaccaattcctcccgactccccaagaggcagccagcgccgccaggcagcagcggcgacggttgacggcggcggcggcgccggcacagctgcggcagaagcaccggcgggaaggcagcggcagcacagattgtcattgtattgttcaagacttgtcttatctgctgtagaccgaaacaactcaggatgtcattttatgcaagaagaggtggagataggggtagtgagcgttttcaaggaggaggagggcgaggtggatatgccatgcgtgggagatcagggcttcctcctcgaggaccacttgggattaacgctcgaccatctgcacgcattattgctaagtcttttagcagaaccaaagacatgacctggagaccagatctatttagtgatagtatggcggctagtggaattgaaactggtacaaaattgtacatttcaaacttggactatcgtgttccaatgaggatataaaggagctgtttcagaagttgtcatttgaa

SEQ ID NO: 49937 - DNA, 403 bp, Triticum aestivum
  Clone ID: PAT_TA_49937
gcatgtggctctgcatgatcctgaaccagagcctggcgtcataggcctcatcaatacaaaattgtcccccatacaggtagctcaaattgctagtgaggatgcccgttccatttgtatgagggaatacggatcagctcctgacatcaacatttatggagatcaaaatttaacatttccgtaagtttcagatataaactccaccaatcacctttgtttttttcgtggattaaatcatgtgttagcaacagcacctctttgttgtcacttgtcaggttacatgttcattggcttatagtttttgttatcatgttgattgagtggccccatttattgttgtcttgctaactaactactcgcaattaactatgtgcagatatgtcacatcgcatcttcatctcatgct

SEQ ID NO: 49938 - DNA, 358 bp, Triticum aestivum
  Clone ID: PAT_TA_49938
gtagcggactcacgtccgcacaaacagaaactaaagcaggtgttggatttaaagctgtggctgaagaggataaattgacttactacaccccatagtatgaaactaaggatactgatatcttggcagcattccgagtaagtcctcagcctggggttccgcccgaagaagcaggggctgcattagctgccgaatcttctactgggacatggacaactgtttggactgatggacttaccagtcttgatcgttacataggacgatgctatcacatcgagcctgttgctggggaagacagccaatggatctgttatgtagcttatccattagacctatctgaagagggtgccgttactaacat

SEQ ID NO: 49939 - DNA, 338 bp, Triticum aestivum
  Clone ID: PAT_TA_49939
cggacgcgtgggctgcaaaggattcagcccaccgcccgttgggaagggagcttcgaggcggcgcggccgcggcacgtcggccggaccggcttatccaatggcacgggcccttgggggcgcaagcgcccctaacgtgggtcggggcgggcggcgggcgcatgcgtcgcatgctagcttggattctgacttaaaggcgttcaatcataatccggcacacggtagctttgcgccactgggttttcaaccaagcgcgatgaccaattgtgtgaatcaacggttcctctcggactagggggaaatactttcgcgaccctggcttgtagggggggaaaactaac

SEQ ID NO: 49940 - DNA, 354 bp, Triticum aestivum
  Clone ID: PAT_TA_49940
ccagaggcagagcggcagcgagagagagagagagagagagagagttttggttggtggacacgcacagtacagatggcgtcgccctcctcctcgctctgctccagcctcggctacccgcgcgccgcctccctcggcgcccgccgccgcgccggcttctcctcgtccaggaagctattccaagtgaaggcatcaagggtcgacagtttctccaagagcgacatcattgtgtccccttccattctctctgcaaacttcgccaagcttggtgaacaggtaaaagctggggaggtggcaggatgtgactggattcatgttgatgtcatggacggtcgctttgtgccaaacatcacgatt

SEQ ID NO: 49941 - DNA, 257 bp, Triticum aestivum
  Clone ID: PAT_TA_49941
ccggattcccggtcgaccacgcgtcaaatcttaattcaagagttatagggagggactatgtcaccacaaacagaaactaaagcaggggggattaaagctgggtaagatataatgctactacaccaattgaactagatctgaattgcagattcgatagtctcacctggggttcgcccgaagaacatgggctgcagtagctgccgatctttactggtcatggacaactgtttggactgatggacttaccatcttgatcg

SEQ ID NO: 49942 - DNA, 310 bp, Triticum aestivum
  Clone ID: PAT_TA_49942
gtcacgcacgtttcgtttcgttccagtcctctacgttcatctttggtgtgcaggagatggtgttccgcgggactgacacagtggcggtgctgatggagtgggtgctggcccggctggtgctgcacccggacgtgcaagcgagggtgcacgagagctggaccgccgggggcgcgacggccgtgaccgatcgtgcgctctcctactcagcgataagaactcggtaccgccgtcgtgtgctggcctcctgctactcgtcttcctgccactggatggctccaaccctggcacgcatcgcgacgtgccgcacgcc

SEQ ID NO: 49943 - DNA, 299 bp, Triticum aestivum
  Clone ID: PAT_TA_49943
tgcaaccgttggaggtgcgggtccgtagataaagaaggagttgagcgtgctcacccttggcctggtcgatggccttgtactggacattggactcatcggggcaaggcttatgaacaagcgttggggtgcggttggtgaaccatgttgtaagcaagaccatgatcagctccaggaccgacatccacaccgcgaggggcatgcttaagcgaggggcagacccaggggaagagccgctagcggccaggctgatggaatcgagggatataactggtgctagaaccgccgagatcgtctacatg

SEQ ID NO: 49944 - DNA, 315 bp, Triticum aestivum
  Clone ID: PAT_TA_49944
atcagatagagcgccttcgttgcctcacgaatggtcgtctgtactgctgatggccaacgcgggcatggtgacggaggcgacgcggtggattgcaataaggtggccgttctgacggccgtcgcctaggtccaggaccgcggggtcaaggacgaggacgatttcgtgctgcgcacattcctcgtctctcgggactacaacattgggatggcgtcgaccatgctgctccagtacctagagtgggagcgcgtcaccatgcgccatgtgtgcatcttcggagaggaggtgcgcgtcctgatcgtgaagagcagggtcgac

SEQ ID NO: 49945 - DNA, 269 bp, Triticum aestivum
  Clone ID: PAT_TA_49945
taccggtcctgattcccgtcggacgcgcacgcgtccgcccactcttcctgcctcttcctcctcctgcggcatttccagctgcgggacccactgggggtagtgcaccttctcatgcggggaggacgctccctatgccattctctcccatctatccatatccgtgaccacctcctcctgcagcaagtgctgcggcgtctccgttattcattcttcctcaatcctatctctgaacagatagtgcttgcacacccatttttctaaaattaatc

SEQ ID NO: 49946 - DNA, 353 bp, Triticum aestivum
  Clone ID: PAT_TA_49946
ccaattctcacgttgacggcccttccgctcttctccgcggggtccgccggagttgagtcggacggagtgtcacgtcccatattacacgaacctacggtctcaataaagcagattgggattcgatattcccgcggcgtcactcgttcgctctagatctggcgtgcatcggtgcaggctgttggagatggagacaaggaggcggttgctgccgtatccaagtgtgacctcgacgcatggcacgaagacccggttggccatggggcacgcggatcgggatgacaaggttctgcgggtccgagcgctcacacatgggcaccggtcgatcttgctgcgcgcatgctccgatgatcaag

SEQ ID NO: 49947 - DNA, 362 bp, Triticum aestivum
  Clone ID: PAT_TA_49947
cccacgcgtccgatccactcactttccccacaggcaaagcagtagctcctccacggcgcggcgaacaccgcgatgttgatctgcttgcttgtcggagcgggagggtttgctccatgctcgtcccatcgcggcgctcgtgagcgaactgcgcaccaaccctgcggccacgacgtccctcgccccgcgcggcgctcgtaggcgagctgcgcgccgttcctgaggccgcagcctccgtcgcccggcgcggcgctcggcggcgagctgcgcgccgttcctgaggccgcagcctccgtcgctcggcgcttcgctcggtgtcgatctgcgcgccgttcctgatgttgcagcctcctgtcgccgggcgc

SEQ ID NO: 49948 - DNA, 390 bp, Triticum aestivum
  Clone ID: PAT_TA_49948
aaactgtaggatgctcctgtacccccttgcataacacagttgcagggtggacttgtgcaaggtgccattgaagtagaagaccgagcacaacgttcagcaataacaagagtgaacgctgacgatgttcgagtagcagtagctgcccctgctgctcggggggaggctaacaacgagttgctagaatttatgggcaaggtcactttcttcaatcttaactcttggcagtattttagatacttaaatgtatatggtattcgtttacattggtacctgtatgggtataaatctaataatgttttcaaacttctcaccagaacatgtttgtactgaaaatttatgttatcaggttctggggttaagattgagtcagatgacccttcaaggggatgg

SEQ ID NO: 49949 - DNA, 402 bp, Triticum aestivum
  Clone ID: PAT_TA_49949
cttcttccgcaccggcgtccgccctacagcaccaactactgcatcctcagcggcgtgtggaacggggtgctggacaggcacaaggtgttcgaggcgctggagatgatcgtcttcttccgcaccggcgtccgcccgcgctcatgggacgaaacgcaggccgcctggatggaggacaccggcagcgccgccgccgtcgctctgactgacagttcgtaacatacatcgagggcctgtacatacatactacggttcaaaaggtatacagaggatgaactgggattgaatggattcaagtaaacgagtttagctaggtgggaaaatataaatatttaatgtatattttaggttgggtttgaggatgcatatcttgtggtgtatgcaaagagaaaagaattctttaca

SEQ ID NO: 49950 - DNA, 236 bp, Triticum aestivum
  Clone ID: PAT_TA_49950
ttccgcccacccgtcctccaacgcttccggcctattttattctgtgggatcttacaaaattaccctttcatggggggcggcaagtggtgcacatcgtgtaaatcccccaaaccctaaaccccgttgttttggcctttaaaatgccccggggtggggttttgtgcacaaaaaaaagttcccggaatgagcctgtgaaacttcacgaggggggggggcctcccccccttagtggtgcg

SEQ ID NO: 49951 - DNA, 288 bp, Triticum aestivum
  Clone ID: PAT_TA_49951
cctgctaatgcaggatgtcgtcaatgcagtggacgctgatcatgttttaaataaagtaagggccctgggagacatttcaaatgccatgatcatgctggtgaagtacacatccacacatggtccagatcccaggatgttcctggagaaattaatggagcaggagaagctgctattcgaactgcgattagattgcgtaaatgcaatgataagaggttgtagtacttcttcattggcaacttgagcacccggcagaacctgaaactcttacccgctgcatttattgatgtg

SEQ ID NO: 49952 - DNA, 286 bp, Triticum aestivum
  Clone ID: PAT_TA_49952
tgaaagtgttcataccaacttcacccatgttggtgttggaaataatgtgatggctatcgttagtataatttttaatctactcatagacatgaatgacatagatggacctaccagaaataattcggcatacaaatggatgaaaactagcatgacatctacaatgaagtaaaccctggttgcatagatgagaacatggcaatctgatggaccaacaaaatattcgcgtggtgaatttccttacagcgggggtgctcaagaaaatgacaatcactactggaatttttct

SEQ ID NO: 49953 - DNA, 362 bp, Triticum aestivum
  Clone ID: PAT_TA_49953
ggtctcaggtctgggctgcgctgcgctatggcggaggccatgcttctctaccagcttcactattggagggcggctggggaggaggaacccgctgatgacgtggaacctggagaggaacagctggatcacctgcttgatgttatgtgcgtactggctgcagacggacctgaacgcgatcggctgatgtctgatctgatgacagtcgccatctagcattcagctgatcaaaagctacagcttgactgggctattattatacagcatctgcgatgagattgcccacttacgatgaccctcaggtttgcaatacaagtgctggtgtggacatacacatactactcatgaagaaaggtaagcttgag

SEQ ID NO: 49954 - DNA, 381 bp, Triticum aestivum
  Clone ID: PAT_TA_49954
acccacccttccgcccactcgtcctatcatatttctttttcttcattaccgtcttaccatccccacctgatcggactctgagcctcatcatccatggcgaacacctaccccgtcttcagcgccgagtaccatgaagccgtcaagaaggccaggcagaatctcctcgccctcatcgccgagaagaattgctccccactcatgctccgcctcgcatggcactcggacggtaccttcgacgtttcttatcaagacatgcggcccgttcgagtactatgaataatccggctgatcaagcgcacaccgccaacgcgggcctggacaataactttcagatgctccatcccatgaaagagaaaatccccaccatcttctacacctatc

SEQ ID NO: 49955 - DNA, 213 bp, Triticum aestivum
  Clone ID: PAT_TA_49955
ggactttttagttctttgccagaagagtcattaagatcgtcgtacaagttctcatcagttgcttcccgatttaagcaacaacttcaagccctcatggaaacgctgagctcgacagaacctcactatgtacgctgtgtgaagcctaattctgttaatcgacctcagctttttgaaaatcaaagtgtcttgcaccaacttcgctgtggaggtgtt

SEQ ID NO: 49956 - DNA, 448 bp, Triticum aestivum
  Clone ID: PAT_TA_49956
cccacgcgtccggcttggcagagatgtgggatgttctcaatatgatgaaggaagagcaaataagaccagacaaggtaacctgcactaccatgatcaaatggtttctcatcaaagggattgatgatcatcgtgttcagtacctacgtgacctaaaagatgggcgatctacagacaataagtaggtctgaacattaaaacagatactgaacttatgggttctgttctctgcatttttctccaagaagacggaatgacctgcgtaaaggcatcactcagtttgccctttgcaaagaggcatcagtcatattcttctctttgatgcccttaaggagaaactcgagtgttactgaatcaaacatttgtcggtgtcaattcaggggcacaaaattttgtcttagaagttcaacagctgaagtacagaactgtcgggtagcatatgtcggatagc

SEQ ID NO: 49957 - DNA, 400 bp, Triticum aestivum
  Clone ID: PAT_TA_49957
cccacgcgtccgtcctcatcttctgcccgcacccgacgacatcgcgggagaaggaaggaagcatcagggggggagcagcagccgccggcgccgccgtggcctccggcatctcgatccggacggtcgccgatactaacatctcgcgcgcgcctggctcttgtgcggcggtgagggcggtcgtctccttaggcaataaggcttaagcggatgaaaaatctgaggagatctggaacgctgctgatgaatcgatgcctggaggtggtaattcaccaggccgggccttcaaagcagtggtcgggcagcccatagttctttgacactgtgaaggggtcctatatgggggatgtcggtggaaaagaattaattgattatgttgggtccttggggcccggcattattc

SEQ ID NO: 49958 - DNA, 413 bp, Triticum aestivum
  Clone ID: PAT_TA_49958
cggccctctcacacgtgggcccaccgctcaggagcttctccttcctccaagtccggccccccaacacccagaaacccgaagcccgcagccatggccatggagcgacctgtgcggctggtgctggatgcgtccctcctcctcgatcccgtcggtgcaggggcgcaggaggctgcgccggtgcccacgctgcgtcccggggcggaggcgctgctgcggcggctgcgccactccaatctgggcgtggcaatttgccatccggaggaaatgccaactactgtgtcaggctttcttgaaatgacagcagacttgaactcctttgggtatataccactacctgctccaactgggaatcacttactaaatgaattgatgctagaggggagcagaacaaggtcttggttttatggtacttc

SEQ ID NO: 49959 - DNA, 292 bp, Triticum aestivum
  Clone ID: PAT_TA_49959
tagactcgtatgctatcaaattgagctttatgatagtgtcaagcgggtcggaaccaatggaagaagaggaaacaacgacaccgattgactgactctctaagatgagttttaggagtacacagagacggctgggacgctgcgcgacaccaccaccaacgagagcatgctatggctgtacagcctgtacaatcaggccatcgtctgcccagtgaacacaaaaaccatccggaatgttcgacctcaagggcctggccaagggcgactcctgggaaatctgtggaaaagaaattta

SEQ ID NO: 49960 - DNA, 343 bp, Triticum aestivum
  Clone ID: PAT_TA_49960
gggaagagatgatgctgatgaggccgcggttcctgtccccctcgccgccctcctcccggcgcgagccccggctccgcacactctacgaggcttccagaggctgctcgaactgctacccatgctgcgcccggcctcccgggcccggccgccgcccctgctacaacaagcgcccgccgaccaacctccgacgattcaccggccgcatggtggacctcacccgccggatgcagctagcccagatcatggcagaggtggaggcgaacaagcggcgcgcgcgctcaggaaggggagggggtgacaacatcatcaggatgaacgccgtgctggaggcctgcgtgagctg

SEQ ID NO: 49961 - DNA, 318 bp, Triticum aestivum
  Clone ID: PAT_TA_49961
ggagactgcaccttaccacacgaacgaccaacagatggctgtgtctgccagcagcggccacgcgtgatgccgtgaaacacctggggatggtcctgctcaaggcggacgtgaccccacatcggctggacggtctgatccgacgctacccccagcatcaccagatggctgcatccataaatgacttacgctgcagaaccgagctcagaatccagaacaatcgtcaggtgttcacacaccacttctagtctacttttgaaagcacagagcgcgtaagggactaccaatacgatccacttcacctagagccagaaactgatc

SEQ ID NO: 49962 - DNA, 103 bp, Triticum aestivum
  Clone ID: PAT_TA_49962
aggtttcgaaaactgtatttgcatcccctagccgagtaaattttcgccttgatcaaagaaaggctgtggaaacaatacctgcatattccaacatttatatttt

SEQ ID NO: 49963 - DNA, 379 bp, Triticum aestivum
  Clone ID: PAT_TA_49963
gtcctatacaggatgtaatacagactgatgctgctatcaaccctggtaacagcggaggcccacttcttgatagttctggaaacctgataggtgtaaatactgctatatactcaccttcaggagcatcatccggggttggcttctccattccagttgatacagttggtggtattgtggatcagcttatacaatttgggaaagtgacgagacctattttggggataaaatttgcccctgaccaatctgtggagcagcttggattgagtggagtgcttgtcttggatgcccccccgaacgggccagctggcaaagcgggtctgcaatcaacgaaacgggatgcctacggacgacttatccttcgggacataaatactttttg

SEQ ID NO: 49964 - DNA, 126 bp, Triticum aestivum
  Clone ID: PAT_TA_49964
agcaatgggacagcgctctgtggcgagtgatacaccccctgtggtgtggcattaacccccagggtggccgttacaattggcagcgcgctagctacagttgctttcgctttattgccttcttttttc

SEQ ID NO: 49965 - DNA, 457 bp, Triticum aestivum
  Clone ID: PAT_TA_49965
gttgagaaccaggatgaggtatatctcccagagtggatctacgagaaagtattcagcaggcacgaatgggagcttactccagaaatgacagcagaagacaaagagaagatgagacagctgactattgtggggctgtggtgtatccagtggaacccaaagaaccggccttcaatgacaaaggtggtaaacatgttaacggggaggttgcagaacctacaggttccccctaagccctttgtgtcatatgaaaatcaacctagaacataaggcaccgagaacatgctgccatgatttggtgcatattgcagacatgcacttaagtccatgtgttgcacggaatgcatagcacctgattatatgaataatcggccatccccatgtaatagtactaccagccatatgcaagaacatatgagaaccacatcgaactttatttggattggaacagctaaaaata

SEQ ID NO: 49966 - DNA, 351 bp, Triticum aestivum
  Clone ID: PAT_TA_49966
tgctagcaagatggaagcgacatcgtgacggaaggccccaggtgcagtctacggagtcggaaggtacgcgatgataaaaaaatcatacagcagtcatactctgctgtaacattttcattcttttatagtgttatctgtttgcattgattcaaattcaagtaagtcgcatcggtttgtatggatggatactgcaaccccccattgccatgtgcagtatgcctgaaattagtcgacaaacgcaccttacatcgtgtgacaagccctgaaattaaaccgcaaaaattgctgctgcaatttttcatcgatttcatgattcatatttggtaaaaatgtagtgcccgcccctttttt

SEQ ID NO: 49967 - DNA, 204 bp, Triticum aestivum
  Clone ID: PAT_TA_49967
gcctgctcctagcacggtatatacctacatagaacagccatcgccaccaccgtgacggcctcggacgccacctacctggctcctttccaggggctgaagcccacctccgggctcctcgtcagccgccaggtgcagcggcgctagcctgcgccgcctcagctgcggtggaaggatcacgtgcaagcaggacacgcccactgaggg

SEQ ID NO: 49968 - DNA, 347 bp, Triticum aestivum
  Clone ID: PAT_TA_49968
gcaaaggattcagaccaccgcctgttgcaaagggagctaccaggcggccggtgcgcagcacttccgtccggaccggttaagacaatggtacgggcccttgggggcgcaggcgccgctaacacgggttgctgcgggcggacgccgcacgcctgcgatgttagctagtatattgacttatagagcgtaccctataatctgacacactgaagctcagccccactggctattccatcaagcgccaggacaagacgcgtgaatacacgaccgatatgataatatgctgaaacactatcgtgacactggcatgagccggatccaactaacttgtctgaccacactatatatcc

SEQ ID NO: 49969 - DNA, 369 bp, Triticum aestivum
  Clone ID: PAT_TA_49969
tgtatccctctcatccccatccacatgtgcttccacagatatgtgcagtcgttgcttcaacgctgcagagccagcgggatttgccgcgctgggagagccggctgtccggcgagcgccagcgggatttgtgtcaattttgtggctgcatgcagtttccacagcatctctttccaccggagcgcccgcagcccgatctcctcccctctcctccgttttccacagcatctctttccaccggagcgcccgcagcccgatcccctcccctctcctccgtgaccaatctgtgtagagtggagaagaaagctcatcagctaacataaaaaaatggaggaactcgtatggcgtatggggcctacatgtagtaacgta

SEQ ID NO: 49970 - DNA, 295 bp, Triticum aestivum
  Clone ID: PAT_TA_49970
agctcctccatgggtttcttctatggctgtttcatgtgccgacgttggcgtcatcaccatggtagtcgggatcgacgacatggccgccgccgccgaggacgccgaccggattaccaatcctcgctgctaaaatctctacatcgatgaccactattgatcgcctccatggggtgacggacattgagatccagttccttcagatgaacggcaacgcgattggtgtctacctaaatgtcaacggaccgatggcccatctgcgggcttacacagaggagagccagtatgatgggcgact

SEQ ID NO: 49971 - DNA, 375 bp, Triticum aestivum
  Clone ID: PAT_TA_49971
gcttggttgccattgccggccgctcgcagcctcgagttcttggatcaattacacgcgcagaccacgccacccgttggaaatccacgagctctctcgacgccgtgtacgggaagccagcaagccaatgccgctgctcgcgccgggcccgagcgcgctctgccgggacctataccgcgccgccgcggcgcgggagcaggcggtcccgacctacgtgacggcctgcttgaccgtcggcggagcgcgggctgtggggctgcggtgaggcgagttttgtgggggggctagaacaggaatacgtagggtgagggctgatgccgcctacttgtgggacgcgtcggcgcctggggagatgggcgagatcgtattgatgggaca

SEQ ID NO: 49972 - DNA, 368 bp, Triticum aestivum
  Clone ID: PAT_TA_49972
taatcggactcccggccgcccccgccgtcgccgccaacatgaccgaggtctgcgtcaaggccgccgtcggccaccccgacacgctcggcgactgtcccttctcgcagagggtgctgctcacgctggaggagaagaaggtgccctaccagatgaagctcatcgacgtcagcaacaagcccgactggttcctgaagatcaatccagagggcaaggtgcccgtgtataacggtggtgatggcaaatggattgctgattctgatgtgatcactcaagtcattgaggagaagtacccaactccatcacttgttactcctcctgagtatgcatcaatgggatcaaagatcttctccaccttcgtcacgttcttg

SEQ ID NO: 49973 - DNA, 336 bp, Triticum aestivum
  Clone ID: PAT_TA_49973
caccaccacagccccactctcagagagcacggacgccggacacgcacgagtcttcttgaagcaatggcgaccaccgcgatggcgctctccccctcgtccttcgcgggaaggcggtcaaggacctgccgtcgtcggcgctcttcggggaggcgcgcgtcaccatgcgcaagaccgcggccaaggccaagccggtgtcgtccggcagcccgtggtacgggtccgaccgcgtgctctacctcggcccgctctccggcgaccccccgagctacctcaccggcgagttccccggcgactacgggtgggacaccgcggggctgtcggccgaccccgagacct

SEQ ID NO: 49974 - DNA, 322 bp, Triticum aestivum
  Clone ID: PAT_TA_49974
ccgactcgtgcacggacgcgcgcgttatcctctgccggagaagcgcgctcaggtgccaagtgcgcggttagatagatcggtggctgcctccactctgtgctccccatcggtaaaggacctactgcgctgcatttcctgtacctagtgatgtatggtatttctcatggcttgtgtcttgtcgtagtgtgcacaaccacatcttgcaccatgaatgcaggatctcatgactgtaccacagaggcgtctccagcgtgtgctgcgacttgcaccatgccgtcaccaactgtctcgctgcacgaccggagatgacttaaattctatg

SEQ ID NO: 49975 - DNA, 161 bp, Triticum aestivum
  Clone ID: PAT_TA_49975
ccgccgccagattccggcaatccccgtggttccccaccacctagctctgctcctggaggaccacctctggccgctcaccatgtccactgcaccgggtcctctcctagcccaggagagccatgtctcaagcactgctggaggtgcgctgcgcggaggtccca

SEQ ID NO: 49976 - DNA, 240 bp, Triticum aestivum
  Clone ID: PAT_TA_49976
ccgagaccttagaagacacgtgggtggttgtagcgcatgatctgatttgctactggcttcaagtactccaagatattgacattacgacgactacagatcaggagcgcacgaactatgatctgctgggcacggggttaacacctacatatcttcagagtattctgacacggagggcgttgcgcacggccgctgactgcacgacgaagtcaaggccggaacgagcaatgctctcacgcatgg

SEQ ID NO: 49977 - DNA, 277 bp, Triticum aestivum
  Clone ID: PAT_TA_49977
ggaatccatccacggccgatgcggccgacgcgcgcgatgcgctcgagcgggatccagacgaagggcgcgagccgcgcccggcgacgcgggcgatccctccaggtggcggcgtgatgagcatgcgattcgacagggatccaagggaagtgcgcggcgctgccggccgcgaccaccacgactcgctcgagcgggattccggtgcgggaggggatcgacacaaggcgaggcatcctgcccggatcgagccgatgcgacgtgcgtgaggatgcggcgcggc

SEQ ID NO: 49978 - DNA, 381 bp, Triticum aestivum
  Clone ID: PAT_TA_49978
cttccctactacaacaccatggccacaactgggatggcttcctcggccacctgcgtcagcacccttgcagggtctcaagatcaccgagggcctgcccgtcagcgcgcacgatgcagcaaagccggcctccgcagagcagcaactgccgaaggatcaggtgcatgcaggggaggccgattgaggtcatgaagaagtagaagaccctgtcttacttgtcacccctgtgcacggaggccttcctgaagcaggtctactactagatccgctcctagcgggtgccctgcctcgagttcaacaaggatggctctttttagcgtgagcacaacagctgcggcgcgtactacgatgaggcatactggacaatgtggaagctgtctatgt

SEQ ID NO: 49979 - DNA, 293 bp, Triticum aestivum
  Clone ID: PAT_TA_49979
atatgttggttttggtatctcaataatacaagttgctttgataacatggtaacagagcccaggttttagggtctccattgcacgttgcaactcgtgctgctcgaattgagttttttttcctggtcttccttcgatctctacatcgatttcttggtcgtttctcctgaacgctcgcagctgccctactgctgttttcggtcttcgaccggtttggatctgctgctgtacgcgtgtgacgcttgctgatctgctgctccagatcgagccttcatccgccgtctgtacagttcgta

SEQ ID NO: 49980 - DNA, 415 bp, Triticum aestivum
  Clone ID: PAT_TA_49980
cccacgcgtccgcccacgcgtacgcctcccctgaccccgcagagctccccaacccaaccgaacccaacccaaccagaccgatcgaccggccgccatgagcggcggcggcgccggcgacacgctggacaagctggtggtggtcctggcgaagcgcgacggcgtggacaagctggggaagacgtaccagtacgtgtccaagctggcgcactgggcggcggagacgtcgcacccggggctggccgggcgcgccaagagctgggagacggcggccgggctgagccgcaaggtgttccggtcaggccggtccctgacgggcttcaacgcgctgcggcggtccccgggggagttcggcgcgctggcggtgctggccaacgccggcgagatggactacttcttcttcgaccacgttacgtgg

SEQ ID NO: 49981 - DNA, 432 bp, Triticum aestivum
  Clone ID: PAT_TA_49981
aagcttggtagctagcttgatcaatctgatcacccacaatggctgttaaatgtatacttctgtttggtgtcgtactagtgtctttcctgcttctctgccaggatggggtagatgctagagagctcaccgaagctaaacctaaagaatccgaggagaagaatatgaaacctgggtatggaaacaatgggggaggatatggaaacaatggaggatacggaaacaacggaggatacggaaacaatggcggaggatatggaaacaacggtggtgggtaccagcatggtggaggatacggaaacaacggtggtgggtaccagcatggtggaggatacagaaacaatggtggtgggtattggtggaggatctggaaacaatggtgggtatggtggagggtctggaaatcctggatatggcggtggctatggcaatcct

SEQ ID NO: 49982 - DNA, 442 bp, Triticum aestivum
  Clone ID: PAT_TA_49982
ccaccgagatggcctcgacggccacctgcgaggctcctatgcaggggctcaagtacaccgacggcctccccgtaagccgacgctccaacagcgctagcctaggcagcgacagcaacggaggaaggatcaggagcatgcaggagtggcccatcgagggcattaagaagttcgagaccctgtcctacctgccaccgatcagcacggaagccctcctcaagcaggtctgactaccacgatccagctccaagtgggagcgatgcctcgacgacagcaaggcggggcatatgacccgggagcacaacgcatcccgtgggtactacaaacgccggaactggacaatgtggaagctacctatgatagggagcaccgacgccacgcaggtcatcaacgaggacgaggagggcaagaaagagaaccctgacgcgaatgtccgcatcatcag

SEQ ID NO: 49983 - DNA, 440 bp, Triticum aestivum
  Clone ID: PAT_TA_49983
agctagttcatcaatcacctcccaaccaattatccatcgatctatccctgaaatggctggggagaaaaacgaagtgaagctgctggggatgtgggcgagcccgtacatggcgagggtgaagctggcgcttaacctcaagggcgtgagctatgagtacatggaggaggacctcgccaacaagagcgagttgctcctctgctcgaaccccgtccacaaggtggtgcccgtcctcatccacgacggcaagcccatctgtgagtcccaggtcatcgtccagtacgtcgacgaggccttccatgccgcggccaaggccctccttcccgccgacccttacgagcgcgccgttgcccgcttctgggccggctacatcgacgacaaggtgttggggccatgggaaatggtcttgaaggcgaagacgggcaaggagagggcggtctggg

SEQ ID NO: 49984 - DNA, 360 bp, Triticum aestivum
  unsure (1)..(360): unsure at all n locations
  Clone ID: PAT_TA_49984
ccggnccggaanccggggcgacccagcgnccgcggacgccgggccncacaaaggggaaaggagagnagaaggcgaggcgagcggggggggcgccaaaccgccangganccnggaccccggggccgcnccnccncaccnccnccccgccgccgccgcgaggcgccngcagncccgcnacgancngnacanggggnacgacgacgcggacgccggcggggaagaggnggaggcgcgcggggcggacgccaacaacggccccaagggcggcgaggacgacgacgncgacgggcccggccgccacancgacgaccagcacgccggcgaggccaagagcggggcangccccaacngagcaacaag

SEQ ID NO: 49985 - DNA, 480 bp, Triticum aestivum
  Clone ID: PAT_TA_49985
gtgccgtaccggaacggaattgtcgacccacgcgaccggtcctgagaattcttaattcaacagctacatggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacg

SEQ ID NO: 49986 - DNA, 365 bp, Triticum aestivum
  Clone ID: PAT_TA_49986
gagcgtcgttgcgccgatgcgcgccactgcctcctgtcccgcagcgggctgcaacgatgagactctgtgcgcgtgccggccggagggtgtcgctgcagagggtggtcggccatggccatatcctccgcgccgtcgatctgcgcggatgtgagccttttcttgttctgctctttttgtttgtagttcaagaatgatcaattcttcgtgagattcgtgtgagcgcatatatacatacagggtgaacaatccattgttagatcactgtttgaccacaagaaaacatgatctaataggcaaagattaaaatagggaaacactattagttttcctgatcaaggcctttaatccttggatcgttggggatc

SEQ ID NO: 49987 - DNA, 435 bp, Triticum aestivum
  Clone ID: PAT_TA_49987
cagaaccacaaggtctcaagagaaagagagaatggcggccatctcctccacctcctacttctcctcgcagccggagctgccggcgtccagcgccaccgctacagccagcatcagcaaaggccggcagccgcggaggcatcggacgagcggctgcgtcatgctcgagccggcctccggtggcggcgcggtggggaggaggaccaggagcctcacggaggaggacctggaggagctcaagggctgcctcgacctcggcttcggcttctcctaccatgagatcccgggcctctgcgggacgctccctgggctggagctctgctactccatgacgcggaggttcctcgacgagcagaggactctggtcgggcagctggagcccgccgcgtcggcggcgccgcccatcccggactggaagactccggccctggtgatgat

SEQ ID NO: 49988 - DNA, 442 bp, Triticum aestivum
  Clone ID: PAT_TA_49988
cggacgcgtgggcggacgcgtgggcggacgcgtgggggccgccgccacactccgccccgccctcctctcctcctgcgccctccgccggctcgcctccgcctccgcgccgcgcgccccccgcctcgcccagcccaaggtgcaggggttcgcccgggctcgccggtcctacccggccgcgttcgccgcctccgccatgtcgacgtcgtcgggggccaaggaggcgccggccaacaacccgggcctgcaggccgaggctgacccggccaccaagggctacatcatgcagcagactatgttccgcgtgaaggacccaaaagtgagccttgacttctactcgcgtgtgatgggcatgtcgttgctgaaaaggttggattttcctgagatgaaattcagtttgtattttcttggttacgaggacttgtctgcagcccccgctgatcct

SEQ ID NO: 49989 - DNA, 446 bp, Triticum aestivum
  Clone ID: PAT_TA_49989
cgaccactcaaaaaagaaaaagcgaggagcgacgggctaggtcgctccgccgcgccgcccaccgcctcctccgctccgccgcgtcgggcgccaggcgccgtatccgctgcggccggtcgcggcgtcgagcacgtcgaagcgttccccgcagtctcgtcacctagcttctatcaacggaagcaaagtgctctgaagtccgaactgctgaacctcttgtcaactccagcaaactagcagagccttctatcaccaaataaaagggttgtgatgtcgctgcgacagctactgggatggtcagatggagaggtgatgcggccggagtcaaagccctgctcccgactgatgcgccacactgctggtatcttctcagttggtggtggccttgctttctgggtgctttgccgccttcactatggtccaaggataacggttccaaggagtctcag

SEQ ID NO: 49990 - DNA, 430 bp, Triticum aestivum
  Clone ID: PAT_TA_49990
gacaaaagcagagcagaccgaaatatagagaggaaagcaaggccggcctcgaatccacgaccgacacctacgatcggtcatcatcagcccccgcgcaccgaccaccgttccctgccgtgccgacattgcacgccccaggccgataaggctggccctgtcactacgacgagccaaacaggcctgaccaggtgccgcacggacagcccggatgcgagccctggcgccacagcactaccggccagaccgacaatgctcacccgcgggaccgcgaggaccgcgtccgatgtgccgacgctaccactgaagaagcaccggatgcctacggagggcaccatgctgagcctgacgatcaacaacaaccggctgacgtggatcctacagcgagtactgtgactcatggaggcggtgcacagagtgtacagctgaggcc

SEQ ID NO: 49991 - DNA, 450 bp, Triticum aestivum
  Clone ID: PAT_TA_49991
cccacgcgtccgagcgctctgactgatcttaagctgcggctccgagactggctcgctggttagcccgtcggaccatccctccatgacgccggaggtgaaggtgccgctgctggaggggcggggcgccacgcccgcacagacgctggggaacatcgtcgtgtccatcgtcggcaccggcgtgctcggcctgcccttcgccttccgcaccgccgggtggtcgccggcgccctcggcgtcgccggcgccggcgccgccaccttctactgcatgctcctcctgctggattgcagggacaagctgcgggagcaagaaacagaggaggacggactcggagttgagcagcgctgccatggcggcaactacacctacggggatctgggcgagcgaggcttcggccccatcggtaggtacttcacggaggccatcatcatcatcggccagaccggcggg

SEQ ID NO: 49992 - DNA, 453 bp, Triticum aestivum
  Clone ID: PAT_TA_49992
atgatgaggaaaataacaacctggaggaagacgatgcccatcagatatctcatgctgacacggatcaggatgaccgtgagattgatgaagaagaatttgatgaagatctgctagaagaagaagatgatgatgaggaggatgaggagggtgtaatccttcgcctagaggaggggatcaatggaattaatgtgtttgaccatattgaggtttttggggggagcaacaatgtttctggggatacactgcgtgtaatgccattggacatttttggcacaagacggcaaggccgtagtacatctatatacaatctgcttgggagagcaagtgaccaaggtgtacttgaccacccactcttggaggaaccttcgatgttacttccacaacagaggcaaccagaaaatttagttgagatggctttctctgatcggaatcaggaaaatagttcttcccgtt

SEQ ID NO: 49993 - DNA, 460 bp, Triticum aestivum
  Clone ID: PAT_TA_49993
cccacgcgtccgcataaacaaacctgaacccagcaaagccgccgccgccgccgccgcaagaacgacacccctcctccccctgcagagcgaccgacggtaccaccagcctccttcgtccgccgccggcccgggctaggagggccggcacggcggcgcggccttcgcccgcatctccagatttcgcggcaaccaacgcgctcgggcagattcactcctcggggcatcgaccagggagatccatccgcaccgcacggcagcaggacctagatgtgacagaggattgaatcagcaggactaggcctggctcgcatgctccaacatgctccattctaaggagacactgaggaagatgtactcagtcgccaagggctactactgcggggggctagcctctcccaatccttttccagtgttggatctcaggcaatctctcagctcgtcaaggaaagcgccggggtac

SEQ ID NO: 49994 - DNA, 242 bp, Triticum aestivum
  unsure (1)..(242): unsure at all n locations
  Clone ID: PAT_TA_49994
agccaaagaaaataacaacccgaggaagacgatgcccatcagatatctcatgctggggcggatcatgatgagcgaggccatccctgttaacaagaagaataataaggaggcggcggcgaggaatatnattaggangatgaggagggtgtaatccttcgcctagaggaggggatccactggatctaatgtgtttgaccatattgaggtttttggggggagcaacaatgtttctggggatacac

SEQ ID NO: 49995 - DNA, 438 bp, Triticum aestivum
  Clone ID: PAT_TA_49995
agcaagtgcagatcggatcagaccagagacacagagcagagcggataaactcgagggcagtagatcatcaccaaccatgtcgtgctgcggaggcaactgcgggtgcggatccggctgcaagtgcggcaacggctgcggagggtgcaagatgtaccctgagatggacgagggggtgaccaccacctcccagaccctcatcatgggcgtcgccccctccaagggcaccccgtcgttcgaggccgccgccgagaccggagccgacaacggcgggtgcaagtgcggctccaactgcacctgcaacccgtgcacctgcaagtgatccatcaaatcaggacaaggagatggcatggcatggatggacctaatgaaggagcactagtagtagttatgcatggtgtgtgcgtttgtgttctctttttaattgccgccgagaataag

SEQ ID NO: 49996 - DNA, 141 bp, Triticum aestivum
  Clone ID: PAT_TA_49996
cccactctttctcccactcgtcctaccccattccgccctcttccatctctaatttctacacagtgggcgctctctctaaagcagctcaccatcctcatctccatcaatttcaccatccatctctctaccaatacttctttc

SEQ ID NO: 49997 - DNA, 253 bp, Triticum aestivum
  unsure (1)..(253): unsure at all n locations
  Clone ID: PAT_TA_49997
ccccaattttcccaatgtctctctcttataaccctgttacnatcctgaggcaaatggataggcggacaatctggtggtctctggattcatgatttggcgtcgggcgggcgtctggtcctctatgtggaggctctgctgctgctttgtgangtgtcggagcgactcatttgctgatcagacaacgggaggctcgcgtccagtgaatgataagctggcgttaactccctcccgtacagctatttttttctgcatc

SEQ ID NO: 49998 - DNA, 300 bp, Triticum aestivum
  Clone ID: PAT_TA_49998
gggccggaaattccgggttggaccacagccgtccgaagccaccctggccaggaggaggaaggaagcaccccccccttcaacccgattgttttttttcacgtggggacgcttcccagggcccgatttgttgccatggcggtagcaacccgaacagcatcaacagatcccgcctcccttgcacagaaattgtgcaagcaatcgacgaatggttggaaatagggttgtgaaagccaactattcatccaacaatgttggggagaagagtcatgtcccttcagtaaataaccttcttccaataat

SEQ ID NO: 49999 - DNA, 351 bp, Triticum aestivum
  Clone ID: PAT_TA_49999
cgattccgatcggaatcgcaactagccccgccgcttgattagccggcagccggccccgtccccatggcgtccaagcggatcctcaaggagctcaaggacctgcagagggatccccccacctcctgcagcgccggccctgtggcggaagatatgttccactggcaggcgacaatcatgggtccatcggaaagcccatatgctggtggtgtatttttggttactattcacttccccccagactacccattcaagccacccaaggttgcatttaaaacaaaggttttccacccaaatatcaacagcaatgggagcatctgtcttgatatcttgaaggagcaatggagccctgca

SEQ ID NO: 50000 - DNA, 369 bp, Triticum aestivum
  Clone ID: PAT_TA_50000
acaactcgttcgcctactcgacctatacatctctgacctgctccagctctagctcgcagacctgcgcgctctcctacatgcagcgcaccatcctggtctccatccagagcgccatccagctcgcgaccaagacggcgtcctcgtcgtcacagtggaggttgacgaccgcggaactgggagggctgacgaccccgctgctggccggactggcaacctgggtgccgccgtcactggagagcaaggtggcgccggccatggagagcggcaacatggacttcttcaacttcggcatctacgacacggagggcaccgacgtctacggccgccacgacagggaccacttctaccgctacaacgtgatgctgtact

SEQ ID NO: 50001 - DNA, 255 bp, Triticum aestivum
  unsure (1)..(255): unsure at all n locations
  Clone ID: PAT_TA_50001
caataaacttacaggggcgcaaacggaggtgaagatatagctggtnggatataattttaagctgtgtccatacaccatgcggtgcaggagctccggtggaagagtacgttcgacgtttgcaatgggttcgcagactgcaggaaatctggaacaaacaggtcgacgttcatttgctattctatggttagtgatcgcgcgaagactgcagccatgcactggatgctcttcgatattctgtactaactgtgctatgag

SEQ ID NO: 50002 - DNA, 393 bp, Triticum aestivum
  Clone ID: PAT_TA_50002
aacaacaaaacatgaaaaaaaaaaaccctaaatataactgataaaaaaaatacaaaaactaacgcgggggtaaatggcacaaaatcttctccccacacatactaacgctgctcaccttcccatgatgcgccatctcatctctgctgaactggaaaggctgatgtcctgtaatagagctgccttgtcgcgtccgaccaccatctactccacagttttcctcgtttatctcgtattcttcaatcacacgggatctatgccaacctgccttttatggtctatgcgccacatctatgcatatgtcctacttactacataatgcccaatactgcggcggtgataatgatactccgctggttggctgctactcatgtagaccggatttgcatgcttctt

SEQ ID NO: 50003 - DNA, 327 bp, Triticum aestivum
  Clone ID: PAT_TA_50003
cccgatcgatcctcacatctctctcgccccaccccccacactgcgcgcccccgccgccgcccgcgacgtgcgccgccgcccctgatccacgcgctcctcgcccgcctcgagggcgagctgagcagctcgagaagggcgtggagccggcgtgagagaagctggtccacccgctcgagcgcatcgtcgaccggctcgacgtcgtctggaacgtcgtcgaccacctcaaggccgtcaaggactcggccgacctccgcgccgccgtcgaggacgtccagcccgagaaagtgaaattctatctgaggctggggcagagcaagcctatctacg

SEQ ID NO: 50004 - DNA, 102 bp, Triticum aestivum
  Clone ID: PAT_TA_50004
gaccctaatgacacgttacggtccacttgctgatcatcatctgatgcgatgggcctatactgagcgggatgatattgacgccatatcagcgttgccatatcc

SEQ ID NO: 50005 - DNA, 331 bp, Triticum aestivum
  Clone ID: PAT_TA_50005
ctgacgcatagggaagagagacggccgtggtcagcgtctcgctgaacagcagcctctacctgtcggcctctatatgaccactacgggggcgcagccatctacatctcatcccaaaataggagaacgtcatcgcacccaacgtgggcgagaatgcaggcggcagcagctgctgactccatgaacattctgatcatggggagcaccaggtgcatcgtgactcttgctctccaagaaactcgtccagcagggacaccaggtgacattgttcaccagatgaaaggcacccataacccaggagctgccaggtgaatcacatgcagaggatgcagag

SEQ ID NO: 50006 - DNA, 370 bp, Triticum aestivum
  Clone ID: PAT_TA_50006
cggacgcgtgggccaccacgcgtactccgacccgttccatgatggcgtaccagaattcaatattgtgcggcgggttctcgtaggtggtagagtacccttttagccatggcgtggagcgccgccgccgccgtctccaggttcgccgcctacccggccgacgagatccgcctgcccttctcagcagccgccgccgcctacgtatttcttcgccgggcgccgccgtttcctacccgaggcctagtccctcgacacctacagcaccgttcaaaaggaggctgttcagacggagaaggcgccagcaacactaggcccctactgtgaggcgaggaaaggaaacaattttgtgtttgtcttgggcgttttttggcta

SEQ ID NO: 50007 - DNA, 364 bp, Triticum aestivum
  Clone ID: PAT_TA_50007
gagagatccttggtctgcagcgcccgagccgagcgcgcgcagccgcgaagatgctcgacatgcagaagcggcgcgtccagcttctgctcttcgtcgccggcgtgctcgccctcagcatgacaggcatgctccccgatccgccctccgtttttttctccaattactgttaaccagttcgtcgagcgagcaggtgaatacttcttcgtagagcggcggatcgctgcgcgcgcttgcgcgtgtggtttatggcgcctttcggtctttgattcggcgattttgtgtggtgggggctgtttcctagtgaaaaagtgggtgcgcatttggctggtttcgagtggggatgcgtctgatctcgggtttctga

SEQ ID NO: 50008 - DNA, 345 bp, Triticum aestivum
  Clone ID: PAT_TA_50008
caaggcatgggtttctgtctctcaatcatataagctagatgatatttggagaagcatgatgaatggaagggagatctaaagaggagaaagaatttgatgctgagaagatgagcagcatagagctgacagataaattgaaggaaatcctagggacaaagagatacttgatcgtactggatgatgtgtgggcagccaaagtttttttcgaaattaaacatgtttttgttgatgagcacatgggaagcagaataataatcacaacaagaactaaggaagttgcagcagctcatgatggctgcatgaacgaaagggagcctcttgacgagaagaaggcatggcttttat

SEQ ID NO: 50009 - DNA, 239 bp, Triticum aestivum
  unsure (1)..(239): unsure at all n locations
  Clone ID: PAT_TA_50009
gacgccagcctgtcagcccgccatgccgccgcgctcacctccaaccccccttcttccggcccggtcctcccctatccgccgcggccccatccttctatngccgcgtggcgccggcaagcctggggcggatgaggaggcaaaaagaaccctttttgcgacttcagcggaaaggtgaagacaccaagtaatgataccggcttccatcgcgggaacaaggccctgctgccgaggagggaaag

SEQ ID NO: 50010 - DNA, 279 bp, Triticum aestivum
  Clone ID: PAT_TA_50010
atcgccattgcgttgcttcacgtaggacctgttgagtttatctactactggttccacagggggcggggaccaccatttcctctactcccgctaccactcccaccaccatgccttcatcgtcacagagcctataacagctgtcatccatccatttgttgaaaccttagcttacttactgttattgtcgatccccatgctgataccaatttatatgggataaggttctgtcttgggtggtggcctatacctggcttggcacgacttcataaaaaatatggg

SEQ ID NO: 50011 - DNA, 306 bp, Triticum aestivum
  Clone ID: PAT_TA_50011
accacccatccttcccttttcattctccagaaaaaggtttactcacacatctccgactggctaacggtgtgctttccatgaaatctaactcccttacgcccactaatcaatgccatcacaccgacactctaacgctcaacccaccaataccgatctactactactacccgtactttgcaaatacagaacttacccacaacgaaaacatgctcgcctaatcccgatccagtgtcatccaacgaaaatgaacaacttgcatatcactcacatgaccaaatgtttcctctgaataataatactcatgcc

SEQ ID NO: 50012 - DNA, 348 bp, Triticum aestivum
  Clone ID: PAT_TA_50012
cccacgcgtccgctccttcctctcgattccgatcggaatcgcaactagccccgccgcttgattagccggcagccggccccgtccccatggcgtccaagcggatcctcaaggagctcaaggacctgcagagggatccccccacctcctgcagcgccggccctgtggcggaagatatgttccactggcaggcgacaatcatgggtccatcggaaagcccatatgctggtggtgtatttttggttactattcacttccccccagactacccattcaagccacccaaggttgcatttaaaacaaaggttttccacccaaatatcaacagcaatgggagcatctgtcttgata

SEQ ID NO: 50013 - DNA, 385 bp, Triticum aestivum
  Clone ID: PAT_TA_50013
gatcgatcttcagctcccgcgaacctccctcgccgtcaaggttatccaaactgcaggtgggtggggtcgatcggaggaaggggggagaagatggacgcagagcaggagtcgcagtgggcggcggcgcaggggattggcatcggcgaggacctcgtcccagccgcgctgcggcacctggagttcctcgccgcggtcgaccgccgccggtggctctacgagggcccgctgctccacagggctatacacaggtacaaagcttgctggcttcctcttcttgccaagtacactgaggcttctgttgcagatgagcctttggttgttccgcttgattgtgaatggatatggcactgccatcggcttaatccgactcagtacataaaggact

SEQ ID NO: 50014 - DNA, 106 bp, Triticum aestivum
  Clone ID: PAT_TA_50014
ggcgcccgcttctccaagtggcgcacttttgtcagcattcttaatgtcccatctgagcttgcgccgagggtattctgccgggggtcttgcccattacgaggccttc

SEQ ID NO: 50015 - DNA, 315 bp, Triticum aestivum
  unsure (1)..(315): unsure at all n locations
  Clone ID: PAT_TA_50015
ntcaacctatcccttcaagccctctcaaatgctgaatcgcatgctgctaggcaacgtaagctgggggcgggtccaaactatgcacagcccccaaccttactttctttattgcacgccaaccctcaaatcttacagccatcgcttcaagacccggaaaagcaccaccctgctattttgcaggtgatccactgacaacccagcagaggtactctcgttgacatcaatgagccatctcaggcagactaatacgataatctactcagcagttcgtcaaggagtgccccataccataacttgttctccttaacaaaatga

SEQ ID NO: 50016 - DNA, 335 bp, Triticum aestivum
  Clone ID: PAT_TA_50016
gttctgctctactcaagctccaatcctctcctacagtccaccaccaccgtgctctatatcccccatcgtgccgtagcttcccttcaccgccgcgcctcacccacccaactcctccacctctcacgctcatctcgactccatcgccgttccccttctactcccgtcgcgtccctgccgtctccaccccgtccgcggtctcgggcatcgtttctttcgatctgacactgaaccttgggttgggtcttgcagtggagttggctaacgggaggagggagatgagccgtgggaagtctccggagccgcttgatttcttcatatggactgtcgaggatgtc

SEQ ID NO: 50017 - DNA, 391 bp, Triticum aestivum
  unsure (1)..(391): unsure at all n locations
  Clone ID: PAT_TA_50017
gggcagcagatgcaagatgggctcagccctggcatcactgtagaacaggagagggactccgcagccttcactcgataggtctgaaacctgtgccgcatgctttgcttcctgcaacgagagctcaggtctgtacaacgatatgcttctgctggatgcagctacgcgtagctgccaatggctaacatcacgtccggttgatcatcatgtccgagttgtgcaacgctgcagctaaacgtgctcgtccctgtcccgctatttgatgtcagaaaacaataatagtgatcgaacctcaaaagctagaaggcatctaacagagaagagggttgtatgttcttatgtatgattctacaaaatngattgttgcgcgtgggagtagaatattgatagaatg

SEQ ID NO: 50018 - DNA, 338 bp, Triticum aestivum
  unsure (1)..(338): unsure at all n locations
  Clone ID: PAT_TA_50018
gcccacgcgnccggngagaanncnnaanncaagagnnanagggagggacccangncaccacagggggaaacnaaagcaggggggggaggnaaagccggngnnaaagannataaanngacnnacaacaccccagaggangaaacnaagganaccganancgnggcagcannccgaggaagnccacagccaggggnaccgcccgaagaagcaggggcnngcagagcagccgaancnacaacaggnacanggacaacagnnnggacngagggacncaccagacnngancgnnacaaaggacgangcnancacancgagccgggggcgggggaagacagcca

SEQ ID NO: 50019 - DNA, 253 bp, Triticum aestivum
  Clone ID: PAT_TA_50019
tcctaaacccgcctctctctccctctttcacacacgcctcttcctcttcctctctctgtcggcttccatttcctcttcttctagctagcttgcttcggtgcccggcggagttggggcacgcgcgcgcgcgcggagatgtctgaggcgtcggtggtaaaccaggcggaggtggaggacgcggcggcggcggcggcggccgggctggacctgtcgccggggttccgtgtccaccccacgtacgtggttaatattt

SEQ ID NO: 50020 - DNA, 474 bp, Triticum aestivum
  Clone ID: PAT_TA_50020
cccacgcgtccggagcaatctctgatgcttatatatactagcagtaacgtgtagtattaggtatggcaaagtaaatttgcttcaacaatcaattccagcgcagcaatttttttatgggatttctcttgcaatctgcactgaattttgtacgccgatgccagtttgatggttttgctttgaatggtcttctcaaggaaaccgtgttcaatttgtgtgttttgctttgaacgagtctttctggaaatctgtatgtgtacttatatggctggttggaattgtgcaaattgtgatggtttgctttctatgagcaactacttgaatgctgaaattttatacagtacatatcatgtcaacaacatgtatctctttttatttcacatgtggatagagaagttgccatacattgttgtccccttggcaatagtatgtaattctcaaattaacttgctatctttgctcagtagcatttaatat

SEQ ID NO: 50021 - DNA, 401 bp, Triticum aestivum
  Clone ID: PAT_TA_50021
ctctcgctggacctaacattttactcgactattccggttctcgtaactatcttaggggaggtaaagctcagctaggtatcctcactacgattgatgctgatgtacatatcccacgtcacgggtacataatcgctacgaatcctattgtcatttacttcatgataatactaatggctcacttagaaccaagtgagggaatcatggctcactctaccatatacgtgcatgccaatgcatattatgctacacgctctgagctatctatgtgtgcgcgagccaggcatcctgaggttccagtaacaaagggccggccggactctattatccaagcgatagccacgcgtcgttcactttgataattgatccaatgggctaggtaaattgaatttacctgcccctac

SEQ ID NO: 50022 - DNA, 450 bp, Triticum aestivum
  unsure (1)..(450): unsure at all n locations
  Clone ID: PAT_TA_50022
gttattgtgagaattcttaattcaagagttattaggggggggcctaatgtcaacaccaaccaaagcgtaaggcagtggtggatttaaaggttgttttaaaaattattaattggcttactacaccccaaagtatggaacttaaggttccgatattttggcagcattccgaggaagtccttaacctggggttccgcccgaagaagcaagggctgcagtagctgccgaatcttctactggtacatggacaactgtttggactgatggacttaccagtcttgatcgttacaaaggacgatgctatcacatcnagcctgttgctggggaagacagccaatggatctgtgatgtatcttatccactagacctatttgaagagggttccgttactaacatgtttacttccattgtaggtaacgtatttggtttcaaagccctacgtgctctacgttt

SEQ ID NO: 50023 - DNA, 329 bp, Triticum aestivum
  Clone ID: PAT_TA_50023
gaaacacgctcaaaagatggcaagagaaaggaacccattgagggatcgagcaaaagcaacagggaccgctggaaacttctatgcagcatttgatcagttgcttatggagctggcatacagggctgacatcctacttgacaagctgcatatcacccggtctgtgcacgtgctggtgatctatgtgttgagctagaagatgatgacgaaaaccatctcatgttacttgaggaggatgaggacccatgtattcacctactctcgtatttgctgaagcacagacagacatatactgaacgttcatctgttggaagatatcttggaaaccctgc

SEQ ID NO: 50024 - DNA, 388 bp, Triticum aestivum
  Clone ID: PAT_TA_50024
cggacgcgtgggggttgattcccatcgatcggggaaagaagatgggtgcggatgtggagagatgcagcaagaaaaggaccatggccgccgatccgaccagccgagacgatcccttggccaagaagaagaagaaggtggtggatctggggagcgacagcgacgaggacttgcctgatccgtcacagtgggcgggggttaatcccgattccttcggcgatgactacttggccaagatggaaaaggccagactcgacgaagaatcagctccccgccctgtgaaaattgccacgctcgactactacaaacctgccaccaggtttcacaccgtcgagcttttccccgtccgtcgatccggaagcaaggccgtgctccttgctgcgaaatttct

SEQ ID NO: 50025 - DNA, 408 bp, Triticum aestivum
  Clone ID: PAT_TA_50025
gtattggaagtgttggattggatagctctgcaccgctgcatcaaggattcaaggccgggatgaagtcacttaggggctgcttctctatggttaggaaaagagcaaaacaacaaggtaatctgctattcctagcttctattcatattttttgtgatttaaaaaaaatagtaaaacgtatccccgtattggcacttttcaaaaatggctaatttaagtatccgtatcctagcttctttcatgtaagactattcgtattgtaattgagcacatttggaatatatttcctgaactaaattgttgtgagatttgaattgagctattcatgttatttttttgctatatattgtatgacacttggattaggtagaaaaaaatttaaagtgtgcacaccctccattttattcctgg

SEQ ID NO: 50026 - DNA, 130 bp, Triticum aestivum
  Clone ID: PAT_TA_50026
gccggctaggccaccgtacggaccccggagcagcacacatggcatccacgatcagggccgccgtcttccgcgccgtggtggccaatacccctttcctcagcggccagggccgcgccgtcagctccacccc

SEQ ID NO: 50027 - DNA, 312 bp, Triticum aestivum
  unsure (1)..(312): unsure at all n locations
  Clone ID: PAT_TA_50027
cgaaccanttggtactatttatgaaagcttcaatttgatttctataacaggcatcatcgggctgagatacatattatacctgacacctttacgcgcacacccctttgattaaataacttcatgacatatatacattacccgacatcaacccaatgaccataacgtactttccaggactgttcactcaatactacatcccatatgatccgcttgctcatgaggaacgatcataatagtaaatcatgaacaacatcactgatatcatcttcaattgctcataaagaaggcataggacaaccatacactcctaca

SEQ ID NO: 50028 - DNA, 388 bp, Triticum aestivum
  Clone ID: PAT_TA_50028
gaaaattcaaaacaaaatatttctgtcgatgggcgcatgatgagctatgtctgacgactgagtggccttatgatgctgcgtgctcagcaaagtctgatgaattggatagctgaactgggagacggtccgtaagtgcattgctagaataatctcctatcgggtgagctccagctgcacctacgagaacgtaaatgcatgactagcagctgaggaactcaccgccggaatggtagtatgtgatgaaggaggacttgtttctcccaggataccatttgaagtgaaaagcatcttgctgactagattcgcaaacggtgtgtgtgttcgatatatatgcgttaacttagcagtatgcgagcactagattgtgacataaattgcattatcaacc

SEQ ID NO: 50029 - DNA, 363 bp, Triticum aestivum
  Clone ID: PAT_TA_50029
gcgagccacgcggccgctatccttctcccctctcgcgcacggcataccatattccctaccgcacacaaggcgccgcgccgtacggagcgcggtgataatatatttctttatcaagcaatctataatgtcgtcgacgcagctcatatgggctggtgttagctactcgtggccttcattaacaacggcctgcgcctatctcacacgtactcacatagggagtgctcattctaacgctcgtcttgtaagctcgttgaccaagctatcactgtaatcacccccaagtatacaacactcaagccacttggatactgacatcttgagaaggttagctcacttgaagaaaataccattggagggaatata

SEQ ID NO: 50030 - DNA, 333 bp, Triticum aestivum
  unsure (1)..(333): unsure at all n locations
  Clone ID: PAT_TA_50030
cacacgcctaccttaccgagtacatctacggagaaaggaaaagatatcttaccggggcggtttcttcntggatctcgtctaggtcctttcctatttcctatcacatctcttcctttttttcattatctttttttatttaacctatttattacctttattgtttttttacttttttttttatttttaaatttaattttattttattttactccatttttttttaaattatttttaaaacttttttatattttatataaattctcttattttatatctattttttttttttaattcttcattttttacattttttaatgggtttttatattttct

SEQ ID NO: 50031 - DNA, 315 bp, Triticum aestivum
  Clone ID: PAT_TA_50031
cccacgcgtccgctgacgctgggaaatataacaagggagacacaggttgtgggggctctgtttatcatgtgctgagacgggatcgagcgataggaacatgactggagaaggatattattggaagctgggctcaccccatcaaatgaatctcagggtcgggagttagatctgttattgagcgtctacccttgaacactgccatgaaaattacgaagcaatcactgctgtatgtgaataaacttgtatggcacgtgtgctatttggttgactgccagacttataatgtggtgaataatctactgacgaagcgttaac

SEQ ID NO: 50032 - DNA, 398 bp, Triticum aestivum
  Clone ID: PAT_TA_50032
cgccttcccaaaccaaaacgcagcggagcttccaaagccaaaccaaagccctcgtccctgttccccctcctcgttcctatcgccgccacccctcctcccctcgatttctagcacccatcgcgaccctactccccatcccatacccagcctgctcctcgcaccctcgccgccccaatggagacagccgccgccgtgtccgtgcccagatccgcctgccgtgccgcgctccccttcccggcgcccctcaagctccagggccgcgttgcgctcccccgccgggcgctccccggggcgccgaggcagcgcctcgtcgcgcgctgcgcggctgccgacgacagtgcggcggcagagctccccatcgagaaaaggttcgccgccttcccgggcgtcatggacat

SEQ ID NO: 50033 - DNA, 384 bp, Triticum aestivum
  Clone ID: PAT_TA_50033
accacgcgtacgatcaaatacatggctgaataacgataccgagatcacttaccatatcagcgatcgcatttcctatgggatatctatataggaattactatacgatagaacatacactgggtgttcacattatctttgaatgaaacatattcatgaacctaagcatgccctctgtgttgtttaatgagtagatgttatatcaattggatatactagatgtttgacgagatttttgctacagttacatttactcctaattaacatggagttgacagtgttattgagagaatacttatttgaagagacatagggagggacttatgtcacctcaaacaggagctggaactagagttggatttaaagatggtgttaaggattattaat

SEQ ID NO: 50034 - DNA, 396 bp, Triticum aestivum
  Clone ID: PAT_TA_50034
acctattggagttgctgctatcgttgggtggagtccgttggacaattgaggagatccaacagagcctttacagaggtgtggcaatgtccaagggtgccgatatgaagggaaagccgatatattgctttccggccaggtgtgcggacatccaccaaagcaagtcgggcctgtgtatagaaatcaatcatcctcatgcatctcgacggaatcactcggcctctttaggaaagccaccttgtacgtgcatgaaagctctggtcagaagcccatctatgagggcgtacttccacgggaagaactttggagccatgaggggatgtccgagaaatatccaagtaacagtgtcatcgcccgggggaaagaaagacatcgtgaaggatttggtgtagcggtaaa

SEQ ID NO: 50035 - DNA, 356 bp, Triticum aestivum
  Clone ID: PAT_TA_50035
gaacgaggctgccctcgatctattctctacgacgacgggaacaatgccccagccgccatcgcggatctagaggaaccgcagccgagatgctagaggagccgacgccgaggtaatagaggatccgtcgccgccttcattgcacacctcgagggcaccgtcgggacactgctgccgaggtctgccatcgccgacgtcgaggtctgagaggggcatgaccctagggagatcttcgtcgaggttgccgccgccgacgacgtcgcctgcccaaggtgagatcctagggcctgtctcctcctctccttgcagcactatgctctgtcgcgaggctggcggtgggtcgatggacggagaggaaa

SEQ ID NO: 50036 - DNA, 357 bp, Triticum aestivum
  Clone ID: PAT_TA_50036
cgcgctagtctctcgtgtgtctctcgccgtacgcctccgcctcttcccgcctgcttcgggggcggcgagtgcccatggcgacaatgtcccgcgccctcggctcggcgttcgtggggttcacgcggacgccggccgtgccggcgacgacgcccttgccgttgccctcctctcgcgcctcctcggcgctgctcctgcgctggcagcggagccggggcgtcggcggcgtcgtcacgtagcggcggcgcgcggtggtactcctcgggccgcaacgcgaagattagcatgagcctccgcgccggcatagtcggcctgcccaacgtaggaagtccaccctatttacgccattggtgaaatggg

SEQ ID NO: 50037 - DNA, 311 bp, Triticum aestivum
  Clone ID: PAT_TA_50037
cccacgcgtccggttgtgtgttgattagtttgtcccatacacaggtggaaactcttatgtacctgtgtattaagacttatcaggcctacgaccaatgtaagtgcctaaacctatgtttatgtctattcatcagagacctgtacttttcttatatccaagtcacactttttcttaagcttctcgattagcatgacacccatcttaatatccttgtactctatataaccttgctgcgacaaaacagatttatgtataacctatcctgcgcatacaagagaaacgaactaataagttcatttgttatgcacacc

SEQ ID NO: 50038 - DNA, 422 bp, Triticum aestivum
  Clone ID: PAT_TA_50038
cggagccagtgcactgccacctctaacccggagtccgaactgaagaaacgtttctgttcgcttcagactaagtaagttaattgttacaagactttgtttcgagcgatggtgataagctttcatgtttcacgttgctgtcaatgccatcttgtagtttgtcagagggttcgatctccgttaattattcatctatgctatctggggtcttggtatatggcgatgaagctgccaatctagcatcctgcttgctaatacttgttactggccttctgccgatctgttattagttactgctgttatggtactgatttttatggtcataagataactttttcaactagtttgtttactctatttttggggcgaaggcagactggcgctctactgatttcattaagagaacgagtagcaggtccattatt

SEQ ID NO: 50039 - DNA, 401 bp, Triticum aestivum
  Clone ID: PAT_TA_50039
gttagaataagaaatataaatgcatagcactactatagcactaacaggcatagaaaggctggacagcttacgcagtactttccaaatgctcatgtacacccattaaattcgttagagagaatgctagaactggactagaatgaccagcctaaggctcaatagacggatgatgatcatgattgtaagaacaatcctggggatgataaagagccagacccacagttacactactaacgctcaaatacgaggctgagagacaaaaaattaactacgacgacctatggaaactgatatacagagtaaagttgaaataggatgcatacatgctgcgggaacacaatgcatgtgcagagtactataatggcatgtattggacaacaggaaatcatttcaaaaaacaa

SEQ ID NO: 50040 - DNA, 378 bp, Triticum aestivum
  Clone ID: PAT_TA_50040
cccccccgtcctgatccctcctccgctcgcccatcggcgccaggtgtgggcgctctcaggtgggtggagcttgacctgccgggatggatcgcgccgagctcaccaccgagcaggttctcaagcgggacattccatgggagacatatatgtcaactaagctgatcacttcgacatgccttcagcttttaaggcgttatgatcacaaaccagaaagtcagagaggtccattgcttgatgaggatgggccatcgtatgttcgtgtttttttgaatattttgcgaagcatctccaaggaagagactgtggaatatgtgcttgccctcattgatgagatgcttgcagcgaatcctaaacgagcagcactgttctacgacaaat

SEQ ID NO: 50041 - DNA, 426 bp, Triticum aestivum
  Clone ID: PAT_TA_50041
cttcctagccaaggtcgagtgaggtctccaactctccattacatacttccccacccatgcaccaaaggcgcagagaggggagaagaagaagaagaataagcggagggggaggaagatgccttgcctgaacgtgtggacgaacgtgaacctggagggggtggacacctgcgccgtcctcgccgacgcctgcagcaccgtcgtaaccatcatcggcaagccggaggcctatgtgatggttgatctcaagggttcagtgcccatggcatgtggaggtacccaggagcctgcagcctacggcgagctggtttccatcggagggctgaacgctgatgtgaacaagaagctgagcgccggcattgcttccatcctggagtcaaagctggccatccccaaggccccgttttacctcaagttccacgattcaaa

SEQ ID NO: 50042 - DNA, 339 bp, Triticum aestivum
  Clone ID: PAT_TA_50042
aacatatatacgtacatacgtcagacgttgtctacatacatatggcatccatggccaccaccgtgattgctttgcaggggatcaacgtcactcctttcctggggctcaagcgcacctccaacctccctggcatccgccgcttcaacagcggtggactgatcaggggcatgcacggggggacgatcaagggcatgcagaagtgggcgatcctgggtatcatgacaccggtgaccatggatgacctgctaacgctcagcaagtacgtgatcctctagcagggggagtacctgatccagttcaagagggtggcttgcatcttgctcgagcacgacggattta

SEQ ID NO: 50043 - DNA, 426 bp, Triticum aestivum
  Clone ID: PAT_TA_50043
tccacttccccaacaagcgctcttctccttgggcaatcccgcggtagcgagctcgatcggaccgctggggtccatgcccatggcgctcctctccgccacctcccccgccaagacgctcttctgccacgaggagcagtacccagcgcagagcggcctcctcctcttggtcacaaacaatatttcgtctcctcagacgttggtggtggtaaaatgcagtggtatgcatttcacaaggaacctgctggtggtactgatcctgagaatggcaaaaagaaaagactgctcgagatatttagcggttggtgtgataatgtcattgatctgctaaatgcaactgaggaggaagcaattcttcgccgggatatatacgatcggccacctactatcaactgggggaaaggtcgtgtcaccttgcttggtgactct

SEQ ID NO: 50044 - DNA, 400 bp, Triticum aestivum
  Clone ID: PAT_TA_50044
gctagcgcggctactgctccggagcgcctccccgccccgtgcgctgcgcccgcttccgtccccgagccgccatggccgtcgccggcgacgccgcccatttccagaaggtgcggatccagcgagaggacacgaccttcgatgcctatgttgtcggtaaacaggatgcccccggagttgtagtgttgcaagagtggtggggcgtcaacaaccaggtcaagaaccatgccacccacatctcccaaatcggccatggatacagagcgcttgttccagatttgtaccgtgggaaggtcgctctggatgctgccgaggcttggcatttgatggaagggctagactggcagggcgcaatcaaggacattcaagcctcggtgaaatggctcaaggaaaatggatcacc

SEQ ID NO: 50045 - DNA, 423 bp, Triticum aestivum
  Clone ID: PAT_TA_50045
cccgtgtttatttttcccaccaaacaaaaggactagccaagcgctcggcagcctccgcccaccccacgcctgcgcccgcgcccgcggcgatcttgcctccacgtcaccgccccccgccccccgcctccctcctcccgcctccgccagcagcatctgatggcggcggtgttagcggcgcacggctcccgcgtttcggcttcggttttggaagtgctctgagaggaataccaaaaggattttgtcctcgtttttacaatatccaagcatcaatatgtaatggacttgttcataggaggaaaattcctcttccgttgagatggtcttttcgctctattcaagcaagaaataatcactcaccatcagctgttgcacctaaagattattgtgaaacttacatccaatttttgagaaacaaacggatag

SEQ ID NO: 50046 - DNA, 405 bp, Triticum aestivum
  Clone ID: PAT_TA_50046
cccacgcgtccggttgctctccctctccctccctctccccctctctctctctcttgcgcgctggcgttgcttcccttctccgtgtgagcgaggccaccagcggaggagggctgtgctgaagaaggctgcgccagcgagagcttggtgactgggtgactgaacatcagtctggatatctggattaatgtaatataggtatattagataatacgaaatcggaagtccactctactgccgcagtatcagcaggagacactggaatggctgaagtcaacttgttgcatggtgaatctgacacatcagctaccggtttactgccagtgtcattcttgtcatgcagtcctagatctatgggtccaaaatcaattccgtcatcatctggccttgaagctatcctgacaccta

SEQ ID NO: 50047 - DNA, 432 bp, Triticum aestivum
  Clone ID: PAT_TA_50047
cacagtgctgggcacgccgcgacgagtcggaggggaaagatcaagatggaggcggccacctcgaatccgtcgagcaagaggatcgccctggtcaccggagggaacaaaggggtcgggctggagacgtgcaggcagctcgcgtccaaggggctcaaggtcgtgctgacggcgaggaacgaggccaggggactagaggcggtcgagggcgtcaggcgctccggtgctgacgtcgtcttccatcagctggatgtcaccgaccctgacagcgtcgcccggctggcggatttcgtcagggatcagttcgggaagctcgatatcctgataaacaatgcaggaatttcaggcgttgatcgagatccagttctggttgcgaaagttaaagaacaagttgaaagcatggatgtagatcagcgagttcagtggatgaaagaa

SEQ ID NO: 50048 - DNA, 383 bp, Triticum aestivum
  Clone ID: PAT_TA_50048
ggccatcgtgaaccaaaaccttgccaagatggactacgactactatgcattcttatcgggggacgagtggacccttaatgagaaaaggcttgcattcttgcatatcctggttctccatcagctactgttggacgagtgtgccatgaacatgagctgatttgtcctgctaaggaagatatacaaacccatcataaatctccctaactggttctagaaaatcgctcacacgccacgagagtaccccacacgccgggcgggagccgcagccggatctgtgatgactcttgcatgccgggcttcattcagcggggacgaggtccacctcactgcaccgcgaattccgttgttgcagctctacttatacaacgacacgaacgtggtgg

SEQ ID NO: 50049 - DNA, 238 bp, Triticum aestivum
  Clone ID: PAT_TA_50049
cttactcgtccgcaaatgcaaacgcaatggaactgtcgaacacgtagagagcatcgatagtactctgaacgctggacagatcgactttactgatgatggctaggttgtcgttagcctgacctatgtgtttcttcccagcgacaagggtaagctggacgcagagatccaagttgctgcttacaactgctgcttgaacaagggcagcgcttacaccgtggataacgatgctgagatgctt

SEQ ID NO: 50050 - DNA, 133 bp, Triticum aestivum
  unsure (1)..(133): unsure at all n locations
  Clone ID: PAT_TA_50050
ttcccacccaactacccncgtctacctaccttctaccctcatccatccgcccaggttccatttattgaggtggttttattaattgatcctccaccgtcaccaccaccgccttgtataaaggaggaatggcttc

SEQ ID NO: 50051 - DNA, 336 bp, Triticum aestivum
  Clone ID: PAT_TA_50051
gagattctctgttgagaaacatcacacgacgcgggactagctgtagggagaaccactactgtccgggtaaacaaaacagaaccaacggaagcctcatcatctacatagaggcatgcatgacgaccagaactgataagcctatgaccgtacaggggatgtccaatatcgtgttcataccggccatgaatgacacttaaactaagaggcggggagttcgagcccaagacgacctacgcgcgtgatggagacagagaataagacgacgattcctgacaagcaggggaccggactacggcttcgggagaggatcggctccttactccgcaacatgatcac

SEQ ID NO: 50052 - DNA, 375 bp, Triticum aestivum
  Clone ID: PAT_TA_50052
cacaggagagcaaactcatctcgccccatggttccgcctgcaggttagctgatggacacgagcacaaggccggtcgcagcagcttcatctctccatcattcagcggcgaagcatctggccatcttggctcataggaacgtggttaacaggaggtacctactaactctactggcatccgccgcagccatacctgaggccggagaatcaagaaaagccctattgcaagattatgtgaagaaatcaaaggaaaacaaagaaaagaatgacaaggagaggcgggacgccgtttacaaaaggaattacaaggattatttcggtttcatggaaggcccggttagagagaagccagcggaggagctcacagagtccgagaaa

SEQ ID NO: 50053 - DNA, 344 bp, Triticum aestivum
  unsure (1)..(344): unsure at all n locations
  Clone ID: PAT_TA_50053
ggggagagccacgcgnccgcccccgaccaccgccgccgacgccgcctactactctcggagccctctccttccggggagagcttcagccatggggaaggagaagactcacatcaacatcggggtcattggccacgtcgactctggcaaggcgacgaccactggccacctgatctataaggttggaggcattgacaagcgtgggatcgagagggccgagaagagaagccgcgaaatgaacaagaggactttcaagaacgcatagggtgcttgacaagctcaaggccgaacgggagaggggtatcaacatcgataatgccctttgaaaggggaggagcaccaagact

SEQ ID NO: 50054 - DNA, 387 bp, Triticum aestivum
  Clone ID: PAT_TA_50054
cccacgcgtacgctcactcgtccacaaccacctaccctgcatattatacagcgccgccggcggaccacaaacactagtcgacgtcgcaccggccaccctagtcaaccttccaccgatgccgcagccggatccccaccccatgcctccatcgtgctgccctgcgctgtataaatcttctgacacggcgcgctctatacctatgtacccggctcggcctgtacctatgccgccgactcggcccggccacattttgcctataccggcagcagacaactgccgcatcagttagtgagatccgtagggccgtaccaattcgtatacctacaggtatggcaagccgcagaccatgagccacagtgacaccagattggcgcgccacactgccac

SEQ ID NO: 50055 - DNA, 430 bp, Triticum aestivum
  Clone ID: PAT_TA_50055
cttgaatatcacaggtacatactgatggcagaaccagatcatatatttgtgaaacctttaccaaatttagcttttgacaatgatccagcagcattccccttcttttacatcacaccatccgaacatgaaaaaattatcaggaaatactatcctgaagaaaggggtccaatcacaaatgttgaccctatcgggaattcccctgtaataattaagaaggtaattcactgttgttaacttggtgctctatagactgcagtctcatggatgaatgaagctccattccatgtatttggttttgcatgatttgtgtttcagttaccgttttggttagtcattttactgaatctaacttaatctctcgttatatgaggaaagaatagacactgcttgagaagattgctcccacatggatgaatgtatcactagaaat

SEQ ID NO: 50056 - DNA, 415 bp, Triticum aestivum
  Clone ID: PAT_TA_50056
tcctcgtgtacggaactcaacctcgccttcctcgtgctagcctagccggttgggtgggggggtaccaaaccctcttcctctccgggtctttcttcagcacagcgcgctagtactaactacttctagcacggaacagaacagcgcagtatcgaggatcgacattaatggcgtccaagggcgagagggatgtggagatccacgtctcttccccgccgcccgacgaccgcgacgccgccaggcccttgctgcccgccgcctgcgaggcctactccgtctccgccgcaatcctccccttcttcttcccagctctgggtgggcttctctatggctatgacatcggggcaacatctggtgccaccatatcgctcaagtcccccacatccagtggtacagcatggtacgacctgtcatcagt

SEQ ID NO: 50057 - DNA, 283 bp, Triticum aestivum
  Clone ID: PAT_TA_50057
ggctcgcttacgtgaacggctccctacgaaaccccgaacagagatcaagacaatgaggagcggtaggaagaagttggctggaccagggccagaccctgtgagtcaacggggccacatggtacctgagctcatgactggtgaggaccttgctgggcccggaacctccggcaacaatctaagcggaagcacccagccaaagcggccgctcatgctatcgtcgtgcagacgggaatgagcggctcatgtggtgtccgtgcgcgcatggagagtgaaacggagctta

SEQ ID NO: 50058 - DNA, 242 bp, Triticum aestivum
  unsure (1)..(242): unsure at all n locations
  Clone ID: PAT_TA_50058
cctgtccctttccattcgttagggtttattagtatcgtggaagaggaaggaatagcggaggtccattaccggtgggtcgtccccnacctctcctattccaccaactaccataccctccagaacgcctttttcaattaccgcgacgtcatttaatcctatatcttatttctcagtatactgtcaaacatatctcttctcattctatacttatcatattctacttatctcctcttctttttatt

SEQ ID NO: 50059 - DNA, 378 bp, Triticum aestivum
  Clone ID: PAT_TA_50059
cagctcggaaacagagcagagagagagagagagaaaccagcagcgaatcccacacaggatccggggtcccttccttttcctacccccgatcgaaacagagagctagctagagagatagatattcccgcgaatcttctgctccgattccaagcccgtcccggtctcggtcccgtcccacgccccctccctccgccttcaatccttcttcatcggtaccagagcacccctgcggcggcggcagttcgagtcgaatcgctcctcctccttcgtcttcgtcaggcatgtgcgtggagggattcgaggacgcgcagatcgagaggccggcagatttcgcgatggagagagtctgtgagaacacagtgtccattgatttcaagc

SEQ ID NO: 50060 - DNA, 331 bp, Triticum aestivum
  Clone ID: PAT_TA_50060
accaaaaccctccaccgccttcgaccgactacctagagacgtacgctcatggatgacgagggatccgactgcgcagggctctttacgtcaacgccacactgcagtccttctcttccgagcatcgacccaggaaacggccaccgcgcgcatcccgaccgcctagatgtcggcatacctatgcataggcgtggaccctcccacctgcgatccgggggcgacggctcgggcacgcaggacggctggagcgaccgccccgcctgcacgctggtggacgcctagggtgtgcattttgtccgactaggtcatggcatcctatacgacttgcagtggc

SEQ ID NO: 50061 - DNA, 183 bp, Triticum aestivum
  Clone ID: PAT_TA_50061
accaaaactctccatcccatactactctctacctacatatctcccctcatacaagaggagttttccgactgggcatgcccccttacctcaaccactatctcctctccctctattccgatcatcgatccactaaacgtccacatctcgcatcccgaccacctatattttgtcatacctatccat

SEQ ID NO: 50062 - DNA, 424 bp, Triticum aestivum
  unsure (1)..(424): unsure at all n locations
  Clone ID: PAT_TA_50062
cccacgcgtccgcccacgcgtccggttccgccagccgtacacagcacaccactgcccggctgcgtggtcctctctcgcgcggcggccatggcggacgcgccggtcgagctgccgggccggctcgccatactgccgttccgcaacaaggtgctcctcccgggcgccatcgtgcggatccggtgcaccaaccccagcagtgtcaagctggtggagcaggagctctggcaaagggaggacaagggtctgatcggagttcttcccgtgcgggactccgaggctgcagctgttggttcgatcctgtcgcctggcgtgggcagtgattcaagtgaaggaggccgcangtcgccttgtggttctgcgggagagtcgaccaaacaggatgcaaagagtgggaaggagcccattcactggcacagcccgggag

SEQ ID NO: 50063 - DNA, 461 bp, Triticum aestivum
  Clone ID: PAT_TA_50063
ctcatccacctcaaaatccatctctctcttgctccctcacaaaatccgacgagctccggccggccgttctcctctttcctcttggatccccatccccctccggcgacgagctccacacacgccgcagccgctgcatccccatcggctttctcccctggcagtacatacggctgcagctcgcactgctgcaagggggcggggccgagaaggagcggagtcgctgttgtgaggttgctgctgctagccatcaacgccatggccgccgcctccccctcatatggtcgtggtcgtggcgctggagcaggcggtggaaacgatggcctccggtgctacaaccgattttttttgctggagatgacggtgcaagtcgacgacggcagcgagccggagacgaggacgtcgggatgctgcaaccatggtgatggcgctctggacccttcttgttcgagctgcaaccatgg

SEQ ID NO: 50064 - DNA, 378 bp, Triticum aestivum
  Clone ID: PAT_TA_50064
accagggagcctcgacatcgccatcgccatccccatcgcgatttcatcgtcccgtcgcaggaaatgccgccgccgtgcccgaccctctgccgcctccccgcgactaacctcggcctcccttggtgcccccggtccatacctttccctcgcctcgctctcgccgcgcgccgcgccagggccgtcgctgccagggcctcgtcatcctcttcctcgccggactcctccttcggctcgcggatggaggattctgtcaagaaaacgctcgccgacaaccccgtcgtcatctactccaagtcgtggtgctcgtattcaatggagggcaagggtctcttcaagcggattggcgtggatccacatgtcatcgagctcgaccagctc

SEQ ID NO: 50065 - DNA, 452 bp, Triticum aestivum
  Clone ID: PAT_TA_50065
gcacttgctcctacaaccggctggtataggcacaagaggcccatgtagcaaagaaggactcgagcgtggctgactcgctgacacgctgccggcgacaaacggtagccgacaacctcgccgagctcataccgtctctggccgtccagaagcggttactaggtgccgcccgccggctcgcagaggcgacagtaccgtgggtattggttcccagagtggcacctgccggccctggcgggtggccgtgaccactgcgagcccaagccaacagacatcttcctggtgagctgccccaagtccggtaccacctggcttaaatcactggccttcgccaccgtgcatcgagatgtacacccgccgtccagccgtgagcaccctctcttgcacaaaaacccaagatggcttgcgtcaattcatcgacgcaatctatcagcaaccggtcgacgttgcacggg

SEQ ID NO: 50066 - DNA, 452 bp, Triticum aestivum
  Clone ID: PAT_TA_50066
cggacgcgtgggcggacgcgtgggcgtgcatcgacagctaacaagtggtagatttcatggaccaagtacatagctgcacctgcacgaatgccaattgattgactggcggccatcttggaaaacatctgcccgcaaagtgtatatataagaatcaatggagtggagccaaggatctcagcagggaaaaatattgtcagacgctcagacacctccagttccttcaggattgccattggttggcaagggtgaaaaatcggatgtaacgtcgttatgcataatagcattcaggttcacactgttgagcagtgtgggcaatttactagtggtatttcattatgatggtaccagcaaagacacaagtgagctgctaactggcacaattgagcgctttacatcaagctcaatcatcatactggtgatagccatggaaaagttactccaggatcttctaa

SEQ ID NO: 50067 - DNA, 421 bp, Triticum aestivum
  Clone ID: PAT_TA_50067
ccgagtactaacatactccttgctagaaaatggcctccctctcttcgctcttggtggcggcggttttcctccttgctggctcagccttcttctaccgctacgatacaggcagcggcaacaagactagcgccacaaccaccacacacctccacttttacatgcacgacgactacactggaccacgccccaccgcgatgcgcgtcgtgtccgggcgggctatatccaccggcgacgacgctacagcgctgaagacggcgccgcggcagttcggcgacatcgtggtgctcaacaacgcgctgacggtggggcccatcggcggcagcgcgcgggtgggcacggcgcatggctgggccgtccgcgtgtcggagggcggcatcgtatcggacctgacgctgcacctggtcctcgaggccggcgagca

SEQ ID NO: 50068 - DNA, 175 bp, Triticum aestivum
  Clone ID: PAT_TA_50068
tctgcctcctactataatgctttctacatacttaacacagtctttgccctcaaagtgatgttctatttactaacctacctctctcctttctatatactaaactacaccgtcatcctccccattactcaacctccaactaccctaccctccactcttcatcacactactaatacat

SEQ ID NO: 50069 - DNA, 590 bp, Triticum aestivum
  Clone ID: PAT_TA_50069
ccacgcgtccggcaaaggattcatgcccaccgcccgttgggaagggatgcttcgaggcggccagccgcggcacttcggtcggaccggcttagccatatgacacagtcccttggggcctcttgcgaccctttcattaagtccttcgtcatctttcttacaacttatttatttttattcttgataatttcactaatttttttagtaaatattctcactatctttatcagattttttattcaatttgtaaaaatattattttaaagaatttttatagaatttctctcatttttataataaaattttttatacattctttattccaatttatcaacattttttttaacaaattttttcttatctttgttatattaatgtctatcaataaattttgtttttatttgtttaatattattttgtcttcattttatataaaatattatctacaataattttattatatattatttctacaatattattataattttatttcaatttattattacatattattttttattttattaagttatttttttaatatcttattaaatttattttattattttttttaacttatttcaattttt

SEQ ID NO: 50070 - DNA, 334 bp, Triticum aestivum
  Clone ID: PAT_TA_50070
ccacgcgtccggcgcgcgacccgccatctggaacgcgccgttggatgttccggccgaagcttttgctgtccgttggtcgacaactaggcctctggacggggcgtcaacatattacaaggggaccaccgccgcattcataggttactgagggagttgcgcaagtttttgatgcccacagtccactttcttggacttgagattgcgccggctctatttgtgagttgtttctgctccaatactaccaatcttgtacctcggtatgtgacattttgtgagctatattttcctatttctgtgcgcatgtagcggtctttcatacattctgacacttact

SEQ ID NO: 50071 - DNA, 105 bp, Triticum aestivum
  Clone ID: PAT_TA_50071
ggcgctgacggttgcgcctatctcacatgcggatcccatcactttagagatccacggcgtgaggctccgcataaggtgaaccactgtcccgctctagcaagagct

SEQ ID NO: 50072 - DNA, 127 bp, Triticum aestivum
  unsure (1)..(127): unsure at all n locations
  Clone ID: PAT_TA_50072
nntcattcntttttgtaccttctcgctctactcagccacttttnacaatgttttgcatcggctgcgcttcttagagtgcatcgatattttccgcgcggtacattctcagatgtcatgatagcatcta

SEQ ID NO: 50073 - DNA, 304 bp, Triticum aestivum
  Clone ID: PAT_TA_50073
cccacgcccccatcctacactagtgactcacttgctcggccctcacgaccttagcctacagatactaaagctgctgagggattgaaagctggtgttaaagatgttatattgacttactacacccaatactatgaaccttaggatactgatttcgctggcagcattccgaataatgcctcagcctgcggttactctcgaagaagcatgggctgcattatctgccttattttttactggtacatggacaactgttaggtctgatggacttacctgtcctgatcgtacaaatgacgacgctatcaca

SEQ ID NO: 50074 - DNA, 299 bp, Triticum aestivum
  Clone ID: PAT_TA_50074
gtgagaattcttaattcatgagttattgggcagggacttatgtcaccacatactgaatctaacgcaggtgttgcatttaaagctggtgttaaagattataaattgacttactacaccccatagtatgatactaaggatactgatatcttggcagcattccgtgttagtcctcagcctggtgttccgtcctatgaatgcaggggctgcagtctctgtcgcttcttcttctggttcatggtcaactgtttggactgatggtctcaccagtcttgatcgttacaaaggactatgctatcaca

SEQ ID NO: 50075 - DNA, 406 bp, Triticum aestivum
  Clone ID: PAT_TA_50075
ccaccccaccgtcctgaggttgatcggagccggagcgaccacgccgaggatagaaggagaagcggcgaggcgaaagatggggaagatgccggtgcggatgaaggcggtggttttcgcgctgtcgccgttccagcagcaggtgatgccgtgcctgtggatggacattacctccaagatccaccacaaggtcttcgagaactggatctccgtcacgctcctcatcacctccgtcgtcggcacctaccagtttgcgatgtggtacaaggagctggagaagctgtcccacagatactaatggtggagctttctccaatatagctgcagtgggaatttccatgttctttaatccaccaaatgtgatttaacattttcagaattccttcctagttgtacccttttgtgtttt

SEQ ID NO: 50076 - DNA, 489 bp, Triticum aestivum
  Clone ID: PAT_TA_50076
tctgtagacttagcgtagcggatatactctagttcgatcatctccaaccatgttgtgctgcggtggctactgctggtgctgatccttctgtatgtgctgtttctgctgcgtgtggtgctagattttctcttagttgtacgagggagtgtacaccttctcccagacctttatcatggtcgtttccttctttttgggctctttttctttcgatgtcgtcgcctttttcttgtttttctttttttttccatctgtatcttgctattttttcacttttttttgtttctttttgtcttattttattatttcttgggatgtttttattgttctgtttatagtttaataagttttttgcatttttttcagcttgtcttcgtttttttttgcttcatgatatactttttctatttttctttatttttaaatttgttttcgtttttttgtatttttctatgttttgttgttttttgttatttttctttttttctttca

SEQ ID NO: 50077 - DNA, 414 bp, Triticum aestivum
  Clone ID: PAT_TA_50077
cccacgcgtccgcatggttcttgggacgatgtcttcaaattgtctgtaactctttatcttgttggaactgtgatatggaatttattttcaaccggcgagaaaattatcgattgatatgtatagcccgcttctggttaacgactcatccctgctagtagtagatactgccctgggtggacacaattcattctgcatgcactgctccaactcctgggaagaaagaaagaagcaaagaacagactgccagatctaatatgtaccagcaagcaacagctgcacataattcaggatcttaattttgaaacggagcatgaattgagcacaggaacgccaagcggccggttgtataaggatgtgtagtgtgcaagtgattataggtaccatgtacatatcctgtcatacacgcatagtgtt

SEQ ID NO: 50078 - DNA, 292 bp, Triticum aestivum
  Clone ID: PAT_TA_50078
cggacgcgtgggcgacgcaccaacaacaagcaagttggtttcctcacgaaccgacatgttgcagttgatttggactatccgaaccagaagatgtctcacccgttgccgccgaatcttgggcctggcgtttatcttggggctgtcgagagggcatcatctttcatcacagatgatgtttggaatggaattgatgctggaacaaacccagagacatttgtacgagctgacggtgcattcaatccatagtgctgatgactttgtcatctccacagtcacaactatagttaaggga

SEQ ID NO: 50079 - DNA, 172 bp, Triticum aestivum
  Clone ID: PAT_TA_50079
ggacacttctattctctagaggtagtcagaggcgagcagcctagatcaaaagcttgtgtggcgactcgatcggatctgcagccgacgccggcgaccatggctcgacactaccacctcacggactatcgaattatcgttgggcttggcgtgtgcttcttcgtgggcggccctg

SEQ ID NO: 50080 - DNA, 453 bp, Triticum aestivum
  Clone ID: PAT_TA_50080
atcccatcccccaagtcataaacccaagtcggactcgccttcctcctccccaactactcctctcctccgcgcatcgcatcgcaccgggggtcacctgagatcacatacacattggtgaaggctgtggctgtgcttaccggcagtgagggtgtcatgggcaccatcttcttcacccaggagggtgatggcccgaccaccgttacgggaagcgtcactggactcatggatggtctccacggcttccacgtgcacgctcttggtgacaccaccaacggctgcatgttaactggaccacacttcaaccctgctggtcatgtgcatggtgcaccagatagatgtaatccgccttgcttgtgttcttggaaatgtgacagctggagcggttggtgttgcttacatcaatgttactgactgccatatccctcttactggaccaaattcaattgttggccg

SEQ ID NO: 50081 - DNA, 277 bp, Triticum aestivum
  unsure (1)..(277): unsure at all n locations
  Clone ID: PAT_TA_50081
ccgccacnccccacgcgtccgcccactcgttcgcggtctcgtggggccaccccccttaccccctctgtgcctagtccgttctgctgctctgctccggctgaatacttcccatacatggctcatcactgaatgaggacttctagtacatggcctttaagactctgcaagctccatccggtttagctcggccaggcccttgcatcttctgcccctccttctccaactcttatcgctatcagccttaacctctctcaagaacgcttgcctgattcaccac

SEQ ID NO: 50082 - DNA, 352 bp, Triticum aestivum
  Clone ID: PAT_TA_50082
gaggacgcattgctgtgctcttctatgataatacattctctatatttgacctggtaagtacaaagaagcattagctaacagcctaccatgtcattgtctagctcaagactcattacccacagcacgtgatacttgttgttggagtctgatgtgaaacatatgatttttaaatagttatatgaaacacatttattttgtgcaaaaatttgtgctaagaatatttataagatgttaagtagagaaaaggttggtatattgaataagtgacttgcgcccttctttgatccttattgtaaaccatgcatgttttatttccatttccagtatatatctgatccttttatatttctta

SEQ ID NO: 50083 - DNA, 142 bp, Triticum aestivum
  Clone ID: PAT_TA_50083
tctcatctcttcttccatcctcttccccatctccccacccgcgtgcgatctgtcacccaagaccatccgtgtccagatccggtggcgcatctccccatgtcagccggagcccttggcctggcccttgtcgagtcgctcgcgg

SEQ ID NO: 50084 - DNA, 141 bp, Triticum aestivum
  Clone ID: PAT_TA_50084
acgcagttcgagaaatagccatacgtctgcgattcccagatagttgtcggtatccacaactatggcttatgcgggccaggctcgtgactgagattactttcctacacatactagcttgtatatatacatactggactatcg

SEQ ID NO: 50085 - DNA, 224 bp, Triticum aestivum
  Clone ID: PAT_TA_50085
atcactctcgcttgacagcagagaggaggaggaggagaccatgtcttctcccagcggcaaggtgctcaccctcgaggaggtggccaatctcacctccaaggacgactgctgtctagacatcggcggctaggttgtacaatgtgaccaagtttcttgatgaccaccctttaggcgactattttttgctgttttaaaccgacaaagacgctatcgacgactttttt

SEQ ID NO: 50086 - DNA, 442 bp, Triticum aestivum
  Clone ID: PAT_TA_50086
cccaaccctagcttgcgtacaagccgcctcctggaccaatcctctcgtccatcttcctccggcttgccgacggtggcggcgatccagatccggtgcctagcttggcgagtatgcctagcggaggtgccgttccagcttctgttcgtctcatcgccggcggtctggctgccccggcggacctcgctctgtcctaagagaacaagaactggatggtactcttctccggcgaccagaggtcgacctcgccccattcttttttctacctcaacccgccattctccacatgtcgccaccccaccccgccgacgtcggagaagaaaactccaatctgaaggacacactttctgtactaagtatgatggatacatcggagcttgttgactagtgctacgctcggcaactaccattctgctactgcatgtcaacctgaattggagggaag

SEQ ID NO: 50087 - DNA, 456 bp, Triticum aestivum
  Clone ID: PAT_TA_50087
cggacgcgtgggctgttattgtgagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagaggggtccgttactaacatgtttacttccattgtaggtaacgtatttggtttcaaagccctacgtgctct

SEQ ID NO: 50088 - DNA, 312 bp, Triticum aestivum
  Clone ID: PAT_TA_50088
cagcttaaccacactcatctgatcacccatagctagctagctagcatcttaaggaactagcttgcagctaccgatcgatggctcgtctcaacagcaaggctgtggtggccgccgtggtcctggcggctgtggtgcttatgatggccgtcagggaggcctcgattgttctggcttgcgaaccgttggacttcaagctcgctccttgcctagctgacgcgactgagcggggctcactactcagcttggcgtgcggagcagtccaggaaggtctgtacgaaaacgctcgaagcacgtgagaccggcagatacctg

SEQ ID NO: 50089 - DNA, 282 bp, Triticum aestivum
  Clone ID: PAT_TA_50089
attggtcagaataagctaatagatggcctcaatagtgaagggtttatttttgcaaatagcctgatcaagatctggacaaatgctcagatggctgagcaatcatgggatgggggaatagtctgtaggcgtgacatagtattaatacaagggagatgctattgtacgttacaacctacaataggagatgccaaaccttggcatatactagcagattccttggtatgggtatataccttggtagtttgatatttgaatgtttgaaaaattatttacgatgtgatt

SEQ ID NO: 50090 - DNA, 384 bp, Triticum aestivum
  Clone ID: PAT_TA_50090
ctcacgcgtgcgctacattgtactgtcttgggccccaccgtgatggacttatggcgcacgctccgtgcgcttcttttctgagacctcaaagatgagccgtctgtctgcacactaagcctgcgatacaacggtactagcactggatagagttaacctcggtggaaggatgcaggtgcacacatgaggccaccatagaggacgttaagaaaggtgagaccgtgtgctacttgccaccgctcagcacagaagccctgctcacgcatgtcgactacctgatccgctccaagtgggtgccttgcctcgagttcaacacggatgggttcatcctccgcgagctcaacgcatccgctgagtactattatgggcggtactggacaatgtgga

SEQ ID NO: 50091 - DNA, 447 bp, Triticum aestivum
  Clone ID: PAT_TA_50091
ggatcactcgctaaggtgatttagttggcaaggtttcagctcaagaagaggagtttagctagtagttgcagtagaaaccaacagactagacagaaatataaaacatgaagtagcacccacatatcaaatgggctggagctgaatttttgtgtagatgagttatttgggcatatgagagtgctgctacctcttgagcatgtgttgcttttcccttgaagaggaaagggtgatgcagcaaagtagcataagtatttcccttagttttgagaaccaaggtatcaatccagtaggaggttacgcacaacttgccttatacctacccaaacaaataagaaccttgcaaccaacagaataaaggggtgtcaatcccttcacatccacttgaaaaagtgagatctggtagagataataatataaatatttttggatttttatgatatagattgg

SEQ ID NO: 50092 - DNA, 403 bp, Triticum aestivum
  Clone ID: PAT_TA_50092
cgcgtccgcaagtgcagatcatatcataccagaccagagacacatagcagagcggataaactcagagggagatcatcaccaaccgaccatgtcgtgctgcggaggcaactgcggatgcggatccggctgcaagtgcggcaacggctgctgagggtgcaagatgtaccctgagatggacgagggggtgaacaccacctcccagaccctcatcatgggcgtggcgccctccaagggcaccccgttgttcgaggccgccgcctagaacggatgatgcaagtgcggccccaactgcttctgaacccagtgcacctgcatgtggtccatcaaattaagacaaggagtcgccttggacggacctgatgaaagtgctctattggttatgcatggagtgtgatttgattta

SEQ ID NO: 50093 - DNA, 457 bp, Triticum aestivum
  Clone ID: PAT_TA_50093
cgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgac

SEQ ID NO: 50094 - DNA, 456 bp, Triticum aestivum
  Clone ID: PAT_TA_50094
cccacgcgtccggtttcatttactcctaattaacatggtgttgaccctgttattgagagaattgtcaaccgaatagttataggtgggcacttatgtcaccacaaacagaaacctaaaacacctagtcgatcgaaagctgatgatatagattataaaatgacttactacaccgcagagtgtgaaactatggatactgatatgttggcatacttgcacgtaagtgctcaacatgcggttgcttccaaagatacaggggctgcatgagctgccgaatcttctactggtacatggacaactgtttggactgatggacttaccagtcttgatcgttacaaaggacgatgctatcacatcgtgcctgttgctgcggaagacagacaatggatctgttatgtagcttatccattagacctatttgaagagggttccgttactaacatgtttactttcattgta

SEQ ID NO: 50095 - DNA, 454 bp, Triticum aestivum
  Clone ID: PAT_TA_50095
cggacgcgtgggtttatgaggaaggtaaatataactgcaatagcatagcgacagtgtttggatgacagcaaattgatactaacaggtgtgtagatgcacaaatttagtaacatagaactaatagcactaaggttctcagggggtagaggagggttgatgtgagaagaacagacgatatcggcactttcactacttggtaggcttctttatgttatttttgtatgaactggtctttttttcatttggaggtaccccgtgccacataaaagcaaattgtcagccataagtgccggcgcctctgcctgaaaaccataaatctccacatacatgaactcaataaccccacagcagacaagcattctccaatcacataatttatcaaaagtttaaagctgctggttatcccatccaaccaccataagatatgtgaaaggttaggttatccccgtatttg

SEQ ID NO: 50096 - DNA, 458 bp, Triticum aestivum
  Clone ID: PAT_TA_50096
ctgttattgtgagaattcttaattcaagagttatagggagggacttatgtcaccacaaacagaaactaaagcaggtgttggatttaaagctggtgttaaagattataaattgacttactacaccccagagtattaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatc

SEQ ID NO: 50097 - DNA, 465 bp, Triticum aestivum
  Clone ID: PAT_TA_50097
gcggaacctcctggagcaggacaccctcaagtgggtcttcgtcggcggcaagggcggcgtcggcaagaccacctgcagctccatcgtctccatcctcctcgcctccgtgcgccagtccgtgctcgtcatctccaccgaccccgcccacaacctcagcgacgccttccagcagcgcttcaccaagttccccaccctcgtcaagggcttctccaacctctacgccatggaaattgatcccaaggtagaaaatgatgatttcggcaatgaaggaatggaaggatttatttcagaattgacaaatgcaattccaggagtcgatgaagctatgagttttgctgaaatgctgaaattagttcaaacaatggattactccgttgtagtttttgatactgctcctacagggcatactttacggttgctgcagtttccagcaacactggagaagggcctagagaaaatgatggg

SEQ ID NO: 50098 - DNA, 399 bp, Triticum aestivum
  Clone ID: PAT_TA_50098
ccctcgcttgcccctttttctgtccgtcttgctctcccgatcgcgggcgcgaacacgctggcggatgcgctgcggtcaatggccacgccgacgtgcaccacggcctgtaggacggccaccaggctggcctccgtcctctactcccttctgtacgccaccaggccggcaacaagatcgccatcaagatcgtcatccggcacggtcgtcatcaccgccgcgatcaacccgctggtctaccagctggcctgatatcagcgaccatgtcatcgagctcgcgacccagcgaccgatgctgacactgtgatcgactacgtgatcgactacactgcctacgtcacagcatacctttcagaagacagatccgaggagccatgccacgccaccgatgactactactac

SEQ ID NO: 50099 - DNA, 437 bp, Triticum aestivum
  Clone ID: PAT_TA_50099
ctccaccttatcctcacctcagctcagctcaccatgctcgccccccacctccaatggcggtcggccaacgccatttcaaccgcttccttcttcggttctttttcttccaagggaaggttgtggaggtccagaaccggccgttcttccggcttgttgttccccccgacacccacaaggaattggctttgaccacaaattccgcgccgcgctctcaagccggggtctagaaactctccaacaccgtcggggtctccctctgcccccgagggaggaacacattgctggatgagtatggcaaccccaaagtggtgaacaacggtgttaccattgcccgtgctattgtgctagcttacccaatggaaaatgcggctgcagctctgattcgtgaggtggctagcaagaccaatgattctgctggtgatgggactactactgct

SEQ ID NO: 50100 - DNA, 196 bp, Triticum aestivum
  Clone ID: PAT_TA_50100
cccacgcgttggagggcacgcattgcggccaaaataggcgagaggagaggagaggggaggataggggtttcttgaaacccagaggctttcccctacgctcgtttttaatttcctctactatatataggaggcattcgaccctaaaaggaggaataacaccaaggactcattaccatcgcctttacgagatccatat

SEQ ID NO: 50101 - DNA, 280 bp, Triticum aestivum
  Clone ID: PAT_TA_50101
ccgttctacccactcttccgcctagcatgccacactctccagcaccagcagaggccggcggcatatcatcgcatcacagcatcaggtggccatcatcagcgccgtcgcggcgaccaccgtcgtcgtccgtgccgcgatcgcctggcctcaggccctatgtttgccccagctgatgacgaggagcgtgtggttgaggagcatcttctccaaggacgccatggaggctatccctgtcgtcactcgttcgtggggcctgttcgtttctgctcgccgcggttgt

SEQ ID NO: 50102 - DNA, 282 bp, Triticum aestivum
  Clone ID: PAT_TA_50102
ttcttttccgcgcctcttcccccaaactccgcagattctcctcgccgctcttcaatgcggccgttcctgggcgggctccatcgtcgtccgccctcacaccaatacatcgtcccctccccgccgccgtctgcctcggtgtcggcgctggagagcgatattatgggaggattgttgatgttgcctttccacagacgattttgaggaatatgtccattcaaataattctggctatagacattgcatatccctaaggcgagtggttttcaacatgtgtggggggtt

SEQ ID NO: 50103 - DNA, 457 bp, Triticum aestivum
  Clone ID: PAT_TA_50103
gacggccaccgcgggagctcgccgtcgccccgacgagggttctcaaggaatcaagattctgacatagctcccctgaactcagcatgacgccggtggttcattgctctgttggcaccatcagcctgttccacataggcagtttcaggcccagccgagaaatccagataagaaggttccgtggttcagagaggtattcgagagtcacatcgccctcgcgccatgggctgctgcagccacagacaccattccacctgatcagcatctacaaaagaagctggtcctctgccaacaacaggctaaggaccttgtcagcagcagctgttgggaccgatgtcacggtggagggttcggcatctccgtcaggagaaacctccgaggccgcacctgccgctgctgaaactactgggcaggctgtggctagcaagagcccggcttcctcccctcccaagttaggccg

SEQ ID NO: 50104 - DNA, 226 bp, Triticum aestivum
  Clone ID: PAT_TA_50104
ctcccctcttcaaacccaaaccaactcgacgcgcacgcgcccccccgtatgaccaccaccagacgcagctcgagcccgaccgacgcggctcggctcagcagtcggcgtcgtctcgtctcccccctcccaccttcaccatcccgcccgcccgatcggatccggccagatcccgcgccggcggccatggagatcctgttctcgctcgtcaacaagctgcagcgcgcct

SEQ ID NO: 50105 - DNA, 413 bp, Triticum aestivum
  Clone ID: PAT_TA_50105
ctccgtttcccgccgcctccgccctctgccgccgtagccgcagccatgggcgcgtacaagttcgtgtcggagctatggaggaggaagcagtccgacgtgatgaggttcgtgcagcgcgtgcgttgctgtgagtacaggcagcagcccgccatcgtccgcatcaccaggcccacccgtcccgacagggcacgccttctcggttttatggccaagcagggttatgtggtctaccgtatccgtttgagacgtttcggcttggattctgcccagtgcccatgggtattgtttatggcatgcctaatcaccagggttttacccaacttatgttccagtggtacaagttgtctgttgctgattaaagagctggtcacaggctttttggttttattgttctcatctcctactgggtgtat

SEQ ID NO: 50106 - DNA, 240 bp, Triticum aestivum
  Clone ID: PAT_TA_50106
accttcttcgtaaggcacgagacaagacagagctgcacaggaaaaacacaccaccgttataacgtaacagagactgaaagaagcattgtccaaactatatgaagacctgccttaaccaggctgcctggaagccgacgccccccattgcttgtcatgcgagggctcggactaccttacctccaactacatctggtcctttgcgtccatggtgcaatgccagactcagctggacatcatgaa

SEQ ID NO: 50107 - DNA, 234 bp, Triticum aestivum
  Clone ID: PAT_TA_50107
attggcgcggctgtcccggacggcctcctgagctcgcctatggccggcagaatcggccaatgccaacgcggccctcgtcgtcccggaaggggtcctgacgagcttgccggactcggcgacggacggcgtgggcgcgggcggggacgccataccggacgagctcctatccgcgctgaacctggacgcgtacagcccggcggtgcgcgtggcggacaacgcgctgtgccggatgga

SEQ ID NO: 50108 - DNA, 362 bp, Triticum aestivum
  Clone ID: PAT_TA_50108
agcggtcattcatcgctgatcaccagcacagccgcgcatccaccggtgctagcaaggtcgaccaagcagcaccgagatggctgctgccttctcctccaccgccggcgccccggcttgtacgccgaccaacttgctcgggaagaagctcaagaagcaggtgacctcggccgtgaactaccatggcaagagctccaaggccaacaggttcacagtcatggcagcggaaaacatcgacgagaagaggaacacagacaagcggaagggtcttgcctacgatatctccgacgaccagcaggacatcaccagagggaagggcatcgtggactccctcttccaagcgcccacgggcgacggcacccacg

SEQ ID NO: 50109 - DNA, 253 bp, Triticum aestivum
  Clone ID: PAT_TA_50109
aagacgcgtgtcaagaacgcctggccgctggtcaagcttaaggcacagcatgagagaggtcgctcgattgatcttactgtctgcaagggtgaaaacgccaatcgcgaccgtacccgcatggatgctcttggtcaccgtgtctctattatgaacatacaaagaatgtactgcaatggtgactgatcgggggccatcagcgactacaccagtgcctgagttgaacagcgttaccaaaaagatatccagacacctg

SEQ ID NO: 50110 - DNA, 439 bp, Triticum aestivum
  unsure (1)..(439): unsure at all n locations
  Clone ID: PAT_TA_50110
cgcatcgcactaggtctcgaacattcctctttctctcccttgcttggggaagaagaagaagaagaagaagaagagagggcgagcgcccccgcctcccgacgccggcgcccctcggcggcgatctgatctcaagagccagcgaaaatgcatttcaacaatctggtcctcgagggggccattcgggtggagttcagtctggaggcattcaaggcggacttgttccccgccgttaccaacattgtgggggcccttggtcccaaaggcccggcccgtgaggccaatctcccctggcttaaggcccgcatgtctggggcccggtttcatttcttcgtgggggatggccggtccaacaggagacactcgagaacctcaagctcgccatcaaggccaccaaaaagctatgtgctgttatgctcgacactgntggccctgagttgca

SEQ ID NO: 50111 - DNA, 320 bp, Triticum aestivum
  Clone ID: PAT_TA_50111
cacaagcgatcacgcttatatctaaacgcgtgctaggattctgaccccctctaaggaacggctgcaattcgagggcgtgtcaaagtacatggtagcacgtgacctcctcgccttcagagacaacgtcatgtggtacttttctcaagtggcatttacttacaaagatggacggatggcgcgccacgcaccagtgtgcctctccctatacaacgactcgatccatgagtttcacggccagcgcgtacgtccatgctctggccaaaaccacataaaccatgggatctgcagggacaggtatccttgccatggatgtggcttat

SEQ ID NO: 50112 - DNA, 244 bp, Triticum aestivum
  Clone ID: PAT_TA_50112
gcgtacctcctttcgtccgggcagctgattccatcccccgctttcagatttctagacactcgacagaaatggcttgcaactacggggacaccacaggggaggaggggaggctccacactgacgagcaccacagtaacagcaccactccgaccggtgaggcagggtcgcccaagaatacactgaggaggtggcccgagtcggcgtcagcgccgtccggcgcaagccacgggcctgcttccaagtg

SEQ ID NO: 50113 - DNA, 211 bp, Triticum aestivum
  Clone ID: PAT_TA_50113
cgtaaaaggatgagcagggagagcgtgaccggagctgcacgctacatcccgtcctggctcgtcaagaagctcctagacagaggctggaccgaacatgggaccgtacgatacctaggagatgagatgatgacggagctgctgaaggggctacacggtgcggatgatcatgtggaactagttgaggtggacatttatgacgctggctaattcg

SEQ ID NO: 50114 - DNA, 387 bp, Triticum aestivum
  Clone ID: PAT_TA_50114
cccacgcgtgcggttcggatgcaccgacgccacgcaggtgatcaacgaggtggaggaggtcaagaaggagtaccctggcacgtatgtccagataatcgaattcgacaacatgcgccaggtgcagtgcgtcagatagatagtcttcaagccaccgaactgagacgagtccggcacggcctaaacaggtcactcaccacgggccacatataaagtgccattgcaggtctgacaactgtgacattgctgaggattgtcattatccatttatctctcgttgtcgatcctaagataagaataagcgtatgtacatgttgacgtcatgactggagaaagcatgcttgtatgtgattgctacactgggctatgtatatgcacatgcacataata

SEQ ID NO: 50115 - DNA, 378 bp, Triticum aestivum
  Clone ID: PAT_TA_50115
cccacgcgtccgtcttacttacgactactgcaatcgcaattgctcgagcgcctcatctcactctctaaagcatcagagaaacaacagcacccctctcctccaacaacccaagcagccagccagctcttttcaagccagcttacatcctctactcgatcggctaatttgttcataagagatcgagctagctatcgggcagcaaggtagatgctagccatggaccagcaccaggaggagtcttgtgttcccccagggtttaggttccaccccacagaggaggagctggtggggtactatctggccaggaaggtggccggccagaatattgatctcggaatcatccaggaggtcgatctctaccggaccgagccatgggac

SEQ ID NO: 50116 - DNA, 129 bp, Triticum aestivum
  Clone ID: PAT_TA_50116
aggcgtacctcctttcgtccgggaaagtgatacacatccctcgctttttgattgctcatcgcattttcagtagcacatgctactgcagaggcaccagagatggcgtgggtaagcttctcactgaagagc

SEQ ID NO: 50117 - DNA, 353 bp, Triticum aestivum
  unsure (1)..(353): unsure at all n locations
  Clone ID: PAT_TA_50117
gttatgcggtgaggggctctggagtctggactgggagagaggagaaaccttttgggccccacgcgcgggccatacttgtcgctagtgcaaagtgtgatccctcgctcctacgtgggccgccgttgcgatgtacgccgccgccggcgcccgaggtctgaaatgcgtcgcccgccccgacttctcctggaagccgacgggccggccgcatcacacgctcgcggcggtggtgagcacgtctggcgtggggatccactcgggcgcgcgcgccaccgncaagctggtccatgagcgccgccgcgaggagaggcacgttcgaccagaccatagatatgccggtctttggttggcaatgg

SEQ ID NO: 50118 - DNA, 333 bp, Triticum aestivum
  Clone ID: PAT_TA_50118
attttggtgtttctctcacagtatttgtagtggatttttcgcactgtaattatcttgttttcatacagtgtaattctcaaagtatttacactgtaatttgttagtgtaactctcaaatgattttacactataatcattttgtttgatgtagtgtaattatcttgttttgatacagtgtaaatctcaaagtattttcattgtaatatcttttggtgtttctctcacagtatttgtagtggatttttcgcactgtaattatcttgttttcatagtgtaattctcaaagtatttacactgtaatttgttagtgtaactctcaaatgattttacact

SEQ ID NO: 50119 - DNA, 100 bp, Triticum aestivum
  Clone ID: PAT_TA_50119
accattcgttcgggcaagatacatagcatactgcaccccacacagtaccacattcctgctatccgcatgcaccattatcaccaaactctaaactttacgc

SEQ ID NO: 50120 - DNA, 441 bp, Triticum aestivum
  Clone ID: PAT_TA_50120
aaacgtatatacactcacgaaggcaatgggggaaatattacttggtcaatacaaaggggagcttgcgattgtcattattagacccaccatggtcacaagcacttatcaagatccatttcctggatggattgaaggaacgaggacaattgacgctctaattgtcgcctacgatgagcaagcactgccatgttttctaggtgatcgtaatgacataattgatttgattcctgccgacatggttataaatgctgcattggtagcaatggcagttcactggaatgaaaaattgcaggtcatttaccatgtgagctcatcgtgccagaacccactttcagttaatgattttgtggactcatgcttcgattacttctccattagtcctcgtatattaaatgggagggtcctccaaacaagaagaccatacttgttcaagagatatgc

SEQ ID NO: 50121 - DNA, 308 bp, Triticum aestivum
  Clone ID: PAT_TA_50121
gggttcggccaagcgttcggctataaaaagcactgttcatttcttatcgaggttagatcttcttgcaggggaggaataagggccggggatggacaaggcgaaagaagagcccggacccgtacaagctggcgcaggagcgaatggaccgcatgtcaggctgccggatgagcggacacgtcaagaagggcggccgtggttggaagttcacctgggagggcaccgacggctacaccgaccaggatcttgacgctatcggcaacaagggcaggtgtaccggcggcatcaacaacacgaagtcctacggagat

SEQ ID NO: 50122 - DNA, 258 bp, Triticum aestivum
  Clone ID: PAT_TA_50122
gattttgccgctcccgcccccgctcctccccggccgcgccgtgcctcgtctcgccggcccggcgaccacaggcaggcagtccaagaccaggatggcggcgtgccccgccgtgaccacggctcgcgtgggagcagcgcacggaggaggcctctggaggagaagcgggaggagcccgagcgttctttcgtggacggtccatgtagcgtttgagaagctgcccacttgcttgctacaagagaagcaagtcgtgattgccat

SEQ ID NO: 50123 - DNA, 415 bp, Triticum aestivum
  Clone ID: PAT_TA_50123
gtacggaatcgcagtttcgacctaggcgtacgcgcacgcctactagcaagctaaatacctacatgggagactcatagcacacctacagctagctctacagatatcgctcgcactatagctacaaagctagtaccagacctcgtgctggcggcaatgctcgtggtagccttcgacgcagccatctactgcgcgaaggtgaactgtgccatggcctcctgcgtgtcctactcaaaatgcaacggagacagcaccgctggcagctgctgtggcggatgttggagatgggccagcatatcgcggagcaccgcccacaagcacgcggaatggaaaggcatatagagtggtgtcaggaggcttaaccccgggatggctgcaagtatgccttccaagagccgcgtcaagatccgctactgca

SEQ ID NO: 50124 - DNA, 381 bp, Triticum aestivum
  Clone ID: PAT_TA_50124
gttccagcagtggctcgggatcttcatccagtggtgtgtacatatgagttatttagttatctacattgtgtttaccattggttacatcgttgtaaaacatgtttctccgtgacactgctctgattactttgaccatctttatatttcctttctcatgttctcatagaggtttatgcttatgcctagttcatatttctttggctaaactttagtgaactttgagtttatgagtttacggaaggttgtgaagtaaaaagttgagaaggaaacatttttcactatatgagtttacggatttgtgcttgtcatttaggagtacctttttaaactattattatcgctctgtagacttagaggtatcggtagaaatttacatattat

SEQ ID NO: 50125 - DNA, 147 bp, Triticum aestivum
  unsure (1)..(147): unsure at all n locations
  Clone ID: PAT_TA_50125
gacccaggcgtccggccatctctctctcgctgaccacacacaccatgtgtgcccacattgccctaaataggccgctcgctcccgcgccgagcctctcctcctgccccggcccctggccatgctcagtccctatncactccttctagc

SEQ ID NO: 50126 - DNA, 384 bp, Triticum aestivum
  Clone ID: PAT_TA_50126
atccgttgagtctcattttcagttgctcgagcggttctgacggaggggagcaccgaaagccgccgctggctccgaaggggatttaattaggagcccccggttacttgtggcggaaagccagccgcggagggagggagggaggaggcgtcgtccgtcgggtcggttcgatgggacgcggcggcggcgagggcctacacccagccagccctggcgggctgaaaagtgaatccgatggcatgcccgagctcccctcaaccggtgactttttggagatacatgcctgaaaccctctcgatctccgctaaaggggtgctcattattccttacacccggttggtaccccttcctgtccctgccctggaagaggaggagggcatggaagag

SEQ ID NO: 50127 - DNA, 310 bp, Triticum aestivum
  Clone ID: PAT_TA_50127
gcgtcatggacagttacggtcattgagtgatgtactggtgaaatcagatcttagtggttcataatcacaggtgggctcgtgacgatttacattacgatgatcgacgatggaggttgactttgttacatcagtctctagcgacgaaagcccggatagtgatccagttgcgagactgggtccattaccagtaaactcgcactgatgagaggaccagcgtaatgaacaacttgatgctagtggatgagctgactgcactggtgatgaacatgctggatatgagccacatggtggcatggattagaaaaaaaga

SEQ ID NO: 50128 - DNA, 427 bp, Triticum aestivum
  Clone ID: PAT_TA_50128
cttttgtgtgtgcatggccggctccgtcaagtgcgccagcgcctacactcccttccaatcaagtaagccgttcgccgccgtcctcgatctctttgtttcttgatttcttgtcgcgagagagatcatcgatcaagggagggaattaatcatgtggatgtgtggattgtgtttcgttcagaggtgaaccccgaggagcatacctgcaactccaactcgaaggcgtcgcgccggagcagctccggcccggacaagccgccagatccggcggaggcccctacggcggcggaggaggcgcatgcggtgccgtcggcgttgctcaagtcgttcagaatggcggacctgcgggcgaccaccaagaacttcggctccgcgtcctacctcggggagggcgggttcggctgcatgtacaaggggtggatcgacaaga

SEQ ID NO: 50129 - DNA, 347 bp, Triticum aestivum
  unsure (1)..(347): unsure at all n locations
  Clone ID: PAT_TA_50129
ccttaaaccctcccatggcggccagcccatgctcccgcggccaccccaagctccggcgtctcctctcctctgccgccgccgcgaacctccccctcctgtgctcctagaggcgcatggccgaggccctctccctggcggatttggatgaatgccaccggccggccgccccaacccatcctctccccagcgagatctaggcggcagccccaaagagaactaaatattctncctctncaactcgggcgagctccgatccggtgccctgggcccgggcgtcccgtgactggcccccgccccaaacgccggttccaacccgacggccccattccggacggttgggggcttcg

SEQ ID NO: 50130 - DNA, 265 bp, Triticum aestivum
  Clone ID: PAT_TA_50130
caaaggattcagaacaccgcccgtttggaaaggagcttagaggcggtcatacacggacctacggacgcaccggcttatccaatggcacaagcccttgtagacgcatatactactacctactgcatgaaacagaaggtaccgaaatcttctgataattactcggaattccacgtaagggcttaccgtccgattacgccggacgtagcctagcctccaatagctgtacaatcatatactgaaacatgtacaatggttgacactccag

SEQ ID NO: 50131 - DNA, 241 bp, Triticum aestivum
  Clone ID: PAT_TA_50131
cccacgcgtccgggaaggccccgattgactgatccccgcgtcgccggccgccgcccccagcgtttctcgccggccggcatgtcgctggagctgagcatggccctggcggcgccgccggggggtgggctgctggccccgcccccttgtgtgcgacaagggaaggagcagcaggtggcggtggtgggaatcctgctgcagatcttcatgctcgtgctcttcttttggctcggccacgtactcc

SEQ ID NO: 50132 - DNA, 430 bp, Triticum aestivum
  Clone ID: PAT_TA_50132
ttcaattggctgatttctaaactacacaggtatacggtgggacttatctcaccatatactgaaactaaacccaatgatggattttacgtactactcataaattctaaagccactcactacactctatactatgaaactaagcatactaatatgtcggccgcattccgagtaagtcctgagcctgcgagcccgctcgacaaaacaagctctgccgtagctgtcgaatcttatactggcacatgcacagacttttgcactgattgacttaccacaactgatcgctcaaaagaccactctatgacatcgagctctgtagctggggaagacagccaatggatctgatatgcagcttatccattagacctatttgaagaggcgtacgatactaacatgtttactttcattgtacgtaacgtatttggactcaaag

SEQ ID NO: 50133 - DNA, 437 bp, Triticum aestivum
  unsure (1)..(437): unsure at all n locations
  Clone ID: PAT_TA_50133
cccacgcgtacgcgaatttaatcgggaaatagctaatgtaaaatgtatatgatttagaacactcatatcggtacaatggactgaactatttactggaaaaaaatagggggcaccctgccctgttttaaccactgccgaatcgtcgacctatgtataaaaaagagaaatttgttggatttgaaggaattatattaagaattctattaattttcattagccagttattcagatagaaattcttaatgaaattgaggtcattaaagagggcagataacaactttggtgacaactttgctgaccatgatatattgttatctacgcggaagagtcctctaaatatatatctagtcttatataggngtcggtatactgaaatatgaacatagaagagaagctcgaggcttggctcattgctttaaaaatagatatggaaatag

SEQ ID NO: 50134 - DNA, 291 bp, Triticum aestivum
  Clone ID: PAT_TA_50134
gtaaagcacaaaaaacgcgcagcggtgggagagccatggagatgggcggcgacgagatgatgatgacctcgggcgccacgggccggatcgtgcccgtcttccgctccgtgctctcccgccgcgcgctgctccgcctggccgttgcgctccactcgctcttcctctggctgctcctcctcgtcggtcgccggcgtcgccccgactccgtgagcccggcggagcccggccgtctggggaagggcaggatccggcgctgtccacttggcagggggagttggtgcaacaactgat

SEQ ID NO: 50135 - DNA, 382 bp, Triticum aestivum
  Clone ID: PAT_TA_50135
ggacaagaagagagcagcagcaggagtaggagggccaagcaaatgcgcagcgctggattatttggtgtagtaataactcgatagagttctaggctgaagcaaacaatggagagggaaatggctgcctcatatgagccaaaactgcacagtgaaataaggatttttgggagttcagatgagatactgacagatctagctgagtatatctcccaagtttcagaaatctctgttaaagaaaggggatacttcgctattgccctatctggagggccccttgtcagttttttgagcaaactttgtgaagcgccatacatcaagaccctggattggtctaaatggtacatattctggtctgacgaacgtgctgtagcaaaaaaccatg

SEQ ID NO: 50136 - DNA, 316 bp, Triticum aestivum
  Clone ID: PAT_TA_50136
gccacgcgtccgcccacgcgtccggtttgctgtagcagaagggttctccgtctcctctcgggttcaaggagctggagtggttcgccgacatcgacctgttccacgacgaccaggcgccggcaccaaagtggggcagaaccgcggcagaggtgcccgagctcttcgcctcgccgcagccggccagcaacgctggcttctacaagacagccggtgcgcgccagagcaagaaggcgaaggtggagctgcccgaggacgacgacgaggactaccttatcggtcccgatcttggatgagatattcgaactggatatatata

SEQ ID NO: 50137 - DNA, 221 bp, Triticum aestivum
  Clone ID: PAT_TA_50137
gctatgcgtgcgtacatggaggacttgattgtaccagacatgataaagacgtagacgcacatgcttctatgctctgtagagaccgctttaccttcggtgccatagctatatatagatcacaggtcgagaccggagctgtgaaggcaccttacttgaacgcgactggcagtacatgtgacagaattgttaatagagctgtatttggaagagaattagggact

SEQ ID NO: 50138 - DNA, 308 bp, Triticum aestivum
  Clone ID: PAT_TA_50138
ctgacgagcggcatagtcgggcgatcactcactgctagcaaggtcccgcaagcatcacagcaggctgctgttgtctactgctacatacaccgtagcaaccggctgctactaccaaccaacttcctcggcaagaaggctcaagaagcacgcaagcccaggacgggaactaccatggcacgagctccaaggccaacaggctcacggccatgacagccgtaaacatcgacgagaagagaaacaccgacaagtggaagggtcttgcgtacgatatctccgccgacccagaggacatcaccaagagggaaggg

SEQ ID NO: 50139 - DNA, 377 bp, Triticum aestivum
  Clone ID: PAT_TA_50139
acagccatggcccccaccgtgatggcctggtcggccacctacgtcgctcctttccaggggctcaagtccaccgacagactgcctgtgagccggcgctccaacggggctagcctgggcagcgtcagcaacggcggaaggatcaggtgcatgcacgtgaggcccatcgagggcattaagaagttagagaccctgtgctacctgccaccgctcagcacggaggcacttctcaagcaggtcgactacccgatccgctccaagtgggtgccttgcctcgagtacagcaaggttgggtttatcttgcgtgagcacaacgcattccctgggtactacgatggccggtactgggacaatgtggaagctgcctatgttcgggtgca

SEQ ID NO: 50140 - DNA, 394 bp, Triticum aestivum
  Clone ID: PAT_TA_50140
aaaaaaaaaaaaaaaaaaaaaaaaaaaaaaaaaaaaaaaaaaaaaaaaaaaaaaaaaaaaaaaaaaaaggaaaaaaaaaaaaaatggaggaaacaaaattaaaatacacaaaaataaaaaaaggggggctcttttgtggggcccccttttttggttcctgttttccggcccgttacaccctcttttttggggcctccttttggggttccccacctcaatttttttgcacggttttcccctttacccccctgggatccccctgttttgcccctatccaaattctttttttacagctgcttttttttattgggggttggtccctggttcccctcccctttttttccccccttttgtgggtttgcccccccttttgtccccctttttccccgccctt

SEQ ID NO: 50141 - DNA, 428 bp, Triticum aestivum
  unsure (1)..(428): unsure at all n locations
  Clone ID: PAT_TA_50141
gccacagcttcagccttcaggtcgcacacatacactcggcgcgtcgtcggaggaccagccggcaagaggcagatggtactgataatctcgctgcccctcgtggcgctggtggtgatcatcgccatcatcctctgcatcgtctgccgttaaccagccagccagccagctcgcgcgcggctcacctcgccggatgttgcatcatgtagcctcgtactagtgttgttgctgcgcctgtctcatactgccgtcgtgtattttgtctgcaaccctgctcggtgtgtcgtctntatccccttttctcctactagcttctcgacgtgaaatgtactattgattgatacatgtgtgtgtgtgtgtgtctgctcgtgtgtgtgcgggtgtcagtacagtgcatactgccgtgtaacgtaagctcttgactttgtcgc

SEQ ID NO: 50142 - DNA, 447 bp, Triticum aestivum
  Clone ID: PAT_TA_50142
tcccggtcgactccacgtcttcattactaatccgttaactaaaatttatttccttatctcttaatcaaacaccagggccaggttttaattaggagatctttcttctacgatgaattactattgtgacactatatcaatggcttaaactaacctctctcacgacggtctagtccgagctcactttctctattgtttgttaaacaatcaaacacttgtagaattttgctttacattgataggatgagcttaccatttaaggatcaaaaagcaactttgatatataacacttgcttgccacattccatttatcactttggttactttatctgacatatctaacttttaaatctccaatattttaaagtttctgataggtcattctttttacgtttttcttttttttactggaaatcttcaattctacccagctttttacccttttttttt

SEQ ID NO: 50143 - DNA, 357 bp, Triticum aestivum
  Clone ID: PAT_TA_50143
attagatcccttaattgacgagttatagtgtggtactcacgtcaccacagacagatactaaggcggacgccggatacaaagctccaggttaacaagtataaattgacttactacaccctagagtatgaaactaaagatactgatatcatggcagcattcccagtaagtcctgatcctgcggttccgcccgaagaagcaacggctgcagtagctgccgaatcttctactgatacatggacaactgtttggactgatggacttaccagtcttgatcgttacaaaggacgatgctataacatcgagcctgttgctggagaagacagccaatggatctgttatgtagcttattcattagac

SEQ ID NO: 50144 - DNA, 226 bp, Triticum aestivum
  unsure (1)..(226): unsure at all n locations
  Clone ID: PAT_TA_50144
acctgcaggtacggatccgcagtttcgacccaggcgtacccaaaaaccgcaaagaggaaccgaatagagcacgagaagaccatggccgctgcggcgggcgacgagccggagacgacggtagaggtgaagctgcgcgccgtcggtccgttcaggcccaccaacatccgnctccccccgcttatctcggttgccgatctgcgccgcagcgttcgcttctcgaccggcg

SEQ ID NO: 50145 - DNA, 402 bp, Triticum aestivum
  Clone ID: PAT_TA_50145
cattcatcaccgatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtgctcagcttctacgagtacgttagccagggactcaagaa

SEQ ID NO: 50146 - DNA, 355 bp, Triticum aestivum
  unsure (1)..(355): unsure at all n locations
  Clone ID: PAT_TA_50146
ccctccccgatccacaacacccacgctcctccctcctccctccctccctcacccgccgccacgctccctcccaccttctcctcctccttctccgccctagaagcccggccgccaactgctactcctccaccgcctcccctcttcctcctcctcacctttcaatcgctcgcacgcaggtcacccgacaacaggggcggtcaggaaggcttcccagcctgatggaggagcacgccgncgccgcaagccggctgtcccgatccgcgtccgtcccgatgcagcctggcggatctttctcgggaggcaacgagagttgcaggcgcaccggtcggtgtgcatgcgctgctcaactgggtca

SEQ ID NO: 50147 - DNA, 400 bp, Triticum aestivum
  unsure (1)..(400): unsure at all n locations
  Clone ID: PAT_TA_50147
cccggacacgccgtaactgtcaaaccgacagtctcaaacttagccggtaacgttcaccggtgcgccgtctgatgccgaacacaaaaccttattcacccgacgagacgtaccgngccgaggggcagcatcaggatgcgcatggagagcttgcctgacaacgaaggcatcgagctcctcaaggcgcggggccaaccgtgctacgctcactggcgcaacccggaggcggcacgacctgctgctgagcaccaacatggggccggtgtggtcgcaggccaactgattgagcggcaagtccggcgagaccatgaccttcaagaacaacgccgggtttccggcacaacgtggtgttcgacgaggacgccgtgccgtccggcgttgacgttttcaagatcttccagga

SEQ ID NO: 50148 - DNA, 437 bp, Triticum aestivum
  Clone ID: PAT_TA_50148
attctaattcaccttccgggatatagagaaatcaacatctgccagtaacagttttaactataggcttcatgaatttcaagccagggttaaactatgtgtgggctttccggatccaacgaaatgtgaatttggtagtacagtatttagtttccattggaatagtgtttcatcagaatggctcctaccagatttgaaacttgacatctgcaaagcattgttagcagtataattattgcccatcaagttttaatttgtagtataattctgtacaactgactagagatcttcagaagattcgttcttaacctaaaggtgataatcaggagtggcatctctattactggatggttactcctacaggtggatatagtctagctgacggtggttcattggcttgggtctttgctacaaccatgaaatgagcccaagccagagct

SEQ ID NO: 50149 - DNA, 427 bp, Triticum aestivum
  Clone ID: PAT_TA_50149
gtcgaccccatcaccgtagccgccgcctcccatgccatagtcacctcccgtccgtcatccccagtcctcttcgcgcggtgggatcgagcccacggtgtgctgctgcgccgccgccgtgcgtcgccatcttcacatcgccgcaccttttccttccaaattcgtttcctcgggtgacccatgcgtcccctaggtgagatgccgatgccgatgccgctgcgacttcccttccgtctggatcgcagtccctttgagcgccttcatccgtcccctcgaatctcgcaaggcggtcgttccggcgcctgcggatgtccccgttctttggcgcaaatttgggttgatgtgtgtgttcctatgacggcagcttgtttgggctacgattttcaggggcaatccatcgcgtcccgatgatgcggcgaggcctattgtg

SEQ ID NO: 50150 - DNA, 363 bp, Triticum aestivum
  Clone ID: PAT_TA_50150
aattgctatgtttaaaatggagccgaaaatacactatgcataggatgattgcccgggttcacctccccatggcttcccaaaagatgatgcgcttcagtttgagggtgagatgttggatttctttaaagcctaggtcgtgactgaagatttaagggttgctaagaagattgcttctaaaggcaaggggtgggtaacacctacaaaaccatattaagtgaccgcacggataactgcaaggaccgcaggttgcaaagaaattcttcccaataaagaagtgccatatttcttcactttgggtaaatctgaggcacctaaagggcttgagatgggaattggaacaatggcccccaaggaaaaagccac

SEQ ID NO: 50151 - DNA, 326 bp, Triticum aestivum
  Clone ID: PAT_TA_50151
gagccatccaaacctccaccccacacctcatatcccctcgtgccacccattcaaatacgagtccattggcctcagcgaggcagagaggatagctagcaccttgagcttgaggtcagtggcaggcaggcaagcaagaaaggaagaagaagaaaaaaggacatggcatctgctactctcctcaagtcctccttcctccccaagaaggccgaatggggcgtcgcgcgccaggtcgccgccccgagggtgtccatggtcgtccgcgccggcgcctacgacgatgagctcgtcaagaccgcgaaaaccatcgcgtcgccggggcgcggcat

SEQ ID NO: 50152 - DNA, 434 bp, Triticum aestivum
  Clone ID: PAT_TA_50152
ctttacagaggtgtttcagcagatattcttatgctcgaccgatcgggatatctgcaggtgattatctgaccttaagatagttgacttcaggtttgcgaagaagttggaaggtgaaaggacttacacaatatgtggcatcgctgactctctacctccagagattgttcttggcagggggcatgggtttactgctgattggtgggcgcttggagtattgatttatttcatgctgcaatcagacatgccatttgggtcctggagggagagcgagctagaacctttcggtaagattgcgaaaggtcgcctaattataccatcagctttcaatggtgaagttggtgaccttataaccaagctacttgtggtagatgaaaatacacgccttggagccacaggtgctgacgctgtgaaggaacatccctggtttgatggca

SEQ ID NO: 50153 - DNA, 411 bp, Triticum aestivum
  Clone ID: PAT_TA_50153
ccctctcgttcgcccacgcgtacgatcgggatcccctcctaatcgatttcagctaccagccaaccatcgctctcttctgctcctactcgatccaagcccgcacccgatccaaatcctgtgagcctacaccaaccgccgatccatccatctgcgaccgccggatagagatccgacggacaccaggcggcccgcagccgagcctatcgctccctcctggatgcacatcgagaggagctagctcgagcttcacctacaggaccccgcgccgccgaggagccgtcttatcgtaggaaaccagcgccgttccacctcgtatcgcgggctcttctgcttttgctagagcccgcaggcaccaacatgcccattccaagcctgccgagctcgtgctaccgtggatcccctcggttccct

SEQ ID NO: 50154 - DNA, 420 bp, Triticum aestivum
  Clone ID: PAT_TA_50154
ctgacgcatgggcgcacgcgcacagagggtttcatggcggaggaagctaacgcgccggcagacacaacgtcgacgggggcggatgctgctcctgttactgcctggcatcctgtacgggatcacctggaatacacacgttccaaagacgtaattagttctggctgtgatcgtgcatgttgtgtaccatgatcgaggatagagcgaggctgaagatgaacgcgaaacgaatagctgtcttgaggggcatgttgaattattagaattggacgaagaacggatgggagatgtctggtaaaggtacgcacggataggtgcattagggttgaacgttaaattgtcagttgaactttgaattgagtttaatatagctttcaagttggcaaatgtaggtagctggatagcatattatttgagctcagt

SEQ ID NO: 50155 - DNA, 419 bp, Triticum aestivum
  Clone ID: PAT_TA_50155
atctattagtagcatcccacactagtgataacaatgccaattcttttctcacaagagctgctcatctccgtagtggtcgtgctgcttgttcccctctacctgtacctcagggctagttgtagatcaaagaacccagcagtgctcccaacaaactggccaatactgcacatgttcccttccttagtggccaacatccacaacatccatgactatggcaccctggtcttcgctggatcaggccacaacttcagggcgcacagcccacccgggactggaatgcgattcttcgtcacatgcgaccctaggaacgttcgacacatctttacaaccaactacaccaatttccccaagggcgcggagttcgctgctatcttcgacatcatgggcggcagcctcttcaccatcgacggcgagccgtg

SEQ ID NO: 50156 - DNA, 287 bp, Triticum aestivum
  Clone ID: PAT_TA_50156
cccacgcgtccgcccacgcgtacgatcattctcgacaccaaagctgatattcttgtcctggaaatctttttgggttcatcagattcggaggatgtcttgcaactgaggctccggttgcagctgcggctcagactgcaagtgccgtaagatgtaccctgatctgactgatcaaggcagtgccgcggcccatgtcgacgccgtggacctactggttgttgatcctgtgaacatggcgcattacttcgaggtcgaccctgtgcagggccaactgggcttgatctgccatg

SEQ ID NO: 50157 - DNA, 432 bp, Triticum aestivum
  Clone ID: PAT_TA_50157
gagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaaagagggttccgtactaacatgtttacttccattgaggtaacgtatttggttaaagccctagtgctctac

SEQ ID NO: 50158 - DNA, 434 bp, Triticum aestivum
  Clone ID: PAT_TA_50158
cccacgcgtccgcccacgcgtccggtgagttacagaggagcagccacaccatagatccccgctcacggccactacgcgcaccatctgccgtcgcgccgcgagctccgcttggccgcgccctgcggtagtcacacgtgagctctgccgacacccagtgcgcacggtcgacctgcgagccacctgcaccgcgttgaaccccaccatggcctcgtgctcgctaccgcagtgtcgcacgtggccagcgttggctgtcgccatgactgcggagtggggcaagatccacggagctgcgcatggggtgagcatatcggcccgtgttgctaaattctggctggctatcgtttgggctgagcggcagatatggcgaatttcaacacctcaggtggctcagggagttctaacgacgtattatacaatatacaaggagctatggg

SEQ ID NO: 50159 - DNA, 227 bp, Triticum aestivum
  Clone ID: PAT_TA_50159
acgccatggtctgagctccaacccgggggtggtgctggaaccggcaaggggtggtgctgcaactgtcctcatctgaagctggaaccataagttgttggtgctgtacgcccaggccgcttggccggggacgatggccacgtcgtgctacaatgggtggacgagatgttggaaccagcctcggtgggagcagcaaccagcgacaaattttgctttatccggtttctttt

SEQ ID NO: 50160 - DNA, 103 bp, Triticum aestivum
  Clone ID: PAT_TA_50160
taagaactcgccgcacgttggatcttgaccatcccacacaaatccgagggagagaggagcatggccatctcgaccggggccatgctgaccccgcccaccaccc

SEQ ID NO: 50161 - DNA, 465 bp, Triticum aestivum
  unsure (1)..(465): unsure at all n locations
  Clone ID: PAT_TA_50161
agagaacgcgccgaggattcagagaacacgccgccgccacggaccacgcaccgctcgacagccgagaatgctcctccccttcgcgctcctcgccggcgccgccgccggcgccttcctcctcttcaagttcgccaccgccgatggcgatttcaccctcttgtcgtgcggccgggcgcggcgggacaaagtcgaaggcaaggttgtatggattacgggggcgagccgtgggattggggaggttctttcgatgcagtttgcgagtttaggagcaaagctcatactatctgcacgtaacaaggaggagcttgagagagtgaaacgtaacatcatgagcaagcatccagatagcaaaattgaagtattacccatgganttatcatctgatgaagaatctttgaaagaagttgtacattcagcggaatcactcttttccagtgcaggcattgactatatgatgcacaatgc

SEQ ID NO: 50162 - DNA, 430 bp, Triticum aestivum
  Clone ID: PAT_TA_50162
cccacgcgtccgtcttgataatcggaaaagggacatttcaattgaaaaggggccggtgagagaattgggcttggagttccctgcctgccctgatgatgtcgaaggtagacgtttttcatatgcttactattccagaaaattagctaataaagaggttatggacagaaagtggttggtttactctaaagagttggacaaagttttttgttttgcctgcaagttgttcaaatcaaaccagagcaggtctttgctagcgtctgatgggttaagggactggaagcatctcagtggaagactccaagaacatgagagcagtgttgagcatttaacaaacatgaacacatggaatgatctaaggttgaggttaagcaaaaatcaaacaattgatgatgacatgcagcgggagattgcaaaggaaaaggagcggtgg

SEQ ID NO: 50163 - DNA, 316 bp, Triticum aestivum
  Clone ID: PAT_TA_50163
agctcgagagggccgatctgcgcgttgcgtacctcagcggaaggcatggaccggcatgttgcgctcgagacgagcggtctctagtaaggagatcgtagggtggacccgcgggcatcgtggacggcgatggagagcgcggctgccctcaagatcgacgccaacgatggagagatcaggcgcatacctgtctggtccagatggaacatgaagaactaatagactgttacttacatggcaccacttacctaggtggctcttctctggccgaaccactacctgatcacatagaagtgcgtgcactggcgggaggctagca

SEQ ID NO: 50164 - DNA, 377 bp, Triticum aestivum
  Clone ID: PAT_TA_50164
aatactcatcagaatcctcaggaaaaaatgggcgaaaaaaagggcgcccgagaaggggctggggcgggcgctctggcgcgcgatacgcgtcttcacgggcgcctcctcggagacgtcgccggagacgctcctccgcgcgatggtgggcctgatggagcaggaggtcggtgagctcggtcaggaaatctgccagcggaagtagctgggggagctgctgtacaacaacaggtacaagaacagggacgagcatgtcgacgagctcgacgacgtgccggaggcgctcctcgaggcgctatggaacgccggatggaacgtcgggcagcacgccgtgcacgacaccgatggcgccaccgatagaattatcaagatgcttgtca

SEQ ID NO: 50165 - DNA, 202 bp, Triticum aestivum
  Clone ID: PAT_TA_50165
cgcacgcctgcgctttaaccgctgcttgaacggcgctagcctgggcagcatcagcaacgacagaaggatcaggtgcattctggtttaggccatctagggcctcaagaagctccagaccctgtattacctgtcatggctcacgacagatgaccttctgaagcatgtctactacgcgagcccctcaatgatgcgaccttggcta

SEQ ID NO: 50166 - DNA, 237 bp, Triticum aestivum
  unsure (1)..(237): unsure at all n locations
  Clone ID: PAT_TA_50166
gcgtccgccacgaattatgcgagagacacgcagactgctggtaaggtgaatcggtaaccacagggggggggctattcgcaccaagagcgactatactacccgcaacaccaatctggtggcgagccagttgactgcaacatggttgcggtccatgcggctgnatatcttcattgttagatgcgattgcctagaagcttccaaatgttatgatccagaaggaggatgtcgatgaaatga

SEQ ID NO: 50167 - DNA, 237 bp, Triticum aestivum
  Clone ID: PAT_TA_50167
ggaggtgttctcgattgtacggtgaaggtcagtggccaccatcgacgcctctagtggcacggcaaacaaccagggcttgtacctactaggcctgagcaccaggggcgtgcccgatctgtccgacacgggcgagcaggagatctaggccatactgcgccgcattctggacgtctggccgaggctcctctccatcaggagcttcggcgccagggtccgcgcccagggttccacccggaa

SEQ ID NO: 50168 - DNA, 256 bp, Triticum aestivum
  Clone ID: PAT_TA_50168
gaaagaaattctccgatgagaacgaagactgcacgctcaagggcctggtatgactgtagtggggcgtgtctaccagccgctatctgttgtacgcaggggagttcggcaagatcaacgcaaatgttctccacaacttccggatgcactacgccatcaccagagtggcgaccaacgcacctggagtgaagatgtacatccagaccgggatggcagaacacagggatgagctgcgggagctactgaagagggacaacac

SEQ ID NO: 50169 - DNA, 253 bp, Triticum aestivum
  Clone ID: PAT_TA_50169
caccaccgactgaaactgtctgtagagtcctctccatgagtccattgcagaggctgaagtccaccatcgtgctccgcataaggcggctatccaacctaactaggctcggcagcgtcagcatcagtggacggatcaggtgcatgcagatgtggcccattgaggtcatcaagacgttactgaccatgacctactcgacaccgatcagaacggatgccatcctcaagcaggtcgactacctgatcacgctccaagt

SEQ ID NO: 50170 - DNA, 257 bp, Triticum aestivum
  Clone ID: PAT_TA_50170
gttattgcgagaattcttaattcaagagtcatcgggagggacttatgtcaccacaaacagaaactaaagcaggtgttgcatacacagctggtgctcatgattataaattgactcactacaccccagagtatgaaactaaggatactgatatatgggcagcattccgagtaagtgctcagcctggggttccgaccggagaagcaggggctgcagtagctgccgaatcttatactggtacatggacaactgtttggact

SEQ ID NO: 50171 - DNA, 255 bp, Triticum aestivum
  Clone ID: PAT_TA_50171
cgaggaagcactacgggatgaagtgcaagacgctggcgctcagcgtcaaggcggaagagatattgggtgtgaccttcacaactgctgcgtacctggacaccataggtttgcctaatgacaggatggtttacgtgattgccgaggaagggattctcatggagcttgagctggattgatctcatgaccatggcgtacctacagactgctacaagaggattgagctgaagcctggctttacatgcagcatgacaaata

SEQ ID NO: 50172 - DNA, 122 bp, Triticum aestivum
  unsure (1)..(122): unsure at all n locations
  Clone ID: PAT_TA_50172
cggacgcnttcgacgactcagtacatatgccctccttacctatgtctgatacctgatcctntgcgaggggggtgccttgcctggaggtcagcaaggttgggttatcttcctgagcacaactc

SEQ ID NO: 50173 - DNA, 451 bp, Triticum aestivum
  Clone ID: PAT_TA_50173
cccacgcgtccggctcctgctcgcggtgtctcagtctcgcgcgtgctggcgcacccacggacgtcacgagcctgctgctgcgattctgcgcgtgcggttcagaacacgtcgtctgcccggcgtgcacctgcgcggagcgtatcgcgtcaccgatctccggactcacctcggtccacctggccgccgtcagcccgctgtcgttcctggggctcgcctgctcgccctgcctaaaatgctacgcctatgtcaactccgccgctgctgacatggacttggccggtgccagctcccatgaaaactccagctgcaaggtcgacaccaacggagccttgcctctggagaggctgtatttctgcagcatgcaggccggcagctacgaactcgagtggctattggagcaccacctgagcctacggcagcatgagctccccgctggcgacggtgttgctga

SEQ ID NO: 50174 - DNA, 185 bp, Triticum aestivum
  Clone ID: PAT_TA_50174
cacacacttaacatgccggcccagctgacagccgttataccatcctactcccaggccgacaaggccgccggcggctcggcggcgtcctgcaccgacagccactttctgtactacccgacccgtcggctccgcaatgccgtgcgcgcgcaggtgtcgacgacagagaccgaggagccggcccctgc

SEQ ID NO: 50175 - DNA, 340 bp, Triticum aestivum
  Clone ID: PAT_TA_50175
cccaagagtcagacaaatacacagacacacacacacactctaagagcgcttaactgctaatgccgttgtctcgttgatactatggatgatccaggtggcaaagcttgagaccggagaaaggggcgctaccatgggggtcatacatgatgcctgccatatctgggtattcttcgagctgctgaaccatgctatgtgggaccagctgatggaccaggtggagctggtgagcaaggcgcactacgcgggtcgccgggaggagcaattcaaggacgtcgcggctaagactctggaggccgacgagaagggcgactacgtgaacgacttatactgggagagcacc

SEQ ID NO: 50176 - DNA, 258 bp, Triticum aestivum
  Clone ID: PAT_TA_50176
acgcagggatgagatttgagggggaggcagaccttgtgcggagggcctgaggcagcagagcttctctccggtcgatggcggcgcctgctctgccgacgtcgtcgccggcacggctcgccggggagctccgtggttgctctctggcatgctgctgatcgggcagggaggagggaggaattctgctgcctttcctgttgttttcttggggagggaggaggaagaaggtggaaccacaacttgatctttggtccctcaagt

SEQ ID NO: 50177 - DNA, 369 bp, Triticum aestivum
  Clone ID: PAT_TA_50177
ctagcaaggagtaagctgtgaagctgaaggtgtatcaggctctgaaccacatcttccatgcaagcggctagcagacggttcgaaacgggttcagctctcacaatttccacaagagcagttaccggaggacaaaatatggattggattcaagcggtcggagtgcattgttcatcttgattcttgattaataataacaatcacataaccatagctagagaaccgctcattgtgcgcactctgatttgtgaaattagacaattggcgagtatttatttatttgttttgtgcacctccaaacccataatatgtaatgtgcctgttgtataagctgctacatggaattgaaacttgcatcaactggttttgggt

SEQ ID NO: 50178 - DNA, 685 bp, Triticum aestivum
  Clone ID: PAT_TA_50178
caccacggcgctgacctacaggcaaagggcgacagcggcggcgctcagttggatctgtaggggggagagagagaagatgagagggagagagaggagggagaaagagaggaagaggagaggaggcacggcgtcggatgggagagtggccaacccggctcgcgtcggcttgggccgcacccctccccgaagaacggcgatgatggagggatccgccggcaccatccaggctcccgaccgacggactcgctgggtcgccacccctcccgtgcggtggggacatccacggcgatgcgggctggggaccgagcggcggggcccgtgccgaggccttgcggtcatgaggacgtcgggtcctccgtacatcgtgttcgttccacggtggcgcgggcggcgacaagcttcaactctgcatcgggagcagcgacgccgacacaagcttcagttcattgctaatcttggccggtggtttcgttttgtctacggcatcgggtcgctttgtgctccgttgtgtggttgaggcattgggagttcttgaagggaaatgatgaaaatggtgtatgaaaagtatcttaaagggagcaatgttttggtacttattttccttgaaggaaatgacgaaaatggtgtatgaaaaggtggacaacttgatatgggggggaggcacataggtttgctaattctgttt

SEQ ID NO: 50179 - DNA, 448 bp, Triticum aestivum
  Clone ID: PAT_TA_50179
gcaccggacacgcacgaagtctactggaccagcgagcaatggtgaccaccgtgatggcgctctcccactcgttcttcgccgggaaggcggtgaagtgcctgccgttgtcggcgctattcggggaggcgcgcgtaaccatgcgcaagaccgaggccaaggccaagctcgagtcggccggcagcccgtggtacggctccgaccgcgtgctgtacctcggcccggtatccggctaccagctgagctacctcaccggcgagttctccgtgtactacaggtgggacaccgcatcgctgtggaccacacgcaaaaccttggggcacgaaccgggaggtggaggcgatccactaggcgtaggtccatactggccgctctctgctgcatatacccccagctgatcgtcccaatcgggatcaagataggcgaggccggattgttcaaggtcgattcc

SEQ ID NO: 50180 - DNA, 571 bp, Triticum aestivum
  Clone ID: PAT_TA_50180
gcaggactggtagcactacagctgctcatacttcggcacaaggtgctgaatctagcccagctcttaatgctggcctggaaaacgtacagcttacaagggctgtagaacattatcaaggctctggggcaagtgatggtggatggattgcaaaaatcgctgccttacttgttggggaggacccgtcacagtcgtacgctttgatctgcggcaattgccatatgcataatggcttggcccggaaggaagattacccacacattacatactattgcccacattgtcatgctctaaacacatcaaagaactcaggcccatcgaccccagttgctcctgctgatgtgatatctgctgccagctcagtagtagagagtgaattgattaacttggctacagtgcaggagttgccaaaggaagaacacgcggagaaggaagtggaggcaagttgaagcgggtccgtactattactgttgatctttgtgagattagttcatatcgccgtgtttgaactggtttgagccgcatatgtagcactgttgtaaaattggaaatagatgacctatatgatccacag

SEQ ID NO: 50181 - DNA, 628 bp, Triticum aestivum
  unsure (1)..(628): unsure at all n locations
  Clone ID: PAT_TA_50181
ggaagtcttgcagctaactgctgaaaaaaagtggcatgtaaatctgattgatgaaaattgttgtatgccatcagaaggctgtttgtttgtctgaatgaaatagggcatccaaccatctggttccattattttgggagccttgactgaatatgttttgagccagaggtgtcaaaatgaacactgacggtcacgggagtccctcgggggcatccgataaaatactagctcagggaaaagatcaagttgattagaagagattcgctgacggagtttcttccaaaagctcgggttgacggggagagacgacactgctagtttgctgaagtggtaggttaccattcagggtgatcgacgaggactactgcggcccgatgggagtcgtgctcctcaactactcggaggcagacttcaccgtgaagccccgcgaccgcgtcatacagattatcgtccaggtgattgcgacgcaggaggtccccggngtggaggacctcgacgccaccgtctggaggtcaccgaggtggaggacgacaccaccgtccggagttcctcaaggtggaggacctcgacgctttgtacatacatctagagaagtggtctggttaggttggtggtgaaactctagtgaggg

SEQ ID NO: 50182 - DNA, 654 bp, Triticum aestivum
  unsure (1)..(654): unsure at all n locations
  Clone ID: PAT_TA_50182
cggacgcgtggggttccatctacttgtatngctactggaagcatacaaactctacatgtcatagatcctgacatggtgaaggagctggccagttgcaagtctttggatcttggaaagcctagctacttgcagaaagagcatggagctcttcttggtacgggaattttgacggcgaatggtgacctatgggtacaccaacgaaaggtcattgcacctgaattcttcatggacaaggttaagggaatggttaatttgatgatggatgctgcactatcaatgttgaattcatgggaagaaaaggttgagtctgaaggaggcagggcagagattctagttgatgagttcttacggaacttctcagctgatgttatatcaagagcttctttcggaagcagttttgtcgaaggcaaagagatattttacaaaattcgccaacttcagaaagcgatggcgaagcgaagtatgcttattggtgttcctggaagtagatatttaccgacaaagagtaatagagagatttggaacctgnggagttgcatccgtagcctcatcttgaacatagccaagaagcacggacaagattcagcgaccaccccaaataagttntttctgcactccatcattgagggttctaaatccgcttccttctcttcg

SEQ ID NO: 50183 - DNA, 470 bp, Triticum aestivum
  Clone ID: PAT_TA_50183
ggttctcctgtcgcacggtccagatctgacggggccacatcagcctccacggcaaagcctcggactggaggcgtccaccagttcatgatgaggtcgcagggttactacaagcaacaataattccttgtgatttatcgaatgatgataaaatttgtagagcaactgggctcattgttgtgatctaccatcgtcaacgacattgatatttcacacccatctcaatctggtgccgcctgtgttggccatgatacatctgcagcccttgaagtcgtgtttgctctctgtgctaggctgcagtctttcttgaggcgtccgtttataccgccccacccatccaggtttcaattgaagaggaacaagtgtatagcctacaggtggttcttcaatccaatgattttcctcatatgtttctaagataaatagtcactattttctgttatacctatggattttaatttctgttatacaat

SEQ ID NO: 50184 - DNA, 701 bp, Triticum aestivum
  unsure (1)..(701): unsure at all n locations
  Clone ID: PAT_TA_50184
cccacgcgtccgcccacgcgtccgcaacaaaaccagaatcatcagttactgcctaacactgacatgccagcttcaggaccctgcccgccatcttttgctgacggaactggaacataagaccaggcagtttcaagcaagatgatttactggtcagtataatgttattttttatctttttttacgtaatattttttttaccaattaactgaaactccaataggcatgtacatatcagtagatgaatctcccagtaatacaaagtttgctatcggtaaactgaaactccaataggcatgtagatcggtaaataatgtgcaggcatgatttttattgagttatctatgaaatgtactacatgctgtcattttttcccacgcttaagcgcatgcacttggcgtgtggaacctaccgaattgccgtcgccggatggaacggttcttgatattttgttcccctttggcaccttccgggtcctgtccaatcagtagattaactctgatcgcggcggttgtacatccgtttcactctttcgctgctacattcaatagactttnttgtcagatttgaaaaacaagtcccactagttcacaaacaattgggttgggcatcgctctcttgatgcagacgggacaaggaaatgcacagggacttgcatgagatcagcaactactgaaaatactactagtaatacccagatgaga

SEQ ID NO: 50185 - DNA, 427 bp, Triticum aestivum
  Clone ID: PAT_TA_50185
ggactgactgtatcaagtatgcagaagattaatgcgctgctaagcttcctaactcaaatgccatgtgttcgccttatagtggtagttggtggagacaatgcaaatacgccatctacaacagcagctgctggagtggaaatcataacttactccaggctacacagccagggaaagatgagttctcaaacttaccgtcctccaaaacctgaagatgttgccactatctgctacacgagtggcactactggcacaccaaaggatcaagcttgggcgttaagttttacccctccgacgtgtatatctcatacctacctttagctcacatctatgagagagctaaccaaattgcactgcttcactatggtgttgccattggattttaccaaggggataatttgaaagctgtggatgatttggctgctttgag

SEQ ID NO: 50186 - DNA, 453 bp, Triticum aestivum
  Clone ID: PAT_TA_50186
ctccccgcgatcccggacgccattagcaacaagcaccacaggtctcagcaggcttcgtcttctctctcccgcggaagctataccgttgctcttccgtcgatctgtgcgcgcgaacaagttaattaggtggcttggtgtgctcgtcgatcgccatggccgacgactcatcgtccccggcgtcttacatccgactggtgcagcatctgatcgagaagtgcatctgctacgacatgaacaaggaggaatgcgtgcaggcgctggagaagcacgccaacatcctgcccgccgtcacatccactggtaacagctccgtccactctcacattgctttgatcggtagcttcgagtttgtcatcgatcgctccactggctttcttgcattgcatatctgcatgcatgcagaggaagggagatgttcttctaccggtctcttttagatgggcttcagatact

SEQ ID NO: 50187 - DNA, 436 bp, Triticum aestivum
  Clone ID: PAT_TA_50187
cccacgcgtccgcataatcctcgataccaaagtttatcttcttctgcttgaaatctttttgggttcacagatttggaggatgtgttgcaactgtggatccgcttgcagttgcggctcaaactgtaagtgcgggaagatgtaccctgatctgactgagcatggcagcgccgccgtccaggtcgtcgacgaggtcgttctcggcgtggcgcctgagaacaaggcagtgcagttcgaggtggccgccttgcagtccggctagggctgcagctgctgcgacaactgcaagtgcaacccctgcaactgttaagctgcatgcactcgtacgtacgtgtgttggtgtgagaagtatacgtgacataacgagcgtctgatctgatggagccgagcaagggtgcaggtgcgtgtgcctgtagtttgcttgctcgctattccatgc

SEQ ID NO: 50188 - DNA, 401 bp, Triticum aestivum
  Clone ID: PAT_TA_50188
ttcgagggttgcagcaggggtgcccgcagactaggagttcggcctcttcccccgcgcgagcccgtcggcggcagcagccgccggacggaggccttcctcctcctcctcctccgcagcggccctgcgccgcgcccccccgccggcggtctgggcgacggtggacgggcccctggggatgccgctggaggaggcggaggtccacgcgcggcgctttttcctctggggctttttctgcctcctcttcctttgggccattaactgctgctacttttggcccgtccttcgttcccccgacgtcttctcgcccctcgtctttgcccccatctcgccctttgtcatgcgctccgcgattggctttatcattttcggggtggtttttcttacctgggccatgactttta

SEQ ID NO: 50189 - DNA, 393 bp, Triticum aestivum
  Clone ID: PAT_TA_50189
tcgtggacgcgtgtactgtctcttgggtccgacccttacttcgtctttcccgtcatacaggcgtccgttgcgcgggtgcttttggccggtgtgacaacggtcgccgtgatgtctatgctgaaggaggtgacgccggagctgtcctgcccggtggtcatctttttttacttcaacctaatcgcgcggcggtgaacggggagcttcaccggtgtatgcagagaggccggtgtacgaggtcttattgtacctgatcttccttatatcgagacaggttttcttaggaatgaagccataaagaacgacattgagctggtgctgtttacaacaccatttacaaaggcagacatgattaatgagatctcaattgctttagaagggtttgtttacctttgt

SEQ ID NO: 50190 - DNA, 445 bp, Triticum aestivum
  Clone ID: PAT_TA_50190
ctcgctcgatccgcctgcacaaccggcgctgccccgatccccaagaatccgatccagggatccatgtccatggccgccgtcaccaagaagaagaaggtcatcatcgacaccgacccagggatcgatgacgccatggccatcttcgtggcgctcaggtcgccggagctggaggtggtgggactcaccaccatcttcggcaacgtctacaccgccctcgccacccgcaacgcgctgcacctcctggagaccgctgggaggaccgacatccccgtcgcagagggatcccatgtaacaatcaagaaagccaccaagctacggattgctagcttcgtccacggttccgatggcctcggcaaccagaacttccctccgccggccggcaaggcgctggaccagtccgccgccgcctttcttgtcgagcaggcgaatctctaccccggacagg

SEQ ID NO: 50191 - DNA, 426 bp, Triticum aestivum
  Clone ID: PAT_TA_50191
attttgttcatctccaaactccaaattctaatgctctcagcgtctaaaccccttttcgccctgacttcccttactgccatggcaattcggctaccgccacatacaccaacccactatgccccgcctcaccggcggacaccgccattccgctccatcacgcgagcggctctttctccttccaccaccgcaatggcagtctcgttgccgccatctcccaagaaggttcttgtgcccattgccatgggcacggaagaaatggaggcagtcatcctagccggtgtcctcaggcgagcgggcgctgatgtaacactggcctctggggaggacggcctccagggtgaggcttcctatgggacgcgcatcaatcgaaacaagtccattgcagcatgcgctgaccaggtgttcgaccttgtggctcttccggga

SEQ ID NO: 50192 - DNA, 443 bp, Triticum aestivum
  Clone ID: PAT_TA_50192
gtaacagcaaatatgaggggcaatagtgcagaagaagtggctgagagagttctcagccaaacatcattatgtggattacagggcccaactataagcccagtgtattgcacgcttgatggcaatgttgctgtggactactatgctattaatgttgtagttccccaaaagtcgctttacaagtctattcaacaactgagatctattggtggcagcggagtcttggtgtcgaaactgacctacatatttgacgaggagactcctaggtggcgcaaacttctctctgagctgggaatgtgagacttgctgcaaggtcggccatgccctccgctagaatggaccgtctcagtgagcatctgaacttatgctcgctgtagtgtgtacatcatacacagaagcgacccgagtttgaaaaaaaaacccgtatgcaaagtgagcttccatgt

SEQ ID NO: 50193 - DNA, 390 bp, Triticum aestivum
  Clone ID: PAT_TA_50193
cccacgcatacgtcacataagattatctatactagaacctaagctgcaatgaacggtgacaagaacttgatctccaacctgatgttcatcaggaagctcgtcaaggaggcctacaagacgaactacgagaagaacatcgtcaaggacatggacaaggaaaagttagccgacatcttcgactacatcctcaagtacggcaagaagtacgacaagctggaggacaagcccctggagcagtatctggagaacgttgaacagtacatgtaacagtacacctacaaggagaccaacaaggcaaatactgacgcacatgctgccgatgacgcagcaaacacggatgcacccaatgaggcagcgcctgcccctgcccatgacaaataggaagagaaa

SEQ ID NO: 50194 - DNA, 303 bp, Triticum aestivum
  Clone ID: PAT_TA_50194
cccactcgtgcgcggacgcgtgggttcgcatcgcagcacaccagcttagaccatggccgacggcacctacaccgtttccggcctcgtcggcgccgagctcgcccggcggtcagccttatataccagcttcactagtggcggacgtgtgtaaggaaggaacccgatgatgacgaggaacctggagaggaactgcaggatcacctgcatgacggttccgcgggactgtgtagggagggacctgaacgtgatcgggttagggctgatcaggtggctggcgcctgcgagcattccgttgatcaaacg

SEQ ID NO: 50195 - DNA, 394 bp, Triticum aestivum
  Clone ID: PAT_TA_50195
cccacgcgtccgctccgtattcccccacacttcggcttatggctcaagacttttaatgggaagccgagggtagtcgacggggagcacgcggagtgtggcaacgccatggtgagcaagctcgcgccgtactctttggccaaagggctccttcaatggcagcgggaggggttttacatcactgaaccccgcggtaccaagtcggcagctacacgtgcgttccgatctggccctccattacgactcgcatcatggattaataaggggctggactggggaccaattgatgaagtgcagacgctacaaagccgtatccggagtctccttgaaaaggacaccggtcttatcaacatgatccaggtaatgctaggctgccgggtcctgccgtgccagcgac

SEQ ID NO: 50196 - DNA, 337 bp, Triticum aestivum
  Clone ID: PAT_TA_50196
catgatttccgagcatgggggcctcgtggagtaccatttcagcccgcaggacgggtgggagtgggtagagcacgggacgccccaccgggacgtgaccctcgtggtcgccccagggccgtgcttcgacggcacccagctgttcgtcatcgggtccgacggacacgtctacctgcggcacctggacgagcgaacgtggaggtggacgagccacgggcacccgtcggaaccatccagcacgacgacggacgttgccggtggcggcgagcagagctgcgccacgctgggcgccgcggacgcgcactacgcgagcagcttcagggggagctgcgacgaaaag

SEQ ID NO: 50197 - DNA, 366 bp, Triticum aestivum
  Clone ID: PAT_TA_50197
gcctcctcctagcaagctatatacctacatagtacagccatggcccccaccgcgatggcctcgtgggccacctccgtcgctcctttgcaggggctcaagtccaccgccggcctgcccgtaagccgtcgatccaacggcgctagcctcggcagcgtcagcaacgggggaaggatcaggtgcatgcaagcgtggcccatccagggcattaagaagttcgagaccctggcctacctgccaccggtcagcacggaggctctactcaagcaggtcgactacctgaggcgatccaagtgggtgcctagcctcgagtccagcaagggggcgcttatctgacgggagcccaacccattctctggggactacgat

SEQ ID NO: 50198 - DNA, 247 bp, Triticum aestivum
  Clone ID: PAT_TA_50198
gtcggtggctcacacttaacgcaacatagcgctagctcgcctacagcttggcacaagcaagcacagaagctaccgatcgcccacggcgccctcgaggaagcttacatgaacactcttcacatggcgaggcttccgatcctgccgatggacgcaccataacccgcgcgagctgcgtctctctctagaccctgatgctgccccctagcaagttgttgacgtgccgctgagtgtacactacaagctccct

SEQ ID NO: 50199 - DNA, 389 bp, Triticum aestivum
  Clone ID: PAT_TA_50199
cagagcaagctgttctactgtcacatacacacactcacatgtgctggctagctagctgcgagcgcagccaatgtgaaggacgaactctgcctcatggttcaccagatggaggggggggacttgcaacccgccgctgacgggggggtggacacgtacggccactactgcgcgacggtggtgaccggcatcggccacgacggcgactacgagcgcatcaccacggaggagaagcaccacacgcacaaggagcacctcgtgagatgggcgcagacgaggtcggagacttacgccctttacgagaagcacgaggcgaataagggacccgagtacgcgcacaagcacaagatcgaggaggaggtggctgccgtcctactcggtggacccggagg

SEQ ID NO: 50200 - DNA, 438 bp, Triticum aestivum
  Clone ID: PAT_TA_50200
cccattcttcccttcctacctcctcctctgttgccacacgctagatcccccatccacagccggcactctctggtgggcgcccctcccattcgtcaccattgtcggcggacacataggcccatgctcttccctgccccgccccttcttcatatccgatccccgaagtgctcgaggaggcgctcgagctcggcatgctcgccggcgacaccggggccctcccttctcctgatgcactctccgtcgccgccatgagcgtctccaccttctcccgcgcgccgtgaatcctccctcccccctgctcgagacgccatcaaggtccggttccaactcttcttctcccctcgatccggatgctctgctctccgacaccatctttttgcttgttcgattcagtctggagcaggagcagctgctgctcgcgacctctaggtccttctt

SEQ ID NO: 50201 - DNA, 456 bp, Triticum aestivum
  Clone ID: PAT_TA_50201
ggaaaactatttcaagatggaaattatgttgccataagtgtcttcaacctggagacaaggggagcaccaaatagcttcattgcagaatgtaatgtcttaagaaatgtgcggcatcgtaatctggttcctatactaaccgcatgctcaagcattgattctaatggcaatgatttcaaagctctagtgtatgagttcatgcctcgaggaggcttgcatggactactgtactcaactcaagactatgagagctcttttgatttgatgcatattacagtagctcaaaggctaagcattgttgtggatatagcagatgcactggagtacctacaccataacaaccaaggaactattgttcattgtgatatgaagcctagcaacattcttttggatgacaatatgacagctcatgttggagattttggtcttgcaaggttcgtagttgattcaacggtatca

SEQ ID NO: 50202 - DNA, 421 bp, Triticum aestivum
  unsure (1)..(421): unsure at all n locations
  Clone ID: PAT_TA_50202
gtccagcaccgccgccgtcgccgccgtcgaggaagaagaagaggaagcgaccagagcaaacccggcgtgcgaagatgaagacgatcctggcgtcggagacgatggagatcccggaggaggtgacggtgaaggtgtcggcgaagatgatctcggtgacgggtccccgggggacgctgacccgcaacttcaagcacctcaacctcgacttccagctgcaggaaggcgggcggaagctcaaggtggacgcctggttcggcacccgcaagaccatggccgccatccgcaccgtcatcttccacgtccagaacctcatcaccggggtcaccaagggcttccgctacaagatgcgcttcgtttacccccactttcccattaacgccttcatcaccggcgncaacaagggcattgagaacaggaactt

SEQ ID NO: 50203 - DNA, 268 bp, Triticum aestivum
  Clone ID: PAT_TA_50203
cccacgcgttcggcgtgttattgagagaagacttaattgaagagtcatagggagggacttacggcaccacaaacagaaactaaagctaaagttggatttaaagctggtgataaagattataaaaagacttactacaccacaaaggatgcaactaacggggccgcgatcttgggaggataccgagctagtgctcagcctggagaaccacccgcagaagcaggtgccgcattagctaccggatcatgtacagctacatggacaactggat

SEQ ID NO: 50204 - DNA, 244 bp, Triticum aestivum
  Clone ID: PAT_TA_50204
aaggcctagttgattggaaatcgaccatgcaaatccgagccctaatccttccatgtgctggagcgctatcttcatctgttagcgtcgagcggaagatgatggcggcggcggacaaggaccaactagggttcgaggaggaggatgatatgggggcatgaacgccgccggcgcccatgaagatgcattcgatcgatctcgagcacatacggtcgctcgcggcggtggcggagtccatttcgccccg

SEQ ID NO: 50205 - DNA, 445 bp, Triticum aestivum
  Clone ID: PAT_TA_50205
cagtctgtaccacacaccacgcctgcctcatctctcggagcaggaggaggaggagcttgcaggaacaatggcaaggtgggtctggtgcccccggggacggcgatcctgtggctcctggcaggcgcgatcccgccggcaggcacctaccagtactgggccgacccctacacgctcttcgtgttcgagatggcgctcatcggcttcgcggagcaccggcggctccaggactggtacaacccgggctccatgggcaagcagtacttcctgggcctcgagaagtacctcggtggctccggcgaccccgcctaccccggcgggcccatcttcaacccgctcgggttcggcaccaagagcgagaaggagatgaaggagctcaagctcaaggagatcaagaacggccgccttgccatgctcgccttccttggcatgtccctgcaggccatct

SEQ ID NO: 50206 - DNA, 458 bp, Triticum aestivum
  Clone ID: PAT_TA_50206
ccttcaccaagtccctcgctcccgatccaacttcccgacggctgccatcaccaccaccactgtgccgatccaatcccctcgcccctcaccgatacaaatttacccagcctatgaacgccttcaagttcacggagctcacctcaccgggctcctctgtggagcgtatatcctcggaagatcatagactggatccccccagagcggtggggagtcgagggcgaagacagttctggaggtgccataggccatcctgtctaccgcaggcagctcttcggagatcgtcgaggggcggtcactgaaatcggcctaggcgacatggacatgccaagggcacccgtacgcggaccctgcgtcgtaagcctgccgctgcgcggatcgctgcctaggtgactctccctcatgttggagctcttatccctgcccgaactaagccccacaatttgccctacaccctccat

SEQ ID NO: 50207 - DNA, 264 bp, Triticum aestivum
  Clone ID: PAT_TA_50207
acccaccatccagtcaggggtgctcttacgggagggggtcatagtatccaaacacatatgatcacttctcgctcctccaccaacttcaacctcttcaccttcacctaatgcatcgatacccttaccacctaagcgctgtctgttgatgtcacctaaaaaaggaacctgctcgctgtcataagcctaaccatcgtctggaacaactgcactcttagacgttccagaatgcccgaatgaacagcggcagaccctgcaacgaatctt

SEQ ID NO: 50208 - DNA, 387 bp, Triticum aestivum
  Clone ID: PAT_TA_50208
gttattaaggattttgatggtattgaacagggggggggtgggggcttgcctgcatttgtagctcctttctatgatatctacacactaaatgataagaatgtgcaaattgttgatacgacatgcccttgggttttaaaggtgtgtaacatggttgagatgcatatgaagggggactatacttctattatttacggaaaattttcctatgaagagactgttgccactgttttttttgcagggaagtactttattgtgaagaatatggccgtggttacatacgtatgtgattatatacttggtggtcaactttgtgggtttagcttaactagagaggagtttcttgagaatttcataatgggtgtttttgcaggatttgttcctgatttt

SEQ ID NO: 50209 - DNA, 154 bp, Triticum aestivum
  Clone ID: PAT_TA_50209
gttgccaacctgttgttctcttaacacaagagtggctgggggtgacaggctttctattatctatcgttatttttgcttctttctatattcattacttttctttattctagataggtagttctattgcttttctatattcagtctcctatgtgtt

SEQ ID NO: 50210 - DNA, 165 bp, Triticum aestivum
  unsure (1)..(165): unsure at all n locations
  Clone ID: PAT_TA_50210
acgaccacgcgttcgaggacgcgtgtgttgtccaggtgtgcttgcatagatacactgaagtgagtaatagcatccttagctacctggatggctttagcgctcaaggcttccctcttgccgtcttcctcgcctttgntatgccctcagagtagccgtgccagggcg

SEQ ID NO: 50211 - DNA, 452 bp, Triticum aestivum
  Clone ID: PAT_TA_50211
ctccaacaccatggccctcactgtgatggcttcctagggcaccttcgtcgcacccttccagggtctcaagtccaccgccgtccttcccatcagtcgtcgctccagcagcgccggcctcagcagcgtcagcaacggcggaaggatcaggtgcatgcaggtgtcgccgattgagggcatcaagaagttcgagaccctgtcttacctgccacccctttccacggaggccctcctgaagcaggacgactacttgatccgctccaagtgggtgccctgcctcgagttcagcatggtcggtttcgtcttccgtgagcacaatagctcccccggatactatgacggtcgatactggacaatgtggaagctgcctatgttcggttgcaccgacgccatacaggtgctcaacgaggtgtaggaggtcaagatggagtaccctgactcctatgtccggttat

SEQ ID NO: 50212 - DNA, 143 bp, Triticum aestivum
  Clone ID: PAT_TA_50212
ctaagatggttgcacttggtgttgtggttaagggtggggttgcaaagcatacagtatagactattcttcaaacttcatttttcatatccaaatataatgcttctattgattcccttgtgtggaagatcatgaaattttctgga

SEQ ID NO: 50213 - DNA, 416 bp, Triticum aestivum
  unsure (1)..(416): unsure at all n locations
  Clone ID: PAT_TA_50213
atctaccacttctgtacctcctccgactaggtggtgggacggaggccatccctctcttgcttcttgagttgcttcaacttttttntcccgatttggtttacttgcatggacgaaatcccttcctttctttacttaattcactttgtgatccaaccccttgtataaaatagggttcaagacataggtaaagattgttgagggttgaataaataggtacagatcgtatggtgttgaatgttctttacttttgcctatataaatacaacaacgttgttcatataaaaggtcttcttagatgtaattatatggcattgaaataagtcttgcatgtgattgttagcatgttgggtgtgtgcagtgtgagccgttgcccacgcatatattccttgtgtgactttgattgcttggggaggagc

SEQ ID NO: 50214 - DNA, 460 bp, Triticum aestivum
  Clone ID: PAT_TA_50214
caggacgaaccctcacagacgcgctacgagacacacaatacgcagagcgcattgagtgctaatgaaagtcctcatcaaactatcgtaaactcaccaaagctcactacataccggagcaaggggatcgactaagggagttatacagtataactgcgctagctaagaataattcgagctgctcaaacaatggaattaaggtcgagctgatggactaggaggagcgtttgagcaaggtacactacgcggattgccgtgaggagcagatcaagaagattcgcgacgaaaacactgcaagccgtctagaagggccacgcacttgaacgacgtagactgggagagcacattctacagccgctacctatctcgtctccaacctggccgacctgcctgacctggaccaccactacaggcaagagatgaaggaatttgtggcgtagatcgagaagcttacggagaaggt

SEQ ID NO: 50215 - DNA, 408 bp, Triticum aestivum
  Clone ID: PAT_TA_50215
ctcccctgcctaccccagagctcgatagggattggtaggttctcgggggagaaatctcaagaggcttcaccatgctcgtgtaccaagacaagctttccggcgacgagcttatgtcggattcgctcccgtacagggagctggagaacggcgtgctctgggaagtcgacggccattgggtcgctcaaggagcagctgatgtggacattgcagccaatccctctgctgagggtggtggtgcaggagcaggtgtttggaccgatggactgaccagtcttgatcgttacaaaggacgatgctttcacatcgagccttgtgctggcgaagacagccaatagacctgtattcgttggttatttattagacctatttgcagagggttctcgttcttacatgcttatcttccatgtg

SEQ ID NO: 50216 - DNA, 435 bp, Triticum aestivum
  Clone ID: PAT_TA_50216
cccacacctccgatcatcatccctgataccaaagctgatctgcttattctagaaatctttttgcctccacagatttcgaggatgtcttgcaactgcggatcaagctgtagctgcgtctcagactgcaagtgcgggaagatgtaccctgatctgacggagcagggcagcgccgacatataggtcgtcgtcaaggccaagacgcgcgagctgcgatgggaacagggcagcccaggtgcgtgaactcgtcgaacccggcccacaagtgtgacgactactggccaaacaagagcgccgaggccaagcgcggtctgctggaagagctcccacacttgtggaatgatccttcgtgggaccgcaccgtgcaccctgactggatcaacgccttcaacccctattatggctgcttcgagtactgctttaagaagattgccgacg

SEQ ID NO: 50217 - DNA, 335 bp, Triticum aestivum
  Clone ID: PAT_TA_50217
cccacgcgtccggctcaacggctcatcgggggggggggcatggccgtctctcgcctacgttgagcccaccatcacgagcaagaaaccactgaacactagcggggcaccatgctcggcatccgcatcctctgcggcgcgccaccggccaccgcctcggcaccgccgccgaggggccgctgcagcgcgccgtagaagagcggtcggtcgttcctgctgagcgttcccgcggccgactccctctcgctcgcactctggtcgcaccctagtgagcgccggcatcctgccaggcgtcaccggtctggtgacgttttcagcgtcctcgttgccccggctcg

SEQ ID NO: 50218 - DNA, 426 bp, Triticum aestivum
  unsure (1)..(426): unsure at all n locations
  Clone ID: PAT_TA_50218
tcctctacccactcttccaatttctctcctcctgtctgctgccaccgagggccgagccagggaggaactccgcgcgaggaggtcaaagtaatatattatctnatcacctatcccagcgcgcgcacaggacagcatgcgccgcgatctctgagcggagatggtgctcacgttcactaagctgttcatccggctcttcgccaagaaggagatgaggatcctcatggtcggtctcgatgcggctgttaagaccaccattctttacaagctcaagctcggagagatcgtcaccaccatccccacaatcgtctttaatgtcntatctgatgagtacaataacactagtttcaccgtttgtgatgtcgggggtcaggacaagatcaggcccctgtggaggcactattttcagaacacccatcgtttcatttt

SEQ ID NO: 50219 - DNA, 361 bp, Triticum aestivum
  Clone ID: PAT_TA_50219
cgccactagtgcatagcgactgaggggggctactgggacctgtgcatgggggtaccagtcgatctccatacccaatctccagacgctaaaattgcactactacgcgtccggttccccccactacgagcccatcaggaggagcaagaggaggtgcccgaggataccgttcccccgttgcatgcggagcaacctacggaccatggacatgaccacaatgtgcctgcgaataaagttatgcatgcccatcatgatttgatcacaaacattttcagaagatgcctcacccagaaggtgagtacgcaacagcacgatgagcgcaatgtagtaggaactgagatgacgctggaccaacgggctacat

SEQ ID NO: 50220 - DNA, 259 bp, Triticum aestivum
  Clone ID: PAT_TA_50220
tgacccactcttcccccacgcgtccgccacgcgtccgcccactctgcgggacgcgtgcgtcagcagtgttctcttctttttcttcatatctcttcctctccatcatcagcatccttgcgtcatgttactatgtttctttgctactttactttcacttatgaactactttacctacaaagcctgtggtccgtgctgcccactttattgatgaatccaccacttaccgttgcttacaacttcgtcgttgcttacatgctca

SEQ ID NO: 50221 - DNA, 230 bp, Triticum aestivum
  unsure (1)..(230): unsure at all n locations
  Clone ID: PAT_TA_50221
tctatcttccgagctggggggaagaaacgagaggcaggtcgggctcagctgacctgagctgctcttaccnccttanctcaactcatctcacctgttctcaccgccgtaggggggagagcaagaagagcaagaagattaagcggaagacgcggaacaagatcgtggtgactgtgctgcttctggggacggagacggtgctgatcgtacgaacgcttactcttatcctgact

SEQ ID NO: 50222 - DNA, 140 bp, Triticum aestivum
  Clone ID: PAT_TA_50222
tttccattaccggcggcccggcctttgtgcaggcggtgggcgaggccatcctcgacgccaccttcttctataaccttccaattctttctacctactagatgtacaactaggtcatcttttcgacttcgaatcggctgttg

SEQ ID NO: 50223 - DNA, 445 bp, Triticum aestivum
  Clone ID: PAT_TA_50223
ccttcctcatagtttgcaccatctggtcactaatgcactagtggcacagaggtgtttcaacaggagactatgattataataaaaatggaccaacacaaaaacacatatcattatttcacgaggttactagctagaagacggtatccagcagcttgacacttaacctttttgctttccgattacaattaatgctagagtcgcttttgatgcaacaagaccatgcagtgagcaataccgtttactattttcatgtattccaaatgtcaggttcgcatggattgacaaggtaattggatattgtcaagaatacagttcggtgggtagttgtttctttactagaactaaacattatcacaaatactacctgagttggtctaatttattgaccttttgaacttactaagctggttcttacttgcagtattgttatcagtgttctttcacc

SEQ ID NO: 50224 - DNA, 363 bp, Triticum aestivum
  Clone ID: PAT_TA_50224
tctatctcccgagctgccgagaagaagcgagatgcagatcgagctgagctgagctgagctgctcgtaccgccttagctgagctgagctgagctgctctgaccgccggaggggggagagcaagaagagcaagaagatgaagcggaagacgcgtaacaagatcgtggtgacggtgctgctgctgggggcggcggcaggtgctgatcggaggtacgctgactctgatcctgacggcgtgtacttataaggtaaagttcttggtagtctcatgtagattggtctgatactttgatcatgcatactagttatttttcttttttctgttatacgtttcttctttacttatcttcttattaagtttcttt

SEQ ID NO: 50225 - DNA, 362 bp, Triticum aestivum
  unsure (1)..(362): unsure at all n locations
  Clone ID: PAT_TA_50225
tgaagaacgaggccagcgacgaagacatcggggggggtgggaataaacataaactcgtttattccctcatacaccaaccttttaaactcactcctgaatacatgaccaggcaactgacaacctggcgaacccaaacatatcagcaggcaggggataagaaagcaaaagccaataaaggcaacgctgccagcgaaatgaaaacaaacgaaaccgggacaacggacatgcggtgagagcaatacaagcgatgnggtgttaggcaaggcggaccagggcctctagcgtattatggatgaagcccatgagcccgactgaatcagtaagttaactgaacaaaccattacccaagtggcatcaggagc

SEQ ID NO: 50226 - DNA, 434 bp, Triticum aestivum
  Clone ID: PAT_TA_50226
gttaaatcgcgagaaggagatgttcactagggacagagtgggtcttatcgtaccattcatcttttacatcaatccattcctacttactgttattgtcactccttttagattcaaactcactacggctctgtaagagtgctgatatactggcatcatcatcaccttctgtttggcctcaactgcggaagtttctaactataaactaagggcttgacaagattctgattccagtcctccaacacttacctatgggattgttagcggattgacagatcatgattatcacatgtgcatttgccggccaattcattatggtaggtttttcttaatcttatatagtaaaagttgttacgagtagttattacttgatatttttccatttttccaactatgcttggttgctttatttattgatacttgaagatcctaccatg

SEQ ID NO: 50227 - DNA, 240 bp, Triticum aestivum
  Clone ID: PAT_TA_50227
ccgatccccaattccacccacgccccaaacctcctccgcataacgtcaaggcggcgcattaagagcggttgatgtgcgccaaggccacctggctggcccatcttatagaagtacaccaaccacttccaagccacctaggccaaggacagtcatgtgcagtgaagagctacctgtactaatccaaccatcccaatcaacactactacgtacgtacgtacggtaccaaagcagaaattaaag

SEQ ID NO: 50228 - DNA, 362 bp, Triticum aestivum
  Clone ID: PAT_TA_50228
gttgcaagcaaggagttggagatccggtttgtcccttcaaaagatcaagttgcagatggcttcacaaaggctttggctacaaggccgtttgaagagttcaagcgtaatctaaactcgagaagtttagattaagagagggtgttaaacatgagatattgtagggatatagatggcagcaaggagttgtcttgcgccatagatagagttatttttctgtttaactttctatccctatctctcttcctgtaatatctctagttggttgaatcccaaccgaaccctctgtacctctcgcgagactcccctcgctcaatcaatataagctgcgggctctccctggtggagagttgagacgcttccac

SEQ ID NO: 50229 - DNA, 268 bp, Triticum aestivum
  Clone ID: PAT_TA_50229
aacacacactcccaacacccgattgccaaactggcgccgcaggggaaaacagtaaaacctgacactgcccaagcaattgtcaaaaaatggccttgatcggctccttcatccaccctacgaagcgtggcacagtcttctcgccggccgcaccaaagcgcggactcctcttgtcacagctcgacctgaggtagaggcgccaggacaacggcatatcggtctcactcgctgccaactttttatacagagcgtgtcagcggaggtcgataag

SEQ ID NO: 50230 - DNA, 380 bp, Triticum aestivum
  Clone ID: PAT_TA_50230
cccacccttccgggaccttgggatccaccatatggtggttaatgactgttacatatgtgtcatacctttagcataactttcttcttatatctctccccatcgttctcatcgagggcctgttgccgtcagggatgcacatccttcacgcttacacaccggtgacggagcctttcggcctgtgggacgggctcgaccggaagagtgcggcataccggagcctaaaagaggagctgtccgaggtgatttggaaggcggtggatcttgcgctgtgcccttagttcatccgctaaaagtgcgacgcgtatctgttcgtcactccgctgacgctcaagcgtgtttctccttttgaaccgattcacctactgctcctccattaaggc

SEQ ID NO: 50231 - DNA, 313 bp, Triticum aestivum
  Clone ID: PAT_TA_50231
ctctctctcatactactgttttgaggtgttgatcgagtggcgccgttggtagctagctagcaagatggtatatatgaacatctagtttctcttaggctcgcctcctgcggccgatcaccactgccaccagaaggttctccagaaccaccctgtcgtcttcggtgttgtcctcccgtttactgatggtctgctgcaggtggacttagcagacactttcaagtacgcggctacgtgtttccgtggaggtctttttggttctttatcttttcttgtacgtctatgtttccttctctctaatgttactactattttt

SEQ ID NO: 50232 - DNA, 277 bp, Triticum aestivum
  Clone ID: PAT_TA_50232
gaaagaaagaatctgatacattaagctaggcagcatgtccatgatctgcagcatgctgggccggaggcagccgccggcgcatccgcagccgcagcagcacgcggcgggccacaaggccaacggccacggccacggcggcggcggggaccaggtcatggtaccggtgatcatcgacatcctggagccgatcatggaggccatctccctgactgggttctgggggggcggctgccggccggcgcttggcctggcgttcttgaccgggagcattgacttg

SEQ ID NO: 50233 - DNA, 430 bp, Triticum aestivum
  Clone ID: PAT_TA_50233
gacggcagcgcggaggggtcgtcgaaagctatatctatcgcggtccacggttccacaaccacgggatcatggtccagctcgagaaaagcttggcaaggtgtgtgcggaattgtagataggctggtcgaggaggagagcgagtacgtgcagcgtgcgctcacatggccggactgggaggaggcggcggtctcagcgactaccttgaccggcccaacgccatccaccgccgcaccgcgtcgctcgccatcgcgcggtccggcgacgatggaccgcgcatcatggatggggttgggcgggagggtcggagggcgcgctcgtcgcgccgtctctcgctgtcgtcgtggctcgggccgcgctccaggcctctgccggccgacgacaccacgtccgtggactcgagaagccgaggattcgaggggagtggcagcgc

SEQ ID NO: 50234 - DNA, 331 bp, Triticum aestivum
  Clone ID: PAT_TA_50234
cagatggccaaggagtcccagtggacacgcacgcgtgctcatggaggggcaaggaggaggacgtgcggctgggcgccaaccgctactcggagcaccagcccatcggcacggcggcgcagaggcggaggcgcggacgagaaggactacaaggagccgcccccggccccctttttcgaggccggggagctcacctcctggtccttttaccgggcggggatcgccgagttcctggccaccttcctgtggctatacatgtaggggctcacccgtgaataggcgtggtgggcaaaccgtgctagtcgcgaatggggcacggcgtggaatccagggc

SEQ ID NO: 50235 - DNA, 281 bp, Triticum aestivum
  Clone ID: PAT_TA_50235
ttgccgaaactgtgcacgccttcgcggagcttccagcagtcggaggcaggcagcgatggcctcggcggccgtggctattccgcaccctttccccaccgttcttgccttctgcccttgccgccgtccccggcgtcatagagtattcacctttcaacatgggctccccaagctcggctttacacttaaaaaatactgtactttttgggtggatcaaaggggatagatattttcggactcttgaattgataccttttgttgaatagcacactctcacagggtca

SEQ ID NO: 50236 - DNA, 430 bp, Triticum aestivum
  Clone ID: PAT_TA_50236
gacgtggttcacgggccacacgctactcacgtctgccttatctcttcatccctaatcttctctcctccagcctggtgagcgcctccatttccccgcaaagctcactgtcaagcacaactcccatctcacacggagccatggccatacatcgcgcgctcctcgattctatgagcagcgctcatccacgcttcccgtcgtggacggcgacccctctcccgaactctccctcccgatctggtgtgcggcgacaacacggcggcggggagaaactgtagccataagaatcgcgtgctacaacggcggtggccacgagctggaacggcgcgcgcgagatgctacaacggcgcgcctgacgagctggaatctacgaccacccacttcgtgaaccggcatggtgtgctacaaccggtcgcagaggagctgcgacccc

SEQ ID NO: 50237 - DNA, 341 bp, Triticum aestivum
  Clone ID: PAT_TA_50237
tctcgctttcgcaggtcgagcctatctcttgttaaacaatatcctatatgtggcggacattgagatccatgcactgcgagaggttgattttgctaatgagactagtcagaacactatctggaaatggcaccaaaggttccgactactaaggacgaggccggggaactagacaggttctatattccccatgggatgtctggcttgctcactaagaggtgaccgcgttgatcgcaaggacggtgcatcatcaaatctgctatcacagcacccttaaactgtgaccgaacttttcagtgcttatggctcagaaaaacatctgaatggttcacgccccaccaaca

SEQ ID NO: 50238 - DNA, 234 bp, Triticum aestivum
  Clone ID: PAT_TA_50238
cctatggggctaccctagttagagatggttctcacccttctcgggatctttagtctttggatgaggatccagggcctgttatatttcttgtggaggtcgcactcgaggctgggttaccaagagcggtgtgggacactggggatagctcacataatgttgcttacatccttggggaagacgaagctattattgcaggctcataggacggatgcacttcatggatgtatgcatata

SEQ ID NO: 50239 - DNA, 385 bp, Triticum aestivum
  Clone ID: PAT_TA_50239
ccacgcgtcgtaggaataggatctgcgccgccgtcgcccaacgagccgcccgtcgtcgagtcctcctcgacgctggtcgaggatccagtccacctggagctgcaccaaggacgcaccccccggacatagaagtgtaaactgtgcggcaattgtttacacatgtccatctttcgcttcattctcctgagaatagaaagaagtagaggctggagatgctttgctactggaatcccttctgattctatagcggagctcaatagggaaatggaatcgatatttggcgaatctccttcagccagccctttgggctcaaatcctacgcagcaagtagtccatcccactcctgcagcccgggagacacaaccgggtcttacccatgttgatt

SEQ ID NO: 50240 - DNA, 436 bp, Triticum aestivum
  Clone ID: PAT_TA_50240
aggagcagatcgtcggctttctgctgcgacaaggagaagcggagggtggagccggcgtgctccccgtcgtcggtccggccagggtcgggaagagcaccctcgtcgagcatgtctgccatgacgacagggtgcgcatccacttctcctcgatcctcctcatgagcggcgacgacctcgaggacgacgagaagctgagcgacccaggagaccacggcctgatcaaacaccacggccgtgcctcgcacccgcacaataaaggctcgctcgtgatcgtcgagctggccggagacgaggttccagacgaggcgatttggaggaggctccgctcctcggcattctgcaaggggggtgtaaccaagatcatagtcaccagcaggtcggaggcggcccagaggctgggcacagagcgcgcgctcaggctcaaagtcctcagccc

SEQ ID NO: 50241 - DNA, 428 bp, Triticum aestivum
  Clone ID: PAT_TA_50241
gtccgcggaccctgggttcagtctggaaaaaccgaccaatccactggcaagctgaacctaaagtcctggcacgagtctggcaccatagaatgcatccggtcgcgcatcaagctgctggttttccatgatttccgagggggccgcggtgagctcgccttcctcaaattcttctttgagagcgcattggtgctgcaggaggcggtgattgtgtttgccgctgcccccagttcgatggaagaggtgcaatccaaattggatattctggggtccatgaaacgggccagtgaaacctccatagtgctgctcactacacgttctgatcctcaaggaggttatatttggagcttcaaaataggatctgatttttctcctgccgacccttttgaaaactactgaagtcaaggcaagtggcctatgtacttcagaat

SEQ ID NO: 50242 - DNA, 394 bp, Triticum aestivum
  Clone ID: PAT_TA_50242
gcccgctcatcatcaaggggaagcactataatgacattgtcgagctgtgctacattcagagatgatgaggttgcctcaaccagaccagggatccggttcttgcaactataggtggactgagacaggaaggcggtagagcagttcgtgaggagagcggaaaaggctggattaaaggcgattgcgctcaccgtggacacgccgcgacttggccgtgcggaagccaatataaacaacagatttgttgactctccaaaatatacactcaagaacctacaaggatgagaccttgacaaaatggaccagcctaacgattcaggactaccttcgtatgtgcccagtcagatcgaccgtacaatgagctggaaggatgtgaagaggctggagtccatcacca

SEQ ID NO: 50243 - DNA, 440 bp, Triticum aestivum
  unsure (1)..(440): unsure at all n locations
  Clone ID: PAT_TA_50243
gatnannaaagaagaagaatttaactaaacaattgaagaagatcaaggggcgccgcgaggagtggaggattgaggtcgtggttgccagcttcaaattttggttgagcacttcctcaagaatcttgttgaggtgtctgcttcccctctctgtgtcatgaatgattgtgatggctgcagggtcttcgcaaggagttgaaggctgaggtcatggttgtcagcttcaattttttgctaagcaattcctcaagagtcttgccaagatctgaggatgaagggaagaagaagaatttaactaaacaattgaagaagatcaaggggcgccgcgaggagtggaggatcaaggttgtgggttgccagcttcaaattttggttgagcacttcctcaagaatcttgttgaggtgtctgtttcccctctttgtgtcatgaatgattgtgatgg

SEQ ID NO: 50244 - DNA, 430 bp, Triticum aestivum
  Clone ID: PAT_TA_50244
cacctggccggtgccagctgctgccgtgctgctttccgctgccgctcggttcaagaacacgggcgcacggagggttgaaaaagcgggggagccacccaggggaggccataaaccaaaccaaatcgatcaatcagtcagccggactcgcctggagatcggaggagccaaaaagaaaagagagagcggagctttttctcggtcagcatccaaagcgcctccgcttcccctctgcattttcctttcggggagagggaggagggagagcattggtgcgcgcgggggatggggacgaggaggaggaggggcggcggaatgccgggcgcggcgtcgctgctgctcctggctagctgctgcttctccgtctggccgcagagccaaatcttggtcggcgccaccaccgacgccactgaccttactgccctcaacacgc

SEQ ID NO: 50245 - DNA, 402 bp, Triticum aestivum
  Clone ID: PAT_TA_50245
agggagaagccatgggaagaggaggaggaggaggagttgctgtctctggttctggttccgggctgtgtggtatcgccagcagtgaggggtgggacggtggttgagggagatggtcttgagctgtctgtgcggatcgacgaggcccaggcacgatggacgacaatgaccaggttgtgtgggctggatttgacaaattactgcttcatgcgtcatatttcatgcatgtactgcttgtcggcttctctaacgagtttcaagtgcttgatgatgacgatgctgcatatgtttgagatttggactcataacgctatggtgcatctatctttttacaaatgcatcccaccccactttactctgaacaaactgtaggatttacggcatcacactctatacttgtgtttg

SEQ ID NO: 50246 - DNA, 377 bp, Triticum aestivum
  Clone ID: PAT_TA_50246
cccacgcgtccgcggaagggaagcttccagagcgcacgcaaccaaaacccgagttccccttcccctctcgcgcgcccgcccgcccgcccacgggatttcctttcttccccgcctccacgcgccctcttcagatccatccatccgtgattccgtcgggggcgggccacatggcgctcgcggtgggggacctggcggcggctgccggggtctcgcgggaggaggtcgtcgtcatcacgcagtgcgcctcgctcggtgggaagttgccttttgatgacgcgtccgtgggtgctgttctgtctgttataaaaaatgttgagagctttggagataagttgggtgctgaaattagccgagtgctgaaagctgggggaatgggc

SEQ ID NO: 50247 - DNA, 433 bp, Triticum aestivum
  Clone ID: PAT_TA_50247
caaggctgggcagcatcgtggaactactgataatggtcctatcattcatactgacatggtgcttgtggatgctgagggttctcatatctatgctgagatctctaaagactgggaggcaacaatctaggcccatatagacacaacgaaaggcccgtttctttgtccagtgccttataaaggacgagaagggctgacctaatatccttggctccctccatagaacctggtggcgcaagagaagtgccctctagcacgaagcttcggacagaaaggacctcgccaggaaaggtaaaagcaaatttccctatggatggagacgaggtcttcgaccgggcctcgcttggatctacatcgtcggggaacaaaataatccatccaaatgttcagattggtccagacactgtaagggtgccagctagaatgatgcttacgc

SEQ ID NO: 50248 - DNA, 350 bp, Triticum aestivum
  Clone ID: PAT_TA_50248
cactgagagcagcagcgatctgcccacctgccgcagcagtggccggggaggaggctgcgtgccgtgcgagctgtggagacggtcgccgagcctgccaccgccgactctgacacgacggtggagccggcgtccgccgactttgcgttcgtcagccctcggttgctggcgggcggaacgccatacatgcactaccgatcggggggctgaggacagaagctaacgtacattatgctccaaggttacatacagctgctactggtcttacagataaatctctgttcaactgttcaggaggcggctaggctggacttgcatcggggaggttgatgtatgcggagaactgctttctt

SEQ ID NO: 50249 - DNA, 251 bp, Triticum aestivum
  Clone ID: PAT_TA_50249
gcgtccgcgccaaccttgatggtgctcgaagtcggctacaaggtccacggtgaaaaatacttacaagaacttattctggcaagaatttcgctgccgccatccgccttccgctctgcacctaccctcctcgttgccaagatcggctactgtgatttgccccgagtgatggtgccgtccatggtcttcgtccttctcttgcttttctccttgatcttcgttttcatcttatttgacttctttttttggactgt

SEQ ID NO: 50250 - DNA, 435 bp, Triticum aestivum
  unsure (1)..(435): unsure at all n locations
  Clone ID: PAT_TA_50250
nccgcgcgcggcgcccccgctgcgcaggtggagccgcacggaggacgcggagcactcccctcggccgggggcagcccctccgacctcctcttcctcgccggcggcggtcgcctccttctctgattgcgcggcggcgctgactgctaagtgctaacccacgctaagtcgtcgttaacaacatccggtacgcggtagatacagcagaggagattgtaagagcagtccggaggagatggagatgaagctgacgattaagagggttccgacggtgctgtccaactaccaggaagaaggaggcgggggctgcggcaggaactgcctcggggattgctgcttgcctgcttccaagctccccctctatgctttcaaggccgacccaaagaagcctgcgcaggatgatgagctccctaccgagttcttcctaaattctctcct

SEQ ID NO: 50251 - DNA, 415 bp, Triticum aestivum
  Clone ID: PAT_TA_50251
atccaatcccgcctccagccgccgccgccgcgccccgcaggagacaagagaaaaccctaacccatctccgctctcccccctcctctcccacctccgaccgcgccgccgccgcccgctccggcctccaccgcaccgccccgaaccgcgcgcggggatggagaaccccgacgggcaagcgggagccgacgcggggctgcccccgcccccaccgccgcccctggacgccgcagcgggggcgggcctgggcggcgacccggccgaggtcctcccgccgccgcccccgcacctcccggggggcgccccgcacgaagtggcggcgcaggggcccgacggatccgcgtacccggccgagcacgccgcggtgaacgggacctccggcgacgcggtgggctaccaggccgcggagaacggcgcc

SEQ ID NO: 50252 - DNA, 348 bp, Triticum aestivum
  Clone ID: PAT_TA_50252
gaaagggcataggtactaagaaggggtggttacttgcgttttgcgaaaccgtccatggcggcagggcagagcttctgagcgtttggtgcaaaagaagcttggatggaacataatttcagataggaggactacacagaggctgaatgtgtacgctacaatgcatagataagtgagatgagataagtgtagtataatagcacactaagtgtgagatgattgttatgatatagatatgtcactagatatacatgaaagttgactcttggaaacggtccattgatctatggaagaaagacaagatgtccaaggatgggctggagacatgctcacaggctgatgatccccagc

SEQ ID NO: 50253 - DNA, 359 bp, Triticum aestivum
  Clone ID: PAT_TA_50253
gcagacattcattactgatcaccatctcagccgtgcatgcaccggtgttagcaaggtcgagcaagcaggacagagatggctgctgtcttctcctccaccgtcggtgccccaggttctacgccgaccaacttcctcggtaagaagctcaggaagcaggtgaccttggccgggaactaccatggcacgagctgcaagggcaacaggttcacggacatggcaggcgaaaacatcgactagaagaggaacaccgacaagtggatgggtcttgcgtgcgatatctccgacgaccagcaggacatcaccagagggaagggcatcgtggactccctgttacaggcgcccactggcgaccgcaccca

SEQ ID NO: 50254 - DNA, 190 bp, Triticum aestivum
  Clone ID: PAT_TA_50254
cgtgacaaaccactccgacctccccgtgtacctgaagctgctgagcctggcgcgcccagggcttggtcgtcccacggcagctccacgtcgagctctgtctctccgctcgctatgacggcgtccaccgacgcctcctgatttcacatgacacacttatcattaaaaaaaaaagaagacctgaccaactgga

SEQ ID NO: 50255 - DNA, 309 bp, Triticum aestivum
  Clone ID: PAT_TA_50255
gcgacccgtgggccgtcactgagcactgtactgggcgctacgccgttcgctagttccatcatggggcccgcggttgctcgatagcgacgccacccattagttggcttacggcaggtcactggccactatgaggcgactggtgacttgcgcctgttctaggctaacgtcaccggtctcgctgtgtgcacccagggaagaggcacgacagacatattcccatccacggctctactatcgatgtagggcaacctgctgcccctaatgagggcagccgacccgtggcgacggtcccaacctgcataggcactg

SEQ ID NO: 50256 - DNA, 496 bp, Triticum aestivum
  Clone ID: PAT_TA_50256
cggacgcgtgggcaaagcagaggggagcagccatgcccgggcttctcctcaacaccgccgcccccctcgccaatcccagcagcctcaggccgtccttcgcttcctcccgccaccggcaccgatgccgagccgctgcctcctcctcgtcgtcgtccagctctagcggcggcgggcgcgggtcgtcgtgggcgacagactacgacctgtacgagctgctgggggtggagccctcgtcgccgcaggctgacatcaaggccgcctaccgggcgctgcagaagcgctgccacccggacgtcgccgccggcaacggagacgcctcggctggcccctcctcccacgacatggccgtggtgctcaacgaggtgtacgcgctgctctccgacccggcgcagcgccaggcctacgaccgggagcacgcgcgccggtccgagttccagggctacacgggccgcccgctctactcgtcgtggcgcgggcgggacgcccagacgcgcgc

SEQ ID NO: 50257 - DNA, 402 bp, Triticum aestivum
  Clone ID: PAT_TA_50257
cggacacgtggtaaaaaaaacgcgcacgctaaacaccggcggatctagtcgtgccgagcgagcgagaagtgaaacacgccgccgatgggtagagcaaggcgtcaggattcagtgtgatgtgtgctaagacgagcatgctttcctcttcttgacgaaccatagggtggtttgttggctccactgggacgattcaatccacgaccagggctggctctctgcgatgcatcagctttatgtctgaacacggatccgtgtccgctgaagttccgtatgaagcgcacacactgacgggactgcgtcggaggggattccaagtccaggggggcctggaccgccggagtgcgaatgacgggtccgatgtcagccgacgggcaggacgtgccggcgagctcgggcatgccg

SEQ ID NO: 50258 - DNA, 397 bp, Triticum aestivum
  Clone ID: PAT_TA_50258
ccctctcaccccaaatcccaaacctccgcgccccccttccggcggcccccaaaaccctagcccgccgccgcccccgccgatcccgccgccatggatgacagcctctacgacgagttcggcaactacatcggcccggagctcgccgactccgacgccgatgactcggacgccgccgtctccccgtccccctcgcagtcccgctccccctccccggagcgctccccgtccggctcccccaactgccgtcgacccgtcagccttatggatgtcgacgacgacgactacgccgacgccgtccagaacgccgtcgtactctccgaggacaagaagtactaccccacgggcgaggaggtctacggcccgggcgttgaggcgctcgtcatggacgaggactagc

SEQ ID NO: 50259 - DNA, 467 bp, Triticum aestivum
  Clone ID: PAT_TA_50259
gagataaaggggaagtcatggaggcgatttgctgtggagattcgggtgcgtgatctggtcggatcccgctttcccgggaagaggccgtggcggtggtgccggtgatgcggtgggtgctgccatggtgtgaatcaatgatgtcctccgcccccgcctatatcctccccgtagccccccctccctgccccgagatgccgcattagccaccaacgcactcccccgtctccccctccaatcttcaccaatccaagcctccctccggcggcggcgacggcggagagatcggcgagatttccctcttcctcccactctgtctctgtctgagctcgaggagagggagagagattgagagggcctccgtgcggattggctcggttcctctggttcttgctcccagcccggcccgcgcgccatgacggtggtcgacgccgagaccccggtccacgtcctggcgggggacgacagcg

SEQ ID NO: 50260 - DNA, 331 bp, Triticum aestivum
  unsure (1)..(331): unsure at all n locations
  Clone ID: PAT_TA_50260
gatgatatagtctctacaatcagacctggattagacatggaaaaatagcccatggggagattggatactacactagcacactagtcactatgcggtgcccggctgcaggacgaccataattgcgagtgacaccctatacagctgctgtactaaagaccgctattgcgggaccgaggacaactactggcgacaacagtgcctgataagcccgagcaccgcgagcggctacatgcgcgggtatcccgacgagagcgangtgatggagacgctgatcaacagggtcaaggcccagaacaccaacgggggcggcgggaagagcgtctactcgctg

SEQ ID NO: 50261 - DNA, 432 bp, Triticum aestivum
  Clone ID: PAT_TA_50261
ccctgttattgtgagaattcttaattcaagagttatagggagggacttatgtcaccacaaacagagactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccaggcttgatcgttacataggacgatgctattacattgagcctgttgctggggaagacagccaattgatctcttatgtagcatatgcattttacctattttatgagggttctgtttcttaaatgtttactttttaatgaaggttactttttttgtttttt

SEQ ID NO: 50262 - DNA, 485 bp, Triticum aestivum
  Clone ID: PAT_TA_50262
ggcctagctagctatcgcctccccacctagcaattcacgtactccaccatggccccagccgtgatggcgtcttccgccaccaccgtcgcgcccttccaggggcttaagtcgaccgccggccttcccatcagccgccgctccggcagcgccggcctcagcagcgtcagcaatggcggaaggatcagatgcatgcaggtgtggccgattgagggcatcaagaagttcgagaccctgtcttacttgccacccctctccacggaggccctccttaagcaggtcgactacctgatccgctccaagtgggtgccctgcctcgagtttagcaaggttggcttcgtcttccgtgagcacaacagctcccccgggtactacgacggtcgatactggacaatgtggaagctgcctatgttcgggtgcactgacgccacgcaggtgctcaatgaggtggaggaggtcaagaaggagtaccctgacgcctatgtccg

SEQ ID NO: 50263 - DNA, 476 bp, Triticum aestivum
  Clone ID: PAT_TA_50263
gtagctcaaaaaaatcaataaatccatgaaaaataacaaatgaagtcagaaagggttgaaaattgatgatgtgtctttgaatggtgcattttgaacacagaaaaaatatggagttcaaatatgttcaagaaaatgaaatccctttgtaacagatgatctaacttcatagtaaaaaaatatggtgcattttaaaactataagtatttagtacaaataaaaaaattaaattataagtaaaataaaactataagtatcactaaaaaactataagtaattaaactaaaataaaactataatattcttcaaatttttaaaaattcaaatttaaactatttaaaatttaaaactaatggcactaacagaaagtttataatttttgtgacctaaaagcaaaaagaaatcactaaaaaactggtagtatttagttttaagtggaaataaaataaatagaaaaaaattctaattttatagtaaag

SEQ ID NO: 50264 - DNA, 481 bp, Triticum aestivum
  unsure (1)..(481): unsure at all n locations
  Clone ID: PAT_TA_50264
gcggaagataagtttaccaatgccaaaaaaattgaggcggagctcaaggaagtgagccatatctagggagcagcttctttcagacaaagctcgatcagtatggttcattcgcaagaagaggagcatacgttttgatggcggaagagctctcgagtcctgactgactaatgttgttttagtcaggtaatgatctggccaatagttattactgttgtgattcagagaggaattaaacgtcctggttctgcctcgatctgcccgaagagaagagaagaaaccctgctatacatttgctgtcagctctgaggccaagacccgcgcatcttcagcctcagcatcacagatcctgctggtcagttgcttcatggtgcttcagcctttangtgactcgggcgctgnggcgcccaaggaatggaagactggtaaatcttctagcaggcaattttcattgggccataacatccaactgcacccacatgac

SEQ ID NO: 50265 - DNA, 444 bp, Triticum aestivum
  Clone ID: PAT_TA_50265
ctcactctaagagttatagggagggacttatgtcgccacaaagggaaactaaagcaggtgtagggtatagaggtgcggataaagattatcaattgacttactacaccccagaggctgaaactctagatactgacctatcggctgccatggcgagcagtgctcaccctgaggatgccgccgaagaacaggcgcctgcgtagctggcggatattctactgcaacatggacaactggttggactgatggacttacgaggcttgatcggtccacaagacgatgctatcacataaatcctgcagctggagaagacacgcaatggatctgttatgtacgcttatccattatacctatatggagagggttccgttaataacatgtggacttgcactgaatgtggcgtaattagtgtcgcagccctacgggctgtacgtttggaggatctac

SEQ ID NO: 50266 - DNA, 152 bp, Triticum aestivum
  unsure (1)..(152): unsure at all n locations
  Clone ID: PAT_TA_50266
gccccaggctcaacacacccaagtcgaaccacacgngcgancgccgtctatactcaacttacctacagggcatgggcgctctgttcctactatatgttatcttatcacttaatactggccactgactttagcctactaatttgtgcttaatt

SEQ ID NO: 50267 - DNA, 185 bp, Triticum aestivum
  Clone ID: PAT_TA_50267
cggacgcgtgggtgggcaggcgacctgtggtccgcctgtaggcgagagtgagggagtagttctctacaaatatgttaggtccagtgattaatatttgaatcacacatgagttgttcattcagtagtttcttatagaaagttgttagtatggtcagtttgtgtgtacaagtgcacggttgctgcac

SEQ ID NO: 50268 - DNA, 489 bp, Triticum aestivum
  Clone ID: PAT_TA_50268
cccacgcgtccggctgcggcgcgtgagcagtgggcctggcttcatttcttgcacaagaaaccgccggtggtcctgtcttcttgataactcacacaaaggcctggcccataatcaagtccttcgtcgggtctggtctactgtcacgcgtcataatcaagtgtttagtcggtaatttggtttggaaatagaagcctgtgtactgtccagtaggcgtgccacggagggaaccttgccgctacttgcttgcctcgcctttctgtctcctgtgccgtacgtctccggttccttctcgcgagcccctctgcatgcctcccctctggataaaaagtgggtatgctgggccggagacaggtcataaagcggcggcctttagcgcaaagctctgtgtgtgtgtgtgtgtgtgccacaaggaaggatacgcctactccacctatcacttcgattatcagcacatctgcttataattgttatgcgctgaacaacgcatct

SEQ ID NO: 50269 - DNA, 465 bp, Triticum aestivum
  Clone ID: PAT_TA_50269
cttcaatgttaggagacactaacacacagagaatctgcttgcgatcaatcctacctgtcaacacaaggccaatctctagtcgacaaacatacgttaccaaggtcgagagggggaaccgacttagcagtctcatctatccatttcatattgccttgcacaatgatccccttgagtatgttcgcaaggcaaaaaggtctatgcataggaaaaagagctctttagaagtgaagtttatacaagtggttgttcaatttttggtgaaatactttggcgcaaaggtaaactcctatatatatttcatgttcttttgtactttatatgctcttctcaagactgtgtagcacaaatgctgaagaagaagcagtacacgtatgtatgcatgtttctaattatgctgcaacttgtcaatgaaagtagacaggagctcttatcttccgcctatttgccacacgtacaagcacactc

SEQ ID NO: 50270 - DNA, 179 bp, Triticum aestivum
  Clone ID: PAT_TA_50270
ccgcacccatctttcttcagaaacaaaccaccgccccccggtccccaccgacccaccgcatgggccggggcggggatagagccatataggatctctcatctcggcccctctggcctacaccgacctgcgcgacgagtccattatgagtccggcgttctcttgactgcatgaacctatcc

SEQ ID NO: 50271 - DNA, 452 bp, Triticum aestivum
  Clone ID: PAT_TA_50271
cagaaaattgacccgacccacgcagctccagtcgaaatcctcaaggcggtcgtggcggcgcatcggtgagggcttggatggtagctggaaggccgacggcggcgaggacgaaacggaggtggagagggggactgcaggtgcggaagtgagctcatcgaccccgccgacggcaaggtctagccttgctcaccatactccggcaccccgcgtggcacaggcaatgaatccaggacccggactgttagaactcagaacttgaatttagcaggtttcacaagcaattcaaaaagcagagggagagtggtctgagtgtgtgatgcatgtggtgcttctgacactgcaggaagtagtgatccagcaacagagcaaagtcggttggtactgcagctacccacgtggaagtagaatcacaagagagtgatcctgggttcttgtaaaatctggtgtcgtgg

SEQ ID NO: 50272 - DNA, 354 bp, Triticum aestivum
  Clone ID: PAT_TA_50272
gtttttcttcaacgggcctccgaaccctctcaagattgtggagtccataatgagcagcagcacagcctctgctcctaccgaggcgccgaagaaagcagagacttctgatgtggtgcttgtcaccggagctaccggcggcgtcggacgaagagtcgtcgatgtcctgcggaagaatggggtgcctgtccgagtattggttagaaatgcatagtaggcgaggacattgttggggccagatgtggacttgatcataggagatgttacaaagggagacacgctcgatcctatgtactttaaatggattaagaatgtcattaatgcaggtgttgtcatattttgtctaaaagaatgtgt

SEQ ID NO: 50273 - DNA, 238 bp, Triticum aestivum
  Clone ID: PAT_TA_50273
cccacgcataatggtgagaaaaggcatgatcgactacatgaatcgcccgatccgagacgaggtggtcgtgcttgggccagtgaacatccttgaccaggggatgcccgtgatgagccgggggaacaggaactactcgtcgacgtgcatgcagatgataaacaaggcctgtttcgaggacgtgatgcacttcttcaacaccaacatcggcgaggacttcgtctgggccacaacttgcacc

SEQ ID NO: 50274 - DNA, 412 bp, Triticum aestivum
  Clone ID: PAT_TA_50274
gagcaattgattgtgaaaggtgccattgagaggggaacaaaaagaattcggcttcacattcttactgatgggcgtgatgtttcgtatggtaccagcgttggtttagcagagacaattgcgaaagatcttgctcagatacagagagcacggagtagacgcacggatcgcatctggtggtggaaggatgtattttaccatggaccgctataagaatgactggagtgtgttcaagcgtggctgggatgcccattgtcttggagaagcacgcatacaaattcccaagcgcacttgaagctgagaagactctaaaggcacagcccaaggcccatgatcattatttgtccccacttgtgatagctgatgagagaggcaaaaactttggtcctataataaacggagatgcattcttgac

SEQ ID NO: 50275 - DNA, 214 bp, Triticum aestivum
  Clone ID: PAT_TA_50275
ggacccggccgaaattccgggtggaccaagccgtccggcctaatcctacaaagtaaaaaacttaaacatgccagccaaggccccaacggaaagggccagttgggcaacttcgaaggttcctttccaggggctaaaggtcaacacgtcggcttcccctggagcccccgttcaaacgatgttggccttggaaaagttacaaacggggaaagaacac

SEQ ID NO: 50276 - DNA, 452 bp, Triticum aestivum
  Clone ID: PAT_TA_50276
ggagaactgagctgagatactacttctgttctcttctccccccttttccgagccccccacccgtcatctctccagcctccagtctccgccgacgccatggggcaggtctgggcgtctctgcaagagaagctccaagggcggcactggaaggagaggcaggtgcggaagatcaccgacagggtgttcgaccggctcaccgaggatacccagaagcccgagaaggacgccctcaagttcgaggaggtctacatcgccgtcctctgcgtctacaatgacatcaacaagtacttgccggggccgcactacgaccctccgtccaaggagaggctcaaggaactcatgaaagagtttgacatcgacatgaacggtctcctggatcgcgaggagttcgcggagttcatccggaagctgaccgccgagtcactctgcgcgatcagccctaagctgatcat

SEQ ID NO: 50277 - DNA, 398 bp, Triticum aestivum
  Clone ID: PAT_TA_50277
gcgttcttctagtgagtaacggccgtcacgcagctcccacacgaacgatccacagcggcgcgacgagaacggagcgacccccccgactccggagccgagcgatgatgcagaaggtcctcacgaagttctgctgcttcaccatcccgcggaaggccaagcaggagctctctgtcatcgaccagcgacatctgagcgcatctcaagcaccgcgaaggacaaagccaaatggatgttcgagaaactcaaaggcaaaccagacaaggccctctttgacctgctgagcgagtacaacctctctacgggcctgttccctcggaacatcatctgatacgagtacaagcagacgaccctcgagcttgtggtgcacctggccaatccctgcgaagtgagcttaaaag

SEQ ID NO: 50278 - DNA, 435 bp, Triticum aestivum
  Clone ID: PAT_TA_50278
agcaattgaatggaatgaatggcacccgtttatagctgggcctgtagctgtacccatagcatttgcgttcggagctagtattcctctgcccctgcctgcctaccgcgagcacctccgtctacctcctcttccctcctcgtcgtcctcccgctgccggccgggttccgcttcgcctcgcctgcatggagccgggcgggccgtggcgcgatccgcgccaggggtacatctacgggctcggatcgccgatgcagatgccggcgcagcagcgctccgacccggccgcggctggcggggttctcaagcggagcctcggcgagttagaaaggtggcagcaccagcgccagttcgccatgcagcaggagctctacttgcgcgccgtcaggcagcgcacggacgccacgtcgccggccgtcttcccggttacgttggcggaca

SEQ ID NO: 50279 - DNA, 408 bp, Triticum aestivum
  Clone ID: PAT_TA_50279
ctcagaggaagaagatggcctcgtccgcttccttgctccacccttccacgctcgccccagccttctcgccgcccgcaccccggcgcgggctccccccgtcacagctcgacctccgccccagccgccgtcaccacggagtctcggtctcactcgccgcctcgtcatccgccgcgtcgccggaggtggagaagaagccctcctcgccgtccaccccgccgccgggcgagtcctcagccctatcggccgtggcggagagcgtgaaggtgctcaaggaggcggccaagacgaggaaggtgccggccccggaggtgctggcggcgctggccaagatcaagaaagccaagctcgacacctcccgctttttcgagacgcttcgggggaccgagtcccccggcaggacatggaagc

SEQ ID NO: 50280 - DNA, 438 bp, Triticum aestivum
  Clone ID: PAT_TA_50280
gtcaaccaaaagcaccacatcgtgggctggcccaccatggccggagatgagaatgatcgctcaaagtggagtcggagacgacgcgacaaatcatatttcggtgtttttaggtgagaagatagatgaagtgagggctcaagagctaatatttccgcgctgatgttttgaacaaacaagaaaaagaaggatacactatgcttgacaaacgattccatgacctgatagatgcctatgattcatgcttcttgttcatattcagcaaagtcttcagtcaaacacctttacttaattcttgtttggtaagaaaccttctataagtgtgtgctcaaagctcgctatagtatgtatgttatttgaatatattatgctatttatcttaacattcaaatttggtgtgcctaaatagcaagaaatgagcaatgttgaatccttggatta

SEQ ID NO: 50281 - DNA, 267 bp, Triticum aestivum
  Clone ID: PAT_TA_50281
cacatgcgtagaattactcattcgacagctctttcgaggaactcatctcactggataccggacctaacgcaggtgtatatataaaagatagagttcaagactataaatgggcgttctacacctcattctataaaactagagttactgatatctggatagcaacacgcggatgcgctcagcatgggggttaccacaaaaaatctggcgctaccctatatggcgaatcataaacttgtccatgggcgacatgaatgctatgagtactta

SEQ ID NO: 50282 - DNA, 441 bp, Triticum aestivum
  Clone ID: PAT_TA_50282
cccacgcgtccggtcctctgtgatcacttccgaggcagtttatccagcgaagcttagcaggcagcagcaatggcggccgagcccgagatctgcgtgctctccaatggcaggatcacagcgaacatcgccagctggggcgccactatcacctccctcctcgtccccgacgcgcaaggggatctcgcggatgtcgttcttgggttcgacacactggagccgtacttgaaaggcatggcaccttattttggttgcatagttggccgagttgcaaataggatcaagaatgggaagtttgatctgaacggagtcgagtattcattgcctatcaacaacgggccgaacagccttcatggtggattgaaggggtttgacaaggttgtgtgggatgttgtaaagcgtaaagaaggcgagtacccatcaataacctttcaatatgagagc

SEQ ID NO: 50283 - DNA, 449 bp, Triticum aestivum
  Clone ID: PAT_TA_50283
atcatcagccacttctttagcggattgattagccattttctggggtcagaggcggaagtgagcggggtatatcagccgcatatgctctccgcaacctcgcgttgactccatggatcccagcatattcttcgcctccggctgattttctattgccccatcctcacaaaaatggtttctttgcctcatcggagccaccactaggtgctcagcccattttcttaccagttccgtccgtttcgccgaccctgctccggcgcaagcgacacgcacctgcggcgctcaggcttcgattggttggttggtgatctcggcttgaccgcgcggcgcagccagtataaagggcggggtcaccggatagggaagagagggagaggaggcggatccatcggtcgtgcggtcggccatggagatcctgagcccgtcgccggccgccagcccggcgaggaacc

SEQ ID NO: 50284 - DNA, 445 bp, Triticum aestivum
  Clone ID: PAT_TA_50284
agaaaccccccacgatcctttccaaaacaaaaaacacccccgtgattcccatcccgcacctaccccgcccccaaccggcacctccgtcgccgccccgcccacaaccggcgccgccgccctcgccccgcccccagcggatgtcgcctcctccccgaccaccggatccgccgctacccgcggtggccaactcccccgcaagggatccgctggggagcacggcggccgatcccgtgccgcagccagccacctcccactttgcccaccactgtggcagccgccggcggccttccatctgcgctgtagctgcccccgcctggatccgacccctgacagccgcccccggcgcttccctcgcctgggttcggccgccgcgtcgccccgcgcctggattcgaccgctgcgctgcacccgcccctcgatccggccaccattagcaccccccttc

SEQ ID NO: 50285 - DNA, 336 bp, Triticum aestivum
  Clone ID: PAT_TA_50285
cccacgcgtccgcggacgcgtgggcggacgcgtgggcggacccgtgggcagaggaccgggcttatggagcactagtcctttttctactcattgttctccactccggaggacaaggtgctgatggtggtggtgatcaatgaaatcaaggcgttgcactacgaactgcacctttagagcttcggcaggcaccagtctctggtcagcgacaaatactacgactacgaggaggattctctcgactactgtcatggacatctacatccacttgcttcacatcaacttcaacgccattggtgtttacctcgacttctacggccccatgtagcattttcaggg

SEQ ID NO: 50286 - DNA, 440 bp, Triticum aestivum
  Clone ID: PAT_TA_50286
accacgcgtgcggcccctgaccccagcggcctgtcatgctgctcctgatctgcacacaggtcacagaaaatggcatttgcggccccgccaccgccgtgtgctaaggcgctcttttcgagggagaccagcgggcgcgacacctgccactacgcccgccacacactctgcttcccgcacctcctgctctgctttgccgtcgaccacggcgtcgttctgctccgaccgactcctcatcagcggagactggctgctctctcttactacatcctgtgattacaagtacaccatggataatgccgaggatatgagcattgtctactggcttcttgacgaggtctacactgacgaggcacagacggaggcactagcgcccttctttacagggatggtactcaaccatgaggtttcatatctgcttcttgcggagcccactcttgagt

SEQ ID NO: 50287 - DNA, 446 bp, Triticum aestivum
  Clone ID: PAT_TA_50287
gcaaaagactggtgcgtctccaagggcgacattccgtacttcgaaacctcggccaaggacgactacaatgtcgaccccgctttcctgtgcatcgccaagctcgccttggagcatgagcacgatcaagacatctacttcaattcagttgcagaacaaggccctaaaaccgaaggacagacgagcggatgcgcgtgctaggctagcatcttggcattactgtccagtataaggctacaattctgctgcatttatcgcactgtatccattcttgaatgtaatgtatgtaccatacgatagttagtgactgatcaacagttgcaagctgtgctcccttagctgggcaataaaatgtaaacagttccaaccaaggaattattgtcgacctaattcttcgtcggttgtaacatgttgcacttcaactgcttggaatgattgtaacagagcat

SEQ ID NO: 50288 - DNA, 394 bp, Triticum aestivum
  Clone ID: PAT_TA_50288
cccacgcgtccgcccacgcgtccgagaaacaacaagagcttttgagagagagaaagaaagacacacacacacacaccctcaacgcagttagccagagagaaagagaatggcgagccaaggcgttgcctccatgttcgctctcgcattgctcctcggggccttcgcctccatcccacaaagcgtcgagtccatcggagtgtgctacggcatgagcgccaacaacctgccggcggcgagcaccgtcgtcagcatgttcaagtccaacggcatcaactccatgcggctgtacgcccccgaccaggcggcgctgcaagccgtcggccgcaccggcgtcaacgtcgtcgtcggggcgcctaacgacgtgctcttcaaccttcccggcaggccggggggg

SEQ ID NO: 50289 - DNA, 432 bp, Triticum aestivum
  Clone ID: PAT_TA_50289
cccacgcgtacgtcaacgcggccgaggactcttattatgatgcgcatgattcatccggggaccgtacatttgccagttggattctgccgaacaataacagccaacagtgactttacaagttggcattcaaaccttggtcattccatccaaataacaacagtgactatccatattaccctgtggagtgtggtttacagtgaacacccatttgcatccagttgctttttttactgctgggagtgggagaagattccacgtcttgttcttctgaactatgaagtgcatcatgctcctactttatcggaaatatttttccaccgggggaagcacctgcctgtatattcggaagcttatcaatacattactgctggaaactctgttggtgccgatgcttttcatggtctacaagcttcaagatcaatcttttggctt

SEQ ID NO: 50290 - DNA, 427 bp, Triticum aestivum
  Clone ID: PAT_TA_50290
aaccacgtacgagcagatgatgaggtcgcacaaagcgccggtatcacaaccatgtattgacgcaccattggttgggacggagtaatcctggggcatgcttagatgagagagctttccaagcacccgctgcgaaccaaggccatgatcttcgggatgctggccgggtgcaacgataccgccgctcagaatatatgatgcgccaagaaggtccatgttacgagggtacggctcatactgctatacggatgatagtacggacgaccatattgatgttcttaccagaaacttatgggcaatagtttgaaggcacacattactggtatagaaacgacgggccagaagggcattctggagcagctaagtgtatgaccgtggcacaatatgatgttcatgatgtactacggtcctgtagctggagggacgccat

SEQ ID NO: 50291 - DNA, 433 bp, Triticum aestivum
  Clone ID: PAT_TA_50291
ggccattaaaaccattaaggtatgcatcaatgacgccgcctcacgcgtgccacgtccaacgcatggattgggcagaaaaaaagggataaaagaaaaaaatatacaagtggtggagcgaaaccctgtcatccccactcgcctctcctttcctctttcgtttggcagctagggttgtcatcgccgccgccgctgccacacccacctccaccatccatgcccctccagccccggccatcagagaaggcgccctcctgagaatccccatgcggcgctgccgttcgtgagcaaggaagaggagattcagaggctcgaggaggtcgccattaccaccggtgaagaggatgcagacgtcctccttgataagtaagcgctcgttactttgctcgatctgacccgaggggaggagcgggaagtggcggcggtggtctggcct

SEQ ID NO: 50292 - DNA, 171 bp, Triticum aestivum
  Clone ID: PAT_TA_50292
gccaagcatcctagggcgcgtatgtggcagcttccgtcctccaagactatgtgactgacatgggatggcgtcctatgtctgcttttgtcgacaaatacgcggatgagctgaacaagacggccggtacataggcgaggctgggaagggcatgctgtcggagacgagtgacgg

SEQ ID NO: 50293 - DNA, 157 bp, Triticum aestivum
  Clone ID: PAT_TA_50293
aacgttgccaggaaaactctgaccagttcttataatcttgctgagcatcacacactatgagtatagccacatgtctatttcaggtcttacttatacttactgcactgccctttatttgtattgataatggttacatgggtatgtgcccaggctatgt

SEQ ID NO: 50294 - DNA, 436 bp, Triticum aestivum
  Clone ID: PAT_TA_50294
gtcgctaatgccacacctgtgcgtggatccgatgatttgttgaaggcccacaatctggatgtggacgtaaggattcagtataacgatcagagcgatttcgagcgtgtagctcgtcagtttggagtatttgaagagtggaaggttcccttgctaacccaatttaattcatttatctttcgttctcaagtatggcaagtgataaatctctgagtggtgattctttgctctattagaaaaatgcaattttgcatttggactagaaatgcgtaagaacctgagtaatactccctccgttccaaaatacttgacttccatttgtccaaaaatggatgtacctatatactaaaacatgtctagatacatctatattttgataaatggaaagcatgtgttgtggaacggaaggagtagtagtctaccggtgcaaaacattatt

SEQ ID NO: 50295 - DNA, 316 bp, Triticum aestivum
  Clone ID: PAT_TA_50295
cacagctgctgcctgaagcttcggccaagaaacgccgtcctcgccgtccgcgcattgctaccgttggttcttgcgaggcacggcggggaggacggcgtttcttggccacagctgctgcctgaagcttcgggatacggcgatgagatgcgtcctcatccgcccgtcttcgtcagcgcacgcggagcccaagtccggaggtggggacggtgatggaggccatgagccgtacgaggagtacgaagtggagatcctgaagccgtactgtctcaagttcgccaagggccgagacggcggcacctacatcaaggtcatcttt

SEQ ID NO: 50296 - DNA, 459 bp, Triticum aestivum
  Clone ID: PAT_TA_50296
cggacgcgtgggcccgcaccccacgcagatagactcgcatcatcagcacccggcggagatcgtatcatggcgatggagggctacgaccgctagttctggcagttctgctaccatctgcggctccagactgtcagcttctccggcctctccctcggcgactccatctggtcccccgacgactccggccatcgcgcccgcgacgccaacctgttctccccctcctcggcgcccgacaacaacaacgccgtcaagatgaacggcaacggccttaacgggcccggccttatcgtgttcggcaagctcgacttcggcgccaccaccaccagcaaggccgaccgttacaacaacgtcagcctccccgtcgtcgatgacgccaactccaagccctacggcaacgccaacgggctatacggtgccaagcccaacaacgccaccaacaacggatttgggctcaacaag

SEQ ID NO: 50297 - DNA, 453 bp, Triticum aestivum
  Clone ID: PAT_TA_50297
gcgccttcctcttctcctccatgaagagcaagttcgtggccatcggctgccccgacctggcctacttcgtggacgacggggggtactacgtgaccgggtgcatgtcggtgtgccggccgtcggagcgcgcgctgcccgggtcgtgccggggcgacgacggctgctgccagagcaacatcccgctggggctggcctcctaccgcccgcacctccgcagcttcggccggcgccagcagcagcagggagggacgttcctggccaactccacgggctgcgcctacgcgttcatggtggacgcctggtggttctggtacgccggctcccacttcaacaggacgggcgacttcgccgtgcccgtcgtgctggactgggccatcagaggcgccggcgccggggcctcctgcgccgccttgcgggagaacgccaccgcctacgcgtgccggagcgcgcaca

SEQ ID NO: 50298 - DNA, 345 bp, Triticum aestivum
  Clone ID: PAT_TA_50298
acgtccttaccgataagagcaggcgggggcggcgcttcacgcattcggttcgccaacacttcctccgtgcagattaccgggagccgccgccggccgccgcttccccttctcgcctaacttccaaaacccgggggcgtgcgtaccggacggcccgttccggcttcttgtgttccggcaagaacaaatccgcgctttctcctgttggtacttgggagttgcagcttgctgttctaggcttggatagcgttcttgggagagattcacggttactctctggcatattgtgatttgttttggattgatccacatggttatctcggattcttgccgtaggatcaccctctt

SEQ ID NO: 50299 - DNA, 274 bp, Triticum aestivum
  Clone ID: PAT_TA_50299
tcgcggacgcgtgggcagacacgtcggtcaatatccatatgctagaactttgcgtagctggaagcaaggagggctctgtacatcatcctccaaccctactccttcaaactctcgtcttcctacgtccatgcaccgtacaccgcgatcaccctgtatccgcagcatgatgctcaaattatgatgtaataaatatgagcatgctttcttaaggtgcagtgaatctactaacttgactggcataaacgaaaattttggctactggtagaataaacat

SEQ ID NO: 50300 - DNA, 145 bp, Triticum aestivum
  Clone ID: PAT_TA_50300
gcaactagaaatcgactggtgtctctgcttcccagctttggccttgctgcctgctctacacggagtctgtgcaccatgtgtagcgcatcgcgcgccatccgcacgttccgactccgaaggcctatgacgtgagtgcgatgcttga

SEQ ID NO: 50301 - DNA, 407 bp, Triticum aestivum
  Clone ID: PAT_TA_50301
agaaatcaagaaactgagtggagcaactccctccccccttcgtcgtcgtcgtcgccccagggcaggttcctccccccttcctcgccgcttcgctccaccttcccttctcctccttggcttcttcttcctcgcgcttgcttgctcccacggccggccggattggaacttcttggcgcgctctgctcagggcggttggttgctgcagggtcgccggcagcttccccgtcgcgcacggcgggccgcctggccctgaccctccctccgcgggcgatggggaactgcgccagcgccatggacggcctcatcccgtggggctggggcgccaagcccgccgccgccaatcccgcagggatgtttgcgtccaagaggaccacgagctcctccaccaccgccacaacagggaagct

SEQ ID NO: 50302 - DNA, 439 bp, Triticum aestivum
  Clone ID: PAT_TA_50302
cacagagcaagaagagaagagagaagcaaagcttgagatggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaccgtcgcggccatcaaggttggcccgccgccgccgctctccggtggactccccggaacggacaactccgacgaggcaagggacttcgacctgcccctgaagaaccggttctacctgcagccgctgccaccggcggaggcggcggtccgggccaaggagtcgggccaggacattcttaacctcaagccgcttatcgacaagaagcaa

SEQ ID NO: 50303 - DNA, 438 bp, Triticum aestivum
  Clone ID: PAT_TA_50303
aaccaacacaagctcccctcaccggcggccattgtttgtcgcaaccagtagctgctagcgggggagaccgggggaggggagggggggctctggatatgctggaaccagagtccacggctccacgcgtgctgcaaccagcacggccggcggtgaagacgacgagctccgatgctgcaactagagatttttattgctggaaccagacggcaaaaaagctgcaaccacttttggcaggtgctggaaccggacggcgtcgagttcgtttttgctggaactggcaagaaaaattgttggaaccgacaagattttttgctgcatgggcagggaacacgatggtctgagcggacgacggcgacgagcggaggcggtgatgcgtggagatgatgcaaccacaatgggtgcgagctggaacaggccggtgggtgagttgcagtcacc

SEQ ID NO: 50304 - DNA, 445 bp, Triticum aestivum
  Clone ID: PAT_TA_50304
gggccagtctcccttgcccacagggttatgatcgtgttatccacagcggcaaatcccaggccaccgtcctccattgtcacgagcctcccattacacttggccagcgcctccaacacggacaagcgggctgtagtaagttggtactcgatggtgtaattcccgatgccgcggaagtagagcgcgtctcccacatggacgctagccgcaaagtgggcattggcctcggggtgatgaagagaggtggtctcgttccacgcgccggtctccgaggagtacaggctggaggctgacactggcttactctttgaaggggctacaatggtgaccacataggagggagcatctattgacaagcgatcgaaggcttctgctgttctgactatcgatgatgcatgcccgacgtagtcctccggctccggcgagggctggggaacccggcgttggt

SEQ ID NO: 50305 - DNA, 424 bp, Triticum aestivum
  Clone ID: PAT_TA_50305
cccacgcgtccggcccagaaaccttcccccaccgtcgccgcggaagatgccgcagcagcagccgggggccagcgcccacgtcctggactctgtaccactcttcgtcgtcatcctcggcgccgactacaccctagagtatgaaactaaggatactgatatcttggcagcattccgagtaagtcctcagcctgaggttccgaccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggtccgttctaacatgttactttcattgaggtaacgtatttg

SEQ ID NO: 50306 - DNA, 410 bp, Triticum aestivum
  Clone ID: PAT_TA_50306
cggacgcgtgggcggacacctcggacacaggcaccaagaccatgatatgcggaatgatagactaaaagatcggttgtatgaggtgcattgattctggctttactgatggtgctgatgatcactgtatagataattacagctaggaggatagaaacttactccatgaagatgacgcaagcttgcaaggtgatgagtttgactactcataactcgtaggcatcacatataccgactaatttacggtgatgataatgactttgttgaagacgaagatcatgatgagtacgatgtgggaggaggtcactacgacaatactaccacgactgcctgtatgactataagcacaacgactatactgacgatattgtgcttaacatatacgacggaaatggtattgagaaacacgctct

SEQ ID NO: 50307 - DNA, 446 bp, Triticum aestivum
  unsure (1)..(446): unsure at all n locations
  Clone ID: PAT_TA_50307
cttgtcggtttcttcatgcccctccttcctttcctttcctttcctttcctttgttttctgtgcaggttgctcggatctggaccagctgctgctcctactgcttcaggtggacgaggacgagccctccctcattgctgctgcggctgcctactccctcctcctaccccctggcctggtgtgagtggtggagttaatgagccgggatgaagttcgagaagttgcattacaccgtgtaaatattaatgagctgtggaagacaagtgcaccggtaagtgtttgaaattctaagtgtgttggtggaggtggaaggggggattgtgagttggatatgtcattaacagaggtggtgaacttggattggtcatgcagatatagttgttagagaaataagaagatgatgtanagtgatttatgggtaagtaatatagcgaatagatttgcacggg

SEQ ID NO: 50308 - DNA, 362 bp, Triticum aestivum
  Clone ID: PAT_TA_50308
accaaacgtacgaaaacatctagaatattgattatgataaacaagccatttataacaaaaatgaaccagcggtgtgccgttttgttgcagacccatactgagccggtcgtgctttcgacggactattgtttcctattgggggacgacagtggattatggtgatgtaaattttacagcagcaaacatgggcaagcggtgtgctaaaccatgttgatgagaatggactctgtgccgcttagagagcatgggatggatgtaaggaggcttcttgttcataggtttaacaatggggtgggccacctgagtgtgactgtgcaatttttttgcagctgtgttgtataagagtaggttgctgtgtttac

SEQ ID NO: 50309 - DNA, 456 bp, Triticum aestivum
  Clone ID: PAT_TA_50309
cagaagcagcagttcccaagaacaacaggcagagccgaatcacacagaaggaagacttctagctagcagagatgagcagcttggccctcttcttgccaagctcctcctcctctctgttccttacaaagcaggttcaccctaccaaggggagggcgcctgcggttgtgaggtgcagcggtgggcccaccctgtcaggatcgcatgaggaggaagagagagagggggtgatggtggccttggtagggaggagaaatgcactggcctctgcagcagcagcttgtggagtttcggtgcttggttttgcaggcaatggcctggcggcggccaagcagggcccgctggcagggaggatccctgggctctctggccctgatcagaatggttggaaaacataccgcaggccggatgaaaagtctggtggccacggagtcggctggagcccgatcatcccgtaca

SEQ ID NO: 50310 - DNA, 435 bp, Triticum aestivum
  Clone ID: PAT_TA_50310
ccatttctcccttcctcccgctagggttgcgccgccgccaatggccgccgccgcagccgccgccgccatggcgcgcaggctgctctccccctcggcctccacctccgcccgcttcctcctctcccgccacctatcctccgccccttcttccttcccgcgcggcggcgccccggcggcgctgatggacatgctgcgcccggcggccgtcgccccccaatccttccatcagctgatccgcaatgctgggatatcgaccacgaggagcctgcttgctgatgatgatgccatggtccctgtttcttccccgttgtcgtcgccgttgggggctgcggaagggaccgacaacaagggagcagtggtgaagcggacgaaagtccaggccatcaagaaggacatcaagcagagccccaagaaggtaaatctggtagccaagct

SEQ ID NO: 50311 - DNA, 453 bp, Triticum aestivum
  Clone ID: PAT_TA_50311
gacaaggagcactccgccgccgccggctgctccgtaacccacgaagctagatagataagcatggcggccaccagcgcgagtgccggtgcctccctctccgtcacggctgccgctcaccgcctcaggcaccggcagctatgcgcttgcgcacgtgggcccgcgacgcgaccgcatcccctcctcaagctgaaccgccgcagctacgcggtcgcggcgtcgtcggcggcggccatgtctcctctgtccctgtgggaaggccaaggcatccgggcggagttggatgcgccgggaggagttgccagcggtgacgtcatgggccttcttctccgggagcgcatcatcttcctcggcaacgagatcgaggacttcctcgccgacgccgtcgtcagccagctcctcctcctcgacgccatggactccgagtctgacatccggctcttcgtcaactccccc

SEQ ID NO: 50312 - DNA, 457 bp, Triticum aestivum
  Clone ID: PAT_TA_50312
gaccatactgaccccacccaccaacccattggccgacggaacaccaccacgggaatggcgttggtgttggggatcctgctcgtggtcgtgctgctcctggcggcgttggcgatgacgtcggcgcagaaggcgaaggcgcccgcgaagccggcccccgccggcgacgacgcgcccgaggtcgtcgaggcgcccgcgaagcccttcccgggcgtagccgacgcgcccggcgcggctgtcgccgacgggaagccgccgacggacgtgactgtcatgctggagaagtacggcaagtactccaagttcgtgcagctgctcaaggagacccgcgtggagacccatatcaacgcgcagctgactgacagctacaacgggctgaccatcttcgctgcccaccgacgccgtcatggacgggctcaaggccggcaccctcaacgggctctcgtgccaggagcagatt

SEQ ID NO: 50313 - DNA, 463 bp, Triticum aestivum
  Clone ID: PAT_TA_50313
cccacgcgtccgcgaccgctcccgccgccccccgccgccgccgccatgccgaagcactaccgccccgcgggcaagaagaaggaggggaacgccgccaagtacatcaccaggaccaaggcggtcaagtacctgcagatcagcctcgccgtcttcaggaaactatgcattctcaagggagtgtttccccgggagcccaagaagaaggtggaggggaaccacaagacctactaccacatgaaggacatcgccttccttgcccatgaccctttgattgagaagttcagagaaatcaaggttcacagaaagaaagttaaaaaggctatggctaagaaaaacagggatctggctgacagattgttgaaccgaccaccgacttacaaacttgatagacttatcattgaaagatatccatcttttgttgatgctctcagagacttggatgattgcctaacgatggtgcatt

SEQ ID NO: 50314 - DNA, 174 bp, Triticum aestivum
  Clone ID: PAT_TA_50314
aggacgcgtgcgtagaaaggtgtagacgtagtttttatcgcagttttccacaccgtgaagcgatcgtctggcatgtagacctgtccttgcagctcctatcgtgccagccgtcggacaactactcgaccatgtctagtcggagcatagtctagggatcactagtatgggggctcg

SEQ ID NO: 50315 - DNA, 439 bp, Triticum aestivum
  Clone ID: PAT_TA_50315
ccacgcgtccgcccacgcgtccgcacacatacacacacacacacacacacacagatggcacttcctgctaatgccgctgcctcgttgagcttcccggtgatccacgtggagaagcttgagaccggggaaaggggcgcgaccatgggggtcatccgcgatgcctgcgagaactggggattcttcgagctgctgaaccatggcatctcggccgagctgatggacgaggtggagcgggtgagcaaggcgcactacgcggcttgccgggaggagcagttcaaggagttcgcggcgaagacgctggaggctggcggagaaggtgctggacctgctgtgcgagaacctgggcctggagcagggctacctgaagcgagcattcgccggttcaaggggcccgacgttcggcaccaaggtgagcaaatacccaccgtgcccacgcccc

SEQ ID NO: 50316 - DNA, 436 bp, Triticum aestivum
  Clone ID: PAT_TA_50316
ggtttgcaaggccctcgggataccgacagaacagtttgaactatccatgggaatgtccggtgactttgagcaagcgatagagctgggcagcacaaatgtgagggttgggtcaacaatatttggaccaagggagtatccaaaccaaaagcagaattaaagaacatgtgcttcttgtgctcttcgacaattcttattgcctatgtgcattgtatgtatgatggaatgtaaatgtacatgtaaatatctgatgtttagaagtgtgtaattccataaaggacactggaagagagcgagatatagctccattactaagggcagcctttgccctgaatgaacatattcggggtatatacaccctggtattgcattattaagagtgaagaatattgcagcccattttcttcaaaaaaaaaaaaaaaaaaaaaaaatattaaat

SEQ ID NO: 50317 - DNA, 416 bp, Triticum aestivum
  Clone ID: PAT_TA_50317
gtagataaggctgaattcaaggggatagtgcttaccgtggtcaccaccggacttgatcgcaagggagctgatataaacaacagatatgatgtgccaccaaatttgacactaaggaactcagaaggtgcggaccttgataaaatggaccatgttatcgattcacgactagaatctatatgaaggccggttaaatatcagcgtacactgagctggaaggatgagatgagggtgaagggcatcaccacgatgccgatcctggtgataagagtgatcaccagcaaggacagctggctcaacgtacaaaacggtgcgatcggaatgatattgtgcaaccacagaggccgatagatgtactacgttccggagaccatgagcaccatataagatgtatgaacatgtggtgtggggcagatgcc

SEQ ID NO: 50318 - DNA, 389 bp, Triticum aestivum
  Clone ID: PAT_TA_50318
agtttagaagcttgcatacggagcacacataggtacgtatgtttgcaagttaaacgagaggatgacggtgctgaggatcttcgacacgctgttcttgaactggcggaacccctttggcgggatcatgggcacgaccggattcaggctcaccgactcgtggatggccagcaacaccacgaggttcgccgacccctacatgtagagcgggaagacgagcaaggcctacgggtagagggacaggctggccgccgacgacaccaacgaggaggacaaggcggaggaggaggaggacgacatggcgtagttcatcggcgccgagtggtgcttgtggagggaggccaagagcgagacccgccagctcgaccagcgcaacaagagcaccttcttcg

SEQ ID NO: 50319 - DNA, 115 bp, Triticum aestivum
  Clone ID: PAT_TA_50319
atttaacatgctagtttacgggtcatacctattaacattgactcccaaggtaaacatgaagacgacgctggtgtgaatatcagacatgctgttccttaaaattcgacaactacta

SEQ ID NO: 50320 - DNA, 318 bp, Triticum aestivum
  Clone ID: PAT_TA_50320
taggttactcccagatagcatccacatgtccaataacccaaaaatttagaagagggggaacaactatgccttctggaaggataaaagaatatatacactattggatcattttattctggaatcataggtttcagatagatgacctggacttgggttgataaagactagtataagacgagagataccatgagtcatgtcagcaagctatatttagtggactacacttttcaaatttggttaatactcaaatttgtcaatgtatctgctatttgtctaaaattgagactgttacatatttgtatttcacatagtaattgt

SEQ ID NO: 50321 - DNA, 431 bp, Triticum aestivum
  unsure (1)..(431): unsure at all n locations
  Clone ID: PAT_TA_50321
tttttggataaaatgattatggtttttgttgtcggttgggggcatccatttctgctgccctttttttgttcagccacttggcattgtgatctccacagctgctctacagactcganagcctgcttgctccattgtcttcatcatgggtgacatctatttctgaacgcaaaactgtctctaaccatggcttctgctcgttccaatgcccacggtgtctctggagaagataaatccgccacacagaaattaagacaccaaccacgttcatgatcgtggatcacgatcaccatgagattaaatacaggagctaggcagctttgctcaaattctactgcgagccaaggttccattccgtcattcccatgtacttttgttacttcagaccaacttctgacaaaacacacgccagactgttttttactactcacata

SEQ ID NO: 50322 - DNA, 275 bp, Triticum aestivum
  Clone ID: PAT_TA_50322
caggcgcgggcgccgacgctcctaccgcgactgattaggacctgatatactggtcgcccggtctggagcggttggagctcaattcctcgcacgcggggacaaggatcgacgcgctgcggaacgccattgcgatcagtgagcacagggagccgcctttcctgtacgagctgttcaggcacctgtgctatgcaagaacgaactctagccagagctgatgctttccgatggtgccaagcttgaaggggaacaccgaactcgactgctctatctccagc

SEQ ID NO: 50323 - DNA, 218 bp, Triticum aestivum
  Clone ID: PAT_TA_50323
gtattgctcacatgggtgccaacatccactctgcttggactgatacagttgtatttcgacagaggcaacttctatcgacttcacttcactggcgcctgagttagatgttcctggtgaaatatctgaacgaaagacatatccattcgagctctctactgatgaaatgccctatgagtcatacaatggcacaaaggctcaaaatgatgtgcatccttaca

SEQ ID NO: 50324 - DNA, 436 bp, Triticum aestivum
  Clone ID: PAT_TA_50324
gaggagactcgaaccctaatcttccgcctcgatctctcccgccgcaggagagattcctctcagcctcggctccaatccgcgactcgactcgaagctccagctccgccgccgccccccgcctccgatggatccgaagctggtggaggtgacgcagctgttcgaccgcttcaaggccagcaatttcgacgtctgcgcgaccctcctttcgcagctcaaggtcctcctcaccaagttccccagcctacccccgctcttccagcagacgcccaacgccgtggaggagctcaagcttgcgagggaaatttatgagcaggcagcaattttgagtgtgaaaatggaagatcacgatgcatctgaaagggacttgagttcacttaagccgtattacatgtacacatgtgtcataatttctccattattcgggggtgtaccctat

SEQ ID NO: 50325 - DNA, 357 bp, Triticum aestivum
  Clone ID: PAT_TA_50325
ggtaccgatctagaattcccgggccgacaacttcatagaatacaccagcgacttttgcggtgctctgagtactgttgtgtacaactaccatgtgcacaagtcagcgactgcgaacgataacgacaagattggcaaaatgttggtgaagtctcggtacggatgcatgaactttgagcaggtaatgatgacagtggagaaggtgctaaagtactggcatatgcctgacgaccaccacgacagtgtcaagcgtatgcatcatgctgacacctacatgatcaacgcatttctgggtgatgctaaccaggattcgatgaaggctgattcattccactcgatacacattctccatacactgcc

SEQ ID NO: 50326 - DNA, 448 bp, Triticum aestivum
  Clone ID: PAT_TA_50326
gtaccggtctagaattcccgggccgacggatgatgggagcgagattttatcgcattcatgcattcttggcatcagatctcccgttctgagaagtatgctggaagaagctagagtggaagatggtctcagaaacatcctgatttccggtgtaccatctcaagcagtccgtgtcttcatcagatttctgtattcttcacgctttgagcaggatgagatgaagaaatacgcccttcatttgctcgtactctctcatgtttactcggtacaatctctgaagatcgtctgtaccgaccagctcgagaggttttttctcgctcctgataacgcggtggacgttctacaacttgcacggctatgtgacgcaccaaggctctcactcatctgtactcgtatgatcactggagatttcaagaccatctctctgtcagaagggtggaaagtgatgaga

SEQ ID NO: 50327 - DNA, 391 bp, Triticum aestivum
  Clone ID: PAT_TA_50327
gtaccggactagaattcccgggccgacggacacaaccaaggcggcactctagatgaacgtgctcaagctggtgaccgcgacgcatgcggcaagattagggttcatagcatggacatcagtctcgtcggcatcttctgcaggtgcggcttcctcgtccacaccatcatcactcgcaccggtcaacacaacatccacgtgtaacacatggccgggtctctgaatgcaagcacctctgtatatgccacaaacctagctcctgtgaatttatgtatgtatgcacgcagtgtaacagatcgtagtatattctgaatgtgtatatcagtatctctgttacgatgaatctcctatctaacaacgttaagaggagattctctgcaagagcttaggtgtt

SEQ ID NO: 50328 - DNA, 179 bp, Triticum aestivum
  Clone ID: PAT_TA_50328
ggtaccgatcaggaattcccgggccgaccgacagaagaggtcccacacttcacaaatccccaccaatcgaacacacactcctcccggctccctcaaatggcgctcctcgctgtcaagggcatggccatttcaacggcggccttccctgggaacaacaacggggccttaccttctcctcc

SEQ ID NO: 50329 - DNA, 314 bp, Triticum aestivum
  Clone ID: PAT_TA_50329
cggtctagcattcccgggtcgacatctaacggcaaattggcatcgagttgaccctggcatcgtgagcagtcgcaggtcatagacatatatggagggacgtatgtcaccatatttgtatgctatggcacgtgttggatacatagcaggcgttaccagaaaatctgtgactgacgacacgccatcatatggggctatcgaaacggaaatctcggcagtattcctactagctcctcaacctgaggttccacccgttgaagtaagtgctgtactagctagcgaatcttctactggtacatggacatgctgcctggtct

SEQ ID NO: 50330 - DNA, 434 bp, Triticum aestivum
  Clone ID: PAT_TA_50330
aattcccgggccgaccatatattaaaaaaggggaaccacatccttgtcacacgggctaccccaatactgaatgacgatgtggttaagcaatgtgttgacacaagacttggaagggactatcctcataaggctgttgcacagtgagcagcagtcactgcattgtacgtccaatacgaagccgacgatcctgccaaacatgagcatcatcctcaatcgagcaccagcgactgctgaaccctctagcacttgacccacagggatgatcacgcaggacgccaagctgcattcaagccttatgtaagaaatactagatcatgctaaatgagccatcaattgtagtgcttgctgcgcatgtggcacgcagtttttgtacatatgtgattattcttcgcaagttgtaagcctcgagattctagtaccagaaatatgtgatt

SEQ ID NO: 50331 - DNA, 359 bp, Triticum aestivum
  Clone ID: PAT_TA_50331
gagcctccggatccatccatccgcccctcgctgccgctgcgtctcgtctccaccacccgacttgcccccggactcaggaggatcgtccgagatgtcagacaccgatgagcaccacgtcgagtccaaggccgaatccggcgcctccaatacctatccgcagcaggctggcgccatccgcaagggtggccacatcgtcatcaatgcccgtccctgcaaggttgttgaagtcaccacctccatgactgggaagcatggtcacgcaaagtgtcactttgttgccaatgagatctttaatggaaagaggcttgacgatatcgttccttcaagctacaactgtgacgtcccccatgtagactgcc

SEQ ID NO: 50332 - DNA, 423 bp, Triticum aestivum
  Clone ID: PAT_TA_50332
ccctcttttcttttttcttttttttctttttttttttatttttttttttttttttttttttttttttttttttttttttttttttttttcttttttttttttggaaaggggccgaaacaaacaatttgcaagggaaagcttgcccattcaaaataaagtctatgggagccccacaaaacaaatgttttccgggtccccttcttggtcttaaacccaaaccccaaaaaaaaggaaaaatttattacattaacccgggggggcaatcaaaaagggtaaccccttaagggggcccccacaaaaaaagggggtgaaaaatttaaaacaaaaccccggagcaagcccacaaaaaacccaatcaaagggggaggccccagttataaaaaagggtggtacccaacccctataaaaagcaaccgagtcaac

SEQ ID NO: 50333 - DNA, 490 bp, Triticum aestivum
  Clone ID: PAT_TA_50333
gcagcagaaaaaggcaagggacgaaatatatttccattcaacaatttacaatataatagaagtacaaaaatgcatttccgtataccagctttttatcctctatatcccctgaaactcttgaaccgaaacatgatgtcgcaacggctcaacaagtcatgaccaaaaaccaaaaagttcctatatactccagacacgcgcaatcacttgaccagaacaaacggcctcagaccacctgatagttagcagtgaccaatcgaacctgctgtgaatattttgaactacctccctgcaatggaaggatggcagtaaccttcatgctactaaatgtatttgatgcagaaaatccaacggagatgggaaaaaatgtcgatggatcagcagcgggaaccgagaactccatggaaccacttcggttggattgatcgataagcataacagaccattccaacacagagtctcttgagtcatacctccattctccatctatctg

SEQ ID NO: 50334 - DNA, 573 bp, Triticum aestivum
  Clone ID: PAT_TA_50334
gatgcattgcaacccctagcctatcttctatcagtggttgtgaccatttgaatcttttgatgctcctctcatcttgtcggctcttctcattctctcggcatacttgttgatgtcgaaggccgtaccggtgcttcttcctccaaatgaagattccagcgtatccaagtcaaagatgtcagccattatcttgatgctctccggcttgtttgcatacacaaacttcactttctctttcatgtctggctgcacgaagttcttggctatcttccagaaagactcaaaaatccttggagggtcgaaagggatcgccacgcctatcacccccggataatagttttggattatgtgtatggattcgcgggttatcgacagcggcgagctcgatatcgaccagcctcggaagtcggtcagccaaacgacgaagtcgtcttgttcatccgccgagttggtggcgaaatgctccaggagatacaccaggtgctttatttgctccttggctgaaactttagacttcattggtacgtttgatacgaggacacttcttccattcttgtcaaggtagtcggccacatg

SEQ ID NO: 50335 - DNA, 540 bp, Triticum aestivum
  Clone ID: PAT_TA_50335
gcaataaattttgatttttgattataccctgtcaccgaaaagtaacaacacagttgcaccagcactgtatgctgtaaagtcaaacagatgtccctgtctatccatttatctctgttttctcatctttcctatctcataaatgtccgccactatcttttacagtttactgtgaaaagaaaaaggaaaaaggaatcctttcttgtgctggtgtcagcgtcttgtttctaccgagcaggagattgtgtaatgtcacccagcatgttgagtgcagggcaagggttgtcgatcggtatcatgtggccagccccgagtatccagtagaatttcaagttcttgtacgacttgaggaaagcctgggtgccggctgcttcaccttcaccttcaccttcaccccccttgcagtagagcggctttctgggcgaccctgtgaaattcttcaagccttcccacttgagcttctggacccagtccagtgttccctttggttgcgcagatgagatcgagctgtccgctgtagatggtcacctccacgccaagtct

SEQ ID NO: 50336 - DNA, 565 bp, Triticum aestivum
  unsure (1)..(565): unsure at all n locations
  Clone ID: PAT_TA_50336
cggaaaatccccggngtcgnanccacgcccgtccgtnaatgcccaataccccacagnaaatccccatctcaaaaccctagccctcatccccgatcccggcgagcgagatggccaacccgagggtgatcttcgacatgaccgtcggcggcgcgccggccgggcgcatcgagatggagctgaacaaggacgcggtgccgcggacggaggagaacttccgcgcgctgcgcaccggcgagaagggcggcggcaagagcgggaagccggtgaactacaagggcagcgcctaccaccgcgagagccccgagttgatgtgccagggcggagactacacccggggcaacgggaccgggggggaggccatctacggcggagaagggcgacgacgagaggggcggccacaaggacaccaagcccgggaggcctctccatgggccaacgcgggggcccaacagccaacggggcccgagagcgtcatccgggaccggggcccacggcaagggggggggggacgggcgcgggaccggggggggggggggggggaggaggggaaggggggggcgggggg

SEQ ID NO: 50337 - DNA, 347 bp, Triticum aestivum
  unsure (1)..(347): unsure at all n locations
  Clone ID: PAT_TA_50337
aagagcangnacaacgcngagaagcgngggaagaggcaggncangancaggccnncnnccaagggcannaccaagngcccaaacgncangcagaagcacgngaacancggcgagnnngagnacgnngaggaccacaggncgggcaagaacgnggncgaanngaanggcaggcngaacaagcgaggngncaacaggccncgcnnngaagaaggngccaaggagaacgaggganggacggcaaggcgccgaccancccggcagggcgggaacagggagcggacaacagcggcngggaccaaggaccangaggaggcaaggcggaagaaggaggcggcaaagcgcaaggc

SEQ ID NO: 50338 - DNA, 504 bp, Triticum aestivum
  Clone ID: PAT_TA_50338
aaaattacagttttaacttatgttttagtaattttacaagctttatagtggtggcagtaaaagctgattgtgatttgctgactgtctgaatctttacttttacatacttcatttgtaattttattgtttgactaatagtacgtctgttggaacaagtgcaaaggcaacatcatcttctagcagaaatttcccctgcattgaccgcttcagagatgcactaggtgggtacaacatcgacagttttgagaaggccaagccgtatgtaccactattatgttgtattaacgaatctagcatcggtttggatgatataaggaaagtaaacagatatgctgatgagcttaattaattcaaaaaaaattgttcttgatttttgtttctagatgatacaacatagaaagttttgagaaggtcaagccatatgtattactattatgttgtattaacgaatctgacatcagtttggatgatactccctccgttcaaatataagtctttttagat

SEQ ID NO: 50339 - DNA, 377 bp, Triticum aestivum
  Clone ID: PAT_TA_50339
cccagcgtccgcccacgcgtccgaaacagagatcaactcctttggttcttctacctcggaggggagccaaactccattcagaatcgccaagctgcaagcaatgggcgccgtcgctgctctgctcctagccggtctgctcgccgcgctcacgtacgtgcttcgattggtccactccatcctgtgggttccgcaccgcctggagcgccgcctgcgccgacagggcatccgggggcctccccgcagcctgctctccggaaacgcggccgaatacgtcgccatgaccaaagccggccagtccgcgccactcgcctccttccaccacggattcatcggccgcgccgcgccgcagtaccgggagtggggcggcgcggaacggg

SEQ ID NO: 50340 - DNA, 424 bp, Triticum aestivum
  unsure (1)..(424): unsure at all n locations
  Clone ID: PAT_TA_50340
actagttctagatcgcgagcggccgctggcgagcccggaggaggcggaggctgaggggggggacccggnggngccgggcgccctcggggggccttgcctccatgtcctcgcgggtgtctccgagcaggaacaataagagaattgtgcttgcattgcaaagcgggttgaagagtgagatattgtggggattgaacgccctcacagggctctgttttaaggagaaggatgagctggcgaggggatacaacaccgtcttgctaaaggtcctgggcgatgggatgcgctgcttcaaggtattgatgactggggagagaggggagggggtaggggccatacagaaccaccaagagtgggaactttgggggggagtacagcaatcgcgggactccggccctgaaaacgggngggaaaaggatacgtgggg

SEQ ID NO: 50341 - DNA, 571 bp, Triticum aestivum
  unsure (1)..(571): unsure at all n locations
  Clone ID: PAT_TA_50341
cggncgcgtgggcggacgcgtgggcgcgaccctagcactgcatgggtaggcagcgatggcatgtggcgcatcctcgtcgcggcccaggtcggcagcaacaacacgggcattgcctccacgctcgtctaccggagcaaggacttccggcattgggagcggaacgcctcaccgttgtacacatcgcgcgccgccggcatggtcgagtgcccagacctgtttccggtggcggagcccggcatggacgagggacgcctcgactacgcggccggtacggcgagtggtgccatgaggcacgtgctgaagctgagcgtgatgaacacgaccgaggactactacgcggttgggcagtacgacaacgtggcagacaccttcacgccggaggtggacggcgagcgcatcatcgaggactgccggacgtggcgccgcttcgactacggccatgtgtacgcatccaagtccttcttcgacgcgcgcaagaaccggcgtgtgctgtgggcgtgggtgaacgagtccgacagcgaggacgacgacatcgccagaggcttggtccggccttcaagattgtttccaa

SEQ ID NO: 50342 - DNA, 477 bp, Triticum aestivum
  unsure (1)..(477): unsure at all n locations
  Clone ID: PAT_TA_50342
agnacgcatgagaaacacctctgctccccgcctccctttcttgcatctagatctggtcgagacggggctctgctcgtccactccaccctttgctgatgcgaggagtaatcaggggctgatgcaacccggggaagccatggccgtccatctccttgtcctccccctcgatgaggttggacgttttgcaacaggtgaggctggaggtggtggccaccggtgatgcgattttgctgcaatcggcaccgaaaaagctaccaccggcgcctggatttgttgcatccaggatccacaatttttgctaggatccaggttttttgagtgatgtttttgctgcaaccagcccaaaattttgctaccatcattttgttttttgctaccaccggtgggatcttttgatttctttttgcttaactagatccatcttttttgctggaatcactcaaacttttgggtaccaagggcgttagatttttgcta

SEQ ID NO: 50343 - DNA, 591 bp, Triticum aestivum
  Clone ID: PAT_TA_50343
gcgtagacatgcgaccagcctggttttcttgcataaaaagtcgaagtgagcgctacgtacgagagcaaaaaatgccggacagggcgatcgccgtgggagagcccacgcgaggggacccaggcctgcgacctcaaagcggtgctatacgagtacataaacacactcaactgcccgttcgccgaccagggctccagtgtggaacaccctgaagctgaccccctaaagcgcggtgacaccccatccgcctgatctcagcggggatagcacacgcctatgcccctgcccatggcgctgtccaagggcgccaacatctgcagggggaacgggaaccccgccgtgaccttccatgcctcccggggcgggaacatgaccctcttcacgggaccgctatactggatcgcccacttgctgcgcttcaccgccgtctgcttccttcttcgcttgtccaccggcggggttcccaccggcaccttctaactgaccggcttcctttcggggtacgaggtagtgctgaagatcccatgacctaaaaaaggggtacacggggtacgccaccgacggggacaccaagaagacagactgtgcaccatc

SEQ ID NO: 50344 - DNA, 400 bp, Triticum aestivum
  Clone ID: PAT_TA_50344
gcttcctggcgatgctgctccgggcggcgatctacctcgccacgtcgctggcgtgccggctcgacctggagacgcggatggccgcgcaactcggccaggccgagctcgacgacctgctcatcccgtcctcctcgcccgagggcgccggcacggcctacgacgtcgacgcggcgcacaggatcctcgccggctacctcgagaacgagggcgagacgacgcgcctggactacaacacggacgacgacttcgcctcggcggcggcgccgcccaacgacgtcggccccggcggcaagctcatggagagctatctcgccgagatctcctcggacgcgaacctgcccggggacaagggcaccggcctcgccgagctcatcccggagcgcgcccggggcaacgagga

SEQ ID NO: 50345 - DNA, 566 bp, Triticum aestivum
  Clone ID: PAT_TA_50345
cttttattttatttttttatttttttttttttttttttagccgaacaactggattagatcagctccttatgaaaatcaaccatttaccgaataaagtcacacttgattcaccatcatccaaccaacaagtaacaagcagtacacaggatataaggggccattagaggcaccgcttcttgagccacaattttatttaggcgaatactactccgctaggtgattactgggccgccgcgtgtagcccaaccttgttcgtcagttcctccttgatagctcccacaaccctgtccttgacatctccttccttaatgaacaggaaggttggcatggcctcaacgctgaattgctccgcaatgggcttcagttcatcgacatcgaccttgaggaaaacagcatttgggaacttcttggcgagatcagcgaaaactggagccatgatgcggcatggtccacaccatgatgcagtgaagtcaaccaccaccagcttcttggcggcgttggcctcctcgatctgcatggtccactgctccagggtgtggacggagatcaccttccccgcccccacc

SEQ ID NO: 50346 - DNA, 188 bp, Triticum aestivum
  Clone ID: PAT_TA_50346
ggcttatatcgaggcgaaaaaaaatctgaagagaatacaaggaaactaactgctgctctagctctttgccctacaggaaaaagcgacctcaaagatcacgtgatggccctaacacacactctgaaaccaccaagcgaaggaaagaagggaaccaacaactggaagcacgacccacaggcccgcaaagc

SEQ ID NO: 50347 - DNA, 463 bp, Triticum aestivum
  Clone ID: PAT_TA_50347
aaaagccagtatgaccaaggttctaatcaccggctgtttgccagccttacaccatgatcagtccaccacatttggctatctcgtaatccacaagaacactgaagaaaacatgtcctcttcccaaggaaggtagcaagaaggatgacaaatattactccttctctcccggatgaataataatcttgaatcatctcgaggagaacttgactcactcacacactcaaagaaagcacgcattatataaagtagagatcatctgttgttgtcgtggtctgtggtcttctctaattgccaccggggatcttcccgctcccgtcccgcttggcgcgctcggcccgcgcgaacgccttgccgagcatcttgagcttgcggctctcggacgtgatgacgccggtggtggacgccggcgcctccgcgaagatgacctggtagccgtccccgtaggagtccatgccgtcggcca

SEQ ID NO: 50348 - DNA, 556 bp, Triticum aestivum
  Clone ID: PAT_TA_50348
gtataaatatattatgtgcatgtgcatatacatagccaccgattgcattcacatacgagcatgctttctcgagacatgttggtacatgaacatggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacgtacgcgtcagggtactccttcttgacctcttccacctcgttgatcacctgtgtggcgtcggtgcacccgaacataggcagcttccacattgtccagtaccggccatcgtagtacccaggggatgcgttgtgctcacggaagatgaacccaaccttgctgaactcgaggcaaggcacccatttggagcggatcaggtagtcgacctgcttgaggaaggcctccgtgctgagcggtggcaagtaag

SEQ ID NO: 50349 - DNA, 554 bp, Triticum aestivum
  Clone ID: PAT_TA_50349
ggcatcgtatcttcttttacatttaaatgaaaagggggcaacactaatgtttcttaattagcactggagcgaatcaacagaatttgcagtaagcattatgacagtgacagcaggtccgttgcctcgagcctccaaatcacagtgcacatagataatggtttcacagttctacagcagggccctttgcacattccagcgccacccgccacctgagtcttgccaactacaattcttcagttactaccttgttctccagcagaagtcagctgagcctaagctttggtgagatgccaagatctttttgcataagccacagtgaacacatcagtcaaccctgagttctccaggctcagtattcttttgatctttctgtaatcgagaggcaggcaaaatagatttgagctgggtgctctccatgtttgacaacagttgtgtgacagtcttaatttgagatgcgctttgcaaattgctctgtgttctttgtaagagatgcttttgccaagagattcttagggagtttagccaagtggacctgggcaggggaggactgctca

SEQ ID NO: 50350 - DNA, 558 bp, Triticum aestivum
  unsure (1)..(558): unsure at all n locations
  Clone ID: PAT_TA_50350
tttttnntttttnntttttnnttttttnnttttttnntttttttnnttttttttttttttnttttttttntttttttnttttttttnttttttttnttttttttnntttttttttttttttnttttttttttttttggggggctaaacattttttggttaaaagaaacgggaaacaagggggggaagcccaaacaacgattggcttaaccccttcaaggtaacaaaaaaaaatcccgcccccccccaacaagggggggttcgcataatcatttattaaaagcccatcagcaacttcaaagggaaaaaaggagctggggcagttaaagttacttcacttcaaaaggaaaaaagacccctccattccaagaaaggggggggaagcaaccgggctagtcctcgaccccaaccacctttttgggctcggggagggcccccgggggggggtccttgccccacccaaacccggggggggacccaaggtactggtcaacaagggggcggcccttttggggggggttgaccccctcgatccggtagcaccaaggggggggggcggg

SEQ ID NO: 50351 - DNA, 574 bp, Triticum aestivum
  unsure (1)..(574): unsure at all n locations
  Clone ID: PAT_TA_50351
gnctaggccgtcttctaccttggcaaagcctgaaaggtgtcggcacgagaacacaaggacacagggagaacttgggagagagtaaacgaggttcaaagtcgcatgttcattacatcagtgaaggagagatctgtcaactgagcccttgggccagaacagaattgtgttatttacagctactacataattggacaactttgatctgcaggacaatatgtacaacaagatcgtgtctgctgacatctagcggttgttgtattcattcttcagctcagatcatcaaatagaaagtggcccaaggcaacagaaggctaatcttgttagtatcaagatatattctactgaagcagcatttgttgaaaagaacacttcgtacagttcagccagcaggagaatacccccattaaacctggagtggtgggctggcgaatattgatttcccgtctttgtagtgccctcaagaactcctctgagcttaggttcccatcacagtttgcctcaaacacatggaaaatgacatccaccaccttatcagtcaagtccaccccacaaacatgagttgcagcacgtttta

SEQ ID NO: 50352 - DNA, 565 bp, Triticum aestivum
  unsure (1)..(565): unsure at all n locations
  Clone ID: PAT_TA_50352
cccagcgtccgcggacgcgtgggtgagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtattccaagttgcaaagagnataagtttgaaccaagtattgggt

SEQ ID NO: 50353 - DNA, 477 bp, Triticum aestivum
  Clone ID: PAT_TA_50353
ttctgagaatgctgcgatgcgtgcgagacctatatccaggcaagtgtgtcaagatcactcctgccaaggccgaacacatcaagcactacaagtgtccgaactgcagcggaagtggcaagagagcccgagcatgatgatgctggctggatatatccatctctcatgcctgacttgatgtaaaacgcccacatggggaccgaatgcccgatggctgatgctttcagcgcaggaccagctgcgtaggacctcgatgtgctgcttgctgcagtatgtcaaagacgctctacatctattgctagcaactagcaactaattgtagtagcctgtatttcttcaatcttctcccagggcgcctgtgctgaactcaaaactgccccagatctaagcggcgcattagggatcactcatgccagcccgcccaccaacacccaacaccaccacaaggggcgggccgcactaaaaggagccaaggctaac

SEQ ID NO: 50354 - DNA, 294 bp, Triticum aestivum
  Clone ID: PAT_TA_50354
cgcaccctagctggctacaacatccaggagggagtccagcctccacctggagctccgcctcaggggcggtatgcagatcttcgacaagaccctcaccggcaagaccatcaccttggaggttgagtcatacgacaccattgacaacgggaaggcgaagatccagaacaaggagggcatccccccggaccagcagcgcctcagctatgccggaaagcagctagaggacggccgaaccctcactgacaacaacaaccagaaggagtccaccctccacctggggctccgactcagggg

SEQ ID NO: 50355 - DNA, 316 bp, Triticum aestivum
  unsure (1)..(316): unsure at all n locations
  Clone ID: PAT_TA_50355
caagganggccagacccgngagcacgcccnccnngcnnncacncnnggagngaagcangagaacngcngcngcaacaagaaggangccaccacnccgaagnacccgaaggcncgnnangaggaaannggcaaggaaggcncnncgnaccngaagaaggnnggcnacaacccngacaagggacccnncggccccaacncngggnnngagggngacaacanganngagaggnccaccaaccnngacnggnacaagggcccgacccnncnggaggcgcgggaccagagcaacgagcccaagaggcccacagacaagccc

SEQ ID NO: 50356 - DNA, 352 bp, Triticum aestivum
  unsure (1)..(352): unsure at all n locations
  Clone ID: PAT_TA_50356
cgaccgcccagcgnccggaagaaaggggcaacatcanggagcaccagnngcnccgcccctgcacgagcccccgcgcgcccacggaggccgagaagcggaggcggcggacggcgggaacgcgagggcgcagggcacccgcgccgccaccaacggcagccccaacaacaccaacaganacaacgccgacgggcgaaagaccaaggccgccgaccccgagcagaggggcaaggcgaaccagcgcgcacagccaggccgccgcccgcgggcacaccggcgacaaaaccagggcccccaccgaccgcggcagcaaaacccagcaaaaacgcccccggcagccaccccgcggaacacc

SEQ ID NO: 50357 - DNA, 334 bp, Triticum aestivum
  unsure (1)..(334): unsure at all n locations
  Clone ID: PAT_TA_50357
cccagcgaccgcccagcgnccgccccgcggccggagcatcaagaggaacccccttggcaaggaacctggncttgagactcctgatggagctggttttgagagcaatgctattgcacgctatgttgcccgctcaaagggggacagcctgctttggggcggntctcttattgaatatgcgcggggcgagcaagggatggactacggagccacagaggaggagcccaagagcgcaagggggctggacccaaggctgggntatatgccttacaatgcccaggctgaagaatgcggcattgctgggtgaaagagggcgctcgaagcatggaacacacac

SEQ ID NO: 50358 - DNA, 595 bp, Triticum aestivum
  Clone ID: PAT_TA_50358
atccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctcactgagagtggtaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgccggggttgcctacctgcgatac

SEQ ID NO: 50359 - DNA, 391 bp, Triticum aestivum
  unsure (1)..(391): unsure at all n locations
  Clone ID: PAT_TA_50359
cggaccgaaagcccggggcgacccagcggccggcgacgacgacgacgacgaccaggnagaggcggcggcggcgggcggcggcggaggagcgaaggcgacgggggcggagcagagagggcaggcgggacagnccaccgccaaccggcgccagcgcagggagcaggccgccccggcccagggccacggggcgaaacgcccgaagaagcgcggggcaaaagcagcgcggacaaagaacacagagcacgccgcaaagcgcgacgcaaaggaagaccggcacacaacggccgncaaacgagggagagcacccagcgcaaagcgaggggggcggccgcgcgaggacggagggagcagaggaggacggagccgggagaagcgaggggggagcggaggg

SEQ ID NO: 50360 - DNA, 357 bp, Triticum aestivum
  unsure (1)..(357): unsure at all n locations
  Clone ID: PAT_TA_50360
cccagcgnccggcacgcngcacccngcgcnccagcgggggcacggcgcgnngaagagncagacggaggggagnngagaacanganaagcgnanananagcccgccngagcggngggngaacnggaccaancgaccncgcgcgcggcgangancaaggccgagccggagcnncgnggccagcggcgcggcggcggaagnaggcngcagaagcgcngcgacacgagccggacggcgccgngcgcgancaacggccgcgccgacncggcagcgcacggcgccgcgngcgacgcggacgagcacncggccaacacgccggccagccgacaccgccgggagccggagggcgcggaggccccg

SEQ ID NO: 50361 - DNA, 550 bp, Triticum aestivum
  Clone ID: PAT_TA_50361
ggggatctggctgctccccccttcgccgcagccgctcgcggactcgggccaggggggcttcgccgtggcggatgcgggctttggcgacgtgggcaccgcggaggagcccgaggaggagaagcgcaggttcctcttccgagactcatatcgcagaagggtgttcttcaactatgagaagcgcatccggacgcgcagccctcctgagaagatctttgagtactttgcgtccatccggaacccggagggcgaagtctacatgttacctgccgacttgatgagggctattgttcccgttttccctccatccgaatctaatgttgtcagggaaggaagactcagaggagagcgcaaccctggcgagctacagtgtgctccttctgagtttttcatgctgttcgacacaaacggcgatgggctcatctcctttgccgagtatatcttttttgtgacattgcttaacattcctgaatcgagcttcaatatagctttcaagatgtttgaccttgaccacaatgggggaaatagataaagcaacagtttaaagaaaagt

SEQ ID NO: 50362 - DNA, 528 bp, Triticum aestivum
  Clone ID: PAT_TA_50362
caacaccatatatattgagatctgggtaggattcttaaaacaaccacaggcacgacactaggtacatccgacagagactgaattaaaacatgctaaaaacgaaggaacagagggtggtccgagcacaggaccctacaggaaggaaaccagactagcaacttcaccactcggatccaggacaacgactagatgggactagagctaccatttctatcatcgccatcagcagcagcaacctgaaagagagggagggactaccatggagctaaactagcagcgaacatccatcatcgatcagtgacaccagcaatgagcagcaacggccacgttccagagaccccctccccctgctgcggctgcttggcgtgccgcttcactcgtcgccctcgctgccgtcatcctcgtcgttcacctcggacttggacttgtcagagtcgccggacgcctctcctgcctgcgggttgttgtaggcgtcgatcttcttggcgtactcggccttgagcttctcggccttggcagcatagggag

SEQ ID NO: 50363 - DNA, 203 bp, Triticum aestivum
  Clone ID: PAT_TA_50363
caaaagcaaggcttgaagaattttagttaaacagctcggcaaaatacaacgaggatcacccacaagagccaaagaagacgaccccacacaagacccaacgcgtaagccaaaagccaccagcttttcgcgggaagatggcggcagcgttacatcaccgcgaacctgctacacttttttactgctgctagcccaggttaatcagc

SEQ ID NO: 50364 - DNA, 561 bp, Triticum aestivum
  unsure (1)..(561): unsure at all n locations
  Clone ID: PAT_TA_50364
ntttttttttttttttttttttttntttttttttttttttttttttttttccattgaaccactgaatatggattgaatgaatctggccaatatatacacaaggatttggactagctgccagttccatctaaataaacagcatcgggggctgacaaacggcacacaccctacttgtctacacatccaaagcattttgcctgtggatgggcattgggcttcccagattcattcataacaaacaatgggggggggaccatgaaatgaaatagtgttctcggggcgacccaaatctccagcaggcgggtgacgggcaaacttggggtccaaggtccccccgtgctgctgtgtcgtcgtgtaaactcgcaaaccatgtgtcatccacctaacaaggcctgtatggcccaaatccaatgaagccgccgcatgctgtgccttggtatgtacaggtgggctaggtgactcctcttcggtgttcatgaagcccctgctgcaatttctggggccgtgtcttgcgcctcgtccttgcttaacaatgctggtgtgaccgaaaccaccccgatc

SEQ ID NO: 50365 - DNA, 307 bp, Triticum aestivum
  Clone ID: PAT_TA_50365
ggaagggggttttttttttttttccccgggcaaaagaaagcacccttatgtttttgccccaaggccccatttttttacccaagctcccaaaagggtcccccccagcccacaaaaaacgacgggcgatcaagcttttcacccctcgtagggggcccgggaggaaaacctgaaaaccatgtggggcttgtacaccgggccgggcctcaaaatggaggacggaaaattgggggggttgacggcgtaggggtacccctggttttccaggcacagggcgccgtactgcccggacaccttcccgggctttccc

SEQ ID NO: 50366 - DNA, 439 bp, Triticum aestivum
  Clone ID: PAT_TA_50366
gaacttgaacgtacttgcacgggcaaattcacagtttcacagaagcaacatgactgggccggcccttccatatcgagatcatatcacgcttctacagctgcaggcacgcaccacaaactgtctcgactgaccgtccgatcgcggatcccaatactgatagattcaaagcagacgaagagagcttcgcatacatgcatcatggaatgcgggaaccgcgcgagaaactaaaacaaccggtgacggctaagaagggagataccaaacattacacgggcggatggacctggactcctatcctaagctaaatgcttagtaccaggtggaggagagctgctcgcagctcccggagataaacagcatctcgtatatgacgccggcgaggccgtcttctatgaaggggcacacccaatacacccactggttcccccactctcagctg

SEQ ID NO: 50367 - DNA, 377 bp, Triticum aestivum
  Clone ID: PAT_TA_50367
ggggggccaattacaaactaattaggggcaaaagccccaaaaccattggggggggggggttaccccaggggattgggaaaaattaatcgggggcagggggcgggaagtttcttaaaaaaaaacgggccccccgggtttcccggggggaaccagctttaacggaaaaggcggccaaaaacggaaaggccccccccttagaaggggcccactggtcgggccccccaaaggggggacgggggttcccgttaaaggggcgcaaccattacctttttgggtttggcacggggccaaacccctaaaagggttaacaggggaagcatgggatgggccccttcctaatcccccacaaaaagggtgcccaaagggaaccggggggg

SEQ ID NO: 50368 - DNA, 446 bp, Triticum aestivum
  Clone ID: PAT_TA_50368
acgaaaaagaacaggaccctttttagcgggttacttcacaaacattttagggcccgaatacaaaaaaacaataggttgacagggaaaccacagccggggcgggctcaaaaaccgggggtcccaggaaaatacccaggccatacgggaatagcatagcaccatcccatcccaacacaatccctagggccccggggattcaatcggccatccaaagggcccctagctccttaaaaatcttgacaaaaatttaaggcttgctggcaaagttggtggacagccagtccaggcctttatacaggccctcccctggtggaacacaagggccctggaagtaccaatgtccctggcgaagggagggcaagccaaacttatcagggatcccagcaacattcaaggcatttggaaaatcttgcttggtagcaaacacaagcagcacagcatcacgg

SEQ ID NO: 50369 - DNA, 558 bp, Triticum aestivum
  Clone ID: PAT_TA_50369
gccaacaactgatgaaatccggcagcagccacataatcggtagtaccaacacgaaatccaatttatctgggcatccattcatgattcagcaacgaactggaaactaccactagcagaagaaactccaagcttgcagcgggtacacaatactaacagttgtttctgatgtcatcggctgcttcagcaatgctgcaagttcagtagtatctcctagtgtataatagcacctcatccgtccaagttcatccgcgtaatggcaccacgttcacggtcgctgtcttcagcctccaagcgtcaagcctggtcaccttcacgccgccggttccattgttgaaaacgaacacgtgactgttgctcttctctgcgtgctcagggtacacccttgcagtcatgcatgtccgccccccgcctccgaaactttccaccaccgaatagtcaaccagtgttctgagagatatggtgctcccttgctcctccatgtccatgtctacaaatcctccatacgccagcttgtacactttgtctctccgagtggatcttgtgaggtcggtgcacatg

SEQ ID NO: 50370 - DNA, 176 bp, Triticum aestivum
  Clone ID: PAT_TA_50370
attaattatgaagagagtagagatcgttttacaacacaccgtgttacatgcgggtgctactctcccggaattaatgaagcctgtgttgacgcggctgtgatcgctgattggcaccacaaaataactagtgataagccccccccccccccaaaaaaaaagggcgatgccaaggggcc

SEQ ID NO: 50371 - DNA, 566 bp, Triticum aestivum
  unsure (1)..(566): unsure at all n locations
  Clone ID: PAT_TA_50371
gntttattataggtaacaaagcgtcagcaaccgttcagcctttcctgctgctccatcttgatatatttccagatgctgttcaaactcttgacgatgcacttcatctgttttccacccctgaatctttggaaggatacagaacaactgctggaaaggccggagtggtgacagctaggaaatcattcaagatacacgaactttcaaagataatgatactgcacttgaagaggttcagttatggaaatcgtgggtgtactaaactgtacaagccactccacttccctcttgaactggtcctcaatcgggatctgctgagctcaccatcatcagagggtagaagatacgagcttgttgcaaccatcactcatcacgggagcggcccgtccaggggccattacactgctgatgcgaagcgtgacggtgggcagtggcttcggttcgatgacggccatgtcatgcccatcaatgtgaacaaggtgttgcataacccagcgtatatcctgttctacgagcaagtttaagttctggtgtctaccatggcggtttggattgccccccctttcctc

SEQ ID NO: 50372 - DNA, 554 bp, Triticum aestivum
  Clone ID: PAT_TA_50372
catatataaagtcaatgcattcagcataaacgtaccaagctactgtaaatgatgtggaagtgaatgcattagccaatcgacaaacgactcgaccataacactgtcagcaaacacatatgctcacatcgcatctcattcgtaggttgtagatttgaagtacctctggtttagccttctattatctcttcaggggtttactctgctcagcttcaccaatactgaagggcagaggcagtccactgtgtattgcacagaatttctggtagcgaaagaaactgccagacaataaatagtactgcctttcttcagattccaaatagatgaattccttagcatagattactatatatcttcagtcgtggcactattttctaaaagccgatttgtcttttatttcttggaaagctgcagcaagtaagcaatcaaaactgacagtctttttttctaaaacggaagacagtctcttctaaatatttccgttcgatgtgtatgaccagtactcgttgaccagtttgcggaagagagatccttccgtttccatgagctttgtaggt

SEQ ID NO: 50373 - DNA, 401 bp, Triticum aestivum
  Clone ID: PAT_TA_50373
gggaaaaaatttgttcatggattaattgatttggatacaagttcaaactaaatactatcactgttctttgccttatccttggcttcaaagacaccctgcagccagggtatatacacacactagagagcttcaggggtgctttatcttgcggggtcttcaggtatatacacttgagattaaatgctaacgaaggattatttggaagaacaacaaaagctcaccaacccaaatacttacaagacacaagctaaacacctccagcaaactatagtgaaagtctagcttcaacactataacatctcctcactgccgtgccggggatgaaatcagtcagcccatcgccggagaaatcctcaaggattaatgcgtgagtcggtagcgcggggaggtcgatggacccc

SEQ ID NO: 50374 - DNA, 547 bp, Triticum aestivum
  Clone ID: PAT_TA_50374
ctagaagcattcatcatacattcttgtgtactggtgatacatgtctcagaatttgaatccattgaaacaccgcagatccacaaatacatgtctcaagaatacactatgcctcgatttatttcaggtgcacataaacatgtgtgcatccagcgtctgccactagcgatgccaaagcaaacaaagtttcacagatggctcgactcagaagtgacaaatcctttctctctcaagctctcgattgtctccttgaggctcgtctccaggggggtcagctccatgcccagacttcttatcttgttctttgatacctggtagattgtggcaaacggcgcatcatctgcacacttgtctggcactggaaattcaggatacatctcgtgtatgatcttgacaaggtccgagtggtgaatgactctttcaaccatacaatatcttccgtttgctgaaggaacttcatatgcaaggatatgtgccagggcaacatctttaacgtttatccatccaaagcagaaattggcgtatgtagaagatgatccatttataaact

SEQ ID NO: 50375 - DNA, 495 bp, Triticum aestivum
  Clone ID: PAT_TA_50375
gatctataactaggaaagatgctatatacgcggatcattcactatgaccttacaagtatgtccttcttacccttacaaggcatccgaccgtgaaatgcacaactaaggataaccatacgcactattgaactataaggaaatggaaacctgagacattctgcatgagactgaaagcctgactgaatatcaaaccattaatatggttcaaaccttatgtactcacatacccagcgacagaggacccctacactcatgaatccgaggacttgcttcagcacaacccgcacaacatgcaaaaaaacgctgagatggtgatgatacaaggctatgttcataacacccaccacccaaggtgcaagtaaggaggacgttcacatctgctacgagcttgcttgtggcttgcgcacatctaccctactatacaattgagcgccaaacgatcactcatttagaagaaatgcgggctatgtacacagcatgtgtataaatcacact

SEQ ID NO: 50376 - DNA, 333 bp, Triticum aestivum
  Clone ID: PAT_TA_50376
gcgagcacagatttaagggtacttacataacgtttatggtacagaccaaatatggtataacgcagcagcccgtaagcacaagggctattgcaaataatgcgtctcaagcagatttctccctcttccgagtacaccactaaatcgcactgtagcttattcccaaattaacaggaattgataagaacaaactaacaatgtatactgacacacattgaactcccattaatactttgaacaatgctcgctgtaatacaacgttgtgggatgagccaactttactaccaccctctctgaacggtgagcatgattatattcaaacctacattaagcgaa

SEQ ID NO: 50377 - DNA, 385 bp, Triticum aestivum
  Clone ID: PAT_TA_50377
ggaaaccaaactaggggggaggccccgttggcccgcattttttaattaaaaggagggggggggctcaaatttggctagaaaataaatcaaagggggttttttacaaggggaaaaaaaggggtctttttacatttggggcccaagggggacccaagtttaaagctaactcccaaaaaaacttttgaaagggctgatttgaaaaaaaaaaaacctacgataataccctttactgacccctggccaggaaagctatgtcctaaaactttacagttttggactggggtgcactgcactcactaacttttattattaaatggaacactttgggagctccaaaacttttacccctttgttccgttgggagacccccaagggtgggccaacc

SEQ ID NO: 50378 - DNA, 534 bp, Triticum aestivum
  Clone ID: PAT_TA_50378
ggaacatggacatacacatattcttatcttaggaacaaacaagaaagataaatggaaaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgcgtggcgtcggtgcacccgaacataggcagcttccacattgtccagtaccggccatcgtagtacccaggggatgcgttgtgctcacggaagataaacccaaccttgctgaactcgaggcaaggcacccacttggagcggatcaggtagtcgacctgcttgaggagggcctccgtgctgagcggtggcaggtaggacagggtctcgaacttcttaatgccctcgatgggccacacctgcatgcacctgatcctt

SEQ ID NO: 50379 - DNA, 503 bp, Triticum aestivum
  Clone ID: PAT_TA_50379
ccatgcacttcaatggtgaagcatactggggacatgttaaaagactatactccccccatgaaattctagtgccgctagtttcgcatcaactctacatggaaattcttaaaacgaaacaactgagtagtgcctgaacatagaaaaaaggaaaaggatctgggcaaagtaaccacaaccaccaccacttgctatatccaaaagcatgggttcgtcgccgaagggtcgcgcgcctggggagccgtgcacgcggtacgcacccggacgcgaaccgccgacgagcgcgtccttgatcactccttaatccggacccaacaggcaagctgtgtcgggttgaaaaccccggggatgcgggtgccgcccgccatgaccagtattgacgcctaggctatacctcctcgcggggtcaggtgttggcgcgggcgcggacattgcggtctccttccggcccagcgcggagggccgctccccgaggagcgtgccaaacttgaggaactcgtgcgcca

SEQ ID NO: 50380 - DNA, 478 bp, Triticum aestivum
  Clone ID: PAT_TA_50380
atgaaaattcttttgctttatacgtatattactagtgcacaacaaaagtctgcgtgcttattaaatacacacaagataaatagctgccgcagcctgcaagcagtcgtttctctcaactatccttcttccagttggcgttgggaacgttgccttctaataataacatgacatcctggtagcaattggcagattgctagtatcatcgatagcagtagcactacatctctccaggaagcattgtatccccaggaagatcacaaaatgcattaccctcccctgtaagatgggcaacgcatcttttctcagcaatcagttcagcttcactctttttgatccggccccagagaaaatcgtccatcgccacatctttaactagttcatagtcaccatcgccctttgatctgcacggcatgctgaatacaatgtctgctgctatgccataaggatttccggtcgtataaacctatggtttggcatc

SEQ ID NO: 50381 - DNA, 440 bp, Triticum aestivum
  Clone ID: PAT_TA_50381
ccaaaacaaatacagatcattactgaattaatatccttgactcaacttgacacatcagtccacatggagtgaaaaacgttctgaaaggctgaaacaaactcgtaataaaccgcgcgtattaaacacataccattatgttagatcagagggtgggggacgttagttaatcggttagtccatgtgcagccgcccgacggcagtatgaccggcggcggcgccggccggcgagctgctgtgcctaccaaatttacacacacatgcttgccagcatgtacgcacgacacgatcacgagttcgagtccaccgcttcgtcgacgtcgtcgtcgtcgtcgatgccggatcctccggcgcccctccgtggctgccgtgtccgcctgctcttcggcttcagtgccggtgccctgcgccgccttcggagcgcggcgacggtgtccgtgaac

SEQ ID NO: 50382 - DNA, 550 bp, Triticum aestivum
  Clone ID: PAT_TA_50382
gctgaacaatagaatatagtgtatataattataaatatctacatgatcaaacttaaagtcttttggatacaaaagatcacaaaataactgctgaaactactgctatatcggatcttcactgaatcagcaaaagatatatggatgctgcagtagcagcggcaggacaggactcaagtccttggtattcattgaattacttttgctctgaataccagcaatatacagtaaatatagctacagtatacacatacataaacagatcattggtattcatctgaataccaatgaagacccctggcgccgcccctgggatgctgcaatcttattaaatgtcaatgaagactcgcaggccgtcatgagccagttgtgtcggtatttcttctctgatagaccattctgccaacatctggttttctctctcatgctcaaaaaaatgcctcattccaatcaacagagctctttttggatggatcctcttgatagcatcaagactctcactcagagttaaatgggtgctgaaagaatctccaactccatgcaaagagtttgc

SEQ ID NO: 50383 - DNA, 419 bp, Triticum aestivum
  Clone ID: PAT_TA_50383
cttataacattcaattttattgacgcaccatgatacaacataaagctgatacatacactttactttttgatacaatacataaatttgtatgagttgcataagaaaatatacattatgattgtatttttcaaggctagcaaagtgcgcttgtaaacactaactcaatgacatgtatacttgaccacaccggggatgtgaacacggtagaaatagtcgtcccagtcaacggacttggggtcaaagtcgaagtaataggacccattgttattttgatccgtgttcattgccatccttagcctctccaagtttgtgtcatcaaagcatcctttgaacaaaccgtatggtgcgtagagctcgaccatatgcatgaagaatatgtattttctgctaagcttgttgtagtaccgtgagaaaacacc

SEQ ID NO: 50384 - DNA, 560 bp, Triticum aestivum
  Clone ID: PAT_TA_50384
gatgtgacatggaggtggcaactatcgacagacacgacgtaaccgttcggctacttgggttttttggaacagcccgccacctttgtggtagttttttggaaaattcaaaaacggtagtttttcagaacaatggcctgtaatgtggtagttttttgctattcactcgaatatgttgtcggtgcaaatggtgctgagcaaactgttgttagcggctccatggaagtgctgataccctgttggacagttgccacatctggtgtaccggtgccggagcagctttttaatgtttcaatctgccactacaaccatctcaatctgttccatcatggtgacttttcaagaagttttgggaggacatttgatccatctggcttagagagttagaggtggcggcaccaattctgctggagagagacgatggtcatatacacagaagtggaagtcatggcgatattgtctttctaacaagccagggataggtgaccttgtactccaggattacttggtcacgatgcgacgtggaggtggcaactatcgacagacgcgacgtggacaaacct

SEQ ID NO: 50385 - DNA, 382 bp, Triticum aestivum
  Clone ID: PAT_TA_50385
ctccttgacacaaactaggatgatcgatacattgtctgggtatgccgcccgcattacttcacattgggcactggtttggcatttacggctacggtagggtgggcggtcgcaagccaaaagcatgcacgtagcaggcccgaccggtcgatttacttgcaccattgagataaagtggcgcatattaacatacgcctctacataccttgccatcatgaacgctactctggaacttctgcggcttgctccatacgacaggcatgggttcatgattcaaagggatcttgggagtggtttgtcacaaaagaaggcataaacacattgataatgcaagtagatattaaaaacaggcttacaacatgcacgcagaatgcacatgcacgca

SEQ ID NO: 50386 - DNA, 453 bp, Triticum aestivum
  Clone ID: PAT_TA_50386
ggaacgagcgcattgccctacagataccggcccacctgtcgacgaacgacccctcgctactccagtccctcgacgtgcatgactccaaggcgatcgactcggccagacgcggtcgtgaggctccatgcggtccctctccgcgacctcctggtgacacgccagccctaaccgtagctcacagattgccccgcctataacgatcatcacgctgccgctactgcgcacatgaggccgtaccaagggcaaggtactcattcgagggatcattcgggagcgctagccttgtcctactgagccgtagcatacaactccttactgctgactctactattttccagcccctccgtcttcaacctactcagcaccgggacatggctgatgcggacaccactaccgatctagtgggtactacgtatgaaccagcaccgggtacatgtcactcgaatacaccac

SEQ ID NO: 50387 - DNA, 281 bp, Triticum aestivum
  unsure (1)..(281): unsure at all n locations
  Clone ID: PAT_TA_50387
tgttgtgggatgtgctcatggnggctgttcagcggtctgggaagaaccagcagcacaattgcaatgcagcacttaggcaggtgaaagcttggactgagctcctgaatgcttntttcacgaaaagcaaactcaaacaaaatgtgggggggaagctcacacacagtgctatgaggatgctaagccgatgaagctgtttccgtagtttataagaacactgtatgaccaagatgaactagcttgtagatactatgatcctctggcctccgtagaggttaaaaccc

SEQ ID NO: 50388 - DNA, 468 bp, Triticum aestivum
  Clone ID: PAT_TA_50388
gcgatgcacactgattctgaagagagccctccttgccatcctcccctgtgtctccccaaaagccacgcaccggccggtgacttctatgtatgtcccccctgggacaggacggacgcggtctccagcgggcaccggcacgcaccgcgcacaactcccttgctctgcagcgtggttaaaccagctgactttcgtcctccgatattttactacttcccctgacggtatcggcgatcccgtgcggccgatgcagctggcgccctcgggatggacatcggcgcgatgatggacgcgcggacggcggggcgctcacgaagcggaacgagcgggagtactcgtgttcgaccgagcagcatcagccgatgaacacgccgacgcctgacgccgccagggagacaggagctgctgcgcagcaagccgacacaacagtgagggcaggccgaccagtcgactaccatgcaaacgacacct

SEQ ID NO: 50389 - DNA, 599 bp, Triticum aestivum
  Clone ID: PAT_TA_50389
cccacgcgtccgcccacgcgtccgaggatggcttgcagtcgaggcatattcctatctgccaccttcgccgtcctgtcaatcctatcactcccaagggcgacgcacggctgggcgaacggtggcgcaacgtggtacggcggccctaacggcgacggcagcgaaggtggcgcgtgtggttataaaagcgatgtcggccaggacccgttctcgtcgttgatcgccgccggcggagtgggcatcttcaagaacggcaaaggctgcggttcatgctatcaggtcaggtgcaaagagaacccggaatgctccggcaaacacgtgaccgtcgtcatcaccgaccagtgccccgacgcgcagtgccagaagaggccgcacttcgacatgagcggcaccgccttcggcgccatggccaagcccgggatggccgataaactgcgtaacgccggagtcctcaatatcgaattcgagagggtgccgtgcaagtaccatggcaagaagattagcttcaagatggactcgggcgccaacccattctacctcgccatgctggtcgaatacgaggccggcgacggagacctcaactccgtggaagtcatggaggc

SEQ ID NO: 50390 - DNA, 633 bp, Triticum aestivum
  unsure (1)..(633): unsure at all n locations
  Clone ID: PAT_TA_50390
cgtcgctactaccaggacagtaggacatttgtctaagagcaccgaagtgatgaagcttgtcaacaacctcatgaaggccccagaaattgctgttaccatgcaggaattcagcaaagagatgacaaaggccggcgtgatggaagagatggtaaatgatgccatggattcagcactggacgatgagggcatggaggaggagatcgaggaggaggttgataaggtcctctctgcaatcgccggggagactgcgtctcagcttcctgacgctgtccgcaaacaaaaagagaaggtcacacaaccttcgacaagcgaacctgcacagagaactgctgtagcggaatccgttgatgacgacgatgatgatctagaaaagataagagaaaggctcgccaaagtgaggtcgtaaaagagaatcgatgtgctgacatgtgtataatagtccatttggtaatgtacgatacacaacttggcagatgtcgccttgtcactcacaaactgcccagagtcaccaacgtacaagttgttcgatctctgctgtaatctgtacgtgaggatcgtaacgtgtgatcaagtgtcctgtattttgttggtttctacctgttgcgaatacataaatattctggntacatataa

SEQ ID NO: 50391 - DNA, 598 bp, Triticum aestivum
  Clone ID: PAT_TA_50391
aggccccgagaacaggaggacgccgatgatggcgtcgaaccccggggagataccggagtacgagttgaaccccggcgagctccagttccggaaaggggacgaagtgctcaagggcacgtaccaagttgcaaaatggaacggaaccaaggtctccgttaaaatagtcgacagagaaacctactccgatcaggaagccataaactctttcaggcatgagctgacggtgttcgagaaggtccggcatccgaacgtcgttcagttcatcggagccgtcacgcagaacatacccatgatgattgtttctgaataccatgcaaatgctgatttaggaagccttattcagaggaaaggaaggctgaatggccataaggtgctgagatatgcccttgacattgccaggggcatgacttatctgcatcagtgcaagccagaccccatcatccactgcgacctaaagccaaagtgccagaaatatcttcctggataatggaggcctaacgaaggtcggggggttcgggctgatgaggctgtccaagatggctcctgacaaggtgaaactgatgaaccacgaggccatcgtcgacaccttcagttacta

SEQ ID NO: 50392 - DNA, 529 bp, Triticum aestivum
  Clone ID: PAT_TA_50392
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgttttaaaggacccaagtttacttccccggccttgcaacgtaaaagtttttttttggggcccccaaaattaatttaattgcccggggtttaacaacgtggggacgggaaaaaccctggggttccccaattaaatccctttgaaaaaaatccccttttccccagttgggttaaaaccaaaaaggcccccaccgatcgcctttccaaacatttgcccaccctaattggcaaagggaaccccccctttaccggccctttaaccccggggggtgggggggttccccccagggggaccgttacatttgccagccccctagcccccgttcttttcgtttttttcctttcttttttccccacgttggccggttttccccgtaaagttttaaatggggggc

SEQ ID NO: 50393 - DNA, 601 bp, Triticum aestivum
  Clone ID: PAT_TA_50393
atattcagtgaagtgggtgcaaacaaatgtggcatttgcacggcgttttgaagtttacttggactacccgttcttcgaacaccagattcattggttctccatcttcaattctttcatgatggtcattttcttaactggtttagtatcaatgatattgatgagaaccctgagaaatgattatgcaaaatatgctcgtgaagatgatgatcttgagtcacttgaaagggatgttagtgaggaatctggatggaagcttgttcatggagatgtatttcgacctccatgcaacctaatgtttctgtctgctgttgttggcattggcactcagatggcagctcttatcctgcttgttattgtacttgccattgttggtatgctttatgttggacgaggagctattatcacaacctttatcgtgtgctacgcgcttacatctttcatttctggatatgttagtggcggcctctactcaaggaacggcggcaaaaactggataaagtctatggtccttaccgcgtccctttttccattcttgtgcttttcaattggattagtgttgaacaccattgctatcttctaccattcattagcggctatacca

SEQ ID NO: 50394 - DNA, 547 bp, Triticum aestivum
  Clone ID: PAT_TA_50394
atcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactcct

SEQ ID NO: 50395 - DNA, 417 bp, Triticum aestivum
  Clone ID: PAT_TA_50395
aattcccgggccgacgtcgtcaccggcacccgcgtcaagacccacttcgcccggcccaactggcgcaaagtctacaaggacatcgccctcaagcacgccgggcagcgcgtcggagttttctactgcggcgcgccggtgctgatcaaggagctgcgccagcttgcccaagatttctcgaggaagacgagcaccaaattcgagttccacaaggagaatttctaactttgcagccagcccagtcacaagaagttcctcctttttttttagaaaagaaacaagtttctcttttcgcgaggaaaaagtctgttaattcagtacatacccagttctatagatggaagtaggtgttggttgattttcacaagctgggtcaagagttacatcgatttttttgcctaacaaaaacacaagaagtcg

SEQ ID NO: 50396 - DNA, 303 bp, Triticum aestivum
  unsure (1)..(303): unsure at all n locations
  Clone ID: PAT_TA_50396
ccaaaagtaccagggcgccggtgctgacatgcccggnggcatggacgaggacgcgccggctgcgagcggcggtgctggccccaagatcgaggaggtcgactaagttagtcgcttttatatagtngagaaatacactatacaccattttattcagtcctgggtgccaatcatatcacctgggctggaagttttgttgtactttttggtctgtagcatcacgagacttgtgtgtgtcgtgaacaatgcaatgatgcatgttttgggctcattgttgatttcagcttaatgcttattatttggact

SEQ ID NO: 50397 - DNA, 640 bp, Triticum aestivum
  Clone ID: PAT_TA_50397
gtcaccacgaagtgaaatgataggcagcagccttaccttcctttatcgagctgttcttgggattcttcttcatcactggaagcgatgtcaggcaatcgagatgcatcaggtcatgtaatggcaaaaggcggaaccaaaagtgatatctttgcgccaaggcatgattatcttacgtcatgtcctactactggtcctcacatgagaagatcgtatactgaagcagctaaagttgattgtagcttcgattgtcacccagagcatcactacaaaggattggatcgacttacccccttcgcaagctgcaatggtcaatctattgaatgccgcagtgagatagttgatatgcccagaggggggcgctgtgttgacgaggctacttcgttttctagtcgatggtgcttcgaaaatgggggccgcggctcttcactacctggagggctgacatatggcgatgaaatcccttctctgtctagtcggaggtgtaacggcagtggggtgctttcacgctcaagccaatggcattatggtgctgaaatttcctcgctctcaagtaggcaaggttatggcgatgaaatcccttctctgtctaatcagaagtttaatggcatttcacgctcaaatcattggaactacagtgctg

SEQ ID NO: 50398 - DNA, 620 bp, Triticum aestivum
  unsure (1)..(620): unsure at all n locations
  Clone ID: PAT_TA_50398
cggccgcgtgggcgggcgccttttaccggacgagggcgctgccgcggccggtgtggaacgcggcgtcgcaggtgctcatgtgcgcggggtacgtggtgatggcgttcggcatgccggggtcgctcttcgtcggctccgtggtggtcggcgtctgctacggcgtccggctggcggtcaccgtgcccacggcgtcggagctcttcggcctcaagtactacggcctcatctacaacatcctcatcctcaacctgccgctggggtccttcctcttctcgggcctgctggcgggcctcctctacgacgcggaggccaccaaggtgcccggcggcggcaacacctgctccggcgcgcactgctaccgcctcgtcttcgtcgtcatggccgccgcctgcgtcgtcggcttcggcctcgacgtgctcctcagcctcaggaccaggcgggtctacgccaagatccaccaggccaagcgggccaagaggtcggccgccgccgcgcagagggtcagctaagctggccgccgctcttctcagaggaactcagctggctgcacagctagcacctactagcagttnttcagactgatgaagacaacagcgtctgccctgtaaagttttgcgcag

SEQ ID NO: 50399 - DNA, 613 bp, Triticum aestivum
  unsure (1)..(613): unsure at all n locations
  Clone ID: PAT_TA_50399
caacaggnagatgatcaanaagnttggggaacaccagcaaaaaagtaccgggggagacgggcgggacgaaggcatggagatagttgtttggtgccaacgtgcgtttggtgttgattgctggctggccgactacggtgtgctaccggcgatgagatccaggaggaggtggcggctgacagggagacgagaacctttttgcttgcattctcgtgtcttttggcaaggagaaaattatcatttggaggggaaaagacagatgaaaacatgcatgatagtatatgcaattgacatacccttcagttcttgaatcagagttcagtggtgaagaacactacaattttttggccgatggattggtctgaatatattgtaagggattttgcatgaagtggttattcaaagaatggaaccaattttatgattttgcctattctctgagatggatgatgatgagcggtgcaaccgaaaattcagagctgggctttacacactttagtgggttagtgaagttccagtttttcttctttaccctattgctgctctgttgtacagagagcagtgagtttatattagctaaatgttagattggaatgcaagagtagcatgacaacac

SEQ ID NO: 50400 - DNA, 611 bp, Triticum aestivum
  Clone ID: PAT_TA_50400
gaaaacaccgcaactcatagaaactatgggtttgcagcagatcatagcttatagtcgcacggactactatgtctagtctacagttcaaagaaccgccgcaaaatacttttagttacctccagaaaacaacagattcacagacaagagaaactaccagcacaatgcacgtttacacaacacgctatgtctctttttctgtaaaactctcgccacccagggctctgggctactctcaagctcaaaggaacccaactgccaacactgaagttttaatcttcccatgtttctttttgtttcctcagggaagctatctagcagaggacgccatcgccatcaagacgctcatgtcgagctgacctccggagctaaccacagtttcacctttttgtcgtccccgcaactcgctagaatgaacgcaggagcaccaccatttggaattgtccgtggagcccacgcaatgccagaaatagcaccttcatgagccttctcagctgtatccaaaaccgcgccagtttctgcacataaccattgcaacgtcgatccgcttgttacagccagaactttaccatctggggagatgcccatgtgttcatacaggcaagtagagcctt

SEQ ID NO: 50401 - DNA, 172 bp, Triticum aestivum
  Clone ID: PAT_TA_50401
gggaaaaaatccaattttattttttgacacatgtacaaaagcacaatttttggtggtcaatttacatgcccggcagaaaggggggctttttcacgacggggtcccagttaacaagagatacatccccccattcccccccgggttttttacacaaggaaagccccggccccgg

SEQ ID NO: 50402 - DNA, 583 bp, Triticum aestivum
  unsure (1)..(583): unsure at all n locations
  Clone ID: PAT_TA_50402
cacatgacaaatctgaacaatatcaatccgaccaaaagaaaattatgcacacgtctcttccttttaatcacacgagatgagcatgtagatacagtaaatatcgacaggtaacggatgaaaaccatacgtttagggaaaacaggactaggattacagggcaacgcctctattagcatttctgttaacaggacacacatctgaaactcaggaagccatcattcaaccaatggaagactcttcgactgtacccttcaggtttctgaagcttcttcctcatcggtggccaaggcggtatgtgctgggtatctccacatgatgtctgcccaggtgctctgcccatcggtcacttccttcacaaccaaagccacctngtcgacctcaacacggatctgatccttgctgtcccggtcacggacagtcacacttgtagttgagtcgactgtgatcgccagggggacgccgatttcgtttgtccgtgcataccgtttaccaatcggagtgcctgtgatatcgataatgtgagaaatccctgctgttgggaaaggcttttgaaatttttttgggaacaacctttaaatttttt

SEQ ID NO: 50403 - DNA, 424 bp, Triticum aestivum
  Clone ID: PAT_TA_50403
gcgacaaggtcaacatcggcgtcctaaatgcatgccttgcctggacctggcccgagcccgaggggggtgggaaaacaggcgaatcccacgagcttttcgctgagctcccaaaccttgcgggccttttcggggtccctggccccctgcgaaagctggttctcgaaggacccccagtccttgttccaactccaatacaccccggacttggtcaggctgggctcccccaccacctgggccagccttttgccggactccgcctccgaaacaaacccctttgtgatgaacttttggaaccgcgggaaaagcgtgcggaacaacgggatgtgctccccgaacaaccccctggtggcgatgcaacccgggtaaaacgaggaaaaagtgatgcccgtctcctcgtggtacccccgggggaactcctgcatgg

SEQ ID NO: 50404 - DNA, 511 bp, Triticum aestivum
  Clone ID: PAT_TA_50404
aaggaaatgcacttgaattgatgcaagctcttatgccgaacaggctacaaacacaaacatactactactgcctccgctcggaaatacttggcgtggtttttgttcaaatttgaactatgaacttccctggcagtacacaatctgtttgttttcagagaatgaaggagctaccaccggcctctgcatcaacctattgcacagccatagtagcatatatatcatccacatctagtataccaattgaatctgcgtatatactatccatctttgcccaaaagaatcaaggcatgtactgtatgtatgtatccccttcattgctgcgcaaaactttacagggcagacgctgttgctcttcatcagtctgaaaaactgctagtaggtgctagctgtgcagccagctgagttcctctgagaagagcggcggccagcttagctgaccctctgcgcggcggcggccgacctcttggcccgcttggcctggtggatcttggcgtagacccgcctggtcctg

SEQ ID NO: 50405 - DNA, 135 bp, Triticum aestivum
  Clone ID: PAT_TA_50405
ggaagctccatgtgcaggaaaacacttattttggtttcatttcaattctacatatttgaagaaaaaaagttacaagcttcaatcgggcaacaacagggtacaccttttcgcgctggccattagtttacaaggtta

SEQ ID NO: 50406 - DNA, 117 bp, Triticum aestivum
  unsure (1)..(117): unsure at all n locations
  Clone ID: PAT_TA_50406
gcgaacaaatttgctcaggttttcatttcaatcttagaaggcatagcgaacagaagcgggggacgggnaacaaagtaacacgggaacggtnaggcaggggtcacaatctaaacgggt

SEQ ID NO: 50407 - DNA, 396 bp, Triticum aestivum
  Clone ID: PAT_TA_50407
cactgaacagatgaaaatcctgcagggtgaaacacataataaaatctggatggctttagatcacaacacacccaaaacgggcaaaacattttcagttcaacctaggactcgacccgtttacaaaaaatggggttcagtttgtttgcaaacatgacatggccccaacatttaaaaaaatccaacgagtaacatgcagcagcttttcaccctaagctggggcacccttgcccttttttttttggaccttcctcatgtaaaactccagctccttgccctccaatggatcctcgctagttaaaatcgcgggcggcccccccgtccccaaaaacccctggcccaccaacgagtcgaggggggactcgtgcgggccacggaaggtcaccccggtgatctccg

SEQ ID NO: 50408 - DNA, 145 bp, Triticum aestivum
  Clone ID: PAT_TA_50408
tctggcttgccctgcacccaagttgctaaagagggacccgggagacaactcggaagcatctgtccactcttcagtatgtccggccagggggggggcttcatccccaatttccaactctttgagaaaagggacgtgaacggagtaa

SEQ ID NO: 50409 - DNA, 521 bp, Triticum aestivum
  Clone ID: PAT_TA_50409
atcgctgatacactcgtgccactcaaggcccgctgcagcagcttgtatccggccgggcaggaagcgcgcagagagggggtggagcgccgtcggggccgataaggattcctgcatgcactctatctagctcccttataactatatcctccggatcaccctgaagaacaccatcctgctggggctagtcaagaccctgatggccaacggtgacaagctctcgattcccaatgatgtggcagctaagtttcccatcgcagctaatccgaaaacgaccaacatggagaaccgtatgctaccgacatgttgacctccaacaacgcatgtgtgattacactgactgagagagcaccgacggacgcctcttcaaagggtacagatccgcacccgtatgcatatacctcacccccaacataggacgatgctactcatgcatagatcctaaaactcatgtaaccagtgacacacgacatccatgcacaagctgcgtactatatataaggtatgctagaacctcagactga

SEQ ID NO: 50410 - DNA, 440 bp, Triticum aestivum
  unsure (1)..(440): unsure at all n locations
  Clone ID: PAT_TA_50410
ggcagcggcgtgcatcggcgccggnggcgcgctccgcctctccgctcgccctgctcgccgcggccgatgaccgcaccacccgagaccgcggccacacgaaaaaacggcggcgatgaggaggcccggcccttggcgccgacccgcgctcccgagcggcggcggcgtcggatccggccgccccgcggggccagccctcccgtccgcgccgcgccgcgtcgtcggcgtcggtgcggcggcggggtctttggggaccgcgtggcgggggaccggcgcggcttccggtcgagggttccggcgacgccaagccgtagatctgagccgccgtctgcacctcgcttcctcccatgtttcgatctggattctataaacgagagagaagaggtttcaagcattgcttggtgcatgtacattgaagaattcatggattgtgggggtatcag

SEQ ID NO: 50411 - DNA, 652 bp, Triticum aestivum
  unsure (1)..(652): unsure at all n locations
  Clone ID: PAT_TA_50411
ccccgcgtccgccagtattacctttggngttagtaactcggtgtgcttttcttcttacagtcttattactctcctgtttcagatttctcgtttcatctggatttctgggctagaagatagatccatgcagtgaatagtgcgtcagatccttcacagaacaagtatggccgatactccaacctcccggatgatccaccccttcagcaacatgcagaggcagaacccgaagcagttccagttccagtactcggacaacccacagcatccctgccgcccttaccagccatctccagacacccatgtcgtgccacagcacctctacagcctcaagtcgtcatcagacgctagctatgagaaccaggtcgctcagatgaagcacactctggactcctcggcggcagccggctgcatgaggcacgactcgccgtccagccatagcttcactcctccgtccatcaggagcggcagcggcagcccgtcgtcccacgacgacagccgctccgactccaccaacgggtctccggtgagtgcttcatgcgtcactgtgacgaccgaggatcccaacgatctgaagcagaagctcaaggaccttgaggctgaaatgctcgggccggacgccgagatagtgaacagcctcgagagctccgtcgcg

SEQ ID NO: 50412 - DNA, 641 bp, Triticum aestivum
  unsure (1)..(641): unsure at all n locations
  Clone ID: PAT_TA_50412
tgctccagtcctgccgcactacggcgccgngacggaggaggcgccctccctcgccaactccctcggcaccctctgcaaggcctgcaggcctgaggtggaggtggaggcgctggtgatccaaggccccaagctgggcaccatcctcagccaggtgaagaagctggaggcctccgtgctggtgctcagccagaccaagccatctacgttctgctggctaaactgcttggcgcggagcagcggggaggagctggtggagcagtgcatcaaccaggccgagtgcctgacgctggcggtgaggaagcagagcaagggcgtcggcggctacctcgtcagcacccggtggcagaagaacttctggctcctcgcttgacctgcccatccgccatggcgccatgtccacgacgatgtttttatagagtgtttgctgctgagtttgtctgtctggttcgttcctgcgtgatcctcattttttactcccgtacatctgtcatcctgtgttctttaacccgtcgatcgagtataaaaaataaaaaagatgtccgtgcaggcgtgcagcatgcggccacgtcgttcgtgtgtcgctgcggtggatcgtgcatgctgctgccccattgtgttgtactgtaaaatgtaaagtctga

SEQ ID NO: 50413 - DNA, 409 bp, Triticum aestivum
  unsure (1)..(409): unsure at all n locations
  Clone ID: PAT_TA_50413
ccaactgcctgctgatgacaanaanaanatcgaggacgccgttgacgccgcgatccagtggcttgacgccaaccagctcggtgaggttgacgagtttgaggacaagatgaaggagctggagggcctctgcaaccccatcatcgccaagatgtaccagggcgccggtgctgacatgcccggaggcatggacgaggacgcgccggctgcgagcggcggtgctggccccaagatcgaggaggtcgactaagttagtcgcttttatatagtgagaaatacactatacaccattttattcagtcctgggtgccaatcatatcacctgggctggaagttttgttgtactttttggtctgtagcatcacgagacttgtgtgtgtcgtgaacaatgcaatgatgcatgttttggctc

SEQ ID NO: 50414 - DNA, 262 bp, Triticum aestivum
  Clone ID: PAT_TA_50414
accatatcactgggggccctttattcgacaccatagagattagctaatacccttagatacagatgaacacacattatgggtgttacagggccggccaactggatatacagacgggtgaatttattatttaccaaaaagcgacttgaaccaccaggtcccttttttgtcggggggcgcggaattttttttcgggggggggtcgctttggggggttttgtgcaacttggccaccttgtaacctttcttcttgcccacccgtccc

SEQ ID NO: 50415 - DNA, 541 bp, Triticum aestivum
  unsure (1)..(541): unsure at all n locations
  Clone ID: PAT_TA_50415
tcgcgatctagaactagtcccgccctttttttttttttttctcctccacctgctgctgcaaggatgagccgacgccggctaaatccacatcaaccatgggagaagctcccacctgggcggggcatgggggtgggggggaggggggatggacgacnaancatccnccctcggcgtcncatccgtcgtcaccaccgcgtgctgcgtcaccccatttcccgtcggcatcgtgctgcgtcatagcatccgcccgtcgccgccgcgtgcttcgtcgcatcaaccgcattgccgtcgtgctgcgatggagcaccgccaagccggagggggctctgtagtgaagcttcaccggaggcccttgggtgctgccatggagcttcggcgagggtagtcggtgctacagcggagctccagcaagcggtggggcgctgcagtgaagctccgccggcggggccggcgggtgctgctatgaaactcgccgcgtcggtgcgggctgcagtgaaacattaccgacggcgttgaatgctgctatggagcattgatggac

SEQ ID NO: 50416 - DNA, 488 bp, Triticum aestivum
  Clone ID: PAT_TA_50416
acaaaattggtcgggacatataggacgagctgggggctttattttgtactgggggggcacacacaccacgcttacaggattacttcacaaaaccaccagcttaggggataagctaacgtacccacacccccggggggcgtacgttgccctttatttacgtacgtttacctacatacggggcatccgttgttttacttaactaaggcacccaacaggtgcttacgtgagcgcgcgggcgaccgaccggggggtatcgcctattggccactttactttcactttctgccgccgtgcttgccgccccccatttgctttccgccggagtaaccgtgcccgtgccccccgccgtgcccgggggggtacaaacccatttgcccaccggggtgtggcccgggcttcccggggtacccccccggcgcgtaacctttcgccgggtagcccccctacggggggcaaacaccgggggggggcggagggtacccgtgctg

SEQ ID NO: 50417 - DNA, 569 bp, Triticum aestivum
  Clone ID: PAT_TA_50417
ggtaggcgttgggtcacccgtcgcccacctgggccacagcccgtggaatccagctgagacatgatgggagccggcctagtcaatcaagagaggaggcaaaaacttccgctgatcgtactccctacttctgttaggtcctcgatggcatcgaacagagctagcccattattgtgtacagaaaactgatttgaaatggatcaacaggagatacatctttgagatgaaaagctgatgcaaacgacctggctagggtattcgtcatcctcgcaacaccagcatccgccgtcaccccgcctgccggtcgccgtcaatagcatcagatgcttccggtgagcggccttgcatcggatgcttccggcgagcaaccccgcgtggctggcgctcccgccggcgaccagccttgcttttgcagccgccccattgctgctaccccccatacgagagagtcgcgcgagaacgctcgccgctgctgcaacttctcaccgccgtcagctaattgccgtcaaacacaccatggctggatttgtgcttgcagagaaagcatggttgttgctgcggacgcgtgggtc

SEQ ID NO: 50418 - DNA, 446 bp, Triticum aestivum
  Clone ID: PAT_TA_50418
aggaaggagggagctttttccttcccacaagaaggttttttttcagtcaagtcaacccaccaaccagaccagaccagaccagaccaggcaacaaaagaatatcatctctacttttctctctctctttctacaaccatgacaggcaaaaaggggaggggaggggaaaggaggcaaccgaaatcaataaacggacggggccacttttcatcaccaaaaaagcttccaattcaatttggatcaacaacaacaacataagtcttccttcttcttggcttctcttcctcgcattcaaactccctttctttttccaaccagtccgtttgcccctccttatcccccctgttgcccttttccttgcaggcgctttagtcaagatcattataccagcgaccgctcgcattcggatcgtcgttgtagtcaccaaagccagcagcatcctggtcgct

SEQ ID NO: 50419 - DNA, 511 bp, Triticum aestivum
  Clone ID: PAT_TA_50419
gtgcacagaactggtgcgcactatcagtatgcactcatcgcctaaagatcgaagctgtggctgttgaaatggaacacggcgcccccgcggcgaaggttttgcgacctgcactccctcgccacgctggcctgcagccccgccggcccgcacaccagcacgccgacgtcggccgccgcgcccccggcccgctccgcgaacgccgcgaattccgcatggaactttggccggcacccgtaccgcgtcgtccgcatggcggcaaggctggccccggaggcgtcggctccaccagcagcgttcgttgtctgttcggcgtccgccccggcacgggcgttgacgtcccacctgtcgtcctgcatcctccgcttttccgagaggtgccagaggaggacgacgagccccccggggagcgtgatgccggctgccatgcacagcaggagcaggaggcccaggtaccaccaggcgtacacgttgtaccgcttcacatagtacagctgcaccagcacgaacgcca

SEQ ID NO: 50420 - DNA, 433 bp, Triticum aestivum
  Clone ID: PAT_TA_50420
gggggatcatattatgataccggaccatattaaatgttatactattttatgtcatacatgacaattaataagggaacctaaaatactaacttataatactatgcattacgaaagtagtagcatacactagttttatgtgcaccataatagtataggatacttcccattacaaccagcctaaacacatgcatgcatggactaatatttaacgttgggcgtatttcaagacaacaatgatggtctgaatgatggtacccaacacgggcattgggcccaaaaaccaccccacggggaaccaagggtttccaaaaaggtgccttataacccaagcgccccacccgtttaacccggacccgcaatgcgttcccaactttacccccaccgggtttaaataatgcttccttgaccggttaaaaaacaaccccttccccag

SEQ ID NO: 50421 - DNA, 433 bp, Triticum aestivum
  Clone ID: PAT_TA_50421
caaagggggaaattttaaaagcgggggaaaagttaaaaaggctttttggggtttgaaaaacttaaaagggcccatgtaaaagggggggtaaaaattttttccccgcttccaaaaggggggaaccaaaaaaaataaaaaaagggttttgtttttgaaaaaccccaaaaaaaaccgggaaaattaaggggggggccgggttttcattggggggggaaaaaaggggccaaaaaaaattccccggggaaaacgaccaaaaaaaaaaatggtattttttacccccccccccgttaatggggaatatggaaataaaaaaaacccccaggggggggccccccttcaaggtccccggccatggggtaaaactttcccaacccttttggaaaaggtttaaaaggcccaaagggaaaaagggggaaggaaaaaaacctgtttt

SEQ ID NO: 50422 - DNA, 536 bp, Triticum aestivum
  Clone ID: PAT_TA_50422
gtgaaacctcattagacaatcaaattacatggtagacatccttctacaacatatatacatgcatatatttcaacacaaggttccctacaaagattactgtgtcaaaattgtacatctctacccagtgaagggtagccagaagatattgctggtcaatgagaccatttcttcccataatcatagctagtacatagcacgacaatcagcgtgtgtatccttcaaatacagtcagccaagaaccaagctgagttatcatggtggagaagtgcaaagaaaaactgttcactatgtctctaacttcacatctaataatttgagctcttctaataattcctcatacttctttgtttccttagcaatttgataccgaagcttttgttcctaaaagcatgatcacaatattcttttgttatatcaatcagttctctaaaatgttcagctctaaagataacacataggaatgtacaagggcaccaaccaaaatataactcaagattgccaaatttctctaaaatgtcaagctctgaagacaacac

SEQ ID NO: 50423 - DNA, 443 bp, Triticum aestivum
  Clone ID: PAT_TA_50423
aagcccaacacattattttattggtgattcgatcaggaatctgctcgatctggtttaacgggaacagggggggggggaacccatggggaaaacaacaacgaacacccgccgggggcagcaacagtggacaccgggggggctagctagcccggggggatgaagatgctggtagataacttaatgaagggtggtgcaattggttttggggttgatggggaaaaaaaccgaaaccccccatttgccggggatgttgggggggttacccatgctgatgccccacccccccaggtttttgaggcagttgcacccccccttccggtcggccgggggggaccccttggcgttcaggggcctcaccccgctgcagcacccccccgagggtgccgacccttgcccccttgcgtaggacatgcacggggcgacgggggacgttacgttgcccc

SEQ ID NO: 50424 - DNA, 536 bp, Triticum aestivum
  Clone ID: PAT_TA_50424
tgcatttccgagtatgatctaaagcatcgctgtatgtctcgtgaggaggacatatccactccgggccagttgtgagggacacgttacaaggggaacgcgaaaatgactataggttgtgttagattgatggcgcgatgattttattgaaaactatcgcgctcccggtatctttctcactctaggcactggttatccatgccttgtgttataccggcagcttcacgtggtattacatggtcggcatatgccaaccgatgacctaaatctttggggacgattctggattacaattgggtggatgaactttaggacatacttgctgaaatgcacccgctgcactggctaatcgagcgggtttagaagcctgtgcacaagctcttaacgaagggcgcgatcttgcgtccgactgtaatgaaattatccgaacagcttgcagatggcgaacggtactatctccaggttgtgatatatggaacgtgatcaaatgcgagtacgagccgcgagatactattgatttactatataatactaaagat

SEQ ID NO: 50425 - DNA, 303 bp, Triticum aestivum
  Clone ID: PAT_TA_50425
cggacgcgtggagcttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacgaacatggctcgagaaagcatgctcgtatgtgaatgctatcggtggctatgtatatgcacggacgcataatattatacaatatgtcgactatatacgttttaatggtaaccaatgg

SEQ ID NO: 50426 - DNA, 536 bp, Triticum aestivum
  Clone ID: PAT_TA_50426
atttgtactgtaatgctaggagcaatggtcttttctggaaatcaagacttccaaaacacttataacacactttttcttgtttaaatcgatggcagtgaggtacgaaatagcggctgcagcagcaaaagctcgcagagtgccaagagaccatgttgattcttggtcgtcaactgcaagctatgcgtcctccagcagagtcaatgggtgcctcgccaacccggcaacgaatggaggacttcttgcaagacgcggcaggaacaaccgaacgaggcgagtatgcccagaaaccatcaggccagcatgatatagatcaggaaatgctggagtcagggaatgtatctcccctcaacggatacaagacccacatgaccccttctgatgtggatggaagcccttccctttcgacaaacagttccaagcgcccaaagcataggtcgcgttcctcatcttcttcctcgtttgctaaccagttgcccgagaaacaaagtcgcggttttagtcagttcttcgccaagggcaaaaagtgaacattagct

SEQ ID NO: 50427 - DNA, 616 bp, Triticum aestivum
  Clone ID: PAT_TA_50427
gtcaacatacctgggctctatcatggcgaccatctatatggatgcgtatcccacattccgcagacttgccccatcttgggctctagacctcagccaggagacatgctcttaagcgcaatctccacaagcattggtgttattgccaagctcgacatactggggatctgacgtggcatagtgacgctggacggatttatgggaatatacattgactagaccctagttgacctatccagcactttacatacaagaatctcctggagcacgatgactactagcatcggtcctagtgggagccctgactaacattgagtatgggggaaccatttttacgggagcacaatagatcccgcggatactatgactgttgatactggacaatgtggaagctgcctatgttcgggcgcaccgacgccacacaggtgctgaacgaggtggaggaggtcaagaaggagtaccctgacgcctatgtccgcgtcatcggcttcgacaacctgcgccaggtgcagtgcgtcagcttcatcgccttcaggccaccgggttgcgaggagtcttggcaggcctaaactacgagtgaaacaagggcctttgtatgaagggcttttggggaacgaac

SEQ ID NO: 50428 - DNA, 425 bp, Triticum aestivum
  unsure (1)..(425): unsure at all n locations
  Clone ID: PAT_TA_50428
accaaacccaggaactcgctgcgcgagagaaacagagaggcggcgcccagcgagcgatccacatactgctaccccgtagtgtgatcatgggcatgggcgattacacatcggtctgggcctgcccagccgcctgctaccttaagatgttccccttccacatgnacttcttgaccactctggaagatctgaagtatgctgaaactcatgaatgggtcaagggtgatggtgattaccgaatcgaggggattactgaccataccaagaaccatgcgtgggatgtcgcacaatgagagatcgcagaagactggatctgtgcactcacagggaaccaaatttgttgctggggaaagctttaatgcaaccataatacactaattttatcgagtgtggataggggattaccatggatgattaattaatacaga

SEQ ID NO: 50429 - DNA, 367 bp, Triticum aestivum
  Clone ID: PAT_TA_50429
ggcgcccacgaagcgagttggctaccaggcggcctcgcaattcggcgcccgtccacacggaggcgtggaataagtcgcacgcggttgcaacctggggaccgtggcaccctgcccgtgcagatgcgcaagtcaccatgaaggacactgagctgtttatccagagggtgaggttgcagggccttgcgtggtagattgcgcaagagttaaagaccgagctaacgttgcagagctgtgcattgtccgggctaaaggaggccgccgatgcacacatggcgagggtgttaccagacaccaatgtgtgcgctatacatgctaagcgcatcatcatccttaccaatgacctgtacctcgcccgcattatccatta

SEQ ID NO: 50430 - DNA, 204 bp, Triticum aestivum
  Clone ID: PAT_TA_50430
gaccatactggggtacataccaggaacaatctacaccatgctcgtgctagaaatgtaagcaacactctttggcatgagggacatgctcttaccagctagttgctgaggaacaccaactgatgctgtgtgcgataaaatatcacatttttcgggatgcttgcatgtatagaataatgaacctttcattcatttggggagctaggc

SEQ ID NO: 50431 - DNA, 343 bp, Triticum aestivum
  Clone ID: PAT_TA_50431
gagctaactatatctatggctaaatttgcaagatgatgcaaaaaaatgcttgcaggtaggctgtgtacagagatgcatgttgtgagttcataacaattttacaatattgagatttgttttagatgcttctaagcagtgctatagcagaacggtgctccatttccttactgttgttgctaaatatttgttttgtggcatattaggactgaacggcatcatgctaacaacctcaccctaggagtccacttcttcacggacatggcatactgcctccaccaattatactatagttaagtgccaagagacaattggggagggcaactttagagctggagcactgtat

SEQ ID NO: 50432 - DNA, 530 bp, Triticum aestivum
  unsure (1)..(530): unsure at all n locations
  Clone ID: PAT_TA_50432
cgctcacctcccgcccgcccgcaactccagnggccttcgatttcgagcgagcgcccgaggaggctcgtcggccatggggaggccggcgatggagagcagcagcgaggaggagctggaggacgacttccccggccacgagtggatcaccccgcagtcctccatccgcgccgcctaccagtcccagaccgagaagggtatcaggaaaacttgctctgagctactggagctgaaggatgccattgaaaacctgtgcgggaatatgcagtcgaagtaccatgctttcctcagaatatctgaggaggttgtggaggcagagcaagagttaattgaactgcagaagcatgtgtctgcccaggggatgcttgtacaagatctgatgagtggtgtgtgccgggaacttgaaatgtggcaaaagcatagtaaggaagaacatgcggtggaaaaggattttcaaagtgaacttaatgaaattttgtctgtagatactcaataccccaaggttatttttctggacgagatagacatttttg

SEQ ID NO: 50433 - DNA, 586 bp, Triticum aestivum
  Clone ID: PAT_TA_50433
ccccgcgtccgatctgctcatacctatacatgtaagatgtaacagtaataattgagttaattgtatgatacagttggcaattatgtctatcgcaaggaggagaagattactaaatgacgatgttctggtttctcttgttgatagctcctggaagatcctagatatatctgggtctgaggttactgatgttggcctggctactgtggcacgtacttgtagtaacttatgggcagttgatattagtcgatgtgaaaaaataactcctgctgccgtttcagaaattatatgccactgcccatccctggagatattaagatgcggaggctgttcaagaagcgaattcactgcccgtgggtgtgtcaatctcctgaaacccaaactgaatacccttgaagaggactcatgggaggagctagaagcagttgatttcggcagtggcgcgcagtctttaagatggctagtttggcccaagatagatgataactcgaaggaaattctcgccttagagtgtcctcgtgttatcgtcaaccccaaagccggcacttcttgaccttggtgaatccaagactccaggtgaagcattggc

SEQ ID NO: 50434 - DNA, 405 bp, Triticum aestivum
  Clone ID: PAT_TA_50434
tacggttatccaagagttcttgggataagcgaaaggttaaggcttggccccaccggccggaccagggagggcctgtccttgaggaggtccgccgcctcctccgtggccgtcctggcgtaggtaagcttcctggcacgggaacaaggcaaactggttggtggcgtagaaggggtacacggggttgaacgtccggaaccggcggaagaacaagagggcccacgtaagggcctccgcccacgtcccgttttacatcgaaaacaaaaacaacaactttgaaacaatcataagccggaaggcccacaaaaacttggccggccttttttacggcctgtccttaaccaagttaaaccgggatttaaccaaaacggggaggaccagtttcttgccggaaagaaagttgttgtt

SEQ ID NO: 50435 - DNA, 310 bp, Triticum aestivum
  Clone ID: PAT_TA_50435
gtcatgagggcaggaccaagtccaagtggcacaggccttcttgcacatgtgtcccgcaactgtaaaaagatgttggacatgatccacttctagcctgaggacagagcctcaagatggacaatgccttaagcgaaatcgccccacccaattaccagacaccactgctggctttttggggacccatacatgaccaccaccattattgtgtattggacgttgtacaagccctgatgttgccagcccttgatctcaagaatggcagatcagaacaaaaaaatgacttaggatacacttgccattgtactctata

SEQ ID NO: 50436 - DNA, 380 bp, Triticum aestivum
  Clone ID: PAT_TA_50436
tttcttttttgtttttttttttttatatttcacaaggccgtgggtgattcgaactgacgggaaatgggtacaacatttaggtgacacgacttatattgggttacagcttattcaaccatcgccttatggcgaatgaggtatttagagggggcgaaccgcccataagaacagtgtcactgcctgataggggtgggatgctacacttgcacatgcccctttaaggcctgcaaaaggtggcgtatattcacacacggaccgctgcaatagccaacgccctagaacccaatcctttagatatcataaacttgctccggtcggcataattattttattcacatcttgggttcaaccctggctttgaactggacattcgggccaca

SEQ ID NO: 50437 - DNA, 541 bp, Triticum aestivum
  Clone ID: PAT_TA_50437
cagaccggaacttggggagactggtagtgggctgttcggttcggtccatccatctcagcggcagtctggtaattggggacgaggtatgggcctcctcgacaagctgtgggacgacaccgtcgcggggccccaaccggacaccggtctcggccgcctccgcaaactcgccgtccgccccgccgccgtcaagatcaacgatgtggctccgggcgccgcgatggtgatcccacctaccacgccggccggcggcgaggatgcgccgatgaaagtcacgcgcagcatcatgattaagcggccggcggggtacccctcgtcgccgaggagcgcggccagcacgccgccagcctcgccgctaggatccacgccgcccatctccccgttcgccggcggcggtggtcgcttcagaaggaaatcatcctcggatgcataccagagggctaccactggggcgtcgaccagtcaccctcctcccccctttgaggtgtgactgcccagcgcgctcatgctcctttttgctcctcggcccgctcttactttatgc

SEQ ID NO: 50438 - DNA, 406 bp, Triticum aestivum
  Clone ID: PAT_TA_50438
acgctggctccagcgcccgctgacgtgcatgctgcagagacggccgctgcggcggtggacgctgtcgagtccgtccgtcgttgtctgtcgaggggactacggtggacagcggtggatattgtcaagcccgctgtcgaccagcctggcgacatcggtggtagctgtcgagccggccgatgtcgctccccacgtagccgtgaaagaggaagactgatgcaccggaccgtatcctacctgcaaacgagcctgaggcagatccatctaagaccagtgatgccgagcccaaggtattacagccggactttacctgtgtggaggcccctgctgcaccgcctgcgttcgataccatatagcccgaagctctccctgcccatggaacagagacctgaatagcggagcctgacgc

SEQ ID NO: 50439 - DNA, 404 bp, Triticum aestivum
  unsure (1)..(404): unsure at all n locations
  Clone ID: PAT_TA_50439
cactgtggtctcaaaganacaccctgaccgtctggcccgtcacgttcaaggcatgcacacacgaacttagctcgtgggcagttcaaggctgacaggcggcaaggtatcaaggtcgctataacaaagtaatgaggcaacatcactacggcatgaaggagcaagttgcatagcacgcgctgaccttcacagtaactaccatcaaaccaacgtgaggcacgtaggtatagaactagtggtacatacatcgatgatcccccttggattgcctaagattgtagttatgataagcctgctttacattacgaagtgacatgtgtggtatgccagttttcatattacgggaaccatcgtatgacatgtgttggtgagaatgaatgatgactagtgtatcacggaacgttaac

SEQ ID NO: 50440 - DNA, 205 bp, Triticum aestivum
  Clone ID: PAT_TA_50440
gctcttatacctaacatcgcgaagcggcacggtcccccacgcacgcataggtcacgtacgccaccttgcgacctcctttctattggctcaagtcaaccaacttcctcccactgaccgtcctttcacaaccgtgctaactctgaaaacgttagcgtcacccaaatgattaggctcgtacaacattcgcctatcgacagcataaaaa

SEQ ID NO: 50441 - DNA, 372 bp, Triticum aestivum
  Clone ID: PAT_TA_50441
gattttctataagactcgccggggagatctgccaagctcgcccgttacaacaagaagcccaccatcacctgcagggagatccagacctgggtccgcctattcctccccggggaagctcgccaagcacaccgccttcgagggcaccaaggccgtcaccaaattaacatcctactaaactgacggcgtgcagacggtttctgcatctgcatgagtactacttgactctggttatctatctatatgaaagcaaagggggcatgtggtagtacctctgctgggtgattggcaacgctttgttggcccttcggatgtaagaactgaagctgctgctttggcaaactgaaaattctctagaactgaaggagtggtcct

SEQ ID NO: 50442 - DNA, 295 bp, Triticum aestivum
  Clone ID: PAT_TA_50442
cgcgcctttctgtctgtaccgatgccacaaaaattctctgcgaagagagttgaatcttgaaaacatagctcattggtcgaaagcttacttctacttgtgggatgagccattgaatatggagcagtacgaagtgatccgcaacatctctaacgagttaaggacatacacacctgatgtgcgtattctaacaacttattatgctggtccaagtggttctgaactgactccttctacattcgatgcttttacaaaagatccaaatgttctacgtgcggatacacaaattttttgcact

SEQ ID NO: 50443 - DNA, 520 bp, Triticum aestivum
  Clone ID: PAT_TA_50443
caaaacatatcataacagaccagaccacaaagcggcggtaaactagaggagatcatcaccaaccgaccatgtagtgctgcggaggcaactgtggatgcaggaatccgtctgcacgtgcggaaacggttgcggagggtgcaagatgtaccctgagatggacgagggggtgaacaccacctgccagaccctcataatgggcgtggcgccctccaagggcaccccgtagttcgaggccgacaccgataactgaggatgcaaatgcggccccaactgctcctgcaacccgtgcacctgctagtgatccatcaaatcaagacaaggagacaccatggacggacctgatgaaggatcactagtggttatgcatggagtgtgttaccgtcctaattgccacctagaataatatgagatctatctcatcggatctagccactaatagttaatggcgtatgtgtgccccttgtggcttgcaccgagtgctgagtaacgcgtcttgcgttgtgatgcgccttatcctatg

SEQ ID NO: 50444 - DNA, 627 bp, Triticum aestivum
  unsure (1)..(627): unsure at all n locations
  Clone ID: PAT_TA_50444
ggacgggataaagatccggaggcgcccggtcacgggcccgtccgtgcaccacgtgggccccttccagttccgcctcgagaacgagggcaacacgccgcgcaacatcctcgagaagattgtctggaacaaggacgttgagatttggcagatgaaggagaaaatgcccctgtacaggctgaaaggtccgctggacaatgcgcctccggccagggactttgttgctgcgctgaaagcgtcctacgatcggactgctctgcccgctctgattgcggaggtgaagaaggggtcgccaagccggggggttcttagggagaattttgaaccggtcgagatcgctcaagcgtacgagaaaaatggagcagcatgcttaagtgttcttacagattcaaaattctttcagggaagtttcgactacttggaggctatacgcaatgctggagtgaagtgtcctcttctgtgcaaagagttcatcattgacgcttggcagctntactatgcacggtctaagggagcagatgctgttcttctgattgccgccatcttacctgatcgtgatatcagttatatgctgaaaatatgcaaaatacttgggatgggcgctctagttgaggtgcatgatgaaaggga

SEQ ID NO: 50445 - DNA, 478 bp, Triticum aestivum
  unsure (1)..(478): unsure at all n locations
  Clone ID: PAT_TA_50445
atttgtggcggcggcgaacacgcgctatctaccgagctaagangtacggcgggcgacatgagtccggccgtggcggcgctcctggctttggcggtactggccgcgagcgccaacgtgtgcgcggcgcagctccggcgggaccattacgccggcgtgtgccccgacgtcgaagccatcgtccggggcgccgtcgccaagaagttccagcagaccttcatcaccgtcggcgccaccgtgcacctcttcttccacgactgcttcgtcgaggggtgcgacgcgtcggtgctgatcgcgttcacggccaacaacacggcggagaaggacagcactgccaacctatcgctggccggggacgggttcgacacggtgatcaaggccaaggcgggcgtcgacgccgtgccacggtgccggaaacgggtcttctgcgccgacatactagtcatgggcaccagggaccccattgcactggccggggggc

SEQ ID NO: 50446 - DNA, 239 bp, Triticum aestivum
  Clone ID: PAT_TA_50446
gtactataggcctgttgaagataaaatcctgggtggctgaagagactcgccgaagtagaggctttgatccaagtctgctgatgggggtggtgacggtgtgatgatgcttgctatgtgtgtgtttggcttcggctgactgatcacatacttgcttggcatgctgcgcctttcttctcatatgtcatctcacttattccaaaaacctgatactttaatactactgttttctatgtttttag

SEQ ID NO: 50447 - DNA, 165 bp, Triticum aestivum
  Clone ID: PAT_TA_50447
cacggagcgaggcacgagcaccacgagccgcccgaggaggcaaaccgaacgacacggacacgacaaccaccggcaacgcgagacgaaaagacccacggcgacacggaggcggagcagaggagaacagccccacggacgcacgggcgacgaccgaaagaagggccg

SEQ ID NO: 50448 - DNA, 366 bp, Triticum aestivum
  unsure (1)..(366): unsure at all n locations
  Clone ID: PAT_TA_50448
tctgcaccacaatcgccacataatccaatgctcgacagaaggcgtgtacacttctgcgaaagctggggccagacggtaaacacccgcgagcgatggccatatggcgcggcaggcacaaacaggcccatcaaggccatcgtgggggggggggcagtcgccgacctgctcctctggaggcggaggaacgcctccgcggcggccgacgcgggcgccacgctcgtctggttcctattcaaacgcgccaggaacagcctcncgtcggacctgtacaacaccctcctgctactagaaaacatactaaaataatgaaaaaaaaaaaaaaagagaaaaaaaaaaaaaaaaaaaaaaaaaaaaaaaaaaaagaaa

SEQ ID NO: 50449 - DNA, 304 bp, Triticum aestivum
  Clone ID: PAT_TA_50449
aactgatgcactctgagacgcaaggatcaattctttgttctgattcgaaatgactgcccatctgctgctcatatcatagagtccatcgtgatcggtcagtctattcacgccaataaacagatgaatgtctattgcatccaagacgtaacccatccatcacatagctcaatatcttaattatcccatattttgaatataagatatagacaaatgatatagctcttatggtaattggatacaggaccaaatgtactataaatgatgaaattattgtaccattactttagaattgtctttattcttt

SEQ ID NO: 50450 - DNA, 299 bp, Triticum aestivum
  Clone ID: PAT_TA_50450
ctcctccataacaagctatatacactatatagccgcgagccatgagcctgaaccgagatggactccgcgagccacactctgtcgcctgctctcccaggggctaaagggcaccgaaggccctagcccgcgagacgacgctccaacgcgagctagagctacggcgagcaggtagcgaacggcaggaaggatcaagtgcatgcaagggaggcccatcaagggcatcaagaagatggagaccttgccctactggacaccgatgaatgcggaggcctcacttaagcaggggcgactgcctgatc

SEQ ID NO: 50451 - DNA, 339 bp, Triticum aestivum
  Clone ID: PAT_TA_50451
ggcgcaggttgcagagagtttttttccggcgccgacgtcggtgcccaccacccacggcgaccgcgccctggagcaaccctttggcagaacctgtcccaagagccttacccatagagagcgtggtgctatcggcagctctgtgagcattgataccaagaagcaccagctcttctacctgtatcggtgatttggagaagaggcacccatatcgtaggtgcacgggaaaaaacatggagctgctcttccgcttttgcgacgcctttatcctaatggcagggatgccatctggcggccatctcatgcgagaaaaggacttaccatttggctgctatatgggat

SEQ ID NO: 50452 - DNA, 366 bp, Triticum aestivum
  Clone ID: PAT_TA_50452
cagacgggaggaggaggagagcggcggcgaagaggtgtcgctgaagctgcagaagcgcctggcctcgagcgtcctcaagtgcggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagaacctgtggatgcgggagatgcccctactgaggcgccttcttcgcaagtaccgtgaggc

SEQ ID NO: 50453 - DNA, 477 bp, Triticum aestivum
  Clone ID: PAT_TA_50453
gccgtaccttccaatccactagcaccggccgccgctcagtgcacgttggggaacgaggcgaccttggtgaacttcctcgaatcccagccaaggcggtcatcctgctgcagggcaagtaacacgacgtaagcaagcggtgatctacgcgcgtgttcgatgtagggtaccctcctaccgcctcgtacagtcactaccttgtccacagtctgcccaattacccccaagaaagtgatcacgagggacttgaacaagaagaccgtcaagatgttgaacatgatggtgttggtcaagctcgataattttactcacctgatgcctacccgcatacacgatacatgtccacctcatggacgttgcctctgagatgatcgactcccttatctgcaagtacaataacgtgacctccaaccaggccgacattgacactctcatgaataggcattagatcgcaaagaactgtatgttctacaccaaact

SEQ ID NO: 50454 - DNA, 557 bp, Triticum aestivum
  Clone ID: PAT_TA_50454
tcacagtacaccacgctgatgcctggcctgcagtacgtgcagcatggcggttcgccggcccggggctgctgcaccggcctacagaacctgctggcggaggccaacaacagccccgaccgacgaaccatctgcgggtgctctcaataacgttaccaacggtgcctccggcgggccctacatcacccgcgccgacgctcttccctccaagtgcaacggcgccctccggtacaagatcagccccaaggtggcactggaactggatccacttgaacggaactgcaagcgccttgcgtgccgagtgtcgacctacgtctgtcgagcgaggagtacaatgtccggagaataaattgctgctactagtactgaagcttaactaggccttggcggacaaactacggtgtgcttacctagatcatcgtgtgaggccttagggtcgatggatctgcgggcatgcattccatggtggtgcggcctgtgtgggatcaggctccgcaagctgagcagagtggtgaactgatattgtgcgcgtcgtacttatggcgcgtgcctatgtgatg

SEQ ID NO: 50455 - DNA, 560 bp, Triticum aestivum
  Clone ID: PAT_TA_50455
agcctcttgtactgatatggtcacctcctacttggctcctaccatcgctgcctgaggatccatataagcatgcttctatctgggggaggagggtggtgatggccaccgtggtgctgatgatcaccatggtggataacattgttgacatccaccctggccttggggggcacacccactgctcgccgtctgcggctgaggatgacgagaccacctctgcgacctgctaatcctcgtgcaccaccacccggactcgggtactttcacactgactctgcatggtcaggtcgccgccggcccgtcgcaccctttctagcaattactttgaagccttctacgtatcccgaagggatctcagacgcgaccaaggaccgttcatgaacactggtgcaccaccgactatgtatccaggattgcctgcggcaacaaatcttgtccgacgacgccagagagcacgaggccatggttatgaaggatcgtcgaggtctggctcaccggcgtcaccatcacgatccatggtcggcgccgcctgctgcgatccggggcgcgcccaggaaattact

SEQ ID NO: 50456 - DNA, 321 bp, Triticum aestivum
  Clone ID: PAT_TA_50456
tctccgagcgcctcagatcaaggctcgatcgctgactagtccatcaaggacctgatggagtagggggctcatcatgcatggtgccaatccactccactcagtcagatcttgactcagtgccactagacacacctgaatgacctaatgtgcttgcctgcctgttttctagcatcagtaggactgtacatgtcgcctgttatattgacgttcattatgaccagcgaggcactttggcactcgtaccacaagtatgtcgaatcgttttcgagtttttggtacaatctaggacgcagtgaaatataccttatattaacaaacaca

SEQ ID NO: 50457 - DNA, 312 bp, Triticum aestivum
  Clone ID: PAT_TA_50457
gttcgggagcgcaaacacaccgaccttggagagacgcgcgcgcagaggcaacctgcatggatcacctgtcctttgtggcgccgcgatacgtcccctgcctctacctccggagctgctactattccgtgctgtgaagactgggtaagaaatatgaagtgataatgcccatatggctcaggatgcatcttgacattcgacatcaacgccaacgggagaaaggtgaacgattaagggcgtgtaccatgtgatacgacaagtacggctccaacaaataacggtacagaccaaagaacacgccacatgaatgaaatg

SEQ ID NO: 50458 - DNA, 379 bp, Triticum aestivum
  Clone ID: PAT_TA_50458
caccagcttaggacatggccgccgccacctccaccgtctccggcctcgccggcgccgcgctcacccggcggccagccttctctaccagcttcacgagtggtgcccgggtgtcggcgaggaacccgctgatgacgaggaacctggagagggaacggcgggatcacctgcatgacgttcccgcggggactggctgcggagggacctgaacgtgatcggggtccggctgattgggtggctggcaccggaaagcatcccggtgatcaacggggacagcttgacggggctcttcttctccaacgtcggcgaggagctcgcccacttcccgttgcccccgggtctccaggagcagaaatgggtgtgggtggtgacgtggcacctg

SEQ ID NO: 50459 - DNA, 488 bp, Triticum aestivum
  Clone ID: PAT_TA_50459
cggcactcgccatccatgggccactgtgggtgctgaccaaaggataccgatccgagaatgcagcctcatcgctgactagctcctgccgctgctgcatagcgggggcttactttcgacgagggcatggaagagaggctctgcacctactccgagagccgtggcgcacttcccgaccgctgtcaaagattcaagagacgaaacggctggttctactctctcatccataacgccctagagggagggaagcctgatccatgcccgctgccacagcttgcctcaaggtagatcaaggtgatatacacaaggattttggttctatgtgcaaacaacaccacgcggactctgcttaaatcttgaagcatgcttttaagtgcctaaccggtgatggtgaggacagacactggagcatagagaactctgtgcccatatattcctccatgtctgcccattgaaaataaccttatgtatgtgtgggaaacacatgtgct

SEQ ID NO: 50460 - DNA, 622 bp, Triticum aestivum
  unsure (1)..(622): unsure at all n locations
  Clone ID: PAT_TA_50460
aactgatgagaaaagccaanatggagagtttgacatcacctgcagcctttgtagagggtggggtccaggatgcatgtgatgatgcatgtagcatttgtcttgaggctttctgtgagagtgatccttccgcattgacaggttgcaaacatgagttccatctccaatgcatcctaccagtcaagagcttcttgaggcagtacagtgggagaggaatataagaaccaatcaaactcaaaatacgactatatttcatcatcctgctcttggtgatttcgaagtgcagcatttacctgttgttggtaatgatgctgaacttgaagagcgtatactgcaacacctagctgctgctgcagcaatgggaaggtcacaccaacatggtagaagagaggggcagaggaaccgttctggctctcatggccgcccacagttcttggttttctctgcacatccaaatactcctgctggctctgtttcatcatcttccactcagggggaaggtgctgatgacctgaggattcttgttcccagagttggtgacttaccaccacatgctaatcccattgaagaagcaggcaaccaaagtccgggggtccttacctacgatgctgaacagatgctggtg

SEQ ID NO: 50461 - DNA, 382 bp, Triticum aestivum
  Clone ID: PAT_TA_50461
ccccgatctagccaactacccagatctcggaaccctcgccgtcgccgcggccatggcgaaggagccccccttctcccttcccccggtggtcctcaacccctccacaccggcccaccgccgccaccctacccctgggcccggcgcctccccgccacccgccttcgcgcctccccgcccctccacctcctccgccgccaaccccctgcccttcatgtccttcgacatacccgctcagtccaactccacgccgcccatcttcaccgggcccatcggcggctccagcgcctccttcgaagacgagccgccgctcctcgaggagctcggcatcaacacgcgtcagatctggcggaagacgctctccatgctccacccgctccggtgc

SEQ ID NO: 50462 - DNA, 399 bp, Triticum aestivum
  Clone ID: PAT_TA_50462
gtgactccatccatatcgatcccagtccacagaaacatcaatggcgtccgtgaagctcgccgccgcgctcgctcttgtcgccgtgtgcgccgcgctcgcggcgacgccggccacggcgttcccgcccgagagctgcgcgacgcagggcagctacttcatcaactgccttcggcgcgggttcggcgagaggtgctgcgccatggtggagaaccccaggtgcttctgccaggtggagcgggaggccgagatccggtgcgtgcccgggcggagctgccccagccgtggcattgccaaggtcgtgaaggttgccgagatgcatctctcctgcatgaggaaccttaagtgcaagcgtgcctaaacttaactggttggttcatttttgaatgttttcctctgctt

SEQ ID NO: 50463 - DNA, 382 bp, Triticum aestivum
  Clone ID: PAT_TA_50463
ggatggaccgtcttcattgcatatcacgagactgtttgccggagcactataatactaatgctacagcttgcctacctggtatctatgcatcgttagattgagtcttgcatggatcacagggatcatccttcttgtatcaactctcattgggattcgcctgcttatgaacatgccgcttaccagggacacactgctatattcatgtgtccagatggattaacttgtgctacctatgaaatttgacccgatggcattgcagtttccaacagacatgcttggtttttttcgttggaccctgatgtttacaactgggaggctgattgcggacttgctgatcacccaacgtagcataaacatactgttgctctgtggatccttattt

SEQ ID NO: 50464 - DNA, 456 bp, Triticum aestivum
  Clone ID: PAT_TA_50464
tcctcctctgctgcagaaatacattaccatggcccccgccgtgatggcttcctcggctaccaccgtcgcacccttacaggggctcaagtccacagccggtctccccgtcggccgccgctccagcggcagcctcgggagcgtcagcaatggcggaaggatcaggtgcatgcaggtgtggccaattgagggcatcaagaagttcgagaccctgtcttacttgccacccttatgcacggaggccctcctgaagcaggtcgactacctgatccgctcaaagtgggtgcagtgcctcgagttcagcaagggtggcttcgtcttccgtgagcacaacagctcccccgggtactatgacggccaatactggacaatgtggaagctgcctatgttcgggtgcactgaccccacacaggtgctcaacgaggtggaggaggtcaacaatgagtaccctgactccta

SEQ ID NO: 50465 - DNA, 437 bp, Triticum aestivum
  Clone ID: PAT_TA_50465
ggggcgcgggggccagcaagcaactacttcgttaaggctctactggcctgatatggcgtgctatcaccatggcactctcctcccccgtccttgccgggaagcatgccacgattgcctccttcaatgggtccggcgagggccgcattacgcatcgcaaggacggcggccaaggccaagcccgcctgttccagctaacaaggggttacgggcccggtatgcgatgatcaactatactgcgatcacgatgatacggatgatgtcgccgtatctaccttaccggcgggtactcccagaagataacagatgggacactgtttggctgatccaatgaccccgtacacgttgcctgaagaacaggtagctcgaggtgatccactgccagtgggccatgcttggcgctcttggatgactttttcacgggctactccctggcaacg

SEQ ID NO: 50466 - DNA, 136 bp, Triticum aestivum
  Clone ID: PAT_TA_50466
gttatagaatctggtctcccagcacaaaggatgttatgtgctgacgcgcctgaatcctgctgaacttgaaagaaatcgtggacaaatcgaccactctccgcctatttatatccaatcctacacttgttccttatca

SEQ ID NO: 50467 - DNA, 492 bp, Triticum aestivum
  Clone ID: PAT_TA_50467
ggcactggtcttcagcgcacacagccatgcaacatgccgcactgcagaccggcctgggtgcgcgctctttcctccacaccagcggcaaaggtcatgccactggaggaacaagggcctcttgttccacagggcctggttcttctaccttgccgactccaacacacggtgctgaatgagcctcaaacttactgttcccaatgttctgggggcgagggacacgttaagggctaccgtgttcccggatgaacgatacgtgttcatgcgtgagcgttgctttgatcctggaggagctcatacggaccacgctgaagcacgatgagtgagttatattcacttctgaatccagagcgctcctggagttgtactaccgcgcggtcatttacaagtgtgatgcaatcgccacgttgtcactactggtatgtgcatccgttgtaccatggccaaccattctgacttgcgatgatggagcaccttgtggatgcacttcacatc

SEQ ID NO: 50468 - DNA, 530 bp, Triticum aestivum
  Clone ID: PAT_TA_50468
tccgaagcatgtgacggggtaggagacgtgatgcaaataggtgacgcctgaactgcaaaggcccctgccctcataccgttctcaagtgcggcatggacaccggctggctccacccctgtgacgccacacagaatctccatggccatactgccggagcacatgcggctgatggtctaggatggtggcttcctcatgaagcctgagaccatcactcaaggcctcgacctaagatgccccatcgaggccatgcaaaccggtcggccttctggatatggctagcgccggggtaccactgaggctaagctacccaccaagatcctgtgtatgcagatgatgctcgttctgatgctccttgctggcaattaccgcgaggacaagaacatcgacaaacacatgtaccatgacatgtacctgaaggtcacagctaacatgttcaataacaagacggttctcatggagagtattcacaagttcaaggctgacaaggcaacagagaagaccctctctgatcagtgcgaggccactcgcgc

SEQ ID NO: 50469 - DNA, 418 bp, Triticum aestivum
  Clone ID: PAT_TA_50469
gtgggcagctccctccccgacggccacctcgcgtgggctctgactagaacgaccagatgcagcaggtctgcatccacatcattggccgccggcaaggaaggcgatcctctgtgggcatccccggacgccttcacccactacttggaaaagaatcatgtaccatgctgaattactcaggcctgaggagcgtaaactacaaggtgtaggatcagatcctgcttgatcagcgctgatgacccatttgctgtggaggcatgggcataagacatacccagatgacacgcatgcgaaggttcttgctgacggagcggctgactacacaagagcactagggcttgagctagaccttgctgagaatggattggacctcctatctaggcggactgctcttcttgctgactacctcttagtcaccgac

SEQ ID NO: 50470 - DNA, 386 bp, Triticum aestivum
  Clone ID: PAT_TA_50470
gtccgcataagcggattgaacaacctgccaccaggggcagcgcgtcaggttgatgggccttaaacccaccgttctgcagaggagtgcgctaagggatagacaggtcactcagcacggaccacatataagcgccatatgggcttgtgacaggtactgcattgatttgggatgcgattgacaatcaatctgttttagatcggtgctgaagataagaaagactgtgtaccggccatgattaccgacaatgactcgagagaactgctgcttagcaatgctacccttggctatgtgatatgcacatgcacataatatgataagtgcaatgtgcttactaagaaagacaaaaaaggcaaggcaatataggagatccaatcttacatgacgcg

SEQ ID NO: 50471 - DNA, 235 bp, Triticum aestivum
  Clone ID: PAT_TA_50471
ggcgcgccgggcggctgcgcgaacgctcgaccttcctggagcctgcacatcatggggagaagactgctatgagctatgggcctatcaagaacaagccataccccatgtcagggggcatgtcgaggagggcctgaccctaggatcaggatctatgatgtcaccttgaggaagaagggtgcggaagactgctctcactgagtccaccctgactgatgtgagaaggagaatgagcaca

SEQ ID NO: 50472 - DNA, 413 bp, Triticum aestivum
  Clone ID: PAT_TA_50472
acaagtcctacatcaccaacaacgaggtcgacatggtgatggtaccggatgcaactgtcctgatgggtattttgccacgccatgtttccacacattgaagagctaaagcctggcgatatctctgtacacgacggaaatgatgttacaaagtactttgtgagcactggctttacattcctccatgctaactccattactgatgttgagacctgtgtgacagatgcacccattgatcatattgaccaatgcttgctccagaaaggtattgctgaattcactgccaaactttgatcaacctgcactgacctagataaggcggaagctcaaatcggaacggatgttcacattgcgcttaatgctgccttgactggttgatgatgacatcttacatttttatgtccatttgattcgca

SEQ ID NO: 50473 - DNA, 302 bp, Triticum aestivum
  Clone ID: PAT_TA_50473
gaccattaacacccctgtgtgtggttcaaaactcaccgtgcgatgctggtccccctgttaccaagaataccgggggtcattacacctaggccatcaagcccgagtccgacactagggcttcagatcaagccctgcggctaaaagtttggctcccttagctccatcgaagcctccttattctccaatctaccttgcaacagtcttttatcctgatcacctgggcattacgatctgctccgagggccctgcatgaatggcttccccactagcgacttgttggacaagctgttggtcacaatgct

SEQ ID NO: 50474 - DNA, 605 bp, Triticum aestivum
  Clone ID: PAT_TA_50474
gccaccttccctcctccacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggcaccgggttgcgaggagtctggcagggccttaacttctaattgaaaacatggacttattattgaaaggtttttgtgaactttaatttt

SEQ ID NO: 50475 - DNA, 537 bp, Triticum aestivum
  Clone ID: PAT_TA_50475
gccccgccacttaaactctgtggttttgttgtctcacggacaccaagatctgcgcaactcatccaggagatgcagaaggaaggtgcattactgttcgctgtgcagaaggtgatgacagaacctggctcagtgatataggaccagaacatgcccgtggcaaccatgctgtggtttcagaggagcatacctggagctgtttcctctttaaggagcggcgcgcagcggtggtcactctaggggtagaaacaggctagcagtagacctgagagttctttagcttcagtgtgggctcattgtgccttgcaccttctatgtccgtctccgtttttctgctatagctagcccctgtcatgttgaggactgaactgtggtggtgtagtggtgttcgctctctgtatgatgtattaagagccgacttagctgagcttacttttctgttgtgcaagttgtacaagtttgagccaattttgctgattgtactgtaaaagcatctcctctgtacaatatgatgcgcaaattatcatcagttcatcggtt

SEQ ID NO: 50476 - DNA, 393 bp, Triticum aestivum
  Clone ID: PAT_TA_50476
gtgagttatatagataataggggatcctatggccatgcaggaatagtcaactgggggatctaccgcaatacttttaggggctaatattgacgggacaacggcctactagtcgacattccaagggcactggatgcagcagttgatagacagaaaaaaggaggagtgcattgcaggggatgaccaaaagggtcgtgaatgagtgggagagattatattaactgccacccatcagtacggaagccataatgaaacacgcgaaatactttaggcgttgcaaatgggatggctcgactatagtatatgaaaaagagcgtgcatgtggcatgagcacaactcatgactggggaactatgacaggcgttactgcacaaggtggaagcggtatatatgttg

SEQ ID NO: 50477 - DNA, 488 bp, Triticum aestivum
  Clone ID: PAT_TA_50477
gttagactacatgggtctttccatggtcctttgagaacgggtatcatgctaactccattgatggcacctgcgtatgcacagacccgcggaaccgatcgaatgctcttaagccatgattgactgatacttgaccgcatatcttttgatatagggcaagttacgtactcttcgtgcacactttgatcaagcgcttggcctttactacagtctggttatgacccattgccagacagggtaataccatcactactgaaacaagatccactgtacgatatttcacagggtactgaacatttgaataaaaaatgtgactttttgatttatataaggatgatatatattgctcattgatcggatggataaataaaaagacatgtttaaacagatagtggactgtatggattctgaacactacaaagaatgctctctatctaagcacatgatctgctgggatcgcaattaatattgatcttgctgatacatagcta

SEQ ID NO: 50478 - DNA, 472 bp, Triticum aestivum
  Clone ID: PAT_TA_50478
gcaacacacaacagctcatatccaaacacacctgtgctctccgaactccacccaacacgtagatgtgttgctgcggacgaagactgacgttgcggaaccgactgcaagtgcgacaacagatagcagcaggctgcaacatgtacccggaggccgatgacgccggcgccaccctatctcgtatacgccaccgccacacacaaggcaagctccatcggcatggagatggcggccgagaacggaagatgcatgctgcacccattgcaagagcggcaccagctgcggttgctcctgctgcatctgctagatcattgatcattgatcatgcatgcaccgagcgtgcagcatcacatcatcatcgatctactactaccataccatgtaaccgctacctgatcaatggccttatatatacacctgacctgcatcatcaagcacgtgccatgccatgcttgttgtaaacagcgacccccta

SEQ ID NO: 50479 - DNA, 581 bp, Triticum aestivum
  unsure (1)..(581): unsure at all n locations
  Clone ID: PAT_TA_50479
aggcataccgacactggtgagacgggggnagctcccgatggagtgcatcctccgttccacaaccaaacatcctgttcttcttcttaaactcttgaagacacacagttccagtcccttccaagggcaacgctggtgacagctgccggaacctctggagattccatggaagcgccaaacacgaaccgcctcctgaccaagtgccgggtgaaaggacgcactgttcgtgtcgatctccacgcgtgacaacctgctctcgcaccatactagccggcacatgcacctgcgtggctaggcacgggtgggtatgtacccgaggcaacagactctgtgaagatcacctgctaccactggcattgcctctaagagggtacactgcaagaacctgagatcaagctagggcttatacgtgatcgactaccggccgatctgggtagcggctctacattcactgcctcctgtcatgccgagacagacggatgctgggttccggaaccctcagccatcccgtaaccgtgactattaacgacatggcagccgcctgggtgagcccaggatcatgaggtagcctactcatgggcgct

SEQ ID NO: 50480 - DNA, 588 bp, Triticum aestivum
  Clone ID: PAT_TA_50480
ggaaagacacctggtaagtgtccgtgctctgcaagaccagcgggcgggggaagacccaagagcgacgctccgccctgctccgaccaatgctgcgcccggtgaaccggaggcacactcaccaccgactacgcctcacctaactggtcctccgtgggggcgcgccggctacacggggtcataatgctacctggccccgagaactactctgtgaccaaatgatcgaagaccttttttgttgggtgaaatatgaaccaaagatatctgctgtccttgagaaccatgactggacgaagaccatataactgacctgacctcacaagtctgctatgagattaaaggaagactgtatatgaaaaccttgggcgaaacggctaggagactcaagatagattacactcacatgaagaaagttggccatgataatcaggacgcggtacctaatgactgtgcgaagtggagagaagacccgactagggctagcgggtggtgccttgcattaaatcttattcaaaagatcctctgtctctgacatggcaatagataattaaaggtcttttggtgttgtgaacaaagttgaacgatgatggc

SEQ ID NO: 50481 - DNA, 445 bp, Triticum aestivum
  Clone ID: PAT_TA_50481
gccactctagcggagagccatttccccccggtctagccgcctgtgacagccgggcgaaaggataacaccaagacaacaggtacttccatctcgaacgattaatagcaaaggaagcatagaccattgaattctgatagagcaatagggtgactcgctttcacaacctatagagcacatgctaccaattctgctcgctgctaaccgaccctaacccggacaaccctgtcgtcccccagatcgcccacatgtacaagacagatcagcccaaggtgatacgacagtccctagctggcacgcacaagtatgccatgggatgatccgaaccccatgctcgtatccactgctagcatgcagaatattgtgtcactgtcaagataaactatctatgggccattattatgtttgattacttggacgacatgtgcgactacctgatccatgtcgg

SEQ ID NO: 50482 - DNA, 590 bp, Triticum aestivum
  unsure (1)..(590): unsure at all n locations
  Clone ID: PAT_TA_50482
ggcaggnacgggtggagctcgcttggagggattgtgctctgcatcacaggtgctgaagcaatgtttgcagaccttgggcatttttcaaagctttcactgaggcttgggttcacgatagtggtgtatccttgcttagttctggcgtacatgggggaggccgcctatctgtccaaacatagggaggatctccagagcagcttttacaaagctcttccagaccgtgtgttctggcctgttctgttcatcgcgacgctggccaccgccgtcgggagccaagcgatcatctccgccacgttctccatcataagccagtgccgggccctgggctgcttcccgcgcatcaaggtggtgcacacgtccagccatgtccatggccagatctacatcccggaggtgaactggacgctcatgtccctctgcctcgccgtcaccatcggcttccgtgacaccgagatgatcggcaacgcctacgggctggctgtgatcttggtgatgttcgcgacgacgtgcctaatgttcctggtgatcaccacggtgtggaaccggtcggtgctgtgggcggcgctcttcgccgccggcttcgggtccat

SEQ ID NO: 50483 - DNA, 485 bp, Triticum aestivum
  Clone ID: PAT_TA_50483
acgcatcaacacgtcaatccttcagacgagttcttcgccgttccatacttctgctcctgctgctccggcgagtttgatctactgatggccgccgctgctcccacccaggctccggccatgaccctgccggccgccatggccgccaaggtggcgccctccccgaagcccgcccccgccggcgaccgcaaggtggtgccggtgatgaccgacgccgacgaggtcgtcgtccaggtccaggtccaggccgagctgcacgtgctcgccgtcgacgacagcgtcgtcgaccgcgccgtcatcgccaagatcctccgcagctccaaatacagagtgactaccgtggactctgcgacgagggcgctggagctgctgggcctggggctcatcacggacgtgaacatgatcatcaccgactactggatgcccggcatgaccgggtacgagctgctgaagcgcgtcaaggagtcgtcggagctccgggagatccc

SEQ ID NO: 50484 - DNA, 257 bp, Triticum aestivum
  unsure (1)..(257): unsure at all n locations
  Clone ID: PAT_TA_50484
gntttcttttctgattttgggtctgtgattcgatcgtgccgtgccagatggcgtcggccggcacagattgtactgtacatacgaaaaagcctaattgtagaagtagaagtagcagcaaagcaataggattaggatatatgtagtgttcgttgattcaccgctttctgtcccagcattgtactgttcttgcatcactgcagaatactggaggaatccaacatcagctgaaattaagagaagtgatactgttctagctc

SEQ ID NO: 50485 - DNA, 225 bp, Triticum aestivum
  unsure (1)..(225): unsure at all n locations
  Clone ID: PAT_TA_50485
cggncgcgtgggtgttcgggaaaaaaaaacacataagcttattacgcagaccacaccggttcactatgtaaacaaacaaagttccacccacccaaactatatcgatcctacacccaacaaagtaatatagttcactgtgacatcaatgcagaacatgacccaaggaaggccaagataaacgagtgcgcacagcctcgcttgcagaattgaaacatccctccttgg

SEQ ID NO: 50486 - DNA, 526 bp, Triticum aestivum
  Clone ID: PAT_TA_50486
gcgtcggcgggggcgcctgcagccgcaagaaagaggagaagctccagccgtggcgcacgtcaacttctaccgcaactatggtcaagacattccaagaaaccaagcgtgcttatcagaaggagcgtcttgatgcacaactaacgctggtcagacaatctggactgctgtgcaagcgtgagctctggagggttcaatatgcactgcgcatgattcgtaatgctgcaagacactggctcacactggaatgacgaaaaatccccgccgtatcttagagggcccggcccttctccgttacatgaaccggtatggtctccttgcttagggcgctaataagcttgattacatacttgccctgactgctctgaacttccttgcgcggggccttcatactcttgtcttcaaagctggcatggccaacttcatccgccatgcccttgtgttggtcaggcaacgccacatcaccgttgggaagcagatcaaaaatcccccatcggttatggagagggatgaatctgcacagctcatc

SEQ ID NO: 50487 - DNA, 609 bp, Triticum aestivum
  unsure (1)..(609): unsure at all n locations
  Clone ID: PAT_TA_50487
ggtagaacatcaagcaggcaagagagcacagagccaagcttgtgatgccgcaataccatggtgttcatgaccggcctgtcgcagggcgtgcgtctgccacgcccggccgacaggcgcgccatcaggttcatcgtgagggcgtcctttgaggatgctgcacgccgtcggtcgccgcgcggtgcttgaccttttggccagagcaagtcagtagggagcgctttcgcttaggtgggtgcacgaccggctcacgatctcgagacatcgaagagtatggacaccgcactgcacgaacgaatcatgaggaaggagctctacacggatcgaatcaccttancggacatgagttatggacgactctctcacactaaaacgacagagagagagcgatgtatgcactgcagaatgctgcacgaaggccaggcattttcttctgaaattcattctgagcggcaggtggtcatgaaagccaaacttgaggatgagaatggtgaggatgacggtgttgaatgggaagaggagcaacctgcagggaatacattgggagagccatataagtttgtggacttgaatgctgaggccccagaatccgccgacgacgaggaagatgag

SEQ ID NO: 50488 - DNA, 412 bp, Triticum aestivum
  Clone ID: PAT_TA_50488
acgcgtccgtagcatagctatcatacctacatagtacacccatggtgccaaagcgttatggcctacttaggccacctacaagactctctttgcactggcttatagttcaccgtctgtctaccgactagacaggcgtccaacagggctaacctctgacgcgcgcggggggggggccaggtattatgtacgtgcatgtgctgaccatggggggcgtgaagcagtgcatgtaccctttctttcttgtccaaggtcaggtcttacggcctcgttccgggcggcggcacacctgcacctgtggagttgggttcgtgcgctccatctgttaagagaggcgcaagcgtcctaggacgcgctgcacgcgatcagaactctggtgtgggacacttgggcggtgcggtctgctggatccatg

SEQ ID NO: 50489 - DNA, 326 bp, Triticum aestivum
  Clone ID: PAT_TA_50489
ctaaacaatactgtggtgcgagtgctccatgacagttgctcgatccagctactgcatgaaacatgcaagatcaacgccacgctagtgtgaccttttgtgtgagcacatagccatgaacctactgatgctgtgtatagaaaaagcgcctgggcgcctcataccatcacaacaggtgatagatcttgggcacacaaacgttgatgtacattacatgactaatatatgatataacctgaaactcttttgttgcaacatatgccctattttgggcatgagtactataaaaccatagagaactagatcaaacatgcaagacattgaaagat

SEQ ID NO: 50490 - DNA, 430 bp, Triticum aestivum
  Clone ID: PAT_TA_50490
ggcacaccaaacacaacactactacgctcagtgcacaaccacgcgtaggcagagctacaggcgagcactatagatgtcggtggcgtaccatcctcggcggccgctcgctgctgatcagcacgctggggagtcatgttcctccacgccgcccagcctgctggccgctacaaagcggcacatgcctcacctgatgatatgtcgctgtgccagacacaaagctggtttggctaccacaaggcggattgtgcatgtgtagtactatggattgctgcaacaactgctgttgttaatatcctgccggggtttgctaccgcacgcggagagaggaatgaactgcacgtatgtgtgcattgaaatactagctcatcacgcatctgagtaacaataaatagagatctgcgatcggtccctagctcgatgctaatgatca

SEQ ID NO: 50491 - DNA, 461 bp, Triticum aestivum
  Clone ID: PAT_TA_50491
cttgagaggcgcaaaccatggcgtccatgaccggcctgtcgcaggcgtgcgtctcccaggcccgaccggcaggcgcgccagcaggttcaccgtgagggcgtcgtcggcggaggcggaggccgccggccgccgcgcggtccttggtctcatggccagcggagtcgtcggcagcgcgttcgctcaggtggtgcacgccggcaccgtcgcggccatcaaggttggcccaccgccgccgctctccggtggactccccggcacggacaactccgacgaggcaagggacttcgacctgcccctgaagaaccggttctacctgcagccgctgccaccggcggaggcggcggtccgggccaaggtagtcggcccaggacatcctcaacctcaagccgctcatcgacaagaagcaatggccgtacgtcatgaacgacctccgcctcgaggcctcctacctacgctatgac

SEQ ID NO: 50492 - DNA, 576 bp, Triticum aestivum
  Clone ID: PAT_TA_50492
ctgacgattgctgtgagcacactgcgttgtaaccatttgtttttacagataggcgagcggagggggatgggcatcacctgtcaggtgaactgattttttgctgcaactgtcttaattttatgctatgacccatgattattttgttgagaccagcaaatcgagggcgaggtacggggccagctcaagacagcgtgctgagaccatctccaccagagtcctacatggtccagcaagcacggtctcccaagatgcggtggcaagcgtcgattgccggtgaacacgatgccgagaactagcgtgggggcagccacagatgcgtctgcgacagccccttctccgtgagcatgataccgaagactagcgctgacggcccaaagattcatctgccagagcctgtttccagcgagcatgaggccgacgactagcgcgaccagctcaagtggaaggcgagcgcggcgctgtggaaagttgcactagactgttaaatacagggcgagatgcctcaggaggaagatgatgtctggcgcgaatcgttttttttctatatatccaacggggcatctggcggctagggtg

SEQ ID NO: 50493 - DNA, 451 bp, Triticum aestivum
  unsure (1)..(451): unsure at all n locations
  Clone ID: PAT_TA_50493
agggaaaatggccaacaactcagcctaacactccaacaccagtatctcacaaggaacatggactctgtttacaccaccgctttaaatgacatgaacctcgcacgcggaacaagaaacacaaaaacccgggccggactctttgacagagggagcaaacgccgaacgtccacagccccagggccgccagcgccgcaggagcggagccaattttgccggatagcgcccctaagaggctcatcagggaattgtacgcgcccccgctaaaataagcaaacaggtcggggaacaagatcccgcctaacaccgcgaaccattcccacccggacaccaggagggcctacatgccctccccggggtcctaggcccccgccagccccacccccctgcctagcacgaagaccttgggctccggggccgggcacgcctgggccttntcgaacgccgacacgcc

SEQ ID NO: 50494 - DNA, 522 bp, Triticum aestivum
  Clone ID: PAT_TA_50494
agttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgagggcaggcacccacttggaacggatcaggtagtcg

SEQ ID NO: 50495 - DNA, 533 bp, Triticum aestivum
  Clone ID: PAT_TA_50495
agatggaaccaaaaatttcattcacctccacacaagagatagtacaagacaagatgcgtcgcaccctttttttcttttcctccaaagaacacaaaactgtacaatagcgagttctatccaataaattcaaacgcctctgctttttcccgccagcttcctctgtctgttccccatcccaaccgcatcagatcgcacctgcctgcacggctggaacccatcgccatcagcagctcatcgcctcgcatttcaccgggagggagcggtcgaacccgctgcgggacagcagcgtgcccaccaccgccaggtcgcggcagaacaccccttggtacaccggcgccgtcgcctgggacgacaccgttgcaacggtcgcgccagccttcgccttcggtttcgccgtcgtcctcgcggtggagctgttaacggcgggaggattctccggtatcggcgccgcgtgttgttgctgcttgggcaacgccgcggcctctttcgccctctgcctagcggcggcctcctcgtcgatcacgggcgacatg

SEQ ID NO: 50496 - DNA, 452 bp, Triticum aestivum
  unsure (1)..(452): unsure at all n locations
  Clone ID: PAT_TA_50496
ataaaacaaacaggggggaaaccgagattgccctttcatggatcacagggctgggtcaacggaattacccccacgacggggaaaagctggacaacaaccaggacttgaaaacttatttgggtttgcgggcacaaatgggtgccccaccaggaaaacaatagcgattgcggttttggggcccgggatcaaacaaatgcggggggagccccccccaacagcggcttcaccttggggatgtagtcaaccatggccccccccttggatttggcttcgacggccttccaagcatcccatttggccttgccggccatataaaaaaggcccccagggcgggcggggttgacggggcccacgggggcccgcttgtaaaggccgnaaaggcaaaactggccccccttgggggggggggcgggcagcgnctgggccctcccagggggccccccaaacccccc

SEQ ID NO: 50497 - DNA, 537 bp, Triticum aestivum
  unsure (1)..(537): unsure at all n locations
  Clone ID: PAT_TA_50497
caacatgtcaacaatggactgttatatctgcttcttttttcacaatgactttggattgactgatgaataaaaacataaaaattacagagggagaacaaagctattctggactcaaatcactcatgcaaatacatgccaacagcagccaagctcgagctcattcgactgctgattatcactaccacgttattccgttgccatggcagcctcctccgacatacgaaagtaagctgcctgccctccctccgcaactgctcagactagatttctccatcccagatctcttcttcggacttgaacacgccttccgggtgcgtccagaatttcccgcggatcagcctcgtttgttcgatttcagagaagccggcgaacaggtcgctcggaatggaccagtcgaagacgtcgaagttggccctgatcctctcctcgtgggtgctcttggggagcacgctgngccccgcctggatcccccaccgcagcgccacctgcgccggcgttttccccagcttctccggccgcgacaccaccaccgggtgc

SEQ ID NO: 50498 - DNA, 551 bp, Triticum aestivum
  Clone ID: PAT_TA_50498
gccagagttcttggtgtcgcactggtgggtaactgagagccatattgtgaggtatccgaatatttctaggtggggggtgagcttgtggggtagatactgtgcttggtgacatccaatgcgttgggatagcccagatgttgactcatgagaacgccctgattgtggttgcacgtcgtgataacactgacgaaacaggcgcacccatgcctgtccatcatacccacgacatgatttgttcctggggtggatacaccctcataggcctatgctgatatccttcttcccctactgctccttgcttttgccctaacgtatgataggcctgtcctgaagaccttacaagctggttactttctgtggtacatggtgcgtacggctctggtcttatgataacctatcctcacttgaatcttatggatggtcacggccaacctggtcttctttacattgtgcccttcactctcggaactttcatataactcggtaaaaagctgcgcgagctagaggaacctattggatgaaaggacagcctcacgatagtctgcacgcac

SEQ ID NO: 50499 - DNA, 474 bp, Triticum aestivum
  Clone ID: PAT_TA_50499
gccacgcatccggctatgacagctcactatgtggcccacccaaccacgaactttggactgagcacttgggattatacatgggaagatggcgttggatctgcaattgcaggcgacggcgccacctacttcaacaaaacctttgatgccgaaaaagtagaggttaagctaatagtaaaacccatacaacctatgggtctactgcaggatttggaacatgaatagcacgctactcgaagcaaatgtaaaattggaagaaattgcacatgagatagcacatctacttgatgggcttgcttctggcattcctttacgagatcgccgaccagattgcagcttaacaagctatccaactacttatgctgattatgatgacgaaaaccatcactttagctaacgctcaagctcatgtccaacggtgccaacttttgagccaatgtgggacatgaggcatctcaaaaactatatgggtgacta

SEQ ID NO: 50500 - DNA, 386 bp, Triticum aestivum
  Clone ID: PAT_TA_50500
agtattcatacacatatctcccccttctttttttttgtcctgacaaaacattggggcgcaggtcaccggaggtaatgcgccgtggagcagctggcgactcaagcggcacgcaagtttgccccggtcaccgttggagtgaagaacttccaccggtgtccgcccggtgaacacgatggcgacttcggtgagatccgcaatgtaccagcatcatcacggttctgctcttccgctagctcctcttccagcgcctgatccgtgagatcctgcaagacttgaagaccgaccttcgtttgcagtggtatatcggcttcaccttgcatgaagcacgtgatgtgtacctgtagtgtgcttttctatgacaccaacctgtgctctctccacaccaa

SEQ ID NO: 50501 - DNA, 459 bp, Triticum aestivum
  Clone ID: PAT_TA_50501
agccgaaagaggctcttcttcctcctctgcttctgtcctgcatcttggtgctggctctcccaggccggcggtggtgatggtagggggcgtcacgttccacgtaaccaacaagtgcccgtttcccggtgtggccggcggtcgcgcccaacgccggccaccccgtactcgccgcaggcggcttcttccttcctccggggcagtcggagcgcgtcggggctccggccacctggaacggccgcttctggggccgcaccggctgcaccttcgcgggcaacgccgcccgctgcctcaccggcgactgcgatggccgcctcgcctgcaacgggtccgtcggcacccctcccgccaccctcgtcgaggtgagcctgcccgaggaccagagcatggggagctcctacgacgtgagcgtggtggacgggtacaacccttccgtggccgtgtggtcctggccggcgaacc

SEQ ID NO: 50502 - DNA, 591 bp, Triticum aestivum
  Clone ID: PAT_TA_50502
acagctcgacaagaaatgccacccatgcaagacaagcatagctctcaggagctgctccaggctcaagttaacctttggcaccatgcactgggatttgtcaagtccatggcactcaaatgtgcaatggaactgcaaatccctaacaccatccaacaccatggtgggcttatgaccccgtcagagttggccacaaagatcggcctccatctgtctaagcttccccgcttacggcgactcatgcgtgtgctcaccatatcaggcatctttgctgttcatgaggcagcctcgccaagcaaggaggttgtttacgggcttaccccaaccacacgcctactcgttggtggtgaagttaaatcaaacttatttcctattctgtctttgatgcttgattcaactgtcattgcccccttttttggcatgcactcatggttcctagatgagcattccgcgtccctgttcaaaaaggctcacagccttaacttttgggagatggctgagcaggatgatgcttacaaccagatactcaataatgcaatggtttcggttagtaactttctcacggacatcatcttaagggagtgtggtgatgta

SEQ ID NO: 50503 - DNA, 604 bp, Triticum aestivum
  unsure (1)..(604): unsure at all n locations
  Clone ID: PAT_TA_50503
gtccggnnaattcccggggctttgnaagtctcacacctatgtacacgttcttcgattccggtctgctgtatatttagttcgctgcagtccaaggattgttgctgtagcacttgcagcacaaatctactgctttgatgctgttactcttgagaacaagctcagcgtcttgtcatatcctctgcaaggtgcacctggggtaaatattgggtatggcccgatggctgttggccccagatggttagcctatgccacaaatactcctttattgtcaaacacaggccgtctaagtccacagaacctcacaccttcaccaggagtgagcccatctacttctcctagcagtggcagtttagttgctagatatgcaatggagtccagcaagcaattagcttctggtattattgacatgggatataaaacattttcaaagtaccgccaggaacttctaccagatggttctaactcccctttgtcatcaagcccaggcaggagatctggtaaaattccttccagtgtgcatccactggaagctgacaatgcaggaatggtagtcatcaaggatttcacttccaaagctgtggtctcacagtttagggctcacaca

SEQ ID NO: 50504 - DNA, 458 bp, Triticum aestivum
  Clone ID: PAT_TA_50504
gtgataactgacccgccctggctggcaaaaccggtccgccacatgaagaccgtccccgaggcccgaccgtcaggaggcgctgctggattccccctgggcagctgagatgacggcgaggacgctcgccaaccaccccatcttgctctgagggcgagtcagactgctcgaaacccgtctccagaggagtcccacgcccgcacccagccagccataaaggtctggaccaccacctctgctttgaccaggtctccacggaacggacaagttccataaggcaagggactccgacctgcccctgaagaaccatttctacctgtagacactgccaccgagagaggcggcggtactggccaacgagtgggaccaagacatcctcaacctcaagccggtcatctacaagaagcaatgtccgaacttcatgaacgacctccgcctcagggccttctacctacgctatg

SEQ ID NO: 50505 - DNA, 519 bp, Triticum aestivum
  unsure (1)..(519): unsure at all n locations
  Clone ID: PAT_TA_50505
ggccgcncnnctttttttttttatttttttttttttttttttttttttttttttttttgaagcacaaattcaaccgattccccttccagcactaataccacttgtagttccagataaccagggtcgacaagcactgaagtaacagaaccagctacaggcgctactagatagatagatagatagatacaagcaatgcagatgcaatctaggaggaggggaacttggtgacggccttggtgccctcggagacggcgtgcttggcgagctccccggggaggacaaggcggacggaggtctggatctcccgggaggggatggggggcttcttgttgtagcgggcgagcttggcggcctcggcggcgagcttttcgaaaatgtcgttgatgaaggagttcatgatggacatggccttggaggagatgccgatgtcggggggcacctgcttcagcaccttgaagatgtaaatcttgtacgtctccacgctctttttcgccttgctgcccttcttccggcccctcg

SEQ ID NO: 50506 - DNA, 517 bp, Triticum aestivum
  Clone ID: PAT_TA_50506
agttccgaaagagcactaggcatacaaaaactgaaggtagcaaagtattctatcattgtcaccgtttgatacgttcatttgttgccaaaagttcttcaaacaatgtcacaagggggccaactacaaaataagccatgcaacactttccccttgcgagttaaaagggttgatatcacttttaatgttcatctgttcccgggaattcactgtggtgggagctcatatcaacatttgaatgtacttgtacatgctgatagcttcaaagatcatatgaactgccacttttgcctgctaatgcaatacctctcccctttggagctcgtcaattgtacaccgcttgattcgggctctgttttttctttcttttcagacccacggtctgcttcttctttcttttgagaaacggtctcattttcttcctcctttacagattcagtcgtatttcctcccctcttccctgaataattctcggtctcttccctctcctcaaatgcagcctgagcatcttccttctccg

SEQ ID NO: 50507 - DNA, 591 bp, Triticum aestivum
  unsure (1)..(591): unsure at all n locations
  Clone ID: PAT_TA_50507
tctttttcttaagaaactaccccnattttttttattttaatagtatagaaaaagcccatctcaggggtcnntaaacgccagnacnnacaaaagnacnncttctncnaacggtctgnaggnagccgtgnataagnaaaacaacaacactcacatctccttattaaacaaaatgtctagccagcatgactgggacacacccgcaaaaaaaaaaaggcatgactgggacacgtccaggaacaacacaactaatggacagtgagagatctcgagtcatctatcaaccgcacaacatatacaacagtcaggagagcaacttggcacgggtggctggatcttccttgtcttccaccaaaatcatgaaaacataaccgaggcaccacaacacaatatactggaagggaacccagcacagcagcgccacgaggctcaggatgctccccacatactgcgggtccttgatgtagccaaaggggaactccgtcacccacgggatcttcttcccgaaccggacgccatagtaggtacccgactcgcccagcagctggtacaccttgaagttgaagtactggcccaaggccaagatggggaggg

SEQ ID NO: 50508 - DNA, 542 bp, Triticum aestivum
  Clone ID: PAT_TA_50508
agctgttctactgtagaagaccctatcgctgtccaggaccgaaaataccatggccgtgctcaacctgcgatacatggggacagggatgacatataccagctcggacgacattcttcttgatagtgatcacaggcaaaccaactgagtcgcgaagcgagttggaacccctgagagctcaactgagcggggccctggctgaagacccgcacatgctgaaagacatggccgacccgacaatccgcggcacatttgcggtggagctccctcagcaaggtgactgaggtggccctcaactgcacggctggtgaccccagcgaccggccttccgtggaccacgtgctgtggaacctgcagtactccatgcatgtgcaggaccgctgggcgatcaacgagagcttgagcttgagcgtgaaatcgcaggcgtggtgagtgcgatgctcttttgtagccgggcacctttatggctggccttttgctgtgcaaggagaagcaatgttacttattccccgtttatagaagcgtgctacttccggaactgggga

SEQ ID NO: 50509 - DNA, 274 bp, Triticum aestivum
  Clone ID: PAT_TA_50509
gtgactgatttcgactttagccaggagaagttccgaaactcgccgcggcttctctctctccaactgcgtccgggagatggtgcgccatctttgcatattccttcgggatcataaccaatagcttggagcgctcgatgctccagtgctcctgtgcggtaccagaataaaaaagcaggagttatttcttgtggcagctaaagaaggttcaccttgtatcaaagcataacaacaaatatgtcagatcattactccggccgacactggtcatctgttc

SEQ ID NO: 50510 - DNA, 528 bp, Triticum aestivum
  Clone ID: PAT_TA_50510
gtctagatctagatcgcaagcgccgccctttgtgttttttttttttttacacacatggctctagggttctctgtttgaccggctacatgtgaaaatagtatcattgggagtgctactcattagatgtagctgctatgcaaacatggttcagatactgggatcaattgaaccctagagccgtaccgacatcccaacaaaaaccatctgtttttcttgaagccaatacacactatttccccgacgatactgaaacccaccctaactactatcttaccttcactttgcatacgatgctatgaaagcctgcctggaactggttgatacgacactatgctccagacattaaagctatcggtaatgctttgaatatacgcttcacgtatttaaatcccttcttgcttatcttgagctgcctcctgatttgatggacctgcacatctacgtccggaagaactatctatgatacctagttatccaaaaactgacaagagcatgtctaccgtgatctactctttactagatgctttt

SEQ ID NO: 50511 - DNA, 551 bp, Triticum aestivum
  Clone ID: PAT_TA_50511
acaaggcctatatcctcaccccatcatagcctccaacactaccgtctgccataacgtaactgccgccgcgcttcctgctccctgataggcgctcgccttctgcgaatgtatctagctcaatgacaagtgtgtcaggactcgtgccgctagtcacagacggtctgcgtcggaccatgcctaaggcctgggcacattgtcctgtgacttgcggctgtaatcggggctggtgaaccgagcactcattaccggtacctctggttctgcatcctgggatcccttttatgggcccatgatcatacctgggtgatgcgcttcttaagaggaagataagacatgcattggctgtatatactctaaaactaccatctggggacaaaaaaacagccgccatcttgattatgaccactgcacgcaacctatcgcgtgtctcaactgtgatcaggatctactgccatcacatgtagacgctttagacgcaacctagagacttgcatgactcctggctatataataatagcttgatccgtgtcatctggatatcatctatactg

SEQ ID NO: 50512 - DNA, 552 bp, Triticum aestivum
  Clone ID: PAT_TA_50512
aaggctgggagcaccgggctgtgctgagcgagcaacacctacatgaagcggtcgtggcctgatatgacgaaaacaacacacaagtgaaggagtcaaacccgctgcaactgccaaccttagtctatctaatgctcatgctcagatagtactccctctgaaaactctcatgggactcttgactatagaggatccaaacactcgcttaaaacctgacaaatggagctcttacacctgtgcggtcctggaccataaagctcacaccccaataactactccgacagtcaccaacaggcctgaaccatttgaatcagacgtggtgatgggcatgggcggctacagcgcgtccctgtagaccaccctgccttacgtgcacctgatttacaacccatacgcctagactggggagacctacacggacacattgctcacggggttcccccggggcttcgtcataaaagcgctggacgacctacagttagtccgcccaatcccaatatcgccttcaagctcctgcactgtagccacatagacggcccgttcaagggccaccct

SEQ ID NO: 50513 - DNA, 541 bp, Triticum aestivum
  Clone ID: PAT_TA_50513
tcattttttttgtagctcatcttggttgttcactatcgaatcttggcgtgcttcagcaatatcaaacgaactgctctgaagtctgtgacataaccgtgcgtgcgtacgttgtgcacaaatcggtcaggatcggccactaacgacctctggatcgacaccattaccttattttcatatgctacggctaaaatcctgtcgatgcaaccagccgatctctgatataacccgtcgatgctgcgcaggatagcagcgaccgctgctggaggaactgaacgtacccgggggttgggaatgacacagttagcttacatatttgctggcgcacagcggatggcacctgaacatggtttcactcgctatgacggataccttaggggcctagatggggaaggacatgacgatcctctgtgtgaagaggttgcaaagagctactcctctctatgcccaagtgagtggactgtgcgctgagaaccagcaacgggagaatggcacattccctgaacctctgtaagctgcacaggcgctggaaggacaaacatac

SEQ ID NO: 50514 - DNA, 581 bp, Triticum aestivum
  unsure (1)..(581): unsure at all n locations
  Clone ID: PAT_TA_50514
gnaattagttgtagggccaaanaagatgttgttaagcccaagcagcgagcaaaaggtagtagctgaattgaaaatcgagctggaggcgcaagggttacctacagatggaactagacaagtactttaccagcgagttcaaaaggccaggcgaattaatcgctcacgtggtataccactttgggttcctcctgtggaagatgacgaagtggtcgacgaagagttagatgaaatgatctcacgaatcaagctagaagatggaaatacagagttctggaaacggcgttttctgggagaaactcgaaaccatctttgtgaagaagatagcaaagaagacccagattttgatgacgagttagatgaggacgacgacgatgatgatgacgatgattccgccaaagaagcagatgaagatgagatagatgatgaggtcattgaccgaacggaaaatcaagctggtgatgacgagaccaaggacaaaccagcgaaaggacccaatcagcatcttcaaatgataggagtccagttattgaaggatctagagaagacatctggttcaacaaagaaattaaaaaaaatacctg

SEQ ID NO: 50515 - DNA, 472 bp, Triticum aestivum
  Clone ID: PAT_TA_50515
cggccgcatggggaatgacgcgtgtgtgcagtaccggggatgcaagcactagcataaccacactcgaggatcgaccggactgggatggacaacgacgcagcgacagcgggcgcgagggccggtgggggcggatgacgtctatcgggggcgccggcgcgcgacagcgagcagaggcagcacctgccccctgccgtcgcggctgctgagtacggagctggagcggtgcgcggaagacggagtactgcacagcaaccgctagacggccaaggtgattcaccttgtgctgtgggggcccataatacatgagatctggcaggatgaccgccagacggcttacaacgtgcccgaggtcggtggcacgaccgaccggactgcacactagttgttggatgctccttgaattggccgcggacattgttcaccgctaacgatgaaaatggccaggttgctgctgatgatcacaaagtttagt

SEQ ID NO: 50516 - DNA, 564 bp, Triticum aestivum
  Clone ID: PAT_TA_50516
gcgttcgcgcacaccaccctcctcacccctaacagaaacctctacaggcctgtagcttgcttccctggccgccacccaccaggaaacggagatgtctggctgcggctgcaactgcgggtgcagcacctgatgcacgagcaggaaccgatgcagacccttgcaagatcgcttcctccacgtgtaggccactagccggcgccggcgccatggtcatgcaccaccgactcccacaaggggagctacgggcgcttctagacggacgaccagacctgcggctgcgcacctgcaccaactgcaagtgcggtaccgcatgccgctgttgctgctacaccctcaactgagccggcgcccatgaagccgggcgctacatgcaagcacgaagatgacgaggacaagcaagcaagcaccaaaaccaccaatgaaccaccacctaatgtatcatgaccagacggccaatgcactaactggcactcgcactgaataaaataaaaccacctgttcgagagccaaagctctgaatgcccctgacaactgtgtacaaccaatactggccttactagagcc

SEQ ID NO: 50517 - DNA, 585 bp, Triticum aestivum
  Clone ID: PAT_TA_50517
gtgtgatatggacattcagccaatcttgaagcgatagggaacatgacactcaaaaactgcatcaataatacacaaatacaaggaaacttgctcagatatgatggatgttgccaattcatcttgctctggagatggcggccaatccatcactcaaaggaagggattgagggaggcactcctacgacacaattcatgcgaggagcttgatgagatctgccgtgggggcaattggatattcccaagatacacagtagtaccttcagtatcagatggaatgttccacgccagtgtacgtttgacatgccccgagtttgagatgagcatcactggtggccctcgtctgaccgcacacgaggcaaggtgctcaacagctgccaatatgatactggagcttcacaagaaggcggacgaggaagaacagtacggtacctggtgcaaaatcacaactcctaaatcgcggtactgcaggtggctggaacgagttgttatttagtccttacaactttgaaccaaacttcgtgtggaacataatcacgttggtaccttgcctagctattttacctacggaaggttgactccttgtgt

SEQ ID NO: 50518 - DNA, 485 bp, Triticum aestivum
  Clone ID: PAT_TA_50518
aaaaagctgacagcgacataatgtgtaaccatttacattactaaaaagacatcccaaggatggttagcacggactcattgcacatatactgaagtctgaacgcaagccatataacaatacgcaaataccaacctacacacacataatataggaaatgtttacatagcacattacacaggagagctcgaattgaactggttaaacaaacaagctgaaacccaagtcatcattgatatattccttggcctccacctttatctatgctctcttctgtctaccggcagcacgaccaccagaaggcgatgaagcagacgcactgaatgtgagcaccacctgcaccagaccctaacgaaaggataagggcatggacactccttttttacctgatctagctgaatagcccggtccatgaggcctgaaccttgattcctgcggccttcaccactcggccaatcttctccgaagcggacccctgggtcgccccg

SEQ ID NO: 50519 - DNA, 480 bp, Triticum aestivum
  Clone ID: PAT_TA_50519
ggacaaaaaactatgctgtttcttgggaaatttctgagggccaaacatgccaagtagggcagtacacactaacaagaatgtgctaggaaaaggaaagcacattttgtttcctctattgaaactggctgtcatctttagatacatcgtacaacacacggggactagaccgaacttgacacggacgggggatcaaagcaacccaaaagcgtaagctgagctttcctccatcggcacatgcagcaactcccttgtcgccatcaaaatttcatgaggcaagctcaggcctatcaatggtatggagctgagtgatttccgtgtaataaatcaaatcgccaaatcacggctgcagagggctcccgagttcaaactcaaaacaaaactgctactcggctgggggttggagtgcaaatttcccgttcccgatttgtttggctgcaagaaccctgtccagggtctcatccaggaccttaattccatttg

SEQ ID NO: 50520 - DNA, 192 bp, Triticum aestivum
  Clone ID: PAT_TA_50520
ccgggtaactccaaagctttattttgcgtttataaccataagctgaaaaggatggtttataccctccaaaaacaaaaacgcgggggcgcccggccacggaaaatatgccctaaataagcaggaaaacatcaaacacccaaattaaagttaaaaaaccattgtccgaaaaaaaacacagcctattttgtaatc

SEQ ID NO: 50521 - DNA, 563 bp, Triticum aestivum
  Clone ID: PAT_TA_50521
gtcctagcgcgcgattggaggctcgaggcgcggcatgctcggctgcctcggagctctgttcagcgtccaccgggatcggacccacgcacgggacgtgcgcattctaataccgaactgcagcctgttgaatccgacgccgcatctggcatccatgattatacaacatttcaagatgcgcgaggacgtgaagtcattcaacctgagcagtgtggggtgcaccgcccgcctcatcggcatcgacctcgccaaggtacatgctccaagcaaaccacaactcgtacgcgggtgggcttaaaaccgagacattaccctgaactggtacttcgggaacgaccgctccatgctgcctctccaactgcatgcttccgcatggtcggcgcggcggctctgctctcgaaccggggcgcggacgccgggcgcgccaagtaccgcctcctccacacggtccggacgcacaagggcgccacggacgagtgcttcaagtgcgtgtaccagcgcgaggacgacgtgggcaagggggtcgtgtcgttggcgcgggagctcatgacggtggccggcgacgc

SEQ ID NO: 50522 - DNA, 451 bp, Triticum aestivum
  Clone ID: PAT_TA_50522
gatcaggcgggcagacggactgggcggcgtggtacgcacgtgcatcggcctacctccctggccgcggggatgggctgcggagccatcgccaccagggtccttctatcaccaacctgtggttcttgacggtgtgcacggctgacaccgcacggggctggggtctggggtattcacaataggttaagaggggaaccatgatctcccccgtggcaccagccatgcacagaaccggggcggtacgggctgcagattgaacggcaacagagctagacgctgaaccggggagtgagggaccctgctgatctgatgcctggacgccagtctcctgctagtcaatggcagagacaactctcatttttcacgactgttgctagaaagtgtagatcgactagcacacactctggatgggctatgtctgcaggaccggcagctgacatccagctgcgaaaaa

SEQ ID NO: 50523 - DNA, 568 bp, Triticum aestivum
  Clone ID: PAT_TA_50523
ctccaacaccatggcccccctgtgatggcttcctcggccacctccgtcgcacccttccagggtctcaagtcgaccgccggcctgcccgtcagccgccgctccagcagcgccggcctcagcagcgtcagcaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctacgccaggtgcagtgcgtcagcttcattgccttcaggccaccgggttgcgaggagtctggcaaggcctaaactacgagttgaaacaatggcctatgtatga

SEQ ID NO: 50524 - DNA, 569 bp, Triticum aestivum
  Clone ID: PAT_TA_50524
ccaagggcgcctaggttctcctggttggccagcagtgcttctgttccgaaccccgaaccccgccgccgccgccctcctcctccgtcagcctcgccccggagcagcgcgtcgttggcggcggaggccgtgtaaacccataaagttctgttttaagcgcacatcgaactttatggacatatctcaggagcaacaacaagattttggtgtgctactaaagcagggggctgaaggaagggtatttgtttctacatttgttggacgaaaatgcgtaatcaaagagcgcttttcaaagaagtaccgtcacccattgctggactcaaagctgactctaaaacgcttaaatgctgaagctagatgcatgacaaaagcgaggcggcttggtgttcctacaccagttctgtatgctgtggaccctcttcaacatacattaacctttgagtatgtggatggcttgtgcgtcaaagatattcttcttggatttgggtcaaatgggataaatgaagaacgtcttaatgacattgccacacagataggtaatgcagttggcaaactacacgatggaggtcttg

SEQ ID NO: 50525 - DNA, 586 bp, Triticum aestivum
  Clone ID: PAT_TA_50525
cacaactccccacatccttccggcgaaaccaaaccccagcccgccgcaccgtcagcacccatggcgcccaaggccgagaagaagccggcggcgaagaagcccgcggaggaggagcccgcggcggagaaggcggagaagacgcccgccgggaagaagcccaaggcggagaagcggctgccggcggggaagtccgccgccaaggagggcggcgacaagaagggcaagaagaaggccaagaagagcgtggagacgtacaagatctacatcttcaaggtgctgaagcaggttcaccccgacatcggcatctcctccaaggccatgtccatcatgaactccttcatcaacgacatcttcgagaagctcgccggcgaggccgccaagctggcgcggtacaacaagaagcccaccatcacgtcccgggagatccagacctccgtccgcctcgtcctccccggcgagctcgccaagcacgccgtctccgagggcaccaaggccgtcaccaagttcacctcctcgtagagtgctcctgctcctgtgtctcgtagttagctgtccgggtgtgtttgtggccgtgtaatcgtgtaag

SEQ ID NO: 50526 - DNA, 474 bp, Triticum aestivum
  Clone ID: PAT_TA_50526
tttgtgttttggtaggtgtccaagttgcagattgcttcccttgtggctgatgttttctccaacattgagatcgcagagaacaaggtaatgaaacttcacacacaaaggaataccttatttagtttttcataggcagttcaatccagggttttgtcggagtttcatgaggagctctatctatcctagcaccgtcgcatggggttttcatgcttaacaagaatccgattgcttacattgactgtttggttatcaaatttcatgaaagacgttattaattgaaacgtggaaaatgtgcgcatacaaaaaatcatgcaatatattgtattgcttgcattaccttgcagtacaatcttgtaccgcatcccagttttgcactattgttctaatttcacaatcatttgtactgcctgcacagtttgggcagtaaaaatggtgcactgcttttgagtttttctctggggaggcacaatgcat

SEQ ID NO: 50527 - DNA, 561 bp, Triticum aestivum
  Clone ID: PAT_TA_50527
caccatggcccccctgtgatggcttcctcggccacctccgtcgcacccttccagggtctcaagtcgaccgccggcctgcccgtcagccgccgctccagcagcgccggcctcagcagcgtcagcaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctacgccaggtgcagtgcgtcagcttcattgccttcaggccaccgggttgcgaggagtctggcaaggcctaaactacgagttgaaacaatggcctatgtatg

SEQ ID NO: 50528 - DNA, 553 bp, Triticum aestivum
  unsure (1)..(553): unsure at all n locations
  Clone ID: PAT_TA_50528
cagnagctagccccataatgccagacaccatcatttcaggtctgaagaaatacaactggggtgctctctcgttcgacatcaagctctgtaaaacaaacaacacatccaagtcagtaatgcgtgctcctggagatgctcagggatcttttatcgctgaagctatcatcgagcatgtcgcttcggtgctgtcactcgatgctaatagtgtcaggcagaagaatttccacacctatgacagccttgtgttgttctatccagaaagcacggacgaagcttctacgtacacattgcattctatctttgataggttgctcaccacatcgagctacctgcatcgagccgaatccagcaggcagttcaacagctgcagcaagtggcggaagcggggtatctcttgcgtgcccctcgtattcaaggtggcgccacggccagctcctggaagagtttctgtgctcaacgatggtttcattgtggttgaggttggaggcattgagattgggcaagggctgtggaccaaagtacagcaaatgacagctttcgctttgggacagct

SEQ ID NO: 50529 - DNA, 555 bp, Triticum aestivum
  Clone ID: PAT_TA_50529
acaatttacgtactccgccatggccccagccgtgatggcttcttccgccaccaccgtcgcgcccttccagggctcaagtcgaccgccggcctccccgtcagctgccgctccggcagcaccggcctcagcagcgtcagcaatggcggaaggatcagatgcatgcaggtgtggccaattgagggcatcaagaagttcgagaccctgtcttacttgccacccctctccacggaggccctcttgaagcaggtcgactacttgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggtcaagaaggagtaccctgatgcctatgtccgcgtcatcggcttcgacaacatgcgccaggtgcaatgcgtcagcttcattgccttcaggccaccaggctgcgaggaatccggcaaggcctaaagtgcaagt

SEQ ID NO: 50530 - DNA, 527 bp, Triticum aestivum
  Clone ID: PAT_TA_50530
ccccgagccccctaccacacagaagcctcctcctcccctccggcgcatcggcgacatggcccgctaccaagcagtacggcgaggcaagtcgaccggcggcaaggcgccgaggcaagcagttggcgaccaaggccgctcgcaagtccgccccggccaccggaggagtgaaaaagccccaccgcttccgtcccgggaccgtggcgctgcgagagatccgcaagtaccacaagagcactggagctgctcatcctcaagctccccttccagcgcctagtgcgcgagatcgcccaggacttcaagaccgacctgcggttgcagtcctccggcatctccgtcctgcaggaggtcaccaacgcctacctcgtgggcctcttcgaggacaccaacctctgcgccatccacgccaagcgcgtcaccatcatgcgcaatgacatgcacctcgaccgccgcatccgtggcgagagggcctaggctgctgcacctgcaatccgtgttaggctgagttcatccgtggaaaatagcggtgt

SEQ ID NO: 50531 - DNA, 241 bp, Triticum aestivum
  Clone ID: PAT_TA_50531
gggaaccaccaaggggatcatgtaccggccattctctggcgtgcgctaccagtcctggcgcagcccgccatcggctctgaccgggcgtcacccgcaggagcggaggccgagggacgtcgcgcaggctcttggcctcaaggcagcgcaccatcgggatgcgccttacctaaactggcgcacaccaggaccgcagcggccctctaagttggcccctcgccgtcgatctgctggggcctcccca

SEQ ID NO: 50532 - DNA, 402 bp, Triticum aestivum
  unsure (1)..(402): unsure at all n locations
  Clone ID: PAT_TA_50532
gccatggaacgtctcagccccgggcaggcgcgaagccaagaaggagccgcagggcgcaaggcaggcggccccaggaagaagtcggtgtcgaggtccgtcaaggccgggctccagttcccggttggnccgcatcgggaggtaccctcaagnnaaggtgncnncgctacgcgcagcgcgtcggcacgggcgcccccgtctacctcgcggccgtcctcgagtacctcgccgccgagctgctggagctcgccggcaacgccgccaaggacaacaagaagagccgcattcatcccgagggccacctgctgctcgccgtcaggaacgacgaggagctcgggaagctgctgngccggcgtcaccatcgcgcacggaggcgtcgtgcccaagataacccggtgctgctcc

SEQ ID NO: 50533 - DNA, 489 bp, Triticum aestivum
  Clone ID: PAT_TA_50533
accgaaagcctgataaacctactttgcctaggcgtgttttgctctctagaaagaacttcgcttacggtgataaccgggcagtacttatgttcggcttgacatgaaccaatctatggtatagtgagcattccaatcacagaagaagagacatacggacttgtatggcatgaaaaccctgaatccctctttaggcgctaagactgttttatgaacataacggaagcagggcaaacagaagaatcatgtgagcatttatccgtagaccgcagagatggatgatggttgcacagtaatccatctataggggtgcaagctagaggcgtctgaagagagggtatccactggaccagtagggattgtgatgcgatctggatgaacggaactctgtgctgccaaccgaaaatatggggcctgcgggtacacgatccaaacctgctgacgggatccatccatggtttaatatacgcttagagacgtactacacctgtt

SEQ ID NO: 50534 - DNA, 475 bp, Triticum aestivum
  Clone ID: PAT_TA_50534
gcgacggagctcacggccaactcctggcgcatcaacctccaacgtgcccatcggcctgcatcctactcggcaactactgcggcaagaacgtcccctccggctgacagggcccccgctggaagcagaagaccccatagatccatcgaacacagcaggcatccactatacgtacgtgcgtgcatgcatgcgctcaccaacttgcctgcatgatctacgacccatccattgactaggcctctataactaggagcttacgttattctgctccataatctcacatggggtcttgctagtagcctgctaaactctacatgtgcgctcttgacactgtgtgtcgctacaggtgcagtagtatccttggaaccactgccagcgatctaactatgatccgttactgcctggaccatggatcgagccctcagcctcatctgatctaacgcttgaccctatacctgctactattttgtatgcttca

SEQ ID NO: 50535 - DNA, 505 bp, Triticum aestivum
  Clone ID: PAT_TA_50535
acagtgccgtggggttacgaactacaggactgggaacaccctgacgttaccgacctataattggcttacagctcattcaactttcttcttatggcgaattagctatttaagacggtgccaaccgcccttaacaacagttgcacagcctgattggggaatggtactccccttgcacatgcactttaaggcctgtaaaagtggtgtttacgcacacacggaccgctgcacattgccaaatccttagaaccaaatcctttagataacttaaatttgttcctagcggcataattattttattcacatcttggattcaaccctgcgctttgaactggacatctgagccacatcctaatggaagctaaaccccaacaaaatcggataaataggcggacaaatattggactccctccctcccaaaaaaagttgttctaaattagccacactattttgggatggagggagtataaaccagctaatgggttcttaaatcaagtcacccaacaaa

SEQ ID NO: 50536 - DNA, 452 bp, Triticum aestivum
  Clone ID: PAT_TA_50536
gtccccacaatccatacggcgcagagaccgttacggggtactcacacattccacgcgtcgagcgagacgagcgtctaagcgggtatggaccagtctaagctcatgatcggcgtgaacggcgagcactccgtgagcgagtcgctgctgcaagcagcctctgtcgacgacggaaggccacgtccctatgtcgtggctcgcgctctcctgctggacagcggttgtactacatatctcatgacctagcctctaaccaactgtaccatgactatgttgcaggcgatcaacagcacagcactgccgggcacaatggtccactaaagcccaatgcccgaagacatgagtgacggatgtggtctgtgcacatatcggacctgatcggattttaccactgcataaccagctcttgccattatcatgaagccaagattggctctgcagaactgaaattggga

SEQ ID NO: 50537 - DNA, 538 bp, Triticum aestivum
  unsure (1)..(538): unsure at all n locations
  Clone ID: PAT_TA_50537
agctgcaatagaaaccttgctgtgtaatattgatgttatataatagacactgggagagcgcgaaaagcgtgaaaacaatgcggcgactggggacctgaaatttcaacgcaccgtacggagaaacgaaatgcctaaaaagttggtcgcggtctatgatcctcccaccgcgcgcgagttcactgtggggagaaaagaatcatgtggtccgggtgctaagacatgcggcggggtagtgatcataacacgtactccttgggcgggtacttggcgacgcagtccacccacgggttgcaggccttctcctccggccccggcgccgacacggccggcacgtcgcggagcgcgcgccacaccgcgctgttgcacttgaacccggacccgaacccgatctgccagacgcggttgccgcgcttcacccggcccttggcctcggcgtaggccagctcgtaccacagcgagctgctgctcgtgttgccgaaccggtgcagggcgcacctgctcggctccatgtccttggcctccagnctcaagctgcgct

SEQ ID NO: 50538 - DNA, 520 bp, Triticum aestivum
  Clone ID: PAT_TA_50538
gtaactgaactcttcatagccattgcattccacgctacataggggagcgcggcacatgagtcatcaacaccaacagcaataagacaccagacacgagcagctactacccagattcacgcggcggaaacacggaaaacctaggcgcgctccccacggatgccgtgggcgaactggatgtccttgggcatgatggtgacgcgcttggcagtggatggagcacaggctggtgtcctcgaacagccccaccaggtacgcctaggcggcctcctgcatggcgcgagacggcatgagctctggaaacctgaggtcgggcttgaagtcctgagcgatctccctcacaaggcgctggaaggggagcttgcggatgagcagctccgtgctcttctggtacttgcggatctcccggagcgcgacggtccccgggcggaagcggtggggcttcttcacgccgacggtggccggggccgaattgcgcgccgacttggtagccagctgcttgctgggcgcccgggcgcgtggg

SEQ ID NO: 50539 - DNA, 535 bp, Triticum aestivum
  unsure (1)..(535): unsure at all n locations
  Clone ID: PAT_TA_50539
gcgtgcggtgccaaagagtttctcattattaattacccngatacatagtcgacagattgtataaatatattatgtgcatgtgcatatacatagccaccgattgcattcacatacgagcatgctttctcgagacatgttggtacatgaacatggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacgtacgcgtcagggtactccttcttgacctcttccacctcgttgatcacctgtgtggcgtcggtgcacccgaacataggcagcttccacattgtccagtaccggccatcgtagtacccaggggatgcgttgtgctcacggaagatgaacccaaccttgctgaactcg

SEQ ID NO: 50540 - DNA, 488 bp, Triticum aestivum
  Clone ID: PAT_TA_50540
attctccttttcctccttactatagcactacctgggattccttagcaatcataccagaatatgcctgtggccaaacccaattgcggacacataaggctctaggagtccatcgtaagccaactagtataaccagtgctcaactggagattcccacagttcgtacaggcgtggctaaccatggctttcgatagctcccagcataaagatggtagcggactacttctacctgtccggcctatccgaggaagcccacctcatgcccgccaggcttggatcctacgcgattggaatactcaagagatccaactctatgagtagcttgcggtctgcccaaaccacagagaaaggtcttactcgtacacataggacatattctgaacacagcacatgacattgcttgagggccattaatcatcattttgctgcacaaacattcctcgaccatcacatagaggtgatggtacctatggtgcgaacagatcccaacc

SEQ ID NO: 50541 - DNA, 556 bp, Triticum aestivum
  Clone ID: PAT_TA_50541
ggacagaacaacacgcaatgcatacttgcatagatcagatatacattgtactagtggaagtaactgataggataatgtcaaagaaaaaggagtaacggatagggtaatgtcccccacaaaagaaaaaggatagggtaatgtcaaaagaaaaaaggaacaactgatagggtttgtttgctcttagatttttaatcgctagacaggcgaccaaacaagaagaggaaaattatgtggagtagtaaatatacatacacatagaggatgctgctgctcgttacagtttgctggtgggggtggttgtcgttgctgcggcagcgtacttcttgagggcgtcgccggcgtggtgcaggttgtccggcacgggcaggttgcagagcagcgtgaccctggactcggagatctgcgggcccttcttcccctcctccgacgggtccatcttccacagcttcacctcccacacctgggtggagcgtccgaggtggacggggacggcgcgcgcgaggacgacgtcgccgagcgcggcgctgcggaagtggttgatggcgaggtgcacgcc

SEQ ID NO: 50542 - DNA, 524 bp, Triticum aestivum
  unsure (1)..(524): unsure at all n locations
  Clone ID: PAT_TA_50542
tttttnttgtgatattaattactttattacaattgtaggaggagcaacctccttttgaagcaaatataatagtagcaggcagcggtacaagcatgagatcatatgtggctgagaactcgatccatggtccatacagtaccgtggcctagttcgatgacaagcagtagttcaaaggatactaccccacacacacacacacacagagacacgagcacacatgtaaagtttagcatgcaactagcaagagcgatgataaattatgaagcaaataacgtatacgactagctatagagtactagtcaatggatggatcgtagatcatgcatgcgagctggtgtacgcatgcatgcacgtacgtacgtatagtggatgcctgctgtggacgatggatctctcgggtcttctcttctagcgggggcactggaagccggaggggacgttcttgccgcaatagttgacgaggaggctgaggtcgatgggcacgttgaggttgatgcccaggatgttggccttgagcgccgtgc

SEQ ID NO: 50543 - DNA, 561 bp, Triticum aestivum
  unsure (1)..(561): unsure at all n locations
  Clone ID: PAT_TA_50543
gtccctccccataaggnaagnacatggcagctgcgactgcaaggcagctgttggtccacaggatcacatcctcctgctcctcaggacgcttccgaagcacacttccagttgcttccaagccggaggctggaacaaggccgcgaagctccccagtttcagggcaagggtgaccgtgaagccgccgtgcgccgtgccggggaagggcggcattgtgccggccgacgacgacggggtcagcctcggcaccgtgaagctgccggccaacatcgacgtcgctcgcttcgaggggttgctctttcagtgggggaacagtctctgccaaggcgccatgttgccactgccagtgcctatcaaggtggacaaggtggagggtgggatcaggctagggttcatcgggatcgacgacggcgcgacctcgctgctggcctacatcgactgcctggtgtctccggcgacagacggctctgggtttgtgttccgagccatcacgaacggtgctatgaaggacatggtagccgcctggggagcccaggatcatgaggagcctcctcatggcgcttc

SEQ ID NO: 50544 - DNA, 474 bp, Triticum aestivum
  Clone ID: PAT_TA_50544
gatgtctgggcggcagtcagccactgacagccaccccgctcttatggacgcctgttcggcccgcgggcaacctcacgcccaggctccaatcagatgatcctacatatcgagggcacgaagcaactatgcaaggggaccgtgatggacgaggcgccagcgactggcgcactcccactgcaactgcgggggctgcacttccacggctctcactgcggacagcggacgagaacagctctgccaataactgactacccacttttacgccacaatggacctcgccgccgccggggactcggcacacatttgccacacccgcaggtacaccaaacatcatacagcgatactccaaggcgtgggtgaaaggaccatctctgaacctactgcagtcgggggcgcacgcgatcgccgaatccactctgttcgagcttgcccatatcaggtccactccgatgatggtccaaaagccccacaatt

SEQ ID NO: 50545 - DNA, 561 bp, Triticum aestivum
  Clone ID: PAT_TA_50545
accaaccccaccgaatccacctctcgccggagtcccagcaggagcgagcaagccaggaagaggacgccagcaagctgaagaaggtggccgggaagaagttcggcgggccgaggaagaagtcggtgaccaggtccgtcaaggccggcctccagttccccgtcggccgcattgggcgcttgctcaagaagggccgctacgcccagcgcgtcggctccggcgcccccgtctacctcgccgccgtcctcgagtacctcgccgccgaggtgctggagctggccgggaacgccgccaaggacaacaagaagacccgcatcgtgcccaggcacctgctgctggccatccgcaacgaccaggagctcgggaggctgctgtccggcgtcaccatcgcccacggcggcgtcatccccaacatcaacccggtgctgctccccaagaagaccgctgagaaggccgagaagaccgccgccaagtcgcccaagaaggccaccaagtccccctaagaggccaccagagcctatatcgtaatagtgcggtttgcttatggttccagtgcggttagat

SEQ ID NO: 50546 - DNA, 467 bp, Triticum aestivum
  Clone ID: PAT_TA_50546
aaccaagcgggagctgctgcctgccctatctacctgtcctgactaacggtaagatagcaatggctagaggttacctgaatagaaatgccacacccacacgccagagcttgctgaggactgggtcttcgcaatgtgaacgcgccgctcaacttgcatgatgttattcgtgcttcctaacgcagatactgtcccatgatgaacaagccccatcgcttgagcgtggtgctgtatgcaactctgactaggacttggcacatgaggaacattacggagtcatcccgcaaaaagatctgttactgttgaaactaaactaacacacttggcgctttctgaagcgactggattcatacatacaggcactatcagtagggaaaattaacctggagactttagtttagtttattaccgaatgccacattgtttaaacggcgatgtcagacaaaagatccgtaaatatagcagagtca

SEQ ID NO: 50547 - DNA, 584 bp, Triticum aestivum
  Clone ID: PAT_TA_50547
gtgcgggacgcgcgccggtgttgggatgctacaaccggcatcccgcggtgctggaaccgttgacatgaaaagctgcaaccggcaatcatcgatgctggaagaccaatgtgccgccaggtgttgggatgctacaaccggcaccccgtggtgctggaaccgtcgtcatggaaagctgcaaccggcaatctccgatgctggaagagggcgacaacaatcagagttgtttttgctggaatcctttgtaagttttgccggaaccagcattgtttttgctagaaccgtttgtatgttttgctgcaatcggcatttttttggctggaaccacagagattttctgctggaatcactgggcggcgacatgttttttgctggaaccggtgatctattttgctggaactgacgattttttttgctgctatcaacttttttgggattttttgttgccgattttggttttgctcggacatggtgatgcaagacgacgacgcgagccggagctggtgacgatagggatgttgcaaccacgatatatcacgagctggaaccggccgttggaaagctgcagtcgaagctgggaacccgcc

SEQ ID NO: 50548 - DNA, 578 bp, Triticum aestivum
  Clone ID: PAT_TA_50548
ggtaggtacaggtgcatgcaggtgtggcccatcgagggcatcaagaagttcgagaccgtgtcctacctgccaccgatcagcacggaggccctcctcaagcaggtcgactacctgatccgatccaaagggtgccttgcctcgagttcagcaaggttgggttcatcttccgagagcacaacgcatcccctgggtactacgatggccggtactggacaatgtgcgaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcgggtttgtcaactctgacattgctttgggttttccttctacatttatctttcttgtttgatcctaagaatatgtgtatgcccatgttcatgtaccaacatgtctcgagaaagcatgctcgtatgtgaatgcaatcg

SEQ ID NO: 50549 - DNA, 587 bp, Triticum aestivum
  Clone ID: PAT_TA_50549
accttccaacgtaacatctaatggtggttgtgctagagtatcccatgcgtgataatattgtgcgaaacatgaaacgccctgaggcgacctatgtatgtaactcggcaaccaatcttaccccattgagggcgcatatgacatatctaaaccaaacgctcgcgacctggaacctaatgctggatacatccccttctacaaatggggttcgcgcacctgcaatacatgttacaccacacctattggtatgagcatcgcgagaagcgcaccatctcactatccatcagatcgacggaattccttatgctagagaaataacatctgcaccacctgcctatgggtacacaagcagtacttaatactcatggatggatatgcatacgcctacctccatgcgcctgatccaacagggtcttaccactaccgactaactggcacatatatccctggaatggtatactaccggctacattcctattgccaagtcagtgcttttatcccatgtaacgctacaaatacagaacgtttgcagttcgcacggaccctcatgttcgatctgatagacggctgactctgaaaagaaataaagt

SEQ ID NO: 50550 - DNA, 586 bp, Triticum aestivum
  Clone ID: PAT_TA_50550
agcgcgaccatggccacaggtgtgacggtgtgcgtcaccggcgccgccgggtattgcgcctcgtggcttgtgaagctcctcctctcccgtggctacgccgtccacggcaccgtccgcgacctctgtgataacaagactgcccatctaaggcgcttagataatgctgctagcaacctcaagcttttcaaggctgatctccttgactatgatgcaatggcatctgccatttcgggatgccagggtgttttccatgtggcgactcctgttccttcaggagaattaaccgatccagagctacaaatgttgggccctgctgttaccggcaccacgaacgtgctcaaggccgcctccgccgcaaatgtccgacgagtggtcgtcgtgtcatccatggttgctgtggagatcaaccccaaagactggccccaaggcaagatcagagacgagagctgttggtcagacacagaattctgtaggagcaatgagagctggtaccctgttgccaagatcgcggcagaagcggcggcgctggagtacgggcgtgaaaccgggctcgacgtggtgacactgaaccctgcactggtgtttg

SEQ ID NO: 50551 - DNA, 468 bp, Triticum aestivum
  Clone ID: PAT_TA_50551
gtgagcttagggtggcattcagcctgccatcctggcgtccatgctgtgctcctactccgctgccatgcggcgccggcgtcagtgcttcgctcctccggtccactccctcaggttcgccacctatgagctcgccaggctctacagcctaggcctaacctccaggcacgggaggcttcctgcctaccaagaacacgcatggagatggcgccgtaaccgcccatgatcggagaacaagactacccgggccagcagggggacctatctgcagcctacaacaccaagacatgatcaatggacaacctgctgaacaagacggtgccgtggaaggccggcaagcgctcaaccaggcggacgctatgaagaaaggccctgactaacatgaagaactaaaggctgccctccgggtgcaacacagggaccaaaaaggcttaatatatgcggatagagctcactacaacgtcatgtacg

SEQ ID NO: 50552 - DNA, 450 bp, Triticum aestivum
  Clone ID: PAT_TA_50552
gggaggctagcgctgggggagcgctcagcctcgggcgcgtaaggttcatgcgacgtgcaggggtggctgatgatggtcgatcagcattatatacagcgtgttttacctgctaccggtgcatggctgaggcccttgaccagcttgtccattacctgagtccctgcaacagagggccttccctttggctcagtggggcacgttttatctcgccagtgcacctggcatacgttgggtactagaaaggacgttactgatcaatgcagatgacttgtatgtgcgtgtgtacttgcgctacggatgggatcaacattgtgtaagaggtatataatgattatattgacgcttgcattgcgactcataggattggaaaactgcgagagggagaatcagaaggttcatcttgttgaagccatagggctgggggagagaaatgtaaggcctaaactatat

SEQ ID NO: 50553 - DNA, 447 bp, Triticum aestivum
  Clone ID: PAT_TA_50553
agtcaacctggccggacccgtgggcgtcttgtcgttagggcatcatccttccttactggcctagtagatcatacaaccggccaccacccacctactactactatgaccaacacttgatacttgacacggtggccggaggccaaccaatgcatcactgtggccgcaggtatacgctagatacttgaggcttgtcatcccaacctagcgaggcctggtggatgaagctcggggcgccacacgttcctcaggctgccggcctacttggggggattctgaatctacctacgcttctgcgagatgccaccctttctgctcggcgactccaggctcaccccctcgggcaccacgttaatcttgcatgcctcttacgacagctggtgcgaagcctagcacaagatcgccgtctgctcctccttgggcattggggacgagaccctatgctgagac

SEQ ID NO: 50554 - DNA, 530 bp, Triticum aestivum
  Clone ID: PAT_TA_50554
gcttcgctacaaagtgcctgcacacatactcctcttctttatacggatcctaccaccaatccacttgccgtaccggtacgaacgtacgataacgctaaaaccctgcggtgaccgaatttaacggccttgctcctcgataactttattgctcatatggcagcttgaccacagagacaaggccattgcgacattgaacaacaatgtatcgaatggatgatgcattgtggaactatccctgcagccatggattgaccccattattggtgctgacaacactcaccatgacgcgttgcatttaccagctcactctggcctgctactttgactaccctgccaggctttcatctgctatatgtctgctatactcaacatggtttgtgttaatcgctagatctgggcggccgatccaaagaatacggtgcgctgaccacctggcatcgagagggcactatggaacatgtattgaccatctgactaaagaatggtggagacgcttagccgtaagctaccgcattcttaataagggacat

SEQ ID NO: 50555 - DNA, 464 bp, Triticum aestivum
  Clone ID: PAT_TA_50555
cttattactatcaagactgtcatgggattcagggtgctcaatggggtttacattgggctcctcaatctgagcctttatttccatactgttgggttttaccacatgacaaagctggccatcatcccgtgctctgatattatcgactctttaattgcgcacacaatctaatctggctatccatatcttccttaccaggcttcttttgggggacccggctccaactttgattgagttccaactcaatgctccggggggcatactgtccttctttccaataatcacgacttccatggaccaaatcatgaccaaacactattcagaagaaatgaagggtttttaaaaacacctgctatatcaggcttatgcttaccaatcatagacactgtgatcttatccgccttttccttcagagactcctgactaaccaaaacctcttcgctttcaattacacatctaacggggcg

SEQ ID NO: 50556 - DNA, 517 bp, Triticum aestivum
  unsure (1)..(517): unsure at all n locations
  Clone ID: PAT_TA_50556
ctcctgtgtttaagagactctgggaaatttactaatctatgggaacagcgcttatcacagcacatgtgctatgaggggataccctacattaaagctaccaggtatacttggcactatggaaataggaggactactgggagaccaaccagcccacgtgcaatgcgaggtcacaggagcaggcgtcatgtgtcccatatcatgacgacggggataaccccgaccccgagcactactgcgagccagcggcccaggggcgtgtccgccgcgacgggccgctggggcttgtaccccttggagaggaggtggctgacggagcacctanatgaagatgccggtggcgaggcccatgggagacggcgaaacatccagtcggccacggcgccctgcgtggtggggtggatggcgatgcccacggcgacgccgatggggctggagaccgcgaaagggaacgcgtatgcgaagcaggagagcagcggccggttgggcatcatccggagcagcgcgatgcccatggcca

SEQ ID NO: 50557 - DNA, 527 bp, Triticum aestivum
  Clone ID: PAT_TA_50557
aaccgaacttggccatgtccttgtttttttcaagagcgtggttatatagtttcctgtatgagtatgtacattgtccaatcttggaatggaatttattaaggcgactgttaggcgccggtcgaccagctcaaatttgggcaggtcgcggcatgagcgtgggatacaaccccctaaccgtccagattaatcgctaaccgccttgaaaaaatcaaaacacgctgcaaaacccgtccaatcttctgcttcccctgttctccggccacctacgcgactcgtgcttgccggccgctcccgtcaccatgcccgccagtgcgcagccccttgctgtcgtcgatgagattgcagcacaggtgtcggcgggttcccagcttcgactgcagctttccaacggccggttccagctcgtgatgatcgtggttgcaacatccctatcgtcaccagctccggctcgcgtcgtcgtcttgcatcaccatgtccgagcaaaaccaaaatcggcaacaaaaaatcccaaaaaagttgatagcagc

SEQ ID NO: 50558 - DNA, 551 bp, Triticum aestivum
  Clone ID: PAT_TA_50558
gtaaaagtgcactcagtcgcctgcgtgcgcataaatagtaaactttgtgatcagagcgaaggattcgcacgatacctgattacaaggtgcagcaaactctcctgcactcacgcaaaagttatgctactacctgcgcggatgtgggctgctaccactacttaactgcatcgctgcgcccagcccagcgcagctcagtagtgactcccatgacaatggcactgcgttcctcgttttctctcaaatgtatttacgacactctttctcatcttgttagcagctcgatatcagctccgacttcggcgatcttcaagtccatggaagcttttgcgctgcttgcgacgctcttcacgtcgaggtcaagggcgatggacttgaccaggccgttcaacataagagagccgattgcaacaagggccctgtatttcgaatcggcatcttgggcatcgtcttcagcaatttcaagggccgcagaaagaatttgtgcctgactttgttcatccttcgattcaattgaaagaacagaatagttcagtaaaagtgttgcatatgcc

SEQ ID NO: 50559 - DNA, 417 bp, Triticum aestivum
  Clone ID: PAT_TA_50559
gcaaaaaataacctccagggtgcatatcacatgccactatgcttatgggtgcaatgtggggccctcaacatggtacttccacttattattaggacacaaactacaaataccaatgtagaacgaaaaccagaatcattgatacatgagacaaagccgaaatggaactttatactcaggacccacgcgagacgaactgcatagggattgattgactaacttgaggcccttggctaaaatgccataaaactaacgcactgcacataccgcatgtatggaaataagatgatccccattgacgcttgaggccactcctttttgaaatgttgcaattactacaacacctgactcgtgtaagagcaacacaccatacttggagctcaaaatgatcagcagcaagcattgtacctccaagaagat

SEQ ID NO: 50560 - DNA, 400 bp, Triticum aestivum
  Clone ID: PAT_TA_50560
aacatatgaagctttcacaaaagaggagacatgccacacagggagggagccaaaaataccagaacatgcactggggaaagatacaaatgagagagcattacatacactcagaaccaaacgggaccatgagccaaaagagccggtggcgtcacacaaagaaaactaacggggggggggagctttaaatccttgagaggcgaggcattgagccaaatagagcatgggggcaataccggcggaacccaggaggtgaccaccagcgtgccaatcatggggcgtggggcccgcaccgagcgcccccgagcaaaggcgagtccaacgcgcaaaactaaccgagggcaccaccgggaccccaaccggaggtcaaagccaccttgtcattaacatcccttgctaagaa

SEQ ID NO: 50561 - DNA, 522 bp, Triticum aestivum
  Clone ID: PAT_TA_50561
cttcctgatgaaactttgcgctcacaggggtgggcttgaggggactgataatgtgtccatcgtgagaatactttaaacatcctgtgtatatcactgaggggtcttatacaaacatcaaggggtcatgtgtaactatggggggggggtgatattctcaacttttttaattaactgagcctcaaaatgtgaacttaatgcgggggactactcctgaggacatgctcttaggtgagcgtgtgagaaaccagaaataggcgccatattaacaatgtttacttcatttgagaggcgcctatatgaatttgtgagtacgacattccattgcctttccacagttttggcctcttgggaactagaaaaataaacatgtactccctccgtcccaaaatataataatgtgtttaacactagcatcatgtgcaaaaacggtcttatattctgcggacagaggggagtgggctcatacaccgacatagataacctgtgacgtaacattctgttctgggcgcaatgaaaatacgg

SEQ ID NO: 50562 - DNA, 317 bp, Triticum aestivum
  Clone ID: PAT_TA_50562
ccctgtacggcgctctcacccgagagaggtcaacgtccggctggacatgtgacgtggggcacaacttccgtaacctgaggtagaacgtcagccccaattgaggacaagttcactcgggtagcaactcctttcggatctaatctagcacgtcttgtatgcgtacggactagacaatccaccgttacttattggcgggtggcgatgatgatggacgtgctgtgattttaatcgtgcagtctgaatgcttgattctaacggtgataatgatgcatcaggttatatgtacatggtaattcgagacgatcaagaataaattt

SEQ ID NO: 50563 - DNA, 593 bp, Triticum aestivum
  Clone ID: PAT_TA_50563
cagcattgatagaacaggtcacagcaagatgtggacgccaattaagtgcagaagctgagcaactgcaacacgaatccatctgaactagaaatatgccctattaaacaagcatgaacacgtgcaagcagtgtatcacctggtgatgcgcgtggaacaagaaacagacatttcctgaagaagcacgccatgtgtgcacagcaggatgctgctgatcagagatacctgctcatgtgctgcacgagaagtatgatgaacctatggcgtctcttgctcaaacgagacaacagagctgggatggcagaaacaatggtgaaggccacactgcaataccaatctatccagaaaaaaacactttccccttactcttctccaagagcatctgcacaaaatgattcatttcacgagtgttagctcaaaataataaacttacttgaaccgttttcactgagctggccggataacaacacgggaaagcacaactatgctagctgactgcccagatgccaaacttacatacgctcatgagcaaacggaagaagctcccactgtatatgatgagaaacattgagaacacaactaccggatggtgaatg

SEQ ID NO: 50564 - DNA, 152 bp, Triticum aestivum
  unsure (1)..(152): unsure at all n locations
  Clone ID: PAT_TA_50564
agcgtccggaagaaaatagcgacctggtctgccgccggtgcggcgctcctgcggagccagacccggaagatgcactaagccgacgtcttatggcnctcttgtggacggcggtcgccaggtcttgcgcgaggaccatgtatagatgtacgtat

SEQ ID NO: 50565 - DNA, 447 bp, Triticum aestivum
  Clone ID: PAT_TA_50565
cgcgtaggcgacgagaccgacgcgctctcacacggtcgcacagaactgggaacgtccggaggagcgcaacgagaggaccaggggcatgatgctgcgtctccacggaggtattatgaggccagagaccgagagacccctgctgccggttagaaatggggcccaagtgaacaactgcacctaccaacatcgaacgaaatggagggcatgtaactaacctaacactgcaaggctgatctgaaatgagaagaaggctttatctgaagaccacgatggacagtgctggacgacttgcaaaagatctcacttagagcacaaaagatgcccacagataatcaacgagggggaccacatgacgaagcaaacgcagacaagacccgactagggataggggtcgacgacttgcaccaagatgcaatgcaaaagctcctttgcctttgacatggcaat

SEQ ID NO: 50566 - DNA, 447 bp, Triticum aestivum
  Clone ID: PAT_TA_50566
ctccagccacctccacacacgtcggcataggcaatccgcctcaacacaaacctcggagctgtgccaacaaatctggtacagccccacatcgcggaggagagtggccgtgcaaccggctgggaacgctggatgctgtgaatcacctaacgctcaatacgtgatcgctatgattctgcgcaaagcaaagcgtgtaagacatatgcctatgagactgcacacggaatggacagacctcccggtctgcgaacagctaactgcgctgcatcgccaatcaactgtagccttcttcacatggagacgatcccttagtgtctatgaacaaaaggagcccgagaggcactctaaaagatccaaaattatgaacgcaagcgtgaacattactatctattatataatggaaaccaactacatcatgaagggccgatccatgcccaatgagataggcgg

SEQ ID NO: 50567 - DNA, 581 bp, Triticum aestivum
  Clone ID: PAT_TA_50567
ccgtcccaccattcctaatccacggtccctcttttgatcgatggcagccatgaaggttgtgctgaagctggacgtgcacgacgacaggcagaagcagaaggccatcaagctggtctccgcgctccacgggatcgaccagatcgccgtggacatgaaggaccagaagatgacggtcgtcggcaccgtcgaccccgtcgccgtcgtggccaggctgcgcagcaagccgttcaccacggcgcagatcttctcggtcggcccggccaaggaggagaagaaggacggtgataagaaggagggcgagaagaacgacgcgggcaagcaggtggagtacctgcagtactggtacccgccgccgccgtaccacccgcacctgtgccacctcgccgaggaggaccccaactcgtgcgtcatctgttgatcgacgcgcgccgccgagtcccgccccgccattgtacactttgtagctggccttccttcctgcctgccgatcgatcagcctacctgcaccggtgatcaacggcgtgcgttatatatatggatggccgtgtaaggcgtgagttgcgccggtgatccggcagctg

SEQ ID NO: 50568 - DNA, 159 bp, Triticum aestivum
  unsure (1)..(159): unsure at all n locations
  Clone ID: PAT_TA_50568
tccgccgcgtaccgggaaacgaggccgtaaccgccgccgcgatgaggccaatggnaaaaataanaggatgagaggctcaagaagnaagcgccgtaagaatgagcagcgatccaagtagcgccttgngaagaggggaagcatcatcttgcatccaggctg

SEQ ID NO: 50569 - DNA, 473 bp, Triticum aestivum
  Clone ID: PAT_TA_50569
gggacaaggccggtgcttcgcaaggccatacatagaggtatgcacgtacgactctccgcgccgacggtatcaccatggtcgtcgctgacctcggctgctcgtcgggtcccaacactctgagcttcatctccgaggttatcggtgcggtccgctcctgcactcggaagtcggaagaagaacggcgggccgtggaggtccagttcttcctgaatgacctgccggggaatgacttcaacctcgtcttccggtcactggagcaatttgagaatctcagcaggaaagatacgccgccctactatgtggtaggactgccccgatcatactacaggaagcttttcccttcccggagcgtccacttcttccactcgtcctactccctcatgtggcgctctaaggtgccggaggagctttcaagttgcactcacttgagcgaaggcaacatttacattggaaaaaacaacttcacctatggt

SEQ ID NO: 50570 - DNA, 473 bp, Triticum aestivum
  Clone ID: PAT_TA_50570
gtccggtgtataactgcacccaaatcatggcatggcatgaatcggtctttcccatgaagaccgtccccgaggcccgaccgtcaggcgcgctgctggagtcccacctaggggcgagctgaccatgggggggaggcagctcgccaaccaccccatcttgctctgatgggcaatggagttcatcggagcgtggggggtgaggttgtgcacgcccgcaccgtcatgtccattaaggttgggcccaccaccgaccggtctccggaggacttcccggggcggacagctccgtcaaggcaagggactttgacctgcccttgtataaccgtttctacctggggacattggcacctggggaggcggcggtccgggccaaggagtcgtgctagtacatgcttaatctcaagccggtcatggacatgaaggagtggctgttcgtgttgaacgagctccgccttagggtcttctacgtacgcttt

SEQ ID NO: 50571 - DNA, 549 bp, Triticum aestivum
  Clone ID: PAT_TA_50571
gaaaaagaaaacagctctgctctgcgccatctggtggcccctccgactctcactcaaagtgccgtttttataccgccgtctctcaaggcacaatagtcacctacagctttttccacaggagcaagaccgtctgattgttgctgtgcacaacctgcctcatttcaaggttcctgagtgggtgctgatcaaaatgaaagtctactgtgacggcaggagctgccaggcatttgccaacgcctgggacttcaagcttacggaattaccttagagaggcttaataaaagcattagcgaaccatcagtggtctgccgtcactactgcggtgtgcttgtgacctgccactacaccaggtactaccggcaggagaggacaagatacctttgtcttcaacaagcgattatctgttttacaaagattgctgatagctttgctactactgtgtgggtccattttcataatcttaaagggagtgttcttatctatatgatgaccttgtatgatgctacgccctacataatgttttggttctggaccctttaatatattgta

SEQ ID NO: 50572 - DNA, 532 bp, Triticum aestivum
  Clone ID: PAT_TA_50572
ccttgcatatttgcccacatttattatggttttacacccaatatagttgcaataccattacatacccgcacaatacacctgctgctgctaaacatataggacgaacacactagtaaattaaacggccgggacggcagaagacaggccgggagcagagagctctgcgttattctctcctcgatcgtctaacggggacggatggcagcacacaaagaggagggtacgtagtagggtagcagtggtctcttatcatcatcattaccatcagcagctcatctttgccggctggctaggacacaacccttccattgatccagaccacctaaatgctccagagactgacagcagtgtggtatggtaggcatcgctttctagtagtatggtggcggcgggctgggggtgtgagacaccggcggcgtcggagtgtaggtgggcggcttggtggccggcggcttcggtgtgggagtgtacgtcggtggggtcggcttgggtgtcggaggctttggagaaggggtgtacgtcaattggggtc

SEQ ID NO: 50573 - DNA, 297 bp, Triticum aestivum
  Clone ID: PAT_TA_50573
gatgaattctctgtttaatactgtcgatagttatataattcacaaataattggaaaaacactacagaatttcagaattcctggggaactaggaaggaatcattacactggcagaaccatcaggggcaccaggggggcaaatacccggcggggccacactttcactgtggacatctgtctggcgctaaaccgtggggcatggggccaccatcgagccaactttgggtcacacacaacccgaaaagcgggcaattatcaatgggccatggtgagaggcgaaaggggactttcgcaataa

SEQ ID NO: 50574 - DNA, 442 bp, Triticum aestivum
  Clone ID: PAT_TA_50574
gctaatgacacacgattctttcaggcatatccctgctgcacaccttcgtgcttaattaatttacattgcgcgcaactagcgagaggagctataactcgctcgatcatgggacaaataaacacacagagtgcgtgcaaaggctcccacctttacgcggggacggcggaggcgacgacaaccgtgagctaggctaccgcggcaccaatctctctcccttcaaccgacagcggggacgattgggtactccactgcggcattctataggacctaccggccgctgcctgaggcgctttcccgtgggacgcctccggtttctaatccaatccaagtgcggagaggggcgagcctttgaacaaattaaatgtccccaaaggatccagcagcaataaacccttaaagagagagccctgctggaagacgacatctaaagcttgtagggaaa

SEQ ID NO: 50575 - DNA, 535 bp, Triticum aestivum; identical to SEQ ID NO: 50539
  unsure (1)..(535): unsure at all n locations
  Clone ID: PAT_TA_50575

SEQ ID NO: 50576 - DNA, 420 bp, Triticum aestivum
  Clone ID: PAT_TA_50576
atctattaactattatatcaagttgtataatcccctcagactcgggaggcgggttgcgagtctcatcgcaccaatgcaaaaacgtgatcaagaaggggtgtaccactttcctaacaagtgctgggccaacatgtacgggtacagcgccaatgctacactactcagaaaaatgggctgagtctggtgaccgctaccccaacataactaccctgcttcttatctgggccgtcaccctacacaggcttctcatcgggggcgtcctcatcgtctacaacaccagcgctctcgacttataagagagcatctacgtgtaacacagggtacggttctctgcttgcatgcacgtactgtgtaatctgcgtaggtacctcctgtgaatgtattcaattaacgattcaaactcggacacgggcgcccaca

SEQ ID NO: 50577 - DNA, 483 bp, Triticum aestivum
  unsure (1)..(483): unsure at all n locations
  Clone ID: PAT_TA_50577
aggggggggggaacaatccaaacaaggggtcaggggtacatagcgcgtgtcggggaaacttatttaaacgagaataacatagcagcattacacaggaacacttttgtccattaaaaaggaggaaggggaccaagcgtggcatagccctcgcttatcacaggggtangaaaactagctagggccaaaagaggtgacgtttcatggggctgcttgctctattggggacttcaaacctcaaccaaagcggggggggcaactcggcctcctccttagggggggggatggggaccagggcaggcaccgggggggtagggccaagcttgcccttgggggcccaggcaagcataatcttcaccttgataccaaaaacgccctgtgctgaaaaaaacggcctaactgcgacatcaatgtgactcgagggacgggctgaccagatgnagaaaaacgtgcccgggcccgtgggtcccacccggggaattccgg

SEQ ID NO: 50578 - DNA, 383 bp, Triticum aestivum
  Clone ID: PAT_TA_50578
ccgggcaagcggggagcttttgggggttataatccccgagataattaagccagacgtgcttacgggcgagaacgacacaacaaaaacacgaacgccacccgcccccagcacgtacgggggtgaaaaaaacagggaaaacacatcctcatgggggcggggggggcaacccaaatcacacaccacgttcccacgtgcaggcaagccccccgtgtgtataaatggggaccgacggggccccccgtaagcccgcgcatcgaatcaggggcgggggccgggcttggggcccccctgcttggggagggggggcgacatgggatcctcgcggggcgcggccttgtcctggggcaggtgcgcctcggggggggggaccttgggggggccgc

SEQ ID NO: 50579 - DNA, 355 bp, Triticum aestivum
  Clone ID: PAT_TA_50579
aaccaattccagggggccgggaaattaaaagcggcgaaaaattcaggcccaaacccctttaacccccacattacaaaaaacccaggctggggacaaaacccgcctgggcgttaaacagccaaaggggcccgaacccaggggaaacaggttccacagccctcggagaaaaaaccccaggaaaaaccaaaccctgcccgcaccccccggggccgggcaccccggaaccaaaaaaaagctccccctcctttcaaggggcccccttggagcgctgccccatctttgcgggctcccccttgagcccccccacccccttcttttcccaccggggcctaaacgggggggggggggcgccccc

SEQ ID NO: 50580 - DNA, 427 bp, Triticum aestivum
  Clone ID: PAT_TA_50580
ccccccaaaaggggagcccaaaaccaagggggaccccccccaaaggggggggcaaaaacaaatggagaatgccaaaaaaaacttttaaattccacccccaaaaggaaaacggggaaccaaccggcgaaaaccaaaaaaaaaaaacccggggaaaaagagagggggcaaccatggcccaaggggggggggggggtaaaaaccggacctgggcgtccaaacgggtctttaacccaaaaaacttggggaaccccaccaaaaaaaaccccttaaaaaaaacccccgggggggcccctcccccggaaccttaaccccgaaagcccccccccccaaactacgcccatcggggggggcaagggaataaaaaaatccccggggcaaaccccttgcaacaaaaccaaacccccggaagcccccaaggcccccgccg

SEQ ID NO: 50581 - DNA, 454 bp, Triticum aestivum
  unsure (1)..(454): unsure at all n locations
  Clone ID: PAT_TA_50581
accacaaattaaactatttaaccatatcatgcgtcccacttacaataccttacaatacctgcgtataccactaagtaaactatgtgcattacatgggcttcttcagtgacaacacggaggagggggggcttagcctttgcgttctctagaggcgttgcgacgaggggggcgaacaccacaaacaaggcatgagtaatgtgctccccaagtggggtacgattaggggggccagcgctgcccttatgcgattggggacatttgccccgctgccagcataatctagtaccacatcaccggccgaggcatcctgaggagcccaggtgggttcaaagaggctagcatgcgtcnatgtgcaagagcctactcttgtggagcaactcccggacctctttcacggggggggtggactatggggcgtgnaatgaatccaacttctccttctccacaccaccct

SEQ ID NO: 50582 - DNA, 379 bp, Triticum aestivum
  Clone ID: PAT_TA_50582
gcgcgccctttttttttttttttccaaggcgagagagcacccttttataatctgggactcattacaaccaccagcacgcgactgcgcacgcgacacacagggagcagcgcacaccacagaacgacgacccgcctaaccacattctaaatcccacgcgggggcgacgaccctggctcagccgccaaagccgtagggggggcggggcctggcgcttgagcgcgtaaacgacgtccatgggggggacggtcttgcggggggcgtgctccgtgtgagggacggcgtcccggatgacgttctcgaggagaggcttgagcaccccacggggctcctcgtaaatcagcccgggagagcgcttcacgccgccccgcccggccagccg

SEQ ID NO: 50583 - DNA, 521 bp, Triticum aestivum
  Clone ID: PAT_TA_50583
aatcgtacaaatttctcacacaccatttatttgccaaagtgctgaaaattgtttcacaccactatgttgaaaaggagacatctatcgaacaagaatctgccaaagtgctaggttgtttgacggcaccatgtagaaaagggacattattgaacaagaataacgagtttatttaataaaaagggaaggcatcgattctctcttcttttcagaaatgatctgatgtgaatgggagagcatcaatagttggcgatgattaatgcaaagccgcccctacaaaaatgattcatgcatagcggctgcatacatgaatcattggtaatcaagacacgcaaaaacatgcaactttgcctaagcagcacaatggtagtggcacacgaaacagtgaacagatcacattatggtgcaagcacccgcttgatcctgctcgcagataacccggtagccgctgtatccgccgcagtacggcgtgcgtgcgccaccgtagcagccggctggcggcggcagcgccacggcggcggtgt

SEQ ID NO: 50584 - DNA, 470 bp, Triticum aestivum
  Clone ID: PAT_TA_50584
caaaactacaaatgtgttgcttgttttatcaacattacaatggtttcaaagcatacatgcccaatctggggcatttgctggagcaaaatcgttttaagcgacgacaaatatcctttatgcgtacagaatctacctttagggcgcccaagacccatcacctgggctcctaactgaaggccccccggcactattaccatcacaaacacagtgggcccatacaattagggcgctacaggaatatgtcaaactaggtgacgagagccaaaagttgaaagaaactttgactaagccccatccaacaaaacaaacacgatatggtgtttaagcggacccgtgtatcgacccccgaatctaagaccgggacctgtactcgtaccaggacttcctatgaggagtggtattacacctcttgggcttcatggtaatcgctgtatcctgcttgaaagggatatccgctcgcattttcacac

SEQ ID NO: 50585 - DNA, 419 bp, Triticum aestivum
  Clone ID: PAT_TA_50585
gttggtggttttttttaagcggataccttctttatctttagcgttatctagttaaacaatagggtctaccggggcgaactcgagatttgagcgccttccatacttcacaagctgcggggagtgcaggagtccattggcgaggtgggggggtaatttcattaccttcgcgagcgagatcgcgcccttcgttacgaggttgggcacaggcgtctaaagccactcgattagctgctgcgccaggggcatttccccagggggtcctaaaggtcctccaccaaattgtaatacagaatcggccccaaagatttcgggcagagctggcgtatgccaaacatgaataccacctgaggctaccgggataacacccggcatgggtacccagccctgagggaaaaagaaccgggagcacgatctttttc

SEQ ID NO: 50586 - DNA, 117 bp, Triticum aestivum
  Clone ID: PAT_TA_50586
acgtgagaggtccaatatcgagacatcgcgcgaaaattcaacgggggcacatgcgtatgggttacagaccatatatgcaccaagagaaaagacactgccccttaccctaaaaacaac

SEQ ID NO: 50587 - DNA, 576 bp, Triticum aestivum
  Clone ID: PAT_TA_50587
ggccgcgcgcggcttgggggcccgtgggggtaatgactggctgcctggaacgctatgattcgcgtgcaccgcaaatcggacccgcagccaccgacgcagcgcgatcctggatgacacaacctcggagacatcttcaacccctggccgattatggcaaacatgatcattcaacatgacctgatatctcaaggtcgtcaaggggttcaaacatgtgcggaggggggtgcagaggcagtctaatattcattgatctgggcaaggacatgctccaggccaagcaaaataagacacagttgggctcaatatcacaaacaacgaccttgaatggcactttgggaacaacaaatgcatactggtatccaactgcatcatgcaaatgggctgggtgggccctgtgctgtaccatataggagacctctccgtgcgcaccaagtacttatttacccacaagagaagaacgcacaagggctacacctgcgatgacatcaagtgagcctaccaatgcgaggcaacaagaggacatagtgggtcgtggctgctgatcggtatctcatgacagcgtacgtttacgctctt

SEQ ID NO: 50588 - DNA, 553 bp, Triticum aestivum
  Clone ID: PAT_TA_50588
ggggtggacagcgatctgctggcgactaacctgacggtcgcggcaagtgcagtccatgtccacgacggagctgtacctggggcggctcgcgaacacagacacgatcctgtgaggcttctctttgccgttcgcttaaggaacgatataatgggccgaccccatcgaatcttataactggacggtgacactgctaggcccgtgcaaagacccaaccaagttgctgacctactacgacggaatgcgattggcttaaccgaggaagtccctggccagccatagatgtccggcagccagctgcttacgtggcccaatgccactcatgtcattacctaagcacgcgagatacactgctgacatacaggccatggacaaactgacgcctaagacgatcaagaccagctaactagagttagcatgcatgagcgcaaccaccgactggccgactgcacacgtactaaccaagacctttgcagaggacaccccgcactaccctgatctgacgatccgcaaatgaacacaaatcaaatcactcggccgcttccatgattgcgcc

SEQ ID NO: 50589 - DNA, 585 bp, Triticum aestivum
  Clone ID: PAT_TA_50589
ctcggccaccattgcacaacgtcaaggccaagtaccaggacaagcagggcattcccccggcccagcagcgactcatatttgctggcaagcagctcgaggatggccgcacgctcgctgactacaacatccagaacgagtccaccctccacctggttctcaggcttaccggtggcatgcagatcttctgcaagaccctcactggcaagaccatcaccctggagggtgagtcctcagacaccattgacaatgtgaaggccaagtatccaggacaaggagggcattcccccggaccagcagcgtctcatctttgctggcaagcagcttgaggatggccgcacccttgcggattacaacatccagaaggagtccaccctccaccttgtcctccgtcttcgtggaagcatgcaaatctttgtcaagaccctcactggcaagactatgaccttggaggtggagtcatctgacaccatagacaacgtgaacgccaagatccaggacaaggagggcatccccccggaccagcagcgcctcatatttgctggtaagcaacttgaggatggccgaaccttggcagactacaacata

SEQ ID NO: 50590 - DNA, 560 bp, Triticum aestivum
  Clone ID: PAT_TA_50590
ggcacgcgcacacgtacaaaactagggcagacgctacgcaaggtggcatcctccatgatcacctcgccgtttgaggggccgacgagcgtgccgtgcctgtccatcaggggctgctccttcagcgccggctgcagcggtggcaagaacatcaaggggaataagcccctccaactctgaggcggcttgacagtcaacatctacgccaacgggaggaaggtgggaaagaagggcgtgtaccactttgttgacaaggacggcgccaacgtccacggctacaggccaatctacactccagaggaatgggctgagtctggtgaccgctacgccggcggaacgaccgggctttttatctgggccgacaccctcgccggcctgctgggtgggggcgtgctcctcgtactacaacaccagcgctatcgacgggtaagagagcatgtacgtgtaacacaggcgcctattctctggttgcatgcacgtatatgctatctgagtagctacctgctgtgaatgtatgctatcaaccatgcaaaggaaatgatcctaaaaaaaacaaaaatagg

SEQ ID NO: 50591 - DNA, 556 bp, Triticum aestivum
  Clone ID: PAT_TA_50591
caaatcaacaagcaaatcccctcccctcccgcgtcccgtctagcaccagcggccagactgccgcctagccaccggaccggggcgaagggaagaaggcgcggtcgggcgcaaggccggcgggcccaggaagaagtcggtgacgaggtccgtcaaggccgggctccagttccccgtcggccgcatcgggcggtacctcaagaacggccggtacgcgaagcgcgtctgcacgggcgcccccgtctacctcgcggccgtacttgagtacctggccgcggagctgttggagctcgccgggaacgccggcaatgacaacaagaagtcccgcattgtgcccaggcacctgctgctggccgtgaggaacgaccagtagctcggcaggctgctggccggcgtcaccatcgcgcacggcggcgtgctgcccaacatcaaccccgtgctgctccccaagaagacggcggagaaggagcccaagtcgcccatgaagaccgccaagtcccccaagaaggccgacaagaaggcgtagagacagacgagcatcgattagcttgtagaacta

SEQ ID NO: 50592 - DNA, 119 bp, Triticum aestivum
  unsure (1)..(119): unsure at all n locations
  Clone ID: PAT_TA_50592
gnaaaatgcaaaggattctaactcccaacagnncttnatnntttccttaaaaaagtaactggtacaatgttctacgtaccttatgagagatcagncagggggaaggtcccagggtgaaa

SEQ ID NO: 50593 - DNA, 516 bp, Triticum aestivum
  unsure (1)..(516): unsure at all n locations
  Clone ID: PAT_TA_50593
agctaatcaagctctcagctccttcccagctccacggcattacagcaagcaaaccgaagcaactaagatcctacgatggctcgcgtggcactggtcgccgtgttcgccgtgcttgcggcactggctgcggcggacatggcgtccggagcggcgacctgctgctacgtgacgttcgacgacgcgccgtgcatgtcctacgcgagggggcaagcgtgggcaccctaggcggcgtgctgcagcggnggtgagagaccctgtaacgccaaggcgtgcaccccggccgaccggaaggcggcgtgcaactgcctcaataacctggcggtgtcgggcatcaacatgggtaacgccgccaacatccccggcaaatgctgggtgtccgtctctttccccatcaacaccaaaaccaactgcaacaaccttcactaagttatctaccaccatcatcatcacaccactctaactagcccactctgtgtatactgtagctgctctctgcgtgtgttcgtcgatggacaa

SEQ ID NO: 50594 - DNA, 441 bp, Triticum aestivum
  unsure (1)..(441): unsure at all n locations
  Clone ID: PAT_TA_50594
aattgatcgccttacaatgatgctgacagattcccagaacatcaagnaagttctcctgttcccggccatgaagccccaagagtagctgtttgcaaacccatcaacagaagtaattttgtttgctgtgctgaggttggaggattatgacatgacaatacaaggaggtttaggtataagctacttttgcgtggaagggttgttgaaaatttgaactccggttaggaggagcagtgaggcatatgaagcaagagtcaggaggagccaaagcgtgctacatgtttgcttgttttctttttgatgaaaaatcaaaatttagtgcttggtattgttatacactttgttggatctccgtgtaacacttgccttgcgtcttatttgtatggaccgctagagctagaggtgccctttcctcttatgcttgtagccagggtatttgttttg

SEQ ID NO: 50595 - DNA, 471 bp, Triticum aestivum
  unsure (1)..(471): unsure at all n locations
  Clone ID: PAT_TA_50595
ggtccggnnatnntcccgggtncgnacnccacgnncgtccggagacggatcgaatcatctggtgagagaacgagccccggcgacaagctgtacctgcaagcacctgatatggatctactgcatcatgctctcgaccaccgccgtcaagctcgccctctgggtctactggaggagcttagggaacagcatcgtgcggacgaacaccaaggaaccactagttcaatgtgatcaccaacgtcgacgatctgatggctgccgtcctgggagacagggctgtgtggtggatctaccccgtcggagccgtgctcctcgcggtgtacaccattgcgaactggttcggcaacgtgcgttgaacaaacagacggcactggtggtgacggagcgctctgagcaaagatcctgctgatgctgacctacctggacatgaaccaccacacgcgcgtgcactagatcgacaacattcgggcctac

SEQ ID NO: 50596 - DNA, 569 bp, Triticum aestivum
  Clone ID: PAT_TA_50596
gacacaggcagtaccagacctgccgccggctagtgctacacgtcgagctagacaacacgcccactacgaggaaccaacgaccgctgccaattcagctcctttatgcaaatctggtcatggatattcttggacaggcgacggccctctgccaatactactcgttaaccggtcggaccatgtcggtggccatgctctgcttaggactgcggccccacactgcttgactgttttgtgaactgcaaatggtgctcatatagccctacaaagacgttccagatgcgccgatgctcgcgaccgacgacggcacgccctgggggccctgctataaacaatgaacgctcatgctcacgacatagcaagttggtaccgaatataataagctcgactgaattgaacagagcgggcgggctgtacatgcccgcggaccacgaaaaacaacaattgtcccatgtatcgcgcctggtatgctttcttctctctccagaaaaagctgttgtcattgatgcccgaataaacacatacatatgaatcagggtatgcgtgtatggtcaatgaaacaaacctcagtt

SEQ ID NO: 50597 - DNA, 573 bp, Triticum aestivum
  unsure (1)..(573): unsure at all n locations
  Clone ID: PAT_TA_50597
ctagcatttaataaaactcacgcagacctttatgtagctcagtggacgcatagcgcatgccattgtgctgtccagtctgcgggaagccatgtcgtacacggtcgacnacggagctcanagaataaggcagggatcttttcccgggtcaccgtagctcggctgagataaacgtgtccaggcagtgtcctcgcaggcatagggatggatcggttcgtgcccagacgatcattgcgttgtccatagcagagaaaactttaggcgactggcttagaacagggtggtcatgacagggggactacagctgtacagagtaacttatgtcgggtctaatgtattgtgctacacctttatatagattactaataatcatattaatcggtggtaatatgaccccacttgtcattgttttcttcccagcaacttgcaagtttgtccacaaatagacaaactgatcatgacgatgaattcttagggttcgttgtggatttatagaaatggcctgctgaagtttataatgtgaactatagacatagatgaaaggcatgacaatggagttctgattaatggctgtgt

SEQ ID NO: 50598 - DNA, 495 bp, Triticum aestivum
  Clone ID: PAT_TA_50598
cggacgcgttggccttgcttgtggtaacgagcctatacatcttcctcgccactcctgtctttgcgcgacagcgaacagttccagcacatatgagtatgggcgcatgatgacttcctttgagctgctgtatacattacaagaagagcacccgccgttctacaaaatagagcctgcctcacctatagaccttaaggtcccatgcggcacctacaataaatatgtagtatctcgaatgactaaatccacactgctcaataacctgatgaactctaacatgctaccgttatttttatgacctaaactcctccgcgttttcttaatgataggcgcaggctccgtggagagcagacccctgatgagcttgagatggaggaaggcgacgagcatcgacgccatgcttggccagaccgtatggagctttcctggtccttacacgagcttgctgcaacctgactgttctatgtcgcatgctaccttaagaacctgagctaaaaa

SEQ ID NO: 50599 - DNA, 601 bp, Triticum aestivum
  Clone ID: PAT_TA_50599
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcgtgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcaatgcgttagcttcattgtcttcaagcccaccggtctgcgaggtatccggcaagggcctaaacagtttactcaccacgggcccacatattaaa

SEQ ID NO: 50600 - DNA, 274 bp, Triticum aestivum
  Clone ID: PAT_TA_50600
agctctgaagagaagcaaaggtgtatattgatgtttaaaataaacactgggaatagaaaagctgagaaacaagggacatgggacctgaagtacagcaaactacggggaaacgaggtgcaacaaaaggctaccaacagaatataatcttcccaccgggcgagagaaaactgcggggagaaaagaacatgggatttaaccgtatagatatgcagcggtggagtgaacatcagacgtacgcctagggcggggactaggatacggaacacaacaaggg

SEQ ID NO: 50601 - DNA, 528 bp, Triticum aestivum
  Clone ID: PAT_TA_50601
agcggctgtatccaaaccagttgtcattcaacagaacatcaataaactgatcacatgggaacgcggcgaatacaaccattcgggcggttaacacacgatacagaaataaaaagtgcaagctaacatacccgaaaattgaataggctggcccaagggctccgcaggcgccaccatctcattacaaatgcacaaatcctgcgcatcgaacctacctaccatcattgcacataatacaaatcccttacggtgggcgagggcaccaaacgaatcaacggcagcccggagcccaacacacaatgctaggatccgggcgcttgaagttactgtgttacccctccgcgtcctcgatcaacctatctaccacctccaggtactccacatttctgcaggccttcaacctccccctcagctatgacgcctgctgttagaagagatggctgcggacggcccacctgacggtgtccttcagcgcccggcggcacaatagccgaacccgcttcttctgccccgcgcgtccagccaggtacc

SEQ ID NO: 50602 - DNA, 331 bp, Triticum aestivum
  Clone ID: PAT_TA_50602
aggggggaaatataagatataaaatgaactgaaaaagttcaaaataagaaccacaatttcaggagacactcagataacattagaaaaacaacacaatataactaaatgaaacacaaccaaataccgaaaacagatcgaaacaaccacagcgcgaggcgaccgtggaccgtgagctgtcaaacaaacctatgggttggaaaggtttctgttttgtctttttctggggagtgagaggagaccactataagaggaggcattaaagctaaagaaactgaaagacggtataatacaaatgaagaccggagaaaaaatagagctagggcaataacac

SEQ ID NO: 50603 - DNA, 250 bp, Triticum aestivum
  Clone ID: PAT_TA_50603
tgtgggggctctaggagcggggcccttttttttttttttttcggaagcaataactttgaataaatgggtgccgtacatgcacagaagggatcttcacagattacagtgtacgtgcatgcgagcggtagacctgacctattgttacacgtgagaatcctatcttagcgcatacagagcgctggggtgtagaacgagaaagagcccctcggccaggaggggggggagggggacagaccacataaaaaaacca

SEQ ID NO: 50604 - DNA, 506 bp, Triticum aestivum
  Clone ID: PAT_TA_50604
caaaagactgagttactatttctccgggatgcatgagatatgagcccacacaaccagcacaagtgacaagaggagagagtgcgaacagggagactacagggggacatcgatccatccaccaaagaagacacacggactacgtgccaaattaggcggaggtgaacttggggacagccttggggccctcggagacggcgtgcttggggagctcaccggggagggacgaggcggacggaggtgttgatctcccgggatgtgaggggggggttcttgtggtgaccggccagcttgggggactccccggggagcttctcaaagatgtggttgatgaaggagttcatgagggacatgggcttggaggagatcccgaggtgccggggcacctgcttcagcaccttgaagatgtggatcttgtgcgtctctacgctcttcttgggcttcttcttccccttcttctcgccgccctccttgggagcgcgggccttcttctacgccttgggcttctt

SEQ ID NO: 50605 - DNA, 447 bp, Triticum aestivum
  Clone ID: PAT_TA_50605
aaaatgtaagaccagagcaccacatccaaggatgtgagattcataggaaccacacaagcatcactcgggcaagattttattggaaaatctactgaaatacttaagctactggaaaattccaaaacagcgcaatcccattctaagctactggagtagaggactgcactctttctattgaatatactcccacatctaatcattcaactgctggagcactggaaatcccatatttcatcacatcaattccaaattgctgggcagtacctaatatttgcacgtccaacccgggggagatctccttgatctggacccactttcttggcggattatccgctatccttgctgggttcctcggcgccccacttgatacgcaccttgggggcaccgcatggtttgtactgaccctaccactcacactcaaggtgaaaaccgatggcatagggggag

SEQ ID NO: 50606 - DNA, 284 bp, Triticum aestivum
  Clone ID: PAT_TA_50606
gcggcggcgctttttttttttttttttttttttttttttcagcacatgtagaaatggggtgcgagtgtattgtgatcttaccatgggcacaaaacatctatttggggagccatttggcctcaacggggggaagcgaacaagggggaatcatccctcacaaaacatcactagccgcagcgagaggcccttcgtaacaggtgtcgacacagggggaacacccccaatatgacctagaaactcccagggagaaaggggatcaacatgcgaaaactcctaggggggga

SEQ ID NO: 50607 - DNA, 530 bp, Triticum aestivum
  unsure (1)..(530): unsure at all n locations
  Clone ID: PAT_TA_50607
aataattcagtgcaccataaggagaaaatgcgctaatcatacatcagacatcagaaccatgaaactacttattcaatcacaccaataattttcccattaactgtgtttcagtcttcctactaatgccgaatcgcttatcccaaaagcacaggtggtaaaagtcataggcttctcccgaagtatcaaaactcgtgcccaatgtgagcactatgacattgtgccctgggattttccgagaaacctcgaattatcttcggcgggacctgtgctcacctgcgaagccgtcagttctgcaaatttcaccaacatggtcggacgatgtggtgtgtggctgcagggggggaccgagtgcanccgcctcaagagccccttctcaccgttgtccttgatgagtcgaacgacgcagcgacagaggagatcgtacaacccgagggagcaagcagaagcatgtggggttagcagcaggacagacgagaagaagaagcgctggcgacaggagaaagaccaaaggggcaaagggggcagagacc

SEQ ID NO: 50608 - DNA, 255 bp, Triticum aestivum
  Clone ID: PAT_TA_50608
acaaacaaaagggatgctaacactctcatctttctttacagggggggggggtcataatcatatggcacaacagcgcaagggataaaacctaaagcgcagcacattatccaatggcggattcactcagtaatatgctcgaccggcgttaacggcaaccggaggcggaggaacacctcgggaaaaacaacacccaacacacgcatagagcaacaacaggagacaccgcgtgggctacctaacctggcccgaggatga

SEQ ID NO: 50609 - DNA, 369 bp, Triticum aestivum
  Clone ID: PAT_TA_50609
caagccacgaccactgagcatgaatggagcgatctatatacatttcccaatcccatgcatgcgtgcgccgtgagcttacaaaggatctaacaggccctgcggcacatagcttaaatatttaccaacgtcaagcacgggggagcttatgtgctgcgcgtaccagccaagctcctgggcgacggggggaaccctttggtcctgggcccctgagagacccatggggggggtgaaggggtaaacaaaggggaccttgggggggacacatgggtaagccacaacgccggggttctttttcacgaggaactccataacgtcccggccgaaaccgccgcccacctcggcctggatgtactggcctgcataaacaca

SEQ ID NO: 50610 - DNA, 467 bp, Triticum aestivum
  Clone ID: PAT_TA_50610
aacaaataaatgtttttttattttatttgtagcatgacgcatacactgatacatttgtttttgtacatgaacgggaaacagagagctgcttttctatggggagaggataaagcataccacggccataacaactacaatggtggttggccgaggaccgcgggccacgcccagacaacccctgactgattatcctaagcgaggtgaaattggcgacccacttgttaccctctgagaatgtgcgattagtgatctttccagggatgacaaggcgtaccgaggtctggatctagcctggacccatcgcgagcgtcttctcagggaatttctgaccgacacctgaaggcacaccacctttccctatacttggggccattataatttgagacaaccatccccaaaaataattcctgtgggaaaatgatttgcggaactattccttccactataagaggattcccattaacagg

SEQ ID NO: 50611 - DNA, 442 bp, Triticum aestivum
  Clone ID: PAT_TA_50611
acacagacagaaatcataactccattgttatggatctcctttacgtacagagtggccgcaatcaaacacagaacgagatttatcgagattcaaagggagccctgagaatccaaatagatgagcaggtcctcttgaccggggcaaaaaaggaaacggcggacgacggccccttaaaaaacagaaaacacaaccccatctgacacgaaggggggcacgaagttattgagggacaggaacagcccaacgtgacgcgtgcttctcgcaccttgattatcaaactggcctacgacacggccgtcgttgatatctatgccaaaaacttttgctggaccaaccccaccaaatcctggacagccgctaaacttttctaggaactgcgcaccctaaaaacctgttatggcacgctactgacgaacttcttcatggagtcccagctacagac

SEQ ID NO: 50612 - DNA, 507 bp, Triticum aestivum
  Clone ID: PAT_TA_50612
ggggcaaaaagacgatatccaagcgtatatatatgctcaagtacaaatagtgtcattgactaggtgtgaaggggtccttatttggggggggggagcacacaaaattggtgggaagtgtacatgggggccatcaccaccaccaggttgaaacaacaaactttacaagcgaccggcttatttccgacctgggatttacacatgcataattgcgcacaaaactccggattgcggcaaaattcacataaaaatttaacgcaggaggagtacttacaactacaggcatctttggcctaaaagaacacaatctgggaagcataccggcgaaaacaccgcactcagggtagggggatcccacatatgcaataaaaagggggaaaaacgcaagaagtccatctaggtacgttgtgttcattcaccaaaactggtctggaagcaataaaagaggcgagtgccatcccctgtacagcaagaacagggagaaacggcggttcaaaacttacacaactt

SEQ ID NO: 50613 - DNA, 422 bp, Triticum aestivum
  Clone ID: PAT_TA_50613
atattaattactttattacaattgtttgaggagcaaccttcttttgaagcaaaaaaatggaagcaggcaacgggacaagcatgaagacatatgggcgctgagaacgggaaccaggggccatacaggaccgtgggccagggcgggacacacacttgctgaaaggccaccacccaaaacacgcacactcacagaggggagagcacacatccaagggctgagcacgcaccttagctagagcgatgatacaacatgaagcgcataacctacacgagtagcaatagagaaccagttaatggaaggatcgtagatcatgcctgcgaccgggtgtacgcatgcatgcgcttacccacccatacaaaatgccttctgtggacgacagatctgtcgccccatataatccaacgagggcactgggacccgga

SEQ ID NO: 50614 - DNA, 440 bp, Triticum aestivum
  Clone ID: PAT_TA_50614
gcgaggggagaagagtgtttcattattaattacccaagaacataggcgagagagcgtgtaatatattatgcgcatgtgcatatacatagcgcccgagagcgttcacataccaacacgctgtttcgagccatgtggtgacatgagacatgggcatacacatattcttacgagacaaggaataaagaaaaggggggaggggaacccaaagcggtgagctaggtgacaaaactgcgatggcactttatctgtggggcgggccgagcgagctttgtaggggttgcccgactcctcccagccctggggggtgagagcaccaaagctaacccactgcgcctggggcatgagaacgaatcctatgatccgaacgtgcgccttaagggactcattcttgacctgctgcacctcgtggatcacctgcgtggcgccagtgcgacccaaca

SEQ ID NO: 50615 - DNA, 408 bp, Triticum aestivum
  Clone ID: PAT_TA_50615
actggggagagggctagacctaaatcaggggaacatgggggttactagttaggcttaccaagtgttcaaaaatctacacacaggaggcgacattaaaagtctagaggggaccggggaataacacaatatgggggggggattattagtgataaaaaagcgctcaaaaacattggaacaaggggtccggcctaaaccaggcaaaggcgtttccatgtaaagtgagaccaaatgatggggggtgtggtactctgggccccggggaggcgcatctacacaccacggcccttgtgtgaggtgagacttacttaccaaaagtcgggggcgcggcttccctaccgtatccacaacgggcgtgctgatgaaggggcccttatgctaaaactgttctgtagctccccgcgcctccca

SEQ ID NO: 50616 - DNA, 443 bp, Triticum aestivum
  Clone ID: PAT_TA_50616
ctcgttcaaaactcttttatattttcctcgatcgccattcgcattaataccttttgcaggcattgctcgccagtggagctcctattacgggtaagaatggggctgccggtcccaaggaatgtggcctcatctagaagtcggtgacactgtccgtcaagacgtgctccacttgcccgtcctccgggatcgggccttacctcaagaagggccagttcgcgcagcgcgtgggcactggcgcccccgtctacctctgcggcgtcctgtagtacctcgccccctgagttttttgatttgcatgcatcgcggtgatagacaacaagtatacgcgcatcatccgccgccatgtgctcttgtcgattcgaaccaacgagcatctccgtaagcttctggcctacttcatcattctgcacgtatgctttctcctcaacatccactgcgtgtct

SEQ ID NO: 50617 - DNA, 506 bp, Triticum aestivum
  Clone ID: PAT_TA_50617
gggcccagccaggacagtaacatcgacacatgagcgccacgactgaggatgggagtgctctcatgcatcactctcgtccgcactgctggagaggactagagtgccgtgcctgtctgcccgggactcatccttccacgatggctgccctggggggaagaataaaaggtcgatgagcccgtgcatctatgaggcggcgtgtcgggggatatagacgccaaaggaccgggacgtacttgagaagggtctgtaccagttcggtgacaaatacggtgcccatcctagacggatacagaccaatgtacactgccataggaatagactgggtgtggtgaaccgctacgtcggcagaaacgaccgcacttcttatatgaggcgcaatactcgactgcgtggtagttggctgtgttctgctgctctacaacaccataggtgttgacagttaagagagaatttacgtatagaaaagagtgccggattttgcttgcatgcacgtatatgcaatctgc

SEQ ID NO: 50618 - DNA, 539 bp, Triticum aestivum
  Clone ID: PAT_TA_50618
acggtctcgctggcagtctaccacatatatgccatcgtttgtgtactacctctttgtattcgatctacatgaaggtcccatgaaacaaagggcatgcccctgagagtcatcacccagttcttctatgtcggagcaaagcgtggcagggaagccacaggctagttactctaatgccggtgatccgcgtaactagtggtaatatagtggagtcataactactactacactgtttaacctgcgatgctttgctgaagaaacttcaacgaggacaggtacggaagcactctacatcatgaggctgtattgtgtcatgctgaggccggctttcgaaaatctgatctgtacttacatcatctcctcttttagatttggaactatctatacgtgcgatccagaatttcttgcccatgagactagcgatgatatcacaatttatgtcgcctatgatatcaccaatttcacctcctgctggcgggccctgtagtagatgaaagcttctatcctcgaacaaccgacgtcaaagtttttttatctggtca

SEQ ID NO: 50619 - DNA, 418 bp, Triticum aestivum
  Clone ID: PAT_TA_50619
gcttcctccttctacttcacacgcacggcaagcaacaaataggcacccaaccgacccctccgctaggtgcagttcatccgctccataccgtgtctattaggagtggacgccaacacacacaggcgcttatataggtggctatatttagctacagctacaacagagacctgatttacaagcatagcgagagcagatctttgacgatggagcatacatactgcaaccatgatgaggacgctgagtggagtcgctctagtactcgtactcatcgtccgagagcagcagggcaggcggagcccgacgcggtgctgtgcgcgcctcgcccgcgcatggtccatgcccagcagtgcagcgccgactctgatgctcagccctcctccctttcttttaaacgcctgctacggcaacaacataaagc

SEQ ID NO: 50620 - DNA, 585 bp, Triticum aestivum
  Clone ID: PAT_TA_50620
cgtcacatgatcataataagtagcgtcaaaagcacaactttcagattagggttcgtcacaagatgaagcatctgaaccacacgttttgtcttcagctgattcgcctgaagcatcaaactccgaagcgccatgccctgcagtaccagcgaacaaggagaggagcagtgacctcgttgacaggaccagttcgttcggggcatggctctctccaatgtagcctgttgtactgatgcgtgtgaaaacacaccagacaatactgatggatcttccagccatggcacaaacaaggccgacgagaatgccaacaatgcgacaaattctcgtagcccccttgtcgacttcatcgcctcaagggtcgaaagctcgccgagcaagctatctgtcaagaagcacagtgacccgttaacaaaatccttccggaacatggctaagaagctgctgcttgagtatgaatcagcagagaattttcgtaacagcaatctagtgcattctgaagacgtaccagatccagatgaagtagcattttacagcaaaaccaccaaggacactcaccaagacgcggcgacctcggagcaatccgacgat

SEQ ID NO: 50621 - DNA, 573 bp, Triticum aestivum
  unsure (1)..(573): unsure at all n locations
  Clone ID: PAT_TA_50621
ggggtatgcttaacacatccactgcgaacaggtagtggtgtgaccagaggcgatcgggggattcacacataccaacctgacctgtggtaggggtaacaacaggctggtaaaccagtntgtctatataaccccacaaggcatgacgagtcaaaaggcgcaaatactcacacagaggggctgacctacttattagctaccaggtgaggtaatagcttactatggcgatgatcacaaactggtccgagaggatgatcagtcatactgtaactgatacacgcgccaaactcctacaggaggcagcgatggggcaattttcgcgcattggagcgaaatcctgactcatcactactactggctcatctacggcgccaacgtgcagaaggcgatgcgcgggctttcaattacatatgctgaacactatgagaggcttgtaattaccaacattaacctcaaccgactatgtcaaacctatatatgaaaaacctgggtgaacaactcaaataagtcaagggactgtgaagacgacgaaatcaccaatgaacatgacctattgaaggaatcttttaccatatt

SEQ ID NO: 50622 - DNA, 538 bp, Triticum aestivum
  Clone ID: PAT_TA_50622
ggttcggaaaacaattatatttttaaacaagtggaagcagtggtaaaattgagcaaagtgattcgtgagctgagccgctgctgcctcccgtcctctcctctctcccacgccgctccttctcaaaggcgggaggaaaagagggcacggcgagagagataaacccccgaatccccaaaatcagagcgcaggggtaataaaaccgaagcggcagatacaataagccgccgccaccacgccaccgccgctgcagaaaaagccgagcagtcgcacgggggaatcgcctcgcctgtggccgcggtgggttggtgggtgccgtcgcctcctattctcaaccccactctccaatctccattaccacgcctcgcctggatgccctctcgcttctcccccactccacgcgccgatccgccagccaagaaaccacgaggcgatccagttgaggaggaggaggaaggaggaggaggcgaggtatccgcgctgactctgccgcaagctgcccccttttatcgctcctagccaccagccctggccacgctgc

SEQ ID NO: 50623 - DNA, 609 bp, Triticum aestivum
  unsure (1)..(609): unsure at all n locations
  Clone ID: PAT_TA_50623
ggtccggnnnaattcccgggtncgnaccccacgcccgtccgcaccgacccatgncaaagaacacacacaggccgcagggcacagacagcagagacaggcagtggagaacactaagatggcggcggtggcgatcctggcggccctgctgctgatagcaaatagagagccggcttccgccacgaccgcccaccatgctgacagccagataaatgcagatgccttccctgatgggatgtcactttggcaacaaacaaatctggactaggctgccaccatgcgggctttgcatgaaaaagactataggatggtcatgtaactgcggaccaagatatcctgccagagtgtgctacggcacgcggtgtgaggaatgaactgtacctacatgacccatattattactagcttatcacgcatctgtgtcacacataaatcctgctctggggtccatccctagctggttggttatgaacaacaggctctaccaaacgattgagactaacaataaggtatacagtactggcaggtacgtacatgacatgatctaaccactactgagacccccagcacctagagggacataaattaggtggctggcttcactcactatag

SEQ ID NO: 50624 - DNA, 500 bp, Triticum aestivum
  Clone ID: PAT_TA_50624
tctccccgcgtccgaccgaccaactggcagcgtctctccaagccgcggccacgctgatgccggccaagatcggcggccgggcctcctccgcgcgaccgtcgtcgcacgtcgcccgggcgttcggcgtcgacgctggcgccaggatcacctgctccctgcagtccgacatcagggaggggggaggcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcatgtacgagatgaagaagttctgcctggagcccacctccttcaccgtcaaggcctgaggctttcataagaacgagccgtcggccttgccgtatgaccagctcatgacc

SEQ ID NO: 50625 - DNA, 528 bp, Triticum aestivum
  unsure (1)..(528): unsure at all n locations
  Clone ID: PAT_TA_50625
tcatcctcgnacaccaagctcatcttcttctccttgaaactttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacct

SEQ ID NO: 50626 - DNA, 527 bp, Triticum aestivum
  Clone ID: PAT_TA_50626
agcgcaaaaatttcatatatatctacatacaaagtgtcaagacgtttagatcgagagaaaaaaaagaatgcaacctttacaccagtagaaaaataccagatttctagacttacaaataagcacattgggattgggattcaaagattgtgccctgctggttcgaggctacccaacacatcaggaatgaaaggctggaaggcatgcattgacatacaccaactaggcttgatctccctctaccattctcagttacaagtccttacccaccctaactttattgtaccatgaatgtatctcctacgttttgagatcaacatctacagtacaacctttgtaatcagtacaacttccttacaaaaacgacgaaagtaacaacaacaacaacaataaccctaaaccatggaacgtatatacagatgcttgcaggacatagctactacttactttgcacatgaaattctacgagtgtatattcagtcgtacgtacgtggggagggcgtcctatttcacagaggtttctgctaaaa

SEQ ID NO: 50627 - DNA, 566 bp, Triticum aestivum
  Clone ID: PAT_TA_50627
cccagcgtccgctattttaactcttaaacttagccagcagtaactatccagagtagttcttcaaagctctatcgacacaaccagagtagttcttcggagctctatccagcctgacatcaaagggagtcaagtatcgcttcaactttctatcctgcaacagataattaaagattgtcagaaggtgactggtcgcgcccgatctaggtaaaatcttcgtctgatttttggtccacatgacgatgatctgttttttcgggagtttcttcaggatccgctcgtgtgccagagccgactcaggatgccttcctcgacgacgacgaaacaatgaagcttgaagcgagtggagctccgaaggtaggatctcagggatgaaggaggcgtcggcgacaacctcagaaaagagtggcaggggacagggggcgcgcccgtgctggtgctgtcgctaacgctccacctggacggcagcgattgggagctgccttggggtactacgtgttggaggacaacggcgtgtaggtcatgtgcctggtgctagacatgatggcggggaccaaaccgtcatccgc

SEQ ID NO: 50628 - DNA, 586 bp, Triticum aestivum
  Clone ID: PAT_TA_50628
gcgggtgctacgagctaatacttactagagccaagagtggtccgcacgtggaaggggtacgagcgcccacatccaggacttcattacaagggctatagagtgcaccgcgggcactgcggcatggcggcgttccaacagctctagcctaccgagcgacatgtaacggacggaagcgatcacgtgtatgcagcgcgctgaccatccgagggcatctagtaggctcagaccttgtactaaatgcaaccgatcagcacgggggccctcctgaaccaggtacgactatctgatccggttggatggacagccttggcactgagaatgagatagggtgcggactagattggttctgaactacagagctgctgctgggtacaatgaggggcgttactggacaaagtaataagatggctatcgttcggtgcaaccgacgccacacaagtgatcagcgaggcggatgaggggaagaaggattaccctgacgcgcatgcgcggataatcggattctataacgtgcgccaggtgcaatgcagtagctgcattgtctaaaagccaccgggctgaaaggagtgcggtaaggcataaaagc

SEQ ID NO: 50629 - DNA, 568 bp, Triticum aestivum
  Clone ID: PAT_TA_50629
ccacctcctcacgcacacctagacatcttagctccggctaggtagctagcaatgggcggcgcactgagcctccgagcgcccttctccctgcgcgccggggcgccaccggcgccccgtgtggacctcgcgcccgcggccctcagcctcgccggcgtcaagcaggtgcggggagccaggctccacgcccaggcgacgtacaaggtgaagctggagacgcccgagggcgaggtggagctggaggtccccgatgacatgtacatcctcgaccaggccgaggaggaggggatcgacctgacctactcctgccgagccggctgctgctcctcctgcgccggcaagttggtgtccggcgaacatcgaccagtccaaccagagcttactcatactacaaccagatggaggcaggatgggtgctacacctgccacgcctaccccaagtacgacatcaatatcgagacccacaaggaggaggagctcaccgcataagctgatttacctatctgtctttgcaaggatatatgacggaccctgagacctgtgtaaaccctgagagctgattttatgcatg

SEQ ID NO: 50630 - DNA, 582 bp, Triticum aestivum
  Clone ID: PAT_TA_50630
cggtcgcgtgggttttttttttttttttttttttttttttttttttttttttttaaaattatgcgtccgggcatatacatagccaccgttggcattcacatacgagcatgctttttcgagccatgttggtacatgaacatggacatacacatattcttaggaacaaataagaaagataaatggagaaggaaaacccaaagcaatgtcaggagttgacaaaactgcaatggcactttatatatggcctgtcgtgagtgagctgtttaggccttgccggactcctcacagcccgggggcttgaaggcgatgaaactgacgcactgcacctgacgcatgttgtcgaatccgatgatgcggacatacgcgttagggtactcctttttgacctcctccacctcgttgatcacctgtgtggggtcagggcacccgaacataggcagcttccacattgtccaataccggccatcgtagtacccaggaaatgcgttgtgctcacggaagatgaacccaaccttgctgaactcgaggcaaggcacccacttggagcggatcaggtagtcgacctgcttgaggagggcctcc

SEQ ID NO: 50631 - DNA, 499 bp, Triticum aestivum
  Clone ID: PAT_TA_50631
cacaagctaatcacagctctcaactgcataccacctgccggactcctagcaagcagaccgaaacactagatcctcgatccgatggctcgcgcggcactgctcgcctagttcgccgggctcgacggactggcggtgtacgagatggggtccgctgcggcaacctgcaacgacgtgaccagcgccgcatgcgccatgcatgttctacccgaggcgcaaactgctgagcaccgtccatgagagctgcagcggtgtgaggaccctgaacaccaaggcgccacctgagccgaccggcaggcacatatgccgctgcctcaagaacctgtacggccttggcataacactggataacgccgtcaacattacgggcaagtgcggcgtaatcctgttctataccaatcaacaccgagtctactgcaacaccctctactacgctatcagccagcatcaaaatcacaccaagctagctagcctactcagggtctactgttgctgctccctg

SEQ ID NO: 50632 - DNA, 587 bp, Triticum aestivum
  unsure (1)..(587): unsure at all n locations
  Clone ID: PAT_TA_50632
aggggggagacgaacggaacagagcggcgaccaccaggnacctcggcggcggccacacccaggtggaccgccctttctaaaatacctagactcggctaccggagagcggaactgtgcccgcgagatgggaatggaggagtctgcggggggcgccgcgaggcaggcgaaggagtcgctggagctggcgttccagatgtcccagatcctggacaccggcctcgaccgccacaccctctcgctgctcatggcgctctgcgaccgcggcgccaacccggaggctctcgccgccctggtccgcgagctgtcctccactgctcccccgtccgccgctgcccccaccgcgcccgcctccaacgccgtggcggcaccgaccgccccctcgctgttcccctccggctttcggcagctctaggctagggtaccgaagactggacgcaactgaagttcttgatttgaagtcgaaccaaatctgatacttggcttgctggaagagcctgatgagctttggtcgtgatgttgtttccacaagaaaaagttgtggttcattgagttcctgtaaattggcatctttctttgcttgacttggc

SEQ ID NO: 50633 - DNA, 477 bp, Triticum aestivum
  Clone ID: PAT_TA_50633
gctgttcgtgccgacgcctacgtaggaggtgagcggaatcactttgggccgacgtctccgtagtatcacaatcaacggataagtatggtatacgcaggttaagctcgctgtggtgggtcagagatatggagccgcactcgttacctggggtataggtagactcaggaagacagtgaattgcctgggagagcatgaccgtcttataatgaggaacgtataaggccctgttctggagggcgacttactcaatcttatacagtctgatcagtaggctaagatgatgtgctaacaaatttgttactttataactgtatgtgttgggaagaataaaggtgtactgttgccttcttagtctactgatttccttatttgtctatctatgtggatgagtaaagagtattgttctgttgtctaaattaaagtgcacttgatgaagtgagaattgatcatttttgtggacttattggtaatgtgaaa

SEQ ID NO: 50634 - DNA, 560 bp, Triticum aestivum
  Clone ID: PAT_TA_50634
actgcatacgcaaaacagacaccgggctgaccggggggcaggcccgatcaacatgcgcatggacaacgggacagactaggcggcagctcttcttctacaacctccggagacgagctcgaccacttccagtggcacctggctatgaacaagcacgtactgggaccagctgatgaccctgcacccgagtagtcccatatggcgctaaccttgggcacacatcgggtgcaacggctacaccgacgactacgtagccaacgcgctaatcaactagctctggtgcgaccatgtgcatgagccttactactataagaggctgcataacgtgcatgagcgttcatgtgaaatctacggtcccttcggggtctacgcatgcaagcggatgaagaacgcctgtaattgctactcgataataacccttcctggggaggacaaaggacatgcccacagacacctaattcctctccgcaggggcttcaagaatacacaaactattgccgagggccggcaatgtctgtgaggcataatattgacacgtgatgacatctatgcgtccaaatgtt

SEQ ID NO: 50635 - DNA, 484 bp, Triticum aestivum
  Clone ID: PAT_TA_50635
cattaggcgcgtgaaaacggcgagaccccagcgaccaggagcgcaacgcaagagtagaccatgctagcctcgccggcgctcgccggcgccacccactacttcccggccttcgtgtcgggcaaacaaggcatgcacctgccgtccgtgtgacgcgccctcaaactcgccggcgcggcggaccgccctggtcatgctctccaacggcaaagtgtccacacccaatgccgaccgtatacaccaacacaaccgcctcacaaagtagggtaccggcaacacagagaggccaatactcagagtgctacgcacaaacaagcgtttgaagctcaggagagcgacgagacaaattgacgcactatggcttaagccgcatacaacgcacaaagctttttcaaaggagctagaatactttgccaggacaacaactgaaatggtgcaaaatatggtgaactgactgccaacatctgccttgtagaaaagaaacacc

SEQ ID NO: 50636 - DNA, 541 bp, Triticum aestivum
  Clone ID: PAT_TA_50636
cctagccgcctagcactcctgcaggagcgcacgcatgcgttcaaggccttaatcctgctggctccactcttttcagctgttatcctcggcccctaacctggcgaaactcagccagcaggcggacaaacacgtcggttaataacctaccgcacattcgaacttgctgccacctatggccatatcctcagctacccacaacacggacggctaaaaaggcggacggtaccaaggacacttgctactacgtgggtagagccaccaaggccactgaaggagaggttgcaactacccctgccactgtcgttgctgcactcaaagctacctctgacacgcttaaatgcggaggctccaatcgtgacaactgcggctggtgttatcacggcctacaaggctgccgctgctgcgcgcgccccgtcaacatacccggaccccatgctccgcgcggaggttcgcgcctgagcacactagatgcagctatacgttcctacgcgtgcattcaactatacatgatggtgttcgccactctgaacacgagcgtata

SEQ ID NO: 50637 - DNA, 427 bp, Triticum aestivum
  Clone ID: PAT_TA_50637
gccaaataggaagaatttcgctgcaagtgataccaacatacaccatgatccatgtgttcggatcaaatactatagcatacagggattgcatacattctcagggggtatagacccaacatacacatactcgaaaaccaacatagacccatgcccacacttaaacatgtaaactcaaataaatcctcgagagcactcagctagtggacgacaagagactccgcccacaaaaaagcctcctagggggagggcccatataataacccggtaaggcctccgacaaacctgtcaccagactgagcacatagctatgaagcgtacatagtgctccagccgcaaattgtggcaccctattagtcaacaaaaagctgcacggcattctttcttaacttcctcccattcgcgtagcacccgagtggcaagccggctc

SEQ ID NO: 50638 - DNA, 148 bp, Triticum aestivum
  Clone ID: PAT_TA_50638
cagaacaatgtagctgttacaatagagcctttcatttttaagactttgaggcattaaagggaagtgtgaggattatttatccagataacaagacccaaagggggataaatacacgagaacagggaaatgtagaaggggaacaaaagca

SEQ ID NO: 50639 - DNA, 411 bp, Triticum aestivum
  Clone ID: PAT_TA_50639
aaacaactaaatgggaaacagtctagttacatgggccacaaatttaaatacacacacatgggagcgccaaagcgaaaagagcggcttagctaaatacatatactacttcccaaagcgcggcctgcgcacgactacaattcaggcctcaccatgtgaagtcttccgtgtctgcgatatttgagggctctccaccaaaacatcggaggggaaccagtgcagtagtatttatgacaccacaaatttaccgccagcgactcgtatcaccggaccaggacaactaggccctgggttacttgccctggtttgccccgacaaagaagaactccaggagcacctccaggggatgccctttgtctcacggaccttcatgtaaaccaactcaaaggttaggacacaaaccctggcatatat

SEQ ID NO: 50640 - DNA, 493 bp, Triticum aestivum
  Clone ID: PAT_TA_50640
atgaatgtacacactcatttatttcttacttccttccacactctcatttacaaatacaaccatggatacatggtggggcgatgaacacgaccatggcccaccacaactgcacaagccatctttaacgatcatatcggggaaagaaaaaaccgacccttcttagcaaaaaacacacactcatgatatctacagtaacacttgtctgacacaaactaactggtggaaaaacaagtaaacatacaaaccctctactaggagcaatcctctaccagtatgctgctgctgaggatcattttgcttctaatactctgaattaaacttacttagtctttatacgaccctcactgcccattggatggcaattcatacacgtaaacccgtgtgggagctataccagcaaggaacacacgtcgaaaacggtggaaccaccaaggccctaggagcagtacgcacataaagacatgctggccatgccgaaaatgcacaaggtggg

SEQ ID NO: 50641 - DNA, 519 bp, Triticum aestivum
  Clone ID: PAT_TA_50641
ccattggttaccattaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaag

SEQ ID NO: 50642 - DNA, 405 bp, Triticum aestivum
  Clone ID: PAT_TA_50642
atagcaccttcaaaatattgtagtcctttttcatggccctgcataatcatagtgaagggggccatgtattaacatccaaaacaattcaggctcattatcatcatggatctaaaaacaaaccagctctaaacttttcacaaactgcaactacagaattatttacacaaaagcctgcttacagatgctttccagaatgagcaaacgccgtcctcatacttatctgcaagccctagcgggaaacgacccaacataattattccggagagcggggctcaactgcacatgggaaaaatgaacatggcatccctaaagataagcgctgccgtttggttcccatctccttcctgggactgcaaaccttcccgccggtccaaacacgagaacctagtccattaaccccttgtg

SEQ ID NO: 50643 - DNA, 113 bp, Triticum aestivum
  Clone ID: PAT_TA_50643
ggggtggccttgcaaatgtgcttttcataaactcctgaataacacattatagtgtcttgctattccacaaacaaatttgtggtcgctttataggcagccaagccaaataaagc

SEQ ID NO: 50644 - DNA, 550 bp, Triticum aestivum
  unsure (1)..(550): unsure at all n locations
  Clone ID: PAT_TA_50644
gcagtcggtgcgccagnacttggcgcacgtcgtcgacgagcacgaggtcggagtccaggtagatgacgcggcgcacgcagggctccaggaggtgggcgaggtagttgcgggcgtagttgagcgggtcctccagcgcctgccgcaccgacgacgagatgagcccccggacgcgcgcggggtcgaagtagtagactttgaaccggagctgcgggaagacggcgcggacgaggtcgcccaggctcgggtcggagacgaggaagtggaagaagacgctctccgggcacatggcgtgctggaccacggaatggaccgcggcgaccgagcccctcaggtagccctcgtccagagtaatcgcgatgtggacgagcgaggggtcgcagacattgccggtggcgttgccgcagtcagcggcattgcggaaggacggcgcgcggcggaaggggaggcccctcgcgcccccggcgatctggccggggaagcggacgtggctgtcnaactgcgacgaccggatggcctcggcgggcgggaaggactgcancgacggcgacaa

SEQ ID NO: 50645 - DNA, 422 bp, Triticum aestivum
  Clone ID: PAT_TA_50645
gaaggctgcgataaattagactataatagccattatgatgatagacgaatacaagactaaaagggacggggctcgaagctaaataccttctcacatgctaacacacacattcacgagtccatccccacgaagaatgacgggaaaagcgagtcctaggaaccaaaacttaactcaaaactgagagctacctaatattcacaccacaaatggcacggcgtgacaacaacatataagctaatacgcaacacgtaccttcaagccacgcgttcaaactaaaacccttgatacttgaacaggagcttggaaaccaccagcaacaaactagggatagaactcaacaaactagatattgagacacaccagcgccatacgagtaggtctaaataagacacgaccgtgcaaggggataccacacactgctt

SEQ ID NO: 50646 - DNA, 471 bp, Triticum aestivum
  Clone ID: PAT_TA_50646
atcatgtgaactgggttgcttttcgaaaaccactctctagtgaaaagagagcgaatgtaatcaacacttcaaactccaagtgtgaccgcttgggataagcgggtagctatctaaaaaacaatcaacaactcaaaaaaaaaactccaagtgtctttacaaaagaatgcggttccgctgcaggggttcactttagttaatctgagggggcactcatcaagggcaaaatattctctgtgtgccgaaacacccctcggcaattttaattgcccttcaacttctccccgaggattttgtgcaataaaacaggacttgctttacctttcgaggctttcatcacctggccagcgaaaaatccctgcaacttgggtttcccagcccgatactgctcaaggtgcttcggattctcggcgagtactttatctaccatggcctcaattgctgctggatctgctatctgaaccaaatctttct

SEQ ID NO: 50647 - DNA, 398 bp, Triticum aestivum
  Clone ID: PAT_TA_50647
atgatacacagttgccttacataaggggaaagcatttttgctaactacatacgcagagaccatgaacaagcaatatacaccgaaacggaaactgggtcaccacctgatattacacagggacaaaaatgagatcaggcaataaaaacaaacattctaaagggaggaaacctagcgggctctgtttgatacaaatgcgggcccagggcaaaaataccacaccttactataacagaccacaagtacctggactaccaactccagcaaatagtggctgacatgttccagacaaagaacgatccggcctaataaaaacagtggctagggcgagggatgaataatcctgtagggaacacattatataatatttcaattaaacatacagcaacctaacaaataat

SEQ ID NO: 50648 - DNA, 528 bp, Triticum aestivum
  Clone ID: PAT_TA_50648
ggttaccaaaaagaacggatatcagcttacatatattgtgtaaaattaagcgaccgactatatccataggcaccgaaagagttcaaacccgagcatgctacacatacgccacggggcacaagagacacatccatacacaacaacttaggagcaaaacccaagacaaacggggaaagaaaacccaaatcatgtgcagagggcacaaacctggaagggcgctttatataagggctgacgaaagtgagctgtgtaggccttgacaggactcctcgcaggcctgaggtttgaacgcaactaaactgacccactgaacctggcccatgtgaactaattcaataaggcctgacatacgcggcagggtactgcttattgacctcaaccacctctgggataacttgtgtggcaaacgggcaccccaacatacgcaggttccacattgggcattaccgaccatcatatgacccagggcatgctttgcgctcacggagagagaacccaaccttgctgaactatgaggcatggcaccca

SEQ ID NO: 50649 - DNA, 528 bp, Triticum aestivum
  Clone ID: PAT_TA_50649
ggatgtcatacatatacgtactgaatatatgcgagacacaagccacattaccaagaggtgcgcaaaaatgtagcacgtcttacaacaccaagggcgcttttaatttacgctgctcaacaaaactgattacacctttcacataggtaggcagagaaggaaagcattgcactaataatgcaacagcacagcattcttcttcccaagacagaccggtataaaggaagaaattggttagctcaggctgatatcctaccgctcaaactccttcagggtgaggatttcgccctcacgaacagggccctcgccgttcctcatcatgagactgctctaccgcatccaggaacttgactatcacctgggatacctgacccctttacccgttgcggtccataaccttatacaccaccgctagcttaaactgcgattccatgctatttcccgctgcttatgagacgacagactcaggggtacaagctgcttttgctacaacatacgctagactgcacattcatagaggcggactcattg

SEQ ID NO: 50650 - DNA, 430 bp, Triticum aestivum
  Clone ID: PAT_TA_50650
attgtgaataagcataaatccaacagtaatgcttgatatacattacatactgcttagagaggggcactggcctcacataccataaacaattatgcccctatctgagcaaacactctgccggaaaagacatgggctcctaacctaagccttgggagcctactttctcatcgggcgcaaatcttctcatgcttcttattcctcttcttgttcaaaaagagctctatctcagacagacacctgcgggtaccgcatgatcttcatttaagcaatggtcacgcgcacaatgcttgttcttttacgcatccctgaaggccgactcctgattttgcgagaccaccgccagctccctccttgttaatgtgcacaccaccttgctcatgctgagaatgtggctggcgccgcctgtgaccaatgtcgacgcgcaatgagg

SEQ ID NO: 50651 - DNA, 366 bp, Triticum aestivum
  Clone ID: PAT_TA_50651
gagccaacaaaaatgtgcaagcgggggctttaacaaaccattgggacatattcaacaaataaccaagacccagctacatctcctatgtagatcagcacctgctttaacccacaacagacctgtgccagacccgtgcagacatcactcggcatacaaaaccaaagccccggcgttacacgggcgcgccactcatcatttcgctgcctgagctgacagaaattgctcggaccaccgcccactccaagagggacccaaggggagccaaaatcgcgttgctgcagccggccactctggaggacggcccagccggggagaggccccctgccagggagcgccgccccctcggcaaagcccgggagggcgacc

SEQ ID NO: 50652 - DNA, 362 bp, Triticum aestivum
  Clone ID: PAT_TA_50652
gttaaaggggcatccgggctcaaataacagaattacattgcgtacgggtggacaaaatgcaaccggagagacagaaaaccttatttaggggaggggggttcgacttaataaacaccccgaggacttccgcaaagagataaaattactaaacgccgtaagaaaagacaatggcttccgtctctccactaaggagataaccctaaaataggagaccaacacgcgttatatttccaattccaggtctagggattacctgctgagcttcctaaaaaaaaccaccaccggcaaacgaccctaaaaggattactttaataaaacacaggccataaatatcatcacccacaccatgtgcctcttccatt

SEQ ID NO: 50653 - DNA, 286 bp, Triticum aestivum
  Clone ID: PAT_TA_50653
gaggggggggagaaataagcacaactaagggagttggggggacatatggaataagccctaactggacatgggaatttgagacatacatggggaacatatttaaaggggggggttaatacatacaagagacgaggggggggtgtgtactccaagacactgtgcaaaggggaaccgggctctcgtgcgtatacggggtacgtgcgcactttatttatcagagaccatatttaccaagaacttactatacgcacgtgtgcggattgcaaaacaacatcacctaacagag

SEQ ID NO: 50654 - DNA, 371 bp, Triticum aestivum
  Clone ID: PAT_TA_50654
cttaggacgagaaaacaaaacatgggggaacattggcacccaacgagctctgacggctgaaaattttctggttaaagaccaacctacaataagacacagggacgatccttaagcaggacaaatgcccatccacagtatctagacacgaacatgctaaagcgcacaccgcaaatgaaaaccctactttttaaccctttttgggggacttggacccctttttgggggacttgggctccttgatgccgacgctggccggcttttccaacgcctttttgggcataaccactgagttaatgttggggaggaccccatctttcactatagtgactccagccaacaacttaccgagcttctctttgttgcgtatcccc

SEQ ID NO: 50655 - DNA, 336 bp, Triticum aestivum
  Clone ID: PAT_TA_50655
gcgccctgataaatcagttttgattggcatctgaattaacagtggtacaagtcaccactgatcggtggatcgtatacgtgcatcatatacatacatatatgctgcctggcgaacagaacactaatgtgtgcgtcctggattaatcgggaatgaagaatgaccaattagctggcgatgtacttgtggatgatggagcacagggtggtcttcggtacggggccgatgacgctctccttcttctcgccgcccttgaacatgatcacggtggggatgctcccgatgccgtatgtggatgcgatggttgggcaataaaacctgttcactttggagcacttg

SEQ ID NO: 50656 - DNA, 422 bp, Triticum aestivum
  unsure (1)..(422): unsure at all n locations
  Clone ID: PAT_TA_50656
gcccttnnntttttttnnttttttgaatgnaactacatgtatgatttgaatgcggtgcatcacaataactcacaaggtggacaaatccacaagaacaataccagaacggcttattgtccctatatagcatcgcagctgaaattgttaaaacatttaagacctgctcacaaattgtgcttgaccaaccaactttaagcgcaacctattgtacctacaaatatgcacaatagcttcatatccaaatacaaataaaattaggggttgtgcatatgacggtcaatgcattaacaactagacacggggagcaggggcaccattaacctaaccggagccagaaggcgcaccagaaggagcaccagggccgccggctcggggcggggcaacctgtccaggactccggccgtagttcctgcgcctgaaac

SEQ ID NO: 50657 - DNA, 322 bp, Triticum aestivum
  unsure (1)..(322): unsure at all n locations
  Clone ID: PAT_TA_50657
tttttnnttttttttnntttttttttnnttttttttttttttttttttttaggaaatgaattatgaaccgacaagatcaaagtgcttctctctgacggagttatctaaaatgcacctatgaatgttctgcatactggagaacactatcacaatgaacacgagatgatggcccaaaaaataataataaaaggctctattacgagttcaaatataattacagtcttagggggtccttcgactgcatatagctagagaccataataagaataacacgctaacatgaccggcccaaactcccaaaccattcattcggacacgtggg

SEQ ID NO: 50658 - DNA, 431 bp, Triticum aestivum
  Clone ID: PAT_TA_50658
aatccgtaaaaaatcatattaataataaatgatcgtattcatactggccataaattcaaagaaaggctagcttaagttggtaaattgctagaacacttgaatcagcatagacaatctgagaccacatatcaactagagttgccggaccaaacaactaagcactactggatgcatcacaggtttcccctattttcaatagttcacccagcttgcgcttcatccaaggtttagtcgatggatcctcaatagtgtcatcagtggcatgtgcacaggatgaagaagctatctatttgttctccccattgttgttaatctgtttctcctccggagcagaccatccagataaaaccattctgtcagtctctttctcctcataaaacttcccaacaggaggttcattccaagttaatttttataatcttggcaataac

SEQ ID NO: 50659 - DNA, 443 bp, Triticum aestivum
  Clone ID: PAT_TA_50659
gacagctgccataataataatattaataattactgatgacatctccgagaagtatacaggataaccgagcttgaaatatttagactcgcatctaaaacacggggccaactctctacgagtcaggatcggtgaagtaaacagggttttctaggtcatcattgtttgcagaagcaaatgaatcttcagaccctatactcgacagacatgaaatgctatctgaatcttctgatattccgtcatcatgcggagcgataggcgcttcgaggtcggactcagatccagaagtccctagcatgagcttgttgattgcagtcttggcagtctcaagaaaccattcatcctccggaagagcgctttgtgggtcaacctcccttgccgagaaactgcaattgctctagtaataattactgacacaagcttgtgaactggtctgtgcgggtacc

SEQ ID NO: 50660 - DNA, 436 bp, Triticum aestivum
  Clone ID: PAT_TA_50660
tttttttttttttttttttttttttttttttttttttttttttttttttttttttttttttttttttttttttccggggggacttgcataaaaaagggaaattacaaatccggggccccggtagaattgaaacacacaccgacccacgacaaaaaccgacgcatggggggggggagccactgcataaacagcacccccacttattaagcactcggaagctaagcccccaaaaaaaaaacccacagggaaacacaaaaccaggcccacgtcccagcctttttaattttggaacacacgtaacggaagcccccccccggccggggggaaggccggcccccgaacgtaaacggtaaataaaccaaaaggggggtggttttttttcccggtggcctccttggcccccttgggggcccggcttttttcgggggggcccggg

SEQ ID NO: 50661 - DNA, 575 bp, Triticum aestivum
  Clone ID: PAT_TA_50661
aggcagaagacaaaacgattgcaatatgagcttctcatgttcttcacagcttgattgagtctgaaactgcaagtaaacttgtaatcaattaagctaaccggcgccttagcagataggcagaacttgctagctagaaggatccgtcgctgctgatgtccccccacctgacgttgtacttggcggcgaggtagtgcgcgccgacggggccccggctgccgtacgggtagagctccggcgccaccctcttgtcctccagctccctgagcacgggcgtgaagatggcccaggccgcgtcgagctcgtcgctccggatgaagagccggcgctccccctccatggcgtccaggaggagccgctcgtacgcgtccggtatctcccgctggtaccgctccgagcgcttgtgaaataaagagtaaataatctcttctcacccccatatccaaataaaaaagcggtttaagtaataaatttgaattaaagagaagaatcaatggattcatgattaaacccctcctacttcttgtatttttttacaattttgggttaagtgagggatcaaatatgtagtcaacttt

SEQ ID NO: 50662 - DNA, 472 bp, Triticum aestivum
  Clone ID: PAT_TA_50662
gctgtacgaatagtggtacgcgtgatggtagcgtattactccctgccgttcggaatacattgacggcgtggggttttgttccgaccaggtgtaaaaagcacatgaaatgaccagtttacccttcagtttagaattctctcctcaggtgcacccaggccgcgttccatatccgcctgactacggagagcatgaatttgaaatcccaaactgatggtcgcagtactgcgttcatccactacttcagatgcgtggatctcttgatgctgaagaaaaccttattgccatactgccccttgacacttgaggctgatgtgggcgcctgcaccgtcgcccgagggctttttgtcctcatacgccgtcactcccgatatcttggccgactcctctgtgctgtgccgcgccgcgcctggcagggaagggggttgaggagcagggtatgggatccgagcaggagcaatagaaagaagatgac

SEQ ID NO: 50663 - DNA, 244 bp, Triticum aestivum
  Clone ID: PAT_TA_50663
aaatcaaggggctataagctcattgggtacacgaaaaaacatttttttacaatcctaaaaacaccgcacgggttggggaacatgtctgatctcccacccgggggggcagaatgaacaactgaaggccatgattcccacacaacccaattttatgccgcgacaaaaaatgccgcgcctccgcaaaagtttggtgaattcccgaacctcctgtggagaggaattaggctatttccggcatttcctt

SEQ ID NO: 50664 - DNA, 517 bp, Triticum aestivum
  Clone ID: PAT_TA_50664
caactaccagaatagtcattaatccaaaacggtaggtgctaagcttagcacatctaagcatgaaatttaagagtaccaagttttctcatggaccaaaacaagaccactgtatcaagacaaggcagttcaactctttaatccacaaaaacaggtcataaaacagaaaagacacattatctagataaagcaaaatcccttggcttgtagcccatcacagtgagtatggagtggttgaagtggtcgcgggggtgcacacgtgacacataacccaacttcatcatgtcagcaccagaaagtaaagcctgggcagtccagcgagcgagcttgttggcattgttcttgagctctgtagcaagcacagcaccacgctgggactcgagcttctgcttccagtcaacaccagtaatcttaggatcaaactcattgagtgcattaagcgtgaggaactggcgagcaccactgggatcaacaccagcagcatgcacttaacagcgggcaatgatgctaatatcatcat

SEQ ID NO: 50665 - DNA, 366 bp, Triticum aestivum
  Clone ID: PAT_TA_50665
gcgcattcgaaggtgcctcggccggtgctgccacctactgcactgacgacgctacggatgcggcgggtgcgggcgctgatcatcctccaggaccggcgcctatgccaccggatctgagccctggacactctgacacggtagcaacaaaacctgatgcttatgggtctaagagaactgcctggacggtgacagcagactacactggagcctcactagatgcgtggctcctcctgcactgacacaacgacgtctggggcaacggcctccaactcggccggtgtaacgtctgaaaccggatccattgcaccagccgcatctacgggaatctctggatgtttactttcgcgttaaggtacagcagcttga

SEQ ID NO: 50666 - DNA, 530 bp, Triticum aestivum
  unsure (1)..(530): unsure at all n locations
  Clone ID: PAT_TA_50666
tttnnttttttataactcttccacattacattagttcatcattncattagcacagaaacatagcgatatataggattatcanagaagacctagaaacatgatatactaccactccactttgctatatgacaaagcaagctcacacaaacaaaacatttttcgaacacaaggggggtcatacacgatcaacctagaacatgctacagacaagctggttgaagaaaacctcaaggattgccggcattacacaaatctgaaatggcgctttctattcttcctgaggcctacgagctggccatgccttggaatggtcacaggaagctggtggcctgattgcaatgaaggtcaaccactagagatttcgcatcaaggtcattactgcaaatgatgcttacctttcaaagaccctcctctaggaccttgccaccggtcagaggaattctttggtttggacgcatgggaacatccggaaattccacaacgttcactgcaggccttccaactttccctgataacgaattgtgttaaag

SEQ ID NO: 50667 - DNA, 531 bp, Triticum aestivum
  Clone ID: PAT_TA_50667
gcgagaaaggtatatgtcattatccacaacatgtaaacctcggcaagtttcatgttcatgggaaataatatacaaatcattccgtttctcagactgaagagcgtgcatctaaacccacgtatcagcagttaaacattatgccctggatatccagaaatactctcagcggtggatggatcacggtatagagactctgaggacgaggccaactgcgctggacaactggagagcttccaaatgggccaaaatatttcttctactcggccttcttttgtttaggtggttgccctgtcttgctaatggcggtattcaagtgccttgacagtatgctgtgtactaaaccaaccttttcatcaataacatcctggtgcctctcatataccgggggaaccaacagagcgagtagtacaccaatgtaaatgagcgtaaagaagttgaagagcatcccaatacatgaaaccacccatagagccattataacctgtataaaaactgtcctgtctctcttgatggccatgtcatgggcaacag

SEQ ID NO: 50668 - DNA, 253 bp, Triticum aestivum
  unsure (1)..(253): unsure at all n locations
  Clone ID: PAT_TA_50668
aataaccatatgcattactatgtaccgatagcaggacaacatgcggtatgtaacagatcaaggatgacacaaacaaataacatgatacgggcattacatagcctaaacaaagaaagtgaggactccagcatcagccacatgagcagtatcgcctacctactgagcacatagtaaccacgncctcacaactacaaaaattgccaaaacatggattaataaagcccaaatcgcgcacaaccccacagcgtcccag

SEQ ID NO: 50669 - DNA, 464 bp, Triticum aestivum
  Clone ID: PAT_TA_50669
ggaaagaaatcacctttttattacaaccaaacagacgatgacatgccgtatgcctaagagaacaaatcttgtgctgaactaatagcggattctaactacttggtgaaaagacaagttacatgcccacagcaaaataaaaatgcccaaatggaaggtgctagccctctaaatgaaactcagaccactggaagctccccgcactcactaatgaccacctttttcttcggcacggcgacctgtgtgagcccctgatgactactattgtccttacaatgctccatgccttaaagaacctggccaaagacaacgggtctcccattcatccacggggtctagactggcccaattaataattgggtggcactggcgcttggaccagcatttgtcatgctgagcactccaggcccaggatgaaccaattggaagtgctcatccttaaaggggcagccatatatccttttccc

SEQ ID NO: 50670 - DNA, 420 bp, Triticum aestivum
  Clone ID: PAT_TA_50670
gcaacgtaggagttgttgcgcaaggaacttctgcaacacaagtgatgttgcagaaaatttgcaatggaaatcatgcgacagaaacaccacgtcccttccgttcaccgccgcccagctctgccgttgcaactgcaactgcgggtggtcgttgatggccggggacgatgggaggaggtcgtcgacggtcatgccaagcagagtcggatgctccgcggcggctgatggacccgcgacgaccgatggccatggtggaggcagcagatgaccgacgtctgcagttcaagcactgctgcccctgccgtaagccggggagcgcccccgccgctgctgctacagacccaccatgtgctgcagcttgcaagctcatcaccagatttgtagacttcccacgcaggaccttgtctcgaataaaaagggaaa

SEQ ID NO: 50671 - DNA, 137 bp, Triticum aestivum
  Clone ID: PAT_TA_50671
acaaaccagcagcgccaaagattgatcaacaaagggggcacgagaaaaggaggttcctgttcgaacacacgcgacaggggcatacagacctacggaacacgaacggggggaggcacatcattcaacgggggcgccac

SEQ ID NO: 50672 - DNA, 436 bp, Triticum aestivum
  Clone ID: PAT_TA_50672
aaacaattaggatatatttcccttgaataacaatttttatacgtagtacatactggtatttctcattcctttgtggacaatggcaaagcactagcagttgaaatcagttgaaggctgcacagtcgtggcgtatgttcccctgggacgcatcggtcttgactcccacgcggcccagctttgttatggccgccacgaaggcccggtcgaacgcggcaccgctccgggcccacgcgtcaacggtgggcctggacctcgagtcggtgaacagtagctggtccgagctcagtaggcccattcccccttgaagattcttgaagtactggttgtcaaatgcccgcggcgtcactgtgtccatgggcaccgcgggccgtgggtccaccttgggtgggcaccacgcctgcaggtgtgctgcgaaccgcgggctcaacgttgggtc

SEQ ID NO: 50673 - DNA, 302 bp, Triticum aestivum
  Clone ID: PAT_TA_50673
aagagcatccagacaataatgctgaggcatgcaaaagcataaaggacttgatggcccaatattatcaacagataaagctccaaaacagagttgatacagttggatcgatagggcatgatagaaaaactactgggacaactaaaggcaacgctgacaggcctactaaagtgcagggtcctggaataagcgagttgacagatgagaagaatggccccaccatgccaagctagtacgcccgcaggcagccgcggccaaagaacacatacgaagctacatcaaaccgccgccacccccatcaggct

SEQ ID NO: 50674 - DNA, 407 bp, Triticum aestivum
  unsure (1)..(407): unsure at all n locations
  Clone ID: PAT_TA_50674
tcgcgactanactaggtctgattgaatcaatgtctcagaaaagatcaagnatagaagggatgagcttgtgcagaaggtatgctgcatgatcaaaagtatacgtccagcaagaaggatatatcaaaggggatgagggcagttgatgccattgagcgccttggtgttggttaccactttgaggaggaggtcaataagttcatggatgtcctcatcttcacatcgattgatgagaatgacttggccggagttgccctacggttccgactgttgaggaaacaccaatatgacattccttgtggtagttatacaacatactgcagtaaagtaaattgtaatttttctcctattagatggttagggaattctaaggactatccaattgatgggatattactactattacatga

SEQ ID NO: 50675 - DNA, 445 bp, Triticum aestivum
  Clone ID: PAT_TA_50675
attgttacattttttttgtctaaaaagggaacaaagtgcacttactgaaattgacagaacgggcgaaaacatcctttagacacccacactgggtgcaagcctggaagcccggccataccctccaatggcaatatgacacaacaactgaaatgtgttcttggatgaaagacaccctatgctcatttggagggacacaaccatatatgttggggattggaagctaaaccaaccccggggtgattaacccaaaatgcaaagcactgaactggatggggcttacgaactaacgggacatatccgggggtttcttcaaactgtgtggatatcaaactatgttgtcctgcgggatgaaggggaaaaccggtgccccaccgggcttgaccttgaccacctggcaacacctgctgccttgtgtaccagcccgaccttttggtgtggtacaccg

SEQ ID NO: 50676 - DNA, 452 bp, Triticum aestivum
  unsure (1)..(452): unsure at all n locations
  Clone ID: PAT_TA_50676
tttnttttttttttttttttttttttttttttttttttttttttttttttttttttttttttttttttttttttttttttttttttattaaaaccccatttttaaaaacccaccggccggagggggaatccaacaacaaaccaggggaaacacccccgggacaacagggaccacaaactgggggggggaaaaaacaaaagcggggggaaagggtgaaaaaatggccaaggaattgtttaggaaaaaaatattaccatgacgacgggggaaaacagggtccgaccaaaaaagccgcaataaaggaaaaataggggcttaaaaaggggcaccagttactgtttctcaagggggggacttgttaaaaatggggagggaaaactggcacttggtgatggcgcttccggaggggggggggaaaattggggaaggccttggaagggggcccaaacttg

SEQ ID NO: 50677 - DNA, 372 bp, Triticum aestivum
  Clone ID: PAT_TA_50677
gaactcaacctttactattccctcactcttgttccagaaggatccatcacccatggaactgcacggaggccacagcagggcacagcacatggcgggcagggggcatgaacaaaatacgctaacacaagaaagcttaagacaaacacttggacttaaacacgagtccgacaaatgacaaagacaagccctcctccctaagcgtcctccgtatgaccagaaccatcttatcgatcttgcgcccccaaacaccagcgtacctaccccttggcatccgtggctcattgctttgcttacgcatgcactatgtcgccgttggtgggcgccggcagaatcatatgcgggtgcagcgcccgggtgaccttttttagcgtc

SEQ ID NO: 50678 - DNA, 438 bp, Triticum aestivum
  Clone ID: PAT_TA_50678
ctaagtgcaaacactcatagcacgcattgcagagctgggtagggtatacagcatacaactccccatttacacgtggtacacttttcagtgcaaccacccttaggaatcttgcagcgacatgatactgcggaataaacgtgcagaaccaacaactgtacacaagcaagctccgcattcgtacatgcaagacacaacatcccacttcctgagagctgtgttgcgagcaagggtatacactattatccacataatatgcccatggtaaacctcaacaagtttcatgttcatgtctaacaagttacaaatcattgcacttgccagaatgaaaagcgtgcatctaaacccacttctcagcagttaaacattatgccctggtatatccaaaaatactatcaccgatggatggataacaacgtttgtaacatagtaagacaactg

SEQ ID NO: 50679 - DNA, 242 bp, Triticum aestivum
  Clone ID: PAT_TA_50679
gagtaaaatgcatgccacataaacgtctgttgatgacatattcattaaactgatgcgaccctgcctctacataggctcagacggaataaacgtgcgaacatgcttcctagaccgctggaccaccatgaacatggacttccacatattatcgggaacaaattaaacaccaacatggatgcagaaaaccgcaagctatgtctgaattaacaaaactgtgatggcaatctatatattgcctggct

SEQ ID NO: 50680 - DNA, 280 bp, Triticum aestivum
  Clone ID: PAT_TA_50680
gatctataactaggcccttttgttccacacgaggaggccgacatcgacagagctcataatgagacacctgcgctggctttaagcaggtgtgccggccaaccctaactgcatacctgtcaatggctaccactcacgctcggccccaaccgaccgggccaggcagccaaaacgacgggacatgcaagggcttccggccacgggggaagtcaccgaacattaagggccgggacatgtgagttgcccacgtgagggcttcgagagatgctacaccgcttaaggc

SEQ ID NO: 50681 - DNA, 438 bp, Triticum aestivum
  Clone ID: PAT_TA_50681
gaatggaaactctcacataagatacatctcggtacatgcagcaagccagcaacgaggcttggtttgctttctcagctgtgtcgagcgagtatagcggaaatggtcgcatgaacaaacatgttacatgtttgctgaattacaggcgcgccgcgcccagctgctcacatgagcagagccgcggcaacagtcgctgcggctaggaggacacttgctgaagcggggaaggtggtcgaagcggaggccgacggcgatggagctcgagcggtggtggagtcgccacttccggttccggcttcggctggtgattccgccgacggcgtggatggtgacggcgagtccccgaagaacggagcaccggaagacggtgcaagtgcaggtgctggagaccctccggtcacgcccggaatggaaatgtggcacttgctgaatggaagcgtt

SEQ ID NO: 50682 - DNA, 346 bp, Triticum aestivum
  Clone ID: PAT_TA_50682
gggcttgccatttgattgttcttgatataacacatgtatcaccatcatatatgctcggattgcaatctaaatgaaaccttctcaatgggcatattacataacagggtctggtaccaacagctcacttgtcataaggaaacgggttcacttaacagacccaaatactacgcctttaactggttgactacaagggtaaaagctggattggcataacaaccaactgttcttgccggtttttaatctattctaaagcttggcctttgatgtcttaggggtgaaccccttattgtgtttggcagcgatacagggcctaccccgcttgactagcttgttggagataaagaac

SEQ ID NO: 50683 - DNA, 487 bp, Triticum aestivum
  Clone ID: PAT_TA_50683
aggatacttaacgcgggataggttaaaaaaaaagcgggcacattacataggcacgcccatagggcgacgcacacaatatgaaaaaaccactctgctctgcttgcggagcctaccgacacccaatccaaaaaaacatggactgtatgcacacagattcattgaacctaaaaacacacatacaaataggtataacgacacggatcatggccgtaaaggcctatctaagcttgaacactagtggcatcaatgtacttctccgaacatgggactcataatacggcagaaggacctcgatacaagggccaaggcgatagagaaccctcacgggatccagttgtaaaccacgctgtggctgatcttgaaggggagggcgacgttgcacttctaggggaacgcggcgccaccggtgatgtacggcccaacagaggcgccgttggcgacgttattaaggcaatctcagatggtgcggcggtcggggctgatgttg

SEQ ID NO: 50684 - DNA, 152 bp, Triticum aestivum
  Clone ID: PAT_TA_50684
acgcctaactcgcgctaaggattacaccaaaagtctgacacttgatcacaaatacaggatactctgcagcaccataccacacaaagatgatccgcgaacgaattcatacggtactgtcgtacctacacttccactatacactgaacgcgggt

SEQ ID NO: 50685 - DNA, 380 bp, Triticum aestivum
  Clone ID: PAT_TA_50685
gaataaacaggtatatgcttcgctggtagagtgtccaaaaacgaaatccactgaatttccttggggcacgcagggccaaaacgccctaggtgtggataatgaaccattgtatacccgtgccctttaacagtactggaccagaaaacgggcaacccacatatgcggacaaaaacttgttaatggccctcttgaagaactgctgcttggagctgatctacaccctcctgtggacccccctctacatcagggtctagacggcacttccagacagcgacccgctggtcctccagctctccgtaacgggcgcctggttagaccctggaatatccataccgatacttgaggcctgccagatatccctatacggtgacaatttcaca

SEQ ID NO: 50686 - DNA, 298 bp, Triticum aestivum
  Clone ID: PAT_TA_50686
tcgcgatctagaactagcatgtgttcctcctaaaatacatgggaagttactgatatggcaattggtgctggtttttggcatgacaaaaaccaggccggggccaaatcaggtacctttccacaaggaccaaaattggcacaagtttgggggtacatttccggcccccgcacataaacatgcccggcatttttgctcaaccctaagacgttcaaccacatttcttttgggaggttaaacccacccatttttataaaaacttcggaaaaatacccggctaatagggctccccccggggccc

SEQ ID NO: 50687 - DNA, 327 bp, Triticum aestivum
  Clone ID: PAT_TA_50687
aagcaaaaccacgggtagtattttatttaggggtttacatgcatggcatggcacccgctctgataatgcacgcaggtgcgtacatacatacaaagacccttgatcaggcagcgtaacatggtagtagctgggatatagatcatagatttgatgcacgcggcgcatgcatgatcaatgatctagcagctgcatcaggagcagccgcagctggtgccgcacttgcactgggtgcagccaaagacgccgttctccgccgccatcttcatcccgaccgaacttgtcttgagggtgggaatggccgaaaccaaaaaggtggcaccggccgcc

SEQ ID NO: 50688 - DNA, 264 bp, Triticum aestivum
  Clone ID: PAT_TA_50688
aaaaaagaaaaattttttgaaataagcggggaacccttaaaaggggggggccaaccgaaagcccaaagataggggttttgttggaatttaaacaagcccagtccacatgttttggaattcaccccagtttgggtgatgagattccagggggacaaaaaagtttttttggatgtttctaaaaaaaaacttggacttttcccgttttttaatttccccaaaaattgtttggggttttattataaaacttttttttgggtgaagggg

SEQ ID NO: 50689 - DNA, 343 bp, Triticum aestivum
  Clone ID: PAT_TA_50689
acagtgtccaaaaaaagaggtatataagatgcagtgttacgtacatacacataaaccatctggagagaccatttactttgggtcgaatatatggtacattgacaggaggaaatgtctgttgcattacaaagacgtgcatgcatgcagcagacccggcgcctgtgatacacgtaaatgctatcttaagcggggagagcgctcttgttgtacacgaagaggacgccgtccccgatgaggccggcagaggtgtgacggtccaaataaaaagcccggtcggtactccggcgtttggggcaccatattcaaaccatttctgtggcgtgtagatagggctgtatcctta

SEQ ID NO: 50690 - DNA, 430 bp, Triticum aestivum
  Clone ID: PAT_TA_50690
gggaaaaaaaaaggaaaaccccccccattcctttttttttttaaggttacaaggcttatttttttattaaaatttccttttataaccggtattattggcaaacctggatcccccccgttgaatggttaaggccaaattttttgggcaaaatggtggtcttttggggccaatgggaaaaaagcaaccctttttcggttttaaaaaaaccaaaattttaggttttcccttttaattgggggaatccttttaagcccttggggccaaggaattggttttcgcccccaaaccaataagtgaagctccggtgatggtggccaaaaactttatagggaaaatttggggggcacaaagggttattccccttttcccttaaaaagaaccggggagggggggaacctttccccttaaaaaggaatcccagggttttttt

SEQ ID NO: 50691 - DNA, 271 bp, Triticum aestivum
  Clone ID: PAT_TA_50691
ggttaccattaaaacgtatatattcgacatattgttaaggaaatgcgcacgatcatatacatgagaaaccaatagaattctgatacaagcatgcattggacgaacatgttggcacatgaaaaaagacatccacgtattggtaggaacaaataacacaaacaaagggtgaaggaaaacccaaaggaacgacaggggtgacaaaactgtaaaggcactggatataaagcctgtggcgaatgaccaggttaggccttggcggacatctggcagg

SEQ ID NO: 50692 - DNA, 438 bp, Triticum aestivum
  Clone ID: PAT_TA_50692
caagcgtacagacacatatattcaactgtggcgaatctcaaatgcatgctatcatatgcgttatacaacaaaataacaatgtaagcatggttgaccgtgctgacaagacatgcagcttgcgatgaatgatgatggacagcatatatacactggagctgactgcatatgcttgctaactgcaggatgccctcgcgcatccatgcacggtgtgtaacatggctgattactattgggcgcttgtacctggaccaccttgtgcatccatcataaaacgggttgttatcaacacctttgcgccggacctcaaccacgagcactgaatcagtgcctgccaaccccaaattcctgacacgacggttacagctcatttgacctaccatgttgttgaacaccccaaggtagaacacgcagcgaccatcgccaaggagctgccccttg

SEQ ID NO: 50693 - DNA, 487 bp, Triticum aestivum
  unsure (1)..(487): unsure at all n locations
  Clone ID: PAT_TA_50693
tttnttttacatgactacacatggcattatataccataattccagtgggataaacatgacatttcactttggcatgaatgatgacaaattaacaggctgacgtatagacttacacaggacagaaacactctgcagcagtggtggaacatantaagatacgaccgcgggagtcggctggacattacagtaatctactacgccattattgcactggcaagatcgaccagcattcatccatattccagcaaaacgattggatcgcgcacattgaacttctccttgccctcgcactcgatctccaggtacttggtgatgaacggaactttgttctgattggccagggcctggcagccggagaagatgtaggggaacttgcagctgccgaactggacggtgtatgcgcacgcgaagttggcgccgctcgttgtcgccctcttgttgtcgctcaggtccttgctgagcttgctcttctcgaggtactgctgga

SEQ ID NO: 50694 - DNA, 461 bp, Triticum aestivum
  Clone ID: PAT_TA_50694
gaagctaaatgaataaacataagtgtgcagatagcgcatagcgacctatcaaacgctatgtgatggttcaggtatacactccgcggaccagcagatttcgcgcagatacacagacgtgcaactacacatgcttcaaattgaggctaggcctgaatgatgccaggaacggttaagctcaatgtaataccttgggttattgggctgggcattgtttggggccggtggtggtgcagctggagctgcaggcgctggaggtggtgaatgatctctggggccctgagacaatctgtactacataatggaatgttgacaatatgtgcttgccttggttttggagctcttggactcaaaccgatcagagagggtcttgtttcttggctaggcaaactgggactaagggatactctgcatgaagaccctctatgctctcgaacatggtgcccttgaccttaaggtacatg

SEQ ID NO: 50695 - DNA, 323 bp, Triticum aestivum
  Clone ID: PAT_TA_50695
aaacgctcaagtgacttgcaccgtacataaggtacatgacgaaatgcacatgggcaacttggttcccactagcactttggcagacaagatcaaactacatggaacagacacagggattgaggtgatcggtgcgattactaaacgctgaaacccctaccacgccttgaggaatttctctgatccatagattgagaactggccaccttccttgacgtttgcgactgtgaccgtgaggtcatcacaaagagagcaaaccctctcgaacgaagacccaatgctatcttcgcaagatcaaccttaagagcaagtgcttttgtgtattc

SEQ ID NO: 50696 - DNA, 307 bp, Triticum aestivum
  Clone ID: PAT_TA_50696
agtcgacaggatggactaataatattatgctgcatgtgcatatacatagccatcggtcgcattgacatacgagcatgctgtctcgaggcatgtcgggaacatgggcatacacatcttattatcttaggtagcaaacacgaaagataaatggaaaaggaaaacccgaagcacatgtcagagtagacaaaacacgaattggcactatatttgtggcccgtggtgagtgagctgactaggacgtgccggactactcgaattcgggtggcttgaaggcgatgaaactaactcactgaacctggcgcatgtt

SEQ ID NO: 50697 - DNA, 353 bp, Triticum aestivum
  Clone ID: PAT_TA_50697
aatgattaagcaggcccttcatattacttccatcctcacagacaggataatgtctgacatgacaaggttcgacacaccattcagacacaattacatagcaccacaggcacttggaatctatgttacacacggaaaaatctgctctgtatgagcggaaacactacctatgctaaaatattgcggcctacaggaaagacttgagcaggggcacggttctgtaaggccgtcatggtatccgatcagcttaacaggggctccataatggaagatcctgccctaactattcaactagatgaagtcactgcggtcgaacacgactaaggcgaaattcctgccataaatgatattcctga

SEQ ID NO: 50698 - DNA, 409 bp, Triticum aestivum
  Clone ID: PAT_TA_50698
atcattaacacagtcactttggaacgcaggaaaatatcttgccattgcacaacgctctggggaaggaaacgcagcgcctttcgtcctgatggtaggtacttcatctaaaatccaaccacccatcctacctcgagacatgcgcctactgcaagacccttcctatggttcagatgaagccgaccttgaatggccaagatgtagagcatcaaccagctgatgccagattgaccgccccgtgaacattcccttcaagcctgactagggcgttaactttgttggcctgggcggatacatcttggtggcggaatcctcaatacccttcttgaccaacctttggtcaacattgaaaacggggacggtcttgacatccacaacattaataatggactttgcgtggatgaatgcctag

SEQ ID NO: 50699 - DNA, 306 bp, Triticum aestivum
  Clone ID: PAT_TA_50699
caggaactgaaactactcttaatccagtcacgtgagatgtgaacctcaaccaccaggtcttacaaaaggaacgaaccctccaccacaggacttgacaaggtgacattgctacgtgcacccgagatgaatggggtcccattgccaatttacagcagggcggatctgggtgacaatacgagcagtcattgcaaactggccgcttggagacttcaacactgaggaaaaaggagcaagagggatctttctcctggcaacaaatcacgcacttcttaggtcaccggcccttgttggtggttttaccggcta

SEQ ID NO: 50700 - DNA, 451 bp, Triticum aestivum
  Clone ID: PAT_TA_50700
tttttttatttgagagattggataaattaataagggcaagtgcatagacataggcgaccacgggaaaaacataaaagcgagctagggggagaaaaaacgaaacacagaagaagaaaaaaaggatatcttataggaaacaaagggaaagagaaagggggtaatggaaacccaaaggaaaaggaaagggggcaaaaacggaaaggaacgggaaaagaggaccaagaagaaagagcagtgcagggaaagaaagaaggggaagggcaagggggtttggaggaaaggaaactgaagcacggaaaaaggaaaaagaggaaggaatcggaagaaaagaaatgacgagagagaagaaaaaaaaataaaaaataatcgaaaattgaaaaaaacacaaacaccgtcgcaaagccccccaacaatggggaagccaaaaccaccgcccaaaaaccacaacgcg

SEQ ID NO: 50701 - DNA, 425 bp, Triticum aestivum
  Clone ID: PAT_TA_50701
accaaacactttgttttttttctttttaaccacggggacaaattttaattatcctgagaaactatgaccattaacatgatcccaccaccaactggggcctctttataccggcaagaactccacaattttaaaaacgttttcggacccttacattgcaggccctgaattgaccacccacaaaaaaacaactttctatgccccaaacctagggacactgccagatctctgggcgcacaaagaccgcgatcgccctaccgaaattggacgggggccctgatctcgcgacagacctcatagggaccatgtacaggggttgaaatcaaactttttatgacggcctggatggggggcccttgcttgtgcaccgcgacaaaaggctggtgggcaagtatggagtcaaaacggggggcccacattactccacc

SEQ ID NO: 50702 - DNA, 380 bp, Triticum aestivum
  Clone ID: PAT_TA_50702
atatctaggagggcacaacagtcagactacaatgtaaacagacctgagaattcgggatatgcaaacagacggatcgaaagttatttcgacacaagtataagtcatgatcttacatggagacactcgtgtgcaaaccagcgagcagtaacgagtccttaaattaaacaagtcgataaaaaaacgggtggatacaatggagtatggataatggagtaaaaagccttaattggctctgagttgctgtgccatctttgccttgcaaatcagagatttccgcagcattagacttatcctgcatcttgaggtttagacacttctcgcttatcgtgactctgatcctcaaaattattcatcagcataacagccaaaacttgcatacc

SEQ ID NO: 50703 - DNA, 200 bp, Triticum aestivum
  Clone ID: PAT_TA_50703
gggaaaccaaattaacatgattgattctattgaataattattttgatccagggccctggtaggcacatattgacatcctgaaggtcagcatcagcaatacctaaacctccagactgagatggttcatccgcttgtgaaatctgtaaacgtcgtagctgatggctatggccgactcctatgggcggggttccctttatttt

SEQ ID NO: 50704 - DNA, 446 bp, Triticum aestivum
  Clone ID: PAT_TA_50704
atcagtgagcgacagatcaattgattagcatagcacataacatattggcgggaaataactggtactgtattatcttatctacctagaatcatcatactggagtactagcgcacagactagagacggagaaagcatgtccatgacattcacgcgacagatttttatcgaacggttaacagtctcgctggccttgtccgcttagaagaaggccatcccgacggcgaaggaggcggcgagggcgacgagggcgccggcggcgtggaagcggcgcgccgcgtggctgggcttgggcgactccggcggcgaggcgaacggcgaaggaccagcggggtactgtgggctgccgccgggcgacatgggcgagggagatcccggcctgcacgtacgggaggcagtccgacatgttgagcaacgagttgaggcacgccgggctaaacccccggggc

SEQ ID NO: 50705 - DNA, 310 bp, Triticum aestivum
  Clone ID: PAT_TA_50705
acagaaagtctgacatatctgtaacatatccagatcaacacagcatacatgaggaggggcactccattgagcccgaatactgcttgatacatagagcaccaacccgaatgctcagccagcaatctcgaaacgaatgaaacacactgcacctggtacattctatagactatacacagaggataataatgtagccgcttcgctgcgtgttctgatcagcctcaacctcctagctatcacttcactggccaaacacctcggccgcccccgtgctgacttgaacgatgttaagggccgccgcactagccctccg

SEQ ID NO: 50706 - DNA, 450 bp, Triticum aestivum
  Clone ID: PAT_TA_50706
gtgtgcggtgccaaagatgtataccattattaattacccgaatacatagtcaacagatagtataaatatattatgagcttgagcatatacatagccactcacttgaaatgacatacgagcatgatgactccatacatgaggtgacatgaacatggacatacacatattatcaggaacaaacactaaagataaatggagaacgaaaacccaaaaaatgtcagagttgacaaaaccacaatgggactttatatgaggaccgtggagagtgatctgccaaagccttgcacaacttctcgcagacagatggctgtgaaggcgatgaatctgacacacatgactctgacgcatgttgtaccaatccaataatgcggacgtacacgtaagggtactcctatattgacctcttgaacctcattgatcacatgagaggcgtcggggcacccataacat

SEQ ID NO: 50707 - DNA, 445 bp, Triticum aestivum
  Clone ID: PAT_TA_50707
tccggcggtggacgcggaccggctcttgccgaggcgcttgcacgcctgcttcatgccggccgggactctggcgcgcggagcgcgcacgccgcacgcgacgacgacgggctgcggaagaggggctggcggggcacgaggctgggagggggcgggggaaggtgtcgcggtaaggggacggcgagggttcgggctccgcgtacgtctcctcgccctcgctggcgccggcgaaccgtaggcgctcgccgtatcggcgggagaccttgacgtacaggggcttggttttgttcaagtacttgagcataacctccttggcgaaacgccgctcctcggcggtgatcgccaccgcgtcagaaggctggggtgcctgcaccgccggcctagccgcgccggcgccggcgccggcgtcagaggtgccagagctgttgtcacgcgtgaagagcgagac

SEQ ID NO: 50708 - DNA, 520 bp, Triticum aestivum
  unsure (1)..(520): unsure at all n locations
  Clone ID: PAT_TA_50708
ttctttttttttttttttttttttttttttttttttttttttttttttttttttttttttttttctttttttttttctggaacagggggaaagcatagccccaaacaaaattcagggccttataaacaaggaaaattttggcacaaacccggactagagggccaaatcatataggggaaaggggggaagccccacaagatccgggcaaaaaccaaaccaaacccgggtaaaatacatttaaaagggtttccctgaccaaaccaaggtggggaagcctacacaaaaagggaagggattttttggattcatcagccagggggaagctactagctagggcattacttccactttttgaactttccgccgccgccaaaaatgccgggcttcccatgcttgccgggcttaaacttgccgggggcgggcttcccgggcttgaacttgccgccggggggggcgccccccccgccctagcctccttgggcgccccttttgcccccccntgtggggcccccccccccgg

SEQ ID NO: 50709 - DNA, 500 bp, Triticum aestivum
  unsure (1)..(500): unsure at all n locations
  Clone ID: PAT_TA_50709
gaaccagatgcattccattccaaccagatccaccctcggtacatgaaccaacaagaacattagccaagaagaactaatctaccaacctaaaagcaccaccacgccatactcagatctctgggactctaaaactcctgggactgggatgcggacccgccggtgccggcgcccttgccgaccttcttggggaggagcaccgagtggatgttgggcaggacgccgccggcggcgatggtgacgccgccgagcagccggctgagctcctcgtcgttgcggacggcgagctggatgtggcgcggcgagatccgggtcttcttgttgtcgcgcgccgcgttgccggccagctccagggcctcggcggcgaggtactcgaggacggcgcataggtagacgggggcgcccgcgcccacgcgcttngngtagcggccgaccttgaggtgccgggcgacgcggccgacggggaactgcaggcccgccttcaccgaccgggacaccgactt

SEQ ID NO: 50710 - DNA, 519 bp, Triticum aestivum
  Clone ID: PAT_TA_50710
tttctattttacacaaaaagaaagttgattcctatgtaacttgagtacaccaccctaacacaagcaattgactgaggattccaggtcatatttcaaaaacatttttagataactttaatacacgaccaattagactgcaaacataaatcagtgcatacatgctaacaacagtgataaagagacaaaatgacaagaagataacccatgaaagtctaatgcctcttagctaaagtactcataacaccaacatttgataaatataaggtgatagctactagtttctcattcctcttactcttcaccaccggcgtcaccggcaccacttgccttcttctggttctttctattcaccctgcctgcagggcctacaccgtatggacttgtcaacaagaattggatgtgcttctcaaattcaaccctcaccatgtaagaggggacatttacgatttgcctgtcaaccctgaagtggcgttgcctgatcaagacacgggcattgagaatggattttgccatgccagc

SEQ ID NO: 50711 - DNA, 529 bp, Triticum aestivum
  Clone ID: PAT_TA_50711
cacctgtgtaaagactcaatctagaatcatacttagtgcttgtggacatattatcaacagggcaagttacacttgccggccttccaaatttgaacaaacataaaaggcctgaaagcatcacggaccatatatagcggtatccatgctagaccataacttggcggaggtacatcgctcaagaacggtcttgggctctccgtactacttctgggactcggtggggctctcgatcttggctgcatggtcaagcccgtctagggtggccaagacttgccggtgaggtccttgaggaccttctttccctccttggtggtctcggaggacatgacgggcttgaagtcgtttcgcacgtacgaggccctcaggcggaggtccttcatgacgcacggccattgctttttgtcaatgaacggcttgcggttgaggatgtcctgggccgactccttggcccggaccgccgtctccgccggtggcagcggctgcaggtagaaccggttcttcaggggctggtcgaactcccttgcctagt

SEQ ID NO: 50712 - DNA, 512 bp, Triticum aestivum
  Clone ID: PAT_TA_50712
tttctttcttgctgattaaaccttgcactcacaggcatggccttcaggtcactgatgatgtttccatcatacaataccaaaaacatcctggtcttatcactgagggctcctatacaaacatcatgggctaatgtatcctatgtaaagcggtttatactgaacttggtgaatgagccgaacctgaaaatgtgaccctcgagcacgagactactccttatgacttgctcttaacttagcgttcgttgaacgataaatcaggccaatattaacaatgtttacttcattcgaaaagcacctgactgaatctgagataaccacattccattgcctttgaacagataccggctcttctgaactagaaaaaaaacatgtcctccctccctgccataatattacaatgtctttaacacttgcatgatgtgaaaaacgttcttatattctgggacactaggagtagctcattcaccaaatatataacctgttcgtaacattactttctgtgcgaatcaaaa

SEQ ID NO: 50713 - DNA, 461 bp, Triticum aestivum
  Clone ID: PAT_TA_50713
aaagcgcgcacaaccggctgaattggaggcacggaggaaaactgacatttcttatgagaagggaggactccaaaagaaagggtccggggaggccaacagggacaaaaaagggggggggggggcaccggcacacctggcgagaggtacaggggggcttaccctagccggctgaagccccgacgggtttatagaaaaaaaaggagggggcccaggaatcatattcctgcggaggcaacttgggcggaattcaacccccccgggcaactggggccggggccccgctcaactttgacttgggacgccgggccttgggcccaggctgatgccctcctgaaaacctttatcttggggcccttcttggggccccccggcgggggcttgggtttggggggctctttggggggctctgggccttccatttttggccgccccccccgggttggctccctcggggggggggg

SEQ ID NO: 50714 - DNA, 500 bp, Triticum aestivum
  Clone ID: PAT_TA_50714
gttaatgacacacgattctttcattcatttcgtggcgcacacatactgctttattaattgacatctgcgtcgcaacgtatgcgcgcaggcacctatgcaaatcgtaccatcatgggacaaaaaaacacactaagcacgtgaaggggtacccaccctaccatttgactgcaaccgggacgacaaacgcgaactgggctaccgaaacccaggtgcgcttcccttcgatccacggggggaactagaggttcctcggctggagggtgctccggatctgcgggacgtgccaggggggcgttccgtgggacccctccaggtactcctccaatgccttttcggaggggggcaccgtggagaacatgaatcaggggccgggttgacggcctgcgcgaaccctcaaagcaagcgccctaaggggggcctgcgggtaaagctttccgggcaattctgggactagacgagctgcctgaccggccccgtgcctcgggggctacctgggggcc

SEQ ID NO: 50715 - DNA, 548 bp, Triticum aestivum
  Clone ID: PAT_TA_50715
gcgcctcaatttacacttatattattaacctgaacatagaaggggtgttttgacacatctgccataaaaaattgttctcacactacaacaagcgaattgtaatttcttccacttgctatcatcatggatgcatacgttcagtgtaggattgcatcagtaatcaatgtttaaaatgaatgcaatgtggttggtgccatgcaggggcttcagagtgtttcaggcctcgttgaacttgaagacgcaatcgtaaagccttccacccaaaaactgcgccacttcaggatgcttgaccattccaatcttgatcgaggcacatttcatttgtgcgtataggttggtttcgattcctcttcccatgccttctaggatgaccaagtcagcatcgcttgccatataggctagttccggtgcgacgctagacaaatctattactggcagatcgttcccggagttggcaacaatgaggtcagatacatccacaccagcaagctttccattttcgtccttgagcttgtttacaatctcaaccaactctaggtaagtgatat

SEQ ID NO: 50716 - DNA, 541 bp, Triticum aestivum
  Clone ID: PAT_TA_50716
cgtgcagtagaaatgccaaacagtaggcaccaatttcccaataaaacctctctcataaaaatatatacaggaagaaaactatgcactccatcaattccttgatcaatgttcaaagtgaattacacacacgtcagtcaaatgtgccttgcctaagtcggccatgaatttcccctctttgtcaactcgctactttctctcctccactcatctgagccttgagaaaagagacacgtgtagatgattgctctcagctcactcactcatctgctgcatcatgccacattctcatcatctctggcagtggtatgccaaccaaatcaaatcaatggcaccagcagatctagatacacgacgaatgatccaagcctagctaaccatcgtgaggcgcggtggagttgacgaggctggcgatcctgaccctgggcttggagtagtcgccggtgagcagcttggacgcgacgatggcgttggcgaactcggtgaggtggatgccgtcccagctgatgaactttgcgtccatgtcgcacagctgcatctcccc

SEQ ID NO: 50717 - DNA, 575 bp, Triticum aestivum
  Clone ID: PAT_TA_50717
ccctcttttctttttctttttattttttattttttcttttatttttctttttttcttttttttaatgcaattttctttactgaatgtttataaagttatatcacatcaattggcgctagaattttttttcctttttttccgacaaaacacaatgtatatgtacaaataaacatggaacattcacaggccctggcagaaacgggcaacaaatatggctgccaaggtacaggattcaaaaccacccaaatgccccggaacggaagtatggcacaaaacaaatgggtctcacggtttatgtccaaaccaacactttaaggaagtggtgttgcggcaggcaataacaacttttcgacaacaccaactccttccaagtttcaacggggatccccaaattagtaaattgcctggaggaatcttggccccatattttgagaactaggggcaaggtttaccttgaaaagtactatgtcccatggcagatgatcgattccgcacagctttattccatgaaaacctaggagaatttcaccatcggctacatactatgggacactggatgttttgagcactttttt

SEQ ID NO: 50718 - DNA, 448 bp, Triticum aestivum
  Clone ID: PAT_TA_50718
ggggggcaagggaagcaagcaacaatgtctagatccaactcgtaggctcagtatgaagccctgaccaatgttacaactgagatgatttgtgtgcaatgactactcaaagaacctgaagtgcctcaaaaaagggtcttgtttctggggtgatactcgggggacaaccatctgtcagtgaatcgagtcctccatgcacacatttaaaccaagtgagtgcatctgtgttggggaacatcactggactgcccatatgaataggtgtttatgattgcttggaatgggaagtctggcattggtttgtgtttaagaaaaaaaagggtacagataaagatgcacaaaattacaagggggggaacagaaactcagtgggagtcatttcaccagacccgggagatctcaacctgcttttttgttcactttgaggtggggcagcgcacccatcacgttg

SEQ ID NO: 50719 - DNA, 511 bp, Triticum aestivum
  Clone ID: PAT_TA_50719
aacaatagtgtacgactagatgatcggatagacagatgtcatcataagctagcgatctaatggttctaacatgatagccctggtgtctattcaacaagacaacaaacaataagctattgatcggttaaaaaaacaagaaaggtggggattctctttactaatgattgtcatactcgaatagatgcttggaagtgttaccaaccagcaaaaacaacaaatacttcccatgttatggaggatacacgctcctatgtacggggaataagtaacattttcttcttccttctacaggaaaaggtcagccataaacgtgctccgatccaaaagaacatatgactcaccactcctgccatttcacgcgtaaagactcataactctcagttgagtcgcccacacggtctctgcacctatgctgagagaactgctagttccacatcccgtcgacggcggaaggcccgtcgctgaggacaccagccgtgctagttgagggccgaactgacgaccttgatgc

SEQ ID NO: 50720 - DNA, 472 bp, Triticum aestivum
  Clone ID: PAT_TA_50720
gccaaaaccctaagataaatttaattgcggtgatgcctataagagcctaaccctacgtctagcactgctgcacatagtacaggaacgtcaggaccctcaaaacaatgggggaattaataggcatgagtaacactattaaaaagaaaacctattgcattcctacccacaaatttctgggacttatgatctgactggacctgagcaggggaaaaataaagctctaaaacacttgttcaatcttctttttggcataggtctcgcccctatctgatggattcattctacgggttgcaaaacctattcactgctgacttcgttcagtgaccgcccgaggacaacttggagatgccctagaatacgggaggacttacggggcgagcgatcactcgccctggggtaacaatgggagtcgggcaggtgctccaagctcgaaacgccgaacagctccatgaatctcagggccgggctcctc

SEQ ID NO: 50721 - DNA, 564 bp, Triticum aestivum
  unsure (1)..(564): unsure at all n locations
  Clone ID: PAT_TA_50721
ggattgaaagttttattaataaaacaccgctccggcatcacatggaatgttgacatactggcgtgagggagacaaattccaggtaaaaacatgcactaagtactcattccgtaaacctttataactactgctcaatcacaacggaaagcctagagatccttacacaaagagctacaagagaggaggcactacactgaacactgacataggtaagctagaacatcgcctattcacaaagaacactctcgggcctttcttgcactctgtgagatgtcgcttatctaacagtgggaacggacactagcacnacacctctgtatagaactccggacgccgtgcgtgccaaagcggcagaggtgcgctcctagatatcggggcactccatgggggcgcccacggcacagaactgagacaggccactcctgggattgcgcacggtgccgcctgtacacggccagcacctgagtggggaagccccgggggaacgccttgaggaacggggacatggcctaccccaccgtctcggcgtccgggtcgaacatgcggcgctccggcggaagcgtg

SEQ ID NO: 50722 - DNA, 552 bp, Triticum aestivum
  unsure (1)..(552): unsure at all n locations
  Clone ID: PAT_TA_50722
gtggcgctcgccatagtgcggcgatggagaggtgcttcatcgtagcgcaagatggacaactgcaagccgtgcggcggggcgcatcccgctctgcctggcgtccgagttcgacctgccgctggacctcctagacaggagggtcaccaagaatgaagatgatggcggcctccaacataatctgggcatcagccgcacgctcgcgccgcacgagtacattgggatggtcagactcaaggtgctaagacaacttgactaattcccgggctacagaaagcctgcgccgaggtccttaacggtctgttgctatgatatgatgcgcccaacgtagcgcaaccgctcatacacagtggcactacaaccactgcgacattttccactggatggtgggcgcgctagaaccgctcgctcgaggtggacgcgatcgtgggctcggacggcgccaactcccgcgtggcctaagacatgggcgccggcgactaccagtacgctctcncgttccaggagcgcgtcaagatccccggctaccggatgcgctactacaaagtatcgcgc

SEQ ID NO: 50723 - DNA, 548 bp, Triticum aestivum
  Clone ID: PAT_TA_50723
tcttttttaaggaaacacaaccaaatctgctccctcccgtgtttccctacaatcacgcaatcaaatcgcaaactaaggaaactcaatcaaatctgctccctcgcccttgacctcgacgtttgtctgccttgagtcaccaccgcaccagatgccacccaccaacaccgtcgcctccctgcacgatcgccatcgccgattgtcgccgctcgcagcgtggaatccgtcatcaacgtagcgggcgcccaggaacctaccctcgcagcatggcatccatccgcgagatcgcctgcctcgacacccgcatggctacggccgccctgcacatcccctgaaccagccggacacacgcagctgtaatttcctccctgcacttcttcaggtttgacctcttcctttgacctcgacgtttgtctgccttgagtcaccaccgcaccagatgccgcccaccaacaccgtcgcctccctgcacgatcgccatcgccgattgtcgccgctcgcagcgtggaatccgtcatcaacgtagcgggcgcccaggaaacctaccctcg

SEQ ID NO: 50724 - DNA, 523 bp, Triticum aestivum
  Clone ID: PAT_TA_50724
agataaccttctttttgcacgggtacaacacaaatgtaccttcatttcggtcaaatgtgacatggataatgcagattaaaattgtcaccctatgaactgcacaagcaaacattctaacagatcaatgcttgccattgcaaatataatgtgttccacgatacaaacagaaaaggattataggactacaatttaggaagcaaataaattgcttacactcgttaatttgactgacttgataccttgacacgggcagattgatcctgctagttgtagcaaaagaggcaacgaccttcatgcttccatgcacttccaaatccaactttacacatagcagcttggctaccgacaagcgcgtaaatatatatcactacactttctgcatcttaccactaagctccgttgtctttgcagccttgcccgaatccatctcctttccggtgctctcgtaatagtcgttgagcgcccactggtacttggattgatccaccccgaaccaattggaaatgtactcatccaagcttgc

SEQ ID NO: 50725 - DNA, 534 bp, Triticum aestivum
  Clone ID: PAT_TA_50725
caagaaactgaaattactatttctccgggatcatgaaatatgtatcccaccacaaccagccaacaagttgtacaagaaggtacatgagtccgtaacagggaaactacagggggacatcgatccatccaccagaacaagacacacggacgacgtgccaaattaggcggaggtgaacttggtgacagccttggtgccctcggagacggcgtgcttggcgagctcgccggggaggacgaggcggacggaggtctggatctcccgggatgtgatggtgggcttcttgttgtaccgcgccagcttggcggactcgccggcgagcttctcaaagatgtcgttgatgaaggagttcatgatggacatggccttggaggagatcccgatgtccgggtgcacctgcttcagcaccttgaagatgtagatcttgtacgtctctacgctcttcttgggacttcttcttccccttattttcgccgccctacttggacgccggcaccttcttttcccccttgggcttcttgcccgcgggggtcttct

SEQ ID NO: 50726 - DNA, 560 bp, Triticum aestivum
  Clone ID: PAT_TA_50726
gagatatacccttacctgtctaaatagactctttagagcactagtacatagtgctaacagagaacatatactacatggacaaaagggagggcataaagataatcgtgactgcggtcatttaataaaactttacgatagaatcatgggaggccgtggggatggctcgcatgcatttgaaaggagtaacctataagggacagaaaacaacattaaaaatcctgctgccggtgtacgttttcatgatcatgcgcatgatgcatgatggtaagcccaagggcaactgatgcccaagaactgagatgccgaccccggtactcctggagaaaatcatgaagaggttgtgcccgcagatcacctagatgtcgatgaagtgccaccacccgatggggaacatcgccagagccataggcgactggccggacagggtgcacgatagcgcgccgccgcaggcaccggtgctgcatctcccgatgttgccagccgaacctgcaagccgtgcggccccagattctgccggagctggtgccgccggggatatcgagggtccaagtttggcctct

SEQ ID NO: 50727 - DNA, 470 bp, Triticum aestivum
  Clone ID: PAT_TA_50727
gttagaaacgcccatgaaaccatccggccccagtgaatccatctttcactcactggcattcttctacacggttatcattcaaagcatattttccgtcatcttgtcgtcgtactcaattcactctagccttcaccgccaccgggagcccgtccgccatccgcagcgtcagcgaggcaacctgccgcggccggtacgcgccgtccaccgcaaattcgaactcctccagcacgcatgccacgatagacttcatctggatatacgccatctcctttcccaggcaaattcttgggcccgcgtggaacgccatgtaccggaacgggctctccggccggaacgtcccctccgccggatcaagccaccgctccgggcggtatgcgagcgcgtccttgccccacacggactccatccgccccatcgcgtacgagttgtacgccacgaaccaccccgcccctaccggcgggccgtccgga

SEQ ID NO: 50728 - DNA, 532 bp, Triticum aestivum
  unsure (1)..(532): unsure at all n locations
  Clone ID: PAT_TA_50728
ttttnttttaccattcaaagtcactactgcatttcatacgatagatctgtggcataaggcaaccgagtgcaacggcacaccaaaccactgacagcgtacaaggtatggcctcaagccaacggacattattacggagaagattacttagcagtctgctggtccatactgacccctagtctagacgcagaacaagatcactctgatcgcacatagtagcagcagtagtagacacgcctcttatgcttcagcgtaccccagttcggagagcctgaggtgtgcctccttgtagtcctcaaagaaagccttctcgtccgcagcatatttctccacaagagggcgaaagacagggtcagtcagcagggttttgtcacttggaagctgaagaagcccctctttgtcaccactcagaagctccgtgaagtaagagtggtcaaacttcaaagggttccttgtccagggtccctcaaagccagacctctccttgtggcaccttcccagggtgtggccaccaagagagggcaacaatatcctg

SEQ ID NO: 50729 - DNA, 450 bp, Triticum aestivum
  Clone ID: PAT_TA_50729
aacgccaatgggttcccatcgattcattgatgaaaaggaaaaggggccatgcgttcttaaattcttcctgcactgcactgggatcaagcgacaactgccggggcttttcataaacatcgccaggggggcccgcgtccatgcaccttgcacacacacgggtgtccaacgatgcgtcaaggggtctgccggcctttaacgcggggcacaactgggtggccttgacctttaaacgggggaggcgctgcgcggaccttaacaaaacgggaaccccctccggggcaccaaccatgatgtggcggcgcggcctcggcgcgaggccccctaaagcgtgaccggggaaatgcccggcgcacacgtgcatggggagatgctctcccactacccatgccgaaaacaacagcctcggcgcccgggaaggcgggacccaaccggggggcggggccggaaaac

SEQ ID NO: 50730 - DNA, 461 bp, Triticum aestivum
  Clone ID: PAT_TA_50730
atctgaaaaagggggccggcaaatcactctactaaccaggccgaaaaaatagttcatgacttggctaacatcctatacgttcccgcacctgataaaccggggggcgaacattattatttacgcgaaaaaaaactatactactacgatatctctaagcgggagcataggcctcaatacatgcaagccataccactgccctggcatgcggggcatcgaatttaaaccaccggccaagaacgggatgttttctccccaggagacgcctgccctctaaaacttgaccacccaggggactattagacatgcttgacatctgaataccggcctccccagcgcgagaaaccctgtgccttgctccacaggaggtaccacatataagtggttgttccgggcaccccactgtggaaattggaccccatgaacccaggcgggcactctactagctgctgccatgtagaccc

SEQ ID NO: 50731 - DNA, 481 bp, Triticum aestivum
  Clone ID: PAT_TA_50731
gacaaatgactggaatcaggtcgccagccgaaccatcaacaccctatgggtagctactgagccattctttcgcaccacaatcacacacaccggtggctgcttatgagcataaggccaccagagaagtaaacacaatagggcaactcatcattcataatctaactggatgcaaaaaactggacccaacttgagctactgattacggcctccgatgcttaatgtagacaggcatctccttggaggaggtgaccttctgtgtggcccggccgagcggtcttcccaaccacgacctgtgtgggaattgcgctgactaatccagctcccacgacgtgaccttcctgccttctccactggcggctgcgagctgaacgggctctatctctaacaattcttccctgcgcccactcggctgcggcgttctacacggactcgcggatctgcgcgctctccctttggtggggcgccggccccagcttcttcg

SEQ ID NO: 50732 - DNA, 342 bp, Triticum aestivum
  Clone ID: PAT_TA_50732
atggacgatctcacaactgaactacggctcgagccaaacaaaacagatggcctgcgatcactcacactcgctgataccagtatactgtggcgtgcggaatgacatatgacgaaaacattaactgcgatcctaacgtctaaggatataatcgttgacaccaattgcctcttgtgacgtctactgctagatgatcactatgtccaatgagacagacatagagaataaagaactgcatatcggccggctgctacacaagaatcgttatcattccaagatctggttggactaacactgctaagccatacttgcactacaccaaatttctagatagtacatgaaagc

SEQ ID NO: 50733 - DNA, 593 bp, Triticum aestivum
  Clone ID: PAT_TA_50733
ccccaccgagcaggcttcttccgacaccaccgacgcgcccttccagtggcctcaagtcgaccgccggcctacccgtcagccgccgctcctgcagcgccggcctcagcagcgtcagcactggcggaaggatcagatgcatgcacgtgtcgccaatggagggcatcaagaattcaagaccctgtcttacttaccacccctctccacggaggccctcctgaagcaggacaactacttgatccgctccaagtgggtgccctgccatcgattcagcaaggccggcttcgtcttccgtgagcacaacagctccaccggttattatgacggctcgatactggacaatgtggaaactgcactatgctcgggcgcaccgacgccacacaggtgctcaacgaggtggaggaggttaacaacgactaccctgatgcgcatgtccgcgtcatcggcttggacaacatgcgccaggtgcaatgcgtcagcttcattgccttcaagccaccaggactgcgaggaatctggcaaggcctaaagtgcaagctgaagcaaccgatatacatgtcatgtcagtacaaatttgtcggcggctctgctttctc

SEQ ID NO: 50734 - DNA, 576 bp, Triticum aestivum
  Clone ID: PAT_TA_50734
gggggccgggcctatcccgcgggttcgggttcgataccttccactactcgatgcgatgtgccaggcgatccatgccatgaacggcctacagctggcggccgccctattgctggtaaagaggaacagtcatgtccctccagagaagagtgctgagctgttattctgtcgcggtgagggtacagtgtccaacgatttaaaccttaccgctgctcctttgtctgtgtctgggagcttagctatcttggcgaggtcagttacatggtacttttcatcatggattcttgctacggcaattacggaagcgagatgggctagagcagcggctgacgactgggggaggaatgagcagttctgggtaattggaggtgtatgtgaccatctctttgtcgcgttcgcaaggactacttacggtgatatcatgtgtggacacaaacttctcacgtctcatcaaaagctcgtacttatcaggagtatctaggaactgtgcacattcaaatggacaatcttgctgataaccgcgaccaccttgctcctgatgaacttcatagttgtggatgccggcctatacaaggctat

SEQ ID NO: 50735 - DNA, 509 bp, Triticum aestivum
  unsure (1)..(509): unsure at all n locations
  Clone ID: PAT_TA_50735
anaggcggnggcgcgcctgccgatcccctaccgcgaccagtgcgcgcacctcctcatcccgctcaacaagtgccgcgtcgccgagttctacctcccctggaagtgcgagcccgagcgccactcctacgagaagtgccagtacgagctcgtcatggagcggatgctccagatgcagaagatccgcgaggcgcaggcgggcgccaaggtcaagggcagcgtcaccatcggcgtgccccttgccccctccaccgccaagctcgcctgatccgtcagattcaggatgggttggtcatgggagctcgaagggcgcggtgcttgcaaggatcatcaatgttgttcttgtatgaacaaaacatgtgttctgtttgaattaactcccgtcttgtttcctcctgccttttttctcttttggtgcgagcacctaccagttttcttcttgttaagtgtgatgatgcaataaggaactagatgtttatactcgttgagtgaaatgacaccttgaagttttg

SEQ ID NO: 50736 - DNA, 275 bp, Triticum aestivum
  Clone ID: PAT_TA_50736
cccccaattcccttttccaaaattttcccacccttaattggaaatgggacccccccttttacgggcctttaaacccggggggttggggggtttcccccaaggggaccctttaattttccaagccctttaccccccttcttttggtttttttccctttttttttccccaattttgccggtttttcccgtaaaattttaaattgggggccccttttagggttcccatttaaggttttacgggcccttacccccaaaaaattttttagggggatggtt

SEQ ID NO: 50737 - DNA, 592 bp, Triticum aestivum
  unsure (1)..(592): unsure at all n locations
  Clone ID: PAT_TA_50737
cccagcgtccgcngattatctgcttatgcacggggtagttggtctagccatgggtactatgtggaggttggagaccgattggattgcttccatcataatctgctcaattatccgtgcggtgggagcttgtggatatgtgttagtgtcatcgttcctgatacgagaaaatattcttcaattgataaccgttaacgtgcatgcctccttaacgtacattctggcagcggctggtgtgaacgcaattccatccatggatgcaatatatgtaatctttgggacactgcttctacttaattgtggattctttgtcttcatactgcacataatctacacaatcttcctgaccaagcttggaatcaagccttcgctgagacctccacgatggctgggcaaaacaacttttagttgataggtagaatgccaccatactcatttttagttgaaggtttgcgccctgactgaacttgcagcattttagtcacaacttacaaatgctcccccactacccgcagcatgccggcgtggcaattgtgacctttgtaatatgagcattattgttcggcttcctggtgcatgattgtggttttcctga

SEQ ID NO: 50738 - DNA, 632 bp, Triticum aestivum
  Clone ID: PAT_TA_50738
tcccccttcctttccccccagggaggacgaaggggaggaaggtcggggccgagatggacgcggcggtgcaggaggcgaagctgctgcggcaggtgaacgccctcatcgtggcgcacctccgcgaccagaacctcacgcaggccgccaccgccgtcgccgccgccaccatgacccccagggccgacgcctccgtccccaaccacctcctccgcctcgtcgccaagggtctcgcggtagagcaagaggaggcggcgagaggaggcggagctcccgccgcggctgggctggcgcgcccgctcggcaccaatgccgtggatttcaggggcccgtccaagactttccccaagcatgaaaccaggcacatctccgatcataagaatgttgccagatgtgcaaaatttagtcctgatgggaaatattttgcaactggaagtggggacacatccattaagttctttgaggtgtcgaaaattaagcagactatgttaggagactccaaagaaagctctggccggcctgtggtccgtacattttatgaccatgtgcagcccatcaatgatctggatttccatcctattagcccaatactgatatctggagcaaaagataatacgataaagttctttgacttc

SEQ ID NO: 50739 - DNA, 596 bp, Triticum aestivum
  Clone ID: PAT_TA_50739
cgctcgctccccactcactcgctctctcccggcccagtcgccctccccgccgaccactcgctcaccggccagtcgctcgccggccagtcgccgtcctctcactctcgtcggtgtcttcctcaccccgccttgctcctcaccaccccgattcgtacccctaaccctagcaacccgcctgctagctcttggtcaaaggtgacatttttaccgccgcgctgctcgatctgtgggcggaggtgctcgatctgtgggtcgcggtggtcgatccgtgggtggcggtgcttgatccatgctggagcagcgggaggaggacggcggtgctggattggagaccggagcagcgggatgaggagaacggcggtgctggattggagaccgaagcagcgggcttcttctgctcgtcttggccgtggccgctacctgagctgcccgcgaggcggcgcagcatgtcggggtgtgctctagccttggctcgcttgcctctggtgccgctgcttcgcctgacggtgtggcgcaggaggtgcgcctggctccggaagaaggaggcgtgcgtctgaccgaagcagatgtaggacaccgcctgcctggagcactag

SEQ ID NO: 50740 - DNA, 583 bp, Triticum aestivum
  Clone ID: PAT_TA_50740
gaaattggcaaacatccacacccttgggagcaccagtagagaacctaaacctataaggcgggggtcatgcaacatgctattactatagaacaagaaaggaatggtgatatgaatatgaacaaagaggaacctgcccactcttcatactctggaactggctaggctatgagaaagtgacatcgtctatctagcctgtatagctgtgcacaatgacaggttgttatgcataacacacaaaattgccacttcatatacctctctcaaagaccaaaggttctggaccttaactgatacacaggatgatgtgcttttagtgctaccaagggcactgcaactattgtaactggcattgaatcataaggatctgtcctcatcttgacaatgacatattcttataaataaattctattctgagagcaatgtgcttcttaaaagaacatgcaaatgtattcatgaaaagtgctatacactgaaatgacctgtgctacttcgtaatgctctatcctacaaagttctcacctcgaaactacggtgctacaaactgcataacagatgtacagaatcctgactgctctcgcaatgc

SEQ ID NO: 50741 - DNA, 635 bp, Triticum aestivum
  unsure (1)..(635): unsure at all n locations
  Clone ID: PAT_TA_50741
cccggngtcgacccacgccgtccgtgcctggctctcgctccaataatacattaccatggtcccccgccgtgatggcttcctcggctaccaccggcgcacccttccagggctcaagtccacagccggtctccccgtcggccgccgctccagcggcagcctcggcagcgccagccatggcggatggatcatgtgcatgcaggtgtggccaattgcacggcatcaagaagttcgagaccctgtcttacttgccacccttatccacggaggccctcctgaagcaggtcgactacctgatccggtcaaagtgggtgccctgcctcaagttcaacaaggttgccttcctcttccgtgagcacaacagcttccccgggtactatgacggccgatactggacaatgtggaagctgcctatgttctggtgcactgacaccacacaggtgctcaacagaggtggaagacgtcaagaaggagtaccctgactcctatatccgtgtcatccgcttagacaacctgcgccaactgcagtgcgtaatcttcatcgcctttaggccatccggttgcgaggagtacgacaaggcctaaactacaagctgaaacaatggcctatctcgtatgaaggtcttttgagaacttca

SEQ ID NO: 50742 - DNA, 524 bp, Triticum aestivum
  unsure (1)..(524): unsure at all n locations
  Clone ID: PAT_TA_50742
nagcgggcaggactactagcccggcgggatgccggggtgcctgagcccacgggccggccggtgggcttactagatgtcgatgtgctcgacgtgacaaatccagggcgagaatctactcccggtgtacatcggatgctttaatgcgttagacgctggttttggggctgcagcttaagaagagagaactgtataaatgatcgccctagtataaaaaatgagccatgccagtgatatttattagctggaaggaatgcatgaagctttacgtgacctggcatggaccgtgttgttcttcagttcgatgagctgggcgaggatcatgctctgagcttgtgttggcgtcaacagcacgttatagacggatactgcgttagtcatgatcatactataaagaagatttctatgaccttcaaggcgatattacagactaatgataaaacaagtaagggttgtgatggaacaggctgttgttttagaagaacagactgtcggacgatgaaatgaataagcttggatatgctgtc

SEQ ID NO: 50743 - DNA, 472 bp, Triticum aestivum
  unsure (1)..(472): unsure at all n locations
  Clone ID: PAT_TA_50743
tcgtccggcatccgtcgctgnagtcaacgcgtggctggcttccctggcagcggagggcggcggtatgtgatggcgcgacnnatnctatccaacnattttacttctaatcataccctttatttcaataacctcttatcagacattcaataaaaaatatttgaagaaatcactttatatatttttctctcaatatattttaatattccatattacattcttaataattaataataattaccttcaaacctttttgccatttatttaaattacattgactactattgattttctattcctactaattttatatttttacggcaataaaaatcttgtacaatatttattaactanatctaattcatttccaaataaatattggtcttatcctactaaaaataaatacaatatttaaaataataatacttctcaaaaaaaacgtacaacttatgattgacaaaaacctacctactaa

SEQ ID NO: 50744 - DNA, 522 bp, Triticum aestivum
  unsure (1)..(522): unsure at all n locations
  Clone ID: PAT_TA_50744
gggggggtgtgtggggttttaaatttttttttttgttttttttttttttttttaaggggtaattcatagcggggttcatctcattcaaacggggagatagcagccgccccagggaagataaccaaggcggcccgacagagatccaccagggggggagagggcgacctaaaaccctcctaaaccaaccacgggagatctcatcgggcgggccagggngaaaacaccacacgacacacgactcttttatttaaatcgacgacaccacacgggacacacggggcggcgaccaccacggcgaaaggcgaccccccccccggcggatctaaagctggccccaatccgctataaccacctgcttggagcaagtgcccctgcgggagcccaccttctcgatgttcttgacgacgtccatgccctcaacgacctcgccaaaaaccacgtgcttgccgtcaagccaattgcaggggacggggcaaatgaaaaactgggagccgttggtgttgggccccccgttggccatgg

SEQ ID NO: 50745 - DNA, 480 bp, Triticum aestivum
  Clone ID: PAT_TA_50745
ggggttgtttgtttttttttttaaaggggagccaccccctaatccaagagtaaaaggcaccattcatagcagcacagcacacccccacgggcttctaaaaaacgccggcacgagaatcatagccttaaaagaacccccgcaaacccagcgcggggggggggggcgcaaatgacagtacccatcccctcttcaacagtggttttggacaattcctacctataaaaacaagggcaggcagacatgggtcagataacgtttgctgagggggaaccggactttacgccatacttgatcctgttcccttggaccaactgcgagaggaagcctacaacaaacgctttaccacctcctttggagctaacaagctagcacttggacgatacgatcacagggaatgttttcaccttggcattctaaggcacaactacgggatcaacaccctctgtaaacacaggaatcctgtttcgttttccacaagcc

SEQ ID NO: 50746 - DNA, 503 bp, Triticum aestivum
  Clone ID: PAT_TA_50746
gggggtttgttgtattaaaaaatttttttttttttcctttttttttcaattgttttacataacattttttttataaatttatttttaataccataactattacagggcgcttctttcaattatgtcaccataccccgcccacgggggggggggggggggaaaccttataacgccccccttgcgatcgtttaggggtacacaaaacgtatgccaaacagagtttacaaaaaaaaaaatgctacccggtgtggccgatctaaccaaaatccccgtagtggtccatataaacggccggcggcaacaggctacccagaaaaacggaggggggacatatggggttaccatccaccccgggtggggatacgtttaaaacatgcacgaaggatggggaaaccttcattccatgtaaaaactgtttttccatgaaattctacaaaaaaagccaaaccctagccaaaagggttaaagaggggggggggctaactagatacctaaaacaaaat

SEQ ID NO: 50747 - DNA, 472 bp, Triticum aestivum
  unsure (1)..(472): unsure at all n locations
  Clone ID: PAT_TA_50747
cgccgcggggggggggtggtaaaaaacaacttgcttttactaactttcatctatcgcgcggacaagaagttcagtgacctgggcggcatcagagtcccatctaacgggatccaatacctctccaaacctacncgatgggggtagtcgggggcactttttcccctccaataacactaacgtcaacaggtaaaaaaagggttcctggcttaacataactacaccactagggcccactcccttgactccctacattggtgcccgtcttgatccttcttagtggccgaactgcccacggcgaagagggggggcacaccctcccctctgcctaaattattccatatataatgcccaagtaccaaccatgaaacataaccaaaaactgaacacttggtgcatcatttcatttctatctacacaagagatgggggtaatggaagataaaaaattattggcacaaaaacccttcaaaatt

SEQ ID NO: 50748 - DNA, 516 bp, Triticum aestivum
  Clone ID: PAT_TA_50748
gcataaaaataaaagcgccaactgattttatctataccattccaagacccacatactttttaaaactataataatttggtacagcagcctcatcatcctaattatgtgcactagcatctgttcaaatctgcggcgggggggggggggactcttaatgccatcactaataaccatattattggcccacggcgtattaagctcatctaaggatgctggagttgctataaggtaacctggatataaaaggaagggagcatggggtgtgggaccaacataatgctataagttaagttccaaactactatccggatacatactaaaacctatgagtgggggactcattgatactgatatcatgaattcctacgaccttgcaaggatctaaaccatctttgtataccctacacctcgcttgaagatcaatccaaaacaccatgtgtgccttattgcaaaaccctaaactcaagccacttatcgattccattacacctgcagtttacaagcctaacatcaccc

SEQ ID NO: 50749 - DNA, 518 bp, Triticum aestivum
  Clone ID: PAT_TA_50749
gggggggggggggggttttttatatttttttttttttttttttttttttttttttttttgggagggaaaaccacaatcatgccccagggaagccgaacaataatgctcatattacaaagggcacaattgccacccccccatgctcccggtgggggggaggggttgtaagttgtgactaaaatgctgcaagttcaatcagggggcaaaccttcaactaaaaatgggtatggggggattctacctatcaactaaaagttgttttgcccagccatcgggggggggtaagggaagggttgattccaagcttgggcaggaagagggggtaaattatgtgcagtatgaagacaaagaatccacaattaagtagaagcaggggcccaaagattacatatattggatccatggatggaattgcgttaacaccagccggtgccaaaagtacgttaaggagggatgcacgttaacggttataaattgaagaaattttttggggtgaggaacgaggacactaacacata

SEQ ID NO: 50750 - DNA, 306 bp, Triticum aestivum
  unsure (1)..(306): unsure at all n locations
  Clone ID: PAT_TA_50750
ttaaaatttttttttgtttttttttttttttttttgggaacaactttgctctgatttttcatttcattcatagccaagggggacgggacagggaacacggaacggttgcggggtcacatctaaccgtgggggtagcagggggggacctactcaatagaacnagatctangggactcggggggggagcgataacccttttgggagacagggaaaaaaggggcgggaactaggataactgggcagggagggggcccaccattaactccctccagttgccgtcgccggagccgacgggggggggggcgt

SEQ ID NO: 50751 - DNA, 254 bp, Triticum aestivum
  Clone ID: PAT_TA_50751
ggggggggttgttttttttttttttttactactaggaacatctaagcttggcgtgatgcatgaactaccagcaagtgcacatcgatcgaaggggctatactttactgccgcatcaattccagtcagtcacctcccttggtgacctttcgttggggggtgggggccaccagagttagccccacacatggccgtaaccttatccgggacgcaaccttattcccggcacaagccccaccgaatgcccccaccttgcc

SEQ ID NO: 50752 - DNA, 521 bp, Triticum aestivum
  Clone ID: PAT_TA_50752
gacaaaaaaaaaagatcttactctaccagtttggtacaatgtcaagcttcaacagcatgttaagtacagccactacagttacaagtatttctttcttttaccctgaggtacacatgatacaacaaacttcgtgatttgaatgctagggttgaattgaatctacgctgtttatttccaaaatctgacggatcggtcatttccgcatgtaacaaacaccggctctacaggggagtgctccagccacctaggggcgccggtatggccagagggcaatcttgctaccctttcagaagtaagtgcgtcccagacgacaacctcgttgttttgctcgtcggttgatagtacaaactcctcagtttcgttgaagacagcctgacaccggaattgtgtattaacagcacctggatattgcttcacaagtcttccggtgccaacttcccataactttatacacgaatccttcccactggataggatgtacctctcgtctttggtgaaaattgcactcgtagcttctacag

SEQ ID NO: 50753 - DNA, 458 bp, Triticum aestivum
  Clone ID: PAT_TA_50753
cccaaaaaaagccatgggcgggcaaaaaaaaaaattttattcccaaccttggttgggccttcccaaaggggggggggggggatccacccccagccaaccccttttggggaaaattccagggccaatgggccccaggaaacctccaactggggccacaaaaccccatgtacccgaaaaacggccatgacaaaactcgccagggagggcaaaggccccatttagagggcagcgaagtcccccttgctgcccttaggggcaggcttaatcgactttcccccaggtttccatcctgccgggcaaacctcgttggggtttttttggccgtattgcaaaccctgaggggttctaaagggttaatccacactggggccaaaaccaagggtgtaaataggggaaggctgaatccccccctccttgcaaaggaggaaaaatcctttaaaagcaattccctggccagg

SEQ ID NO: 50754 - DNA, 351 bp, Triticum aestivum
  unsure (1)..(351): unsure at all n locations
  Clone ID: PAT_TA_50754
ttgctgctggtttttcatttcattcatagccaacgggggacggaacaggtaacacgggaacgggggcggggtcacatctaacgggggccagaacatcttttaacctaccccatnnacctagagggggggggggggggattctatctataacacttttnntanacangtgaaaaaggggcggggactaggataactggccagcgagcggccccaccattcactccctccagttgccgccgccggagccgccgcggctgccgccgtagccgccgccgccgccgcctctgggggggggggctcctccctcactgttttcttaggcaccggcggcgcctctgcggccacctttgt

SEQ ID NO: 50755 - DNA, 446 bp, Triticum aestivum
  Clone ID: PAT_TA_50755
gtgggtgggggggtgacgactacaatcccgtggcaggataggggcacttaagcccctcctgccttacttgagatgagggaacacgtcaccatccactgctcctctcatccaagagagcgaaccctgaattctcacaaaagcgcgccaccaccatggtagggggggtgggggccaacgaagttgctagggcaaaaattagactgaggcgacgccagcacgaaagcctatctaaccgtcaagctatcatgaattaatcgatcatccagcaaaggccgaactacccttcatatctaagaaatgcaccccttccagaaattggacctagttggaccggacgcgcccttccacctgtgaattgcggaacgacacctgaacgaataccccctttccctatagagagaatccattcagctggtggaaatcatagatataggtgctagctatgg

SEQ ID NO: 50756 - DNA, 566 bp, Triticum aestivum
  unsure (1)..(566): unsure at all n locations
  Clone ID: PAT_TA_50756
ggggggggggtttgttgggaacaacatagccaacatgcgaatcattttagaactgaccagatgcagaggcaggaattctcgaggcgggctacacaagtgtgcaccgtgcactgcaatgcccaacaacaagattgtagcagcaaacatttaagggggggggggggggggcaaggcagcanttccccatgacgagttaccgggggggacaatcttcctgatacccaaccgtagggaaccccccctagatcttgtcgagcttgtctgccttcaccaccggattagccttggcaatggcgtccctggcagcagtccggtagtggagcttgcagtcntgcttgtcggagtagcggtggagtgcgcantacaagttcccacaccggcagttgaatcccgtaagtccaaccctcttcctgcaggcgctgcaccggttcggccctaccttcccccctttggagatcgccgccaccccctcgctgggtccggcaacatcagcgggctgctgcacgttcattgtttgcaactcaacttgggcaacagctactaccgtgttgctgccagcaacaacc

SEQ ID NO: 50757 - DNA, 557 bp, Triticum aestivum
  Clone ID: PAT_TA_50757
gtgggggtttgtttgtttttttactagctaaaattcgatatattcccagttactaatactagtttgtctctgatacattgggattactatcctgttttacaagagcagcagcaaacatacaaaacaagtaggcaaaatcgtactttagccgggggggggggacactactagaacatctaagctgggcgtgatgcatagactaccagcaagcgcacatcgatcgaagtgcctatgcttcactgctgcatcagtggagtcagtcgcctcccttggtgatcttccctatccagttggccaccaccggcgtgagcgccacagtcggcgggaaccttatcggcgacgccgccttatgcgcggcgtaggccagcgcgaatgtccccaccttccctccggtctcgtccgtggctatcccaatcttgccgagcagctgctggacgtcgacgccggcgttgatgaggaggtagcaggcggtgaaggagatgagcgagagcgtgatcgaggtggccaggtacgctccgccgtacttgcccaggagctccttggcctgctccgttctc

SEQ ID NO: 50758 - DNA, 305 bp, Triticum aestivum
  Clone ID: PAT_TA_50758
gggtgtgtggtgtgttaggtaaatcattcattcttacatattcatcactccatcctaggggagatagatgaagcaattacagggacacatgcacacacatacacacaaggacaccaaggtctgatcatacgccgatagcgatctttggggacgacgggcgcatgcacacccaccctagctcgactcctttagatgagaggctggtgattgacgtttactttgacaccattacacgtgcttacgacgggacgagtgcatgcagcttaacagttgccgggggtgtacttgcagttggggacgtagct

SEQ ID NO: 50759 - DNA, 492 bp, Triticum aestivum
  Clone ID: PAT_TA_50759
gcttgtggggttgttggtttaaaaatatttaatgtttttttctcctttttttttagaaaggtgtagaaaatttatttgtatgataaagcttgaaaaaacacaggatccgccaaaaacgtcaggggactcctaatcacactcatcacactaaccgggggggggggatgtatctataagaacaccacggccattccaggtgcagaaagactactggattccttccaactaataaataaaactggcttggctgattttttaaacgagggcgctggcatttatacaccattttattttcatgctacaaaaaccaaaccacattatgtgggatcaaagcatccaatttacagcgggtaacaatgcacttccacttgatttctacaagggcatcatacaacctcaagaagccctaccgccggacgcgcaaactcacgcccctggaaaatctttgccggctctgtagtattgccctctttccgcacgcttgtgcttacc

SEQ ID NO: 50760 - DNA, 545 bp, Triticum aestivum
  unsure (1)..(545): unsure at all n locations
  Clone ID: PAT_TA_50760
gggggggttggggggggtttaaaatatttttttttggggagggactgcatgcaaccatgtcatatcaaaacaaaccattacctaatcaacatttcagggaaagtcaaaacgggttccagttacaaaaacctatctaacactgtctaatgaggggggggggagacttccatcctaataatattattacaaaaccattcnatacatacatatccactctttgcttctccttcgaggcaggatactgggctccacacttcttgccggggctttttatcaggcttacttccttacctttttgggcagcctgcatccattatgagcgagctcggtcacatgctgacacataccttataggagacggagtcctcactctttcgccccggaaaccatccctaaagcccatgagcaccttcttattcttcctgaaaaaagaaatactttcaccttcacaacgaccgatttaaggccaatcttgatggcaactccccccatgtgttcccctgtagcttcaccagcataccgagcaactcgagacccaccctttc

SEQ ID NO: 50761 - DNA, 126 bp, Triticum aestivum
  Clone ID: PAT_TA_50761
tccgaaaatgtaaacttggtgctcaaaaacgtttttagggcatgagagagaagttttgggctccgcagtggttgtcactttaacagatgatttgctcaaaagaattgacttcttcttttttactcc

SEQ ID NO: 50762 - DNA, 598 bp, Triticum aestivum
  Clone ID: PAT_TA_50762
atatatcatctactgaaattcatttttgtgcacctgtttttgttacctctgtttctgaaccaagtgcatcaatgtgtttagttgggattaacattttattctggtgcttaaaatgcctctgtttttgttacctctgtttctgaaccaagtgcactagggttgaattagttgcctaatccatacactgtgcatcaggttcacaagcattagttccttaatccatacactgtgcagaacttcctgggcagataatcgtgtagttaatgcttgatgacatatatatttagataggtgaattatcagaggttggtccagatatccaaggttaatctatgcctacatcttccaaagttctttggaaaggatcaatccttcagttttttggtgttgttcttggatttgtacatatgtatgtttccattttgctccatttactactacacaaaccttgagcattttttagattttagataactaatgattagtacatatccttccattccatgaattaattttaatttgtctgggttaagctctctgtgtgtacaagctttacaaaaccaagacttaatcctagctaacctgaagatgctagcta

SEQ ID NO: 50763 - DNA, 542 bp, Triticum aestivum
  Clone ID: PAT_TA_50763
tccgcatcatcctcgacaccaaagctcatcttcttctccttgaaactttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaact

SEQ ID NO: 50764 - DNA, 552 bp, Triticum aestivum
  Clone ID: PAT_TA_50764
gtgggggggggggggtaaaacgtatatagtcgacatattgtataatattatgcgtgcgtgcatatacatagccaccgatagcattcacatacgagcatgctttctcgagccatgttcgtacatgaacatggacatacacatattcttagggacaggagggaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacataggcgtcagggtactccttcttgacctcctccacctcgttgatcacctgcgtggcgtcggtgcatccgaacataggcagcttccacattggccagtaccggccatcgtagtacccaggggatgcgttgtgctcacggaagatgaacccaaccttgctgaactcgaggcaaggcacccacttggagcggatcaggtagtcgacc

SEQ ID NO: 50765 - DNA, 545 bp, Triticum aestivum
  Clone ID: PAT_TA_50765
ggggggggggggggtttaaaaaaattttttttttttttttttttttttttttttttttttttttttttttttttttttttttttacagggggcaaaacatttctgaaaaagggggcggaacatatcctcgacagggcactgaaatcgggggggggggggggttacaaaaagaaaaaagggggtctgtctaaaccccgtctcctatggggagaaaaccggccaaaatttggcgtaaaaaggaaaacaggggccatgcttgaactaaaaacttttgagctcggaaaaaaactttgattggccaaacttttgaccatccggcggaaaccaatctgcaaatccccagtatcaacaacactgaggggcaataggggcgaaccatagtttaccacactgaaagcattgggggtggccccgtcgggccctttaaaaaaaaagtcctgcttgcccttggggatcaggttatgtaaatcgaaagccagaaactttgctaaaacccatcttacaaaaaaagagcttgggtatggctgggggggctgcaaccccca

SEQ ID NO: 50766 - DNA, 206 bp, Triticum aestivum
  Clone ID: PAT_TA_50766
gctcaaaaaccttttttaagtacacataaaaaccaccttcagcagataatgcgaactaacaacatcgttgagttacagtaatggttcaagattggagacgagaacatcaatcagcaattccactaacaaattcacgggggggcaatctttcctttctcatgcctcgctcactccatcgatctgctatcctaacattcttcggtata

SEQ ID NO: 50767 - DNA, 348 bp, Triticum aestivum
  Clone ID: PAT_TA_50767
ggggggggggggggggggggggggaaaaaaaaacatgtgggtaagcaacgattacggatacgcgggtgcaggggctccaggggccactcccctagggggatgggaggaggggtagggacagtggaaccgtggaagacaaaccgaccactctacattggggggggggggggggatatctttacgactcccataacaaacgggcggggggggggggggggactccgtgcatagttggggatacgcggcggggggttggggggggggggaggggcggggggggggttcgggggggggtggggcgggggtggggggggggccgggtggggggaggggggggggggggagggg

SEQ ID NO: 50768 - DNA, 557 bp, Triticum aestivum
  Clone ID: PAT_TA_50768
gggggggttgtggagagcaaaataaagctcggtgctttcatacgaccaaagataaaagacaggaccatacattactttttatgacagagataggtattaaaatctaaagtctatacatgtctttgttcagagccaaactgaaaatagcaacatggggggggggggtaccttccactacaaagacaacaacaggaatctttatgtgtttgctgatggtgtgacttgcacaagtaactccacacttagtccgacaaaatgatgaggggtttcatgtctccatggagctggcaaatcgagggaggttgtagccgaggcaatactcagtgcgcgccggggttgcacctaaacgccatccaaccagcgaggaaccacgtcggagttgcgccttgcactgtcccgtcgacgagcacaaacgcatcaaacaacctagcggtagcacaagagcaagcttgtccttctctcccattccttcagcgtcaatactgccgccaccataaatccagaaccagaagatgatagctcaataatatagtatgtgtgccatgccatgctgtata

SEQ ID NO: 50769 - DNA, 524 bp, Triticum aestivum
  Clone ID: PAT_TA_50769
gggggggggcttgcacattattgattatttccttttcattgcaacaaacaaactatgtgattaatgcctgactgatattatttttctagactcaggcatgcgctacctacagccgggtggcaccatgcagatgtagcactggggggcgctttggtggatgggacaactagtgtttttctcctactaaattcactacaggacattgtgcttgcacataaccgataattttcttcgccgttacaacacaagggcatatgtgctagtttgaattaaaggaagtacccgcaagggggaatccccgttttgtgtcttgatgcctgtgacacagcacccaatgaccaggccatgcctacgggcaccgcggtaccaccttggcccgattctggtgagctcgacatccttgaagccggccctctcaaaccactcgatgtactcttcctccgtggggaagagcatccacatgtcagcgaagaagcgggatagccagaacgtcgggcgcacggggcctatcatacaagccacgc

SEQ ID NO: 50770 - DNA, 568 bp, Triticum aestivum
  Clone ID: PAT_TA_50770
ggggggggggggtgttaacataacatctcaatataatcgcgggcataatattgtatcaaccaaccacaagatgaacgactatatccagggctcgagaaacggttctttcaagcgaaagactgactgctagagctaacaaggagtttcaaccgggggggggggggaattacacgtacgattctttcctcctgactgatgatctacaggactacggcccaaggcctctaagacccgatgcgaccaactcaggaggatgctcctgaccaccggtacaagctcacatataccgatgcgagtactcctggctctgctcgatctggacactcttcctcatctgcataaccttcttgagggaattggagagtatgaagctcacgaagttgcgctgttgactggcctggactccagaagaaccctgcctgacttgtacctcacaccggacgcttttcataggggcttgggccctaaaggccggtcctccactggggagccttgtgggacaggcaatgggcgcaccgcttcactggctcctccagagggacctcctggttcacatacgtttttttgg

SEQ ID NO: 50771 - DNA, 402 bp, Triticum aestivum
  unsure (1)..(402): unsure at all n locations
  Clone ID: PAT_TA_50771
aaaaaaaacaggtcacagacatgtactgcatcaagttcaggcaaatgccacgggcacacatgatactgtcattgcgctcgccgctcagtctagctctttctccttttttttttcccnccctcnatcatggggggggggggggggtnctcataaaaaaaaaaaaaaaaaaaaannncnnaccaatacgagaaactaaaaccccacccttcccctntaccccttnttcctaccctnttaattccttacccctaccttcanncctaccacctttccctatactcantcttattaaacctttccctaatggggggatacctatttcctgtttttttttggtatccgctcacagttccacacaccatacaagccgggagcttaatgtgttaaggcctggggggccta

SEQ ID NO: 50772 - DNA, 361 bp, Triticum aestivum
  unsure (1)..(361): unsure at all n locations
  Clone ID: PAT_TA_50772
ggggaaaaaccattttattcaaactaattcaaaatgggaatgtcttcccttccaggggggtcaatcacatgggaagtagcggtaaacttgtataaaatatttaatctcctttttgggggggggggggggctctttactcaaataataaaaattaaaccaaaaaaactaccctacaaanaaaagactcatnacttncancaacanaagataccnnaaaaaaccaaacctnatntactcatnactcatnacaaaacaacancaacatcttaaatctttaaattgggggggggggaccactcggngtttttttgagccgggcatgtaaaccctgtcgtaggggtgcgccccgaagtagttcctt

SEQ ID NO: 50773 - DNA, 523 bp, Triticum aestivum
  Clone ID: PAT_TA_50773
ggtgggggtttgttggttttaaatttttttttttttttttttttttttcatccagggaaggccacaataacagcgggggcattgccaaaaaagggttcagcattgtatacttgaagtcttaaaaaaaaagaatctttacatcaccggggggagggggggggggggtccaatcaggatttacatgaaccccttttaagcgggggcggatatgcttacgctctaaagggaggacaacgttcatgaacttcctttttgcaaaagccaaccaccatttgttgggggggccattagccctgtatgcccagttaagcaccctccggggcgttccctcccttatctgcttaaaatagttcctaaacagttctgcttcctccccaaatggggggagagggaaaagtccagggaatggaaaccctggttccccaggcacaggaactttttccaaccccaggttaatgatggccttaattccaacagccagcgtccggaaggtttttaatcttttcaaggcaatattgatgta

SEQ ID NO: 50774 - DNA, 177 bp, Triticum aestivum
  unsure (1)..(177): unsure at all n locations
  Clone ID: PAT_TA_50774
tgaccatcgggtccatcccggccgggcgcatcaagatggagctcttcgccgacgtcgtccccaagaccgccgagaacttcaggcagttctgcactggcnagtacaggaagtcagcgttgggggagggggtaagggttgtcagttccatcgagtgatcaaagatttcatggattcagg

SEQ ID NO: 50775 - DNA, 335 bp, Triticum aestivum
  unsure (1)..(335): unsure at all n locations
  Clone ID: PAT_TA_50775
ccgcatcatcggnttcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatatacgttttaatggt

SEQ ID NO: 50776 - DNA, 533 bp, Triticum aestivum
  unsure (1)..(533): unsure at all n locations
  Clone ID: PAT_TA_50776
ntnccgcacagggnacacccaacttggnngcagttgctgctttcggcttttccaccgnatgnntaactccacgntggtgagnaacctaataggnactnngtcctgttgacnnctgcggtccacgnnattcaagctattcgatattaaaaaaacaagttcaggcagaaacttgtgcttttgggacaccattgtagatcaggtttgcatatgcctttgagaattcagacaagtggcacatgaagatcattctcattcatccatcaggattgcgagattgtaccacatgtggtgatgccctgttacaagttaatcaggactgtgatggtcatcatccgtttcgtcacagagtaattagtctctgaaattatcgatgcagctccatgtttattgtgctaattgtgagtcagcttcagtcgccgccagtcgagactgggactttgctttgcatttatacatcgagatttggttgtcatgcccaagtatttatgcgtattgcagcgattgatgtagatgcttggcaatttggaggacag

SEQ ID NO: 50777 - DNA, 572 bp, Triticum aestivum
  Clone ID: PAT_TA_50777
gcagcaacaaaatcattgctatataacatcagaaaaatgtgtgaaagtgcccatgaaacaattgcatcttaaaaattcgttgaatcagaaagtaaaatggttgattcatgggccaatggccactacgtatacatcagtagcaacgtgaagagagggaatatgctcactcgacattacctgaatgttctaaagaggcatctcgtgaatgttcttaacaggcattcatgcacggcatgatcaaataaatcattgagagggaatgacataggggttgaaagcactgctcactttgctgggccaacctggcaccgggcgtggagaccatcgacgcgcagagcaccggcgcgagccatctctagccattgggcatggagaccagcgacggcgcctagcatcggtgcgagccatcccggcgagctgccacagcgctccaacgtacggcggatctcgccgggatgaaggcggcctcctcgttcacccgcgcctgccctgttcagcaccgcctggaggatgttgcacgcgcagccgcggccttaccggcaacccgagcctcacgtcgtagacgcgccgtc

SEQ ID NO: 50778 - DNA, 609 bp, Triticum aestivum
  unsure (1)..(609): unsure at all n locations
  Clone ID: PAT_TA_50778
cccangactcgttagggttttctcctttttcggggngagaaatctcaanaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgcggtcgtcagtatttttgc

SEQ ID NO: 50779 - DNA, 620 bp, Triticum aestivum
  Clone ID: PAT_TA_50779
catttctctcctcctcctcctgccaccgatcccgaaccaggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctctgcgccagcgacactggtacatccagagcacatgtgc

SEQ ID NO: 50780 - DNA, 631 bp, Triticum aestivum
  unsure (1)..(631): unsure at all n locations
  Clone ID: PAT_TA_50780
gcgttcgcggncgcgtgggnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttttgaagggtccaaattttacttccgggggcttgcaaactttttagttttttttttggggcccccaaatttaatttattgggccgggttttaaaaacgggggaatgggaaaacccttgggtttcccaattttattccctttgaaaaaattccctttttccccagtggggttattagaaaaagggccccaccgattcccctttccaaaaatttgcccaccttaatgggaaatgggacccccccttttaggggcctttaaagccggggggttggggggtttccccccaggggaccctttacttttgcaaggcccttagcccccgtttttttggtttttttcctttcttttttccccattttggcggtttttccccgtaaatttttaaatggggggctccttttagggtcccattttagggttttagggcccttcaccccaaaaaatttttttggggg

SEQ ID NO: 50781 - DNA, 265 bp, Triticum aestivum
  unsure (1)..(265): unsure at all n locations
  Clone ID: PAT_TA_50781
gtttntntggggaaaacaaactttgctctgatttttcatttnattcatagccaacgggggacggaacaggtaacacgggaacgggagcggggttacatttaacgggagccagaacattttttaacctacncnatnganccagtggggttggantngggannctancnataacacttttnntanacaggtaaaaagggggnggtaantaggataactggggagggagggggcctaatattaaatacctttagttggggggggggga

SEQ ID NO: 50782 - DNA, 431 bp, Triticum aestivum
  unsure (1)..(431): unsure at all n locations
  Clone ID: PAT_TA_50782
ttgggacctctanacggccgggggggggggggggggtttttaaaatttttttttgggcgtcaacaaaattaagcactacaattctatagtgtcatgagtgcaattctgctactaacccacaaaaaaaagggggaagaaataattaaaggcgggaaaaacatnaatggggggggggggggggttaaatatagagcancanataacgcttgcatgcgcaagcgcaaggggataactttaggtcacacaaacaaggggtcccaagatacaaatctcaaaactggaaacaaccaaaactaggttgggggatgcttaatgaaacctgggctcaaaccactgaggacacattttaggccttatagatccaggggtgctgggtggtcctccactttggaatgcgctnaggggaaccacaggggcgatctccttgctgg

SEQ ID NO: 50783 - DNA, 255 bp, Triticum aestivum
  unsure (1)..(255): unsure at all n locations
  Clone ID: PAT_TA_50783
ttcactaaaatcatattaaaaaacatanactgtttcttcatcctttgttagtgctcctcttttttatcaaaatgacagtttttataaantactncctcctgttcctgggggggggggggggggctctttatttcantaattttcnatttaatcaagctaactggatcacattacatagagcagtantgtgtctatctaacaggggctaagatgggccaactccatcaaagagaactttgattttgggcctcctat

SEQ ID NO: 50784 - DNA, 554 bp, Triticum aestivum
  Clone ID: PAT_TA_50784
gggggggggttgttggtttaaaaattttttttttgtttttttttttttttttttttttttttttttttttttttgggaaaccacatatcttaacatagatgagaatcacaagctacataggccccctaatactattatcaaccatgagagagggggggggggattatcgcatatacccaattttccaatatcccccaagggcaaaggggcattggcctctattctccaaagccatccgagggttcttcatcctcaaaactctaaaaaaacaagttatctttgtttggagctcccaatacaagattaaacaattttgggggggcttcaaaaacctcggatgaatcttcttcaacccctgggtgcctacctcgggaagccagcacgtgccaaaccaattcctccgggaagggaaattgccaaagctttgctttcctttttcgggggttcaactcctaaacattaaccacttgggctcgttcaacggcagagggggtccataacttcacaacattatcaattccactggttgcaattgtcatagcatgaggatgggg

SEQ ID NO: 50785 - DNA, 494 bp, Triticum aestivum
  unsure (1)..(494): unsure at all n locations
  Clone ID: PAT_TA_50785
anaccccgcccttggtttggggggggttaaaaaaaatttttttttttttttttttttttttttttttttttttttttttttttttttggaaaccccccttttttaacataaattaaaatcacaagctccataggccccctaatacttttatcatccctgggggggggggggttattatcccatatacccaattttccaatttcccccaaaaacaaatgatcttttgccttttttttccaaaccccccccaggtttcttaatcctcatcactctcaacaaacaagttatttttttttttaactcccaatacaaaattaaacaatttggggttgtcttcaaaaccctctttttaatttttttcaaccccttgtttcctacctgggaatgccaacacttcccaaaccaattcctcccgcaaggcaaattgccaaaactttaatttcctttttcggggcttaaactcctcaacattaaccacttttcctccttcaacc

SEQ ID NO: 50786 - DNA, 557 bp, Triticum aestivum
  unsure (1)..(557): unsure at all n locations
  Clone ID: PAT_TA_50786
ttggtccttaacgcccgctgggggggggggggggaatacaaataacatgcttaatcgcttacaacacacatgtgaatgatcaatcgggtacttttacagttgatgggcatgcataccttggcgctctactagcattgaaaaggtaatcgggcttcttgtgggggggggggggaaccctaacataactccttacacgctangatggatcccacatgccccatgttcggggctccctgtccatctctttgggtgtcaatgcgactactagccgctagggaaagagttaagaaaagacctaagctctaggcgggcattggtgatgtggggtgggatgagtgggatcccggggtactacaaagaacgatccatccatccattttgacgatctcctgcctagcagagtgtttccattactaattcccttgcagcttgcatgcgtatgcatgccttttttcctttccaatcaatctgatatctgatcggggcacgtacggagttctccctggatcgggtgatggtcaaccactgccgccggcggagccgccgttcatgactcc

SEQ ID NO: 50787 - DNA, 532 bp, Triticum aestivum
  unsure (1)..(532): unsure at all n locations
  Clone ID: PAT_TA_50787
ggggggggggggtttttttttttttttttttttttttttttttttttttttttttttttttaaatccaagggggagagaacacccatattataatcggggaactaattaaaaccaccagcacgcagttgcacacccacacacaggaaaggggggggggggaaaacaactacccccctaaccacatttaaatcccacgggagggacaaccctggttaaaccgccaaagccgaaaagggggcggccctggcgcttgagcgcgaaaacaacttccatgggggggacggttttggggggggggtgctccgggtaggggagggggtnaagaataaggtttttaaggaaaatcttgagcacgccaggggtttctttgaaaataagcccggaaatgggtttaacgccgaccaaccgggccagccgcaggaacgccggtttaataatcccctggaggttggngggaagaaccttattgggccgtttagagccaccttttccaagggccttggctcctttgccttggcctgaaatgggtgg

SEQ ID NO: 50788 - DNA, 508 bp, Triticum aestivum
  Clone ID: PAT_TA_50788
gcgcggggggggtgtgggttttaaaattttttttttttttttttttttttttttttttttttggggagaaatatatatactgaacatactatttttagcgcgaagaatttggatacaccatacaaggaggtatattcaatttaaaattttacaggggggggggaggtgaaaaaagcaatggcccaattttgtgccagagcatagaaaggacataaacacagtggccagtaccagaacacttgccatggggaaaacctggcagtttattgagcttgttaaaaaaaatatgctgcccaaaattggcaaaatgtgataaaagaaaaatggtggaatttacgatgatgatttcccaaaaaactagggagttggagaaggttaagaatttggaaaataccaaccacgggttatttaaaggggcttttttttttttgaaaggctggatttgggaggatattaagtatttctgggcatgggggaaaacttaattgttttggagaagggtttgtat

SEQ ID NO: 50789 - DNA, 353 bp, Triticum aestivum
  Clone ID: PAT_TA_50789
gtgttggttgggtgtgggccattaaaacgtatatagtggacatattgtataatattatgcgtccgttcatatacatagccaccgatagcattctcatacgagcatgctttctcgagccatgttggtacatgaacatggacatacacatattgtggaggagcggataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctggcgcatgttgtcgaatccgatgatgcgg

SEQ ID NO: 50790 - DNA, 406 bp, Triticum aestivum
  Clone ID: PAT_TA_50790
ggggggttttgttgggtttaaaaattttttttttttttttttttttttttttttttttttttttttttttttttttttggatcaaggcatgagggaaaaggggcaagggaggcagcatggctacaagggttcaaaaaaaagccaaagccggggggggggagtaaaaagaacaattttaccactactactactactactactagggctactagggcttttactggtgctactaaggaaccgggggtacttactagctacagctaacaaggtagggcaacaacaacactgaaaaggggtttggtttgggcccaacaggtaaacttcaggcctaacacccatttaaaccaactacctcaactaccccgggtgggcgcgcatcacgttacaaaaaaggggacccacccac

SEQ ID NO: 50791 - DNA, 350 bp, Triticum aestivum
  Clone ID: PAT_TA_50791
gcggcggggggggggggggggggattaatgaacaacctggggtgggtcaatgtcttaatgcagcatgtggtgggctcatcatgaaaagccaggaagaacacctggtgaatatgatagttcgagggggtcgcgtgtcctatattgatgatcgggcctacccattagggggggggggggggagcgcaaacctatgatgttaccagacgcctgggtggggggggggattgctgaccgggaccggggggcatacctgctgtaggtatagagagttgtcttagagggtggtgggagcatggagggggctgttttctgtgtgaaagtgttataacgaggggggggactacatcggg

SEQ ID NO: 50792 - DNA, 381 bp, Triticum aestivum
  Clone ID: PAT_TA_50792
ggtggggggggttactaaaaatttcttacgtttggcgttgttatcccttgaaaccgggaatataccttagggcacttaagcatgactcatatttacaacccaaagggatagttttttctctttccaccctccaaccaaaactgacaggggggggagtgctgtatggtgctctacctatcagttactaactacccagaacgtcgatcctatgaaacatgacctttggaattatttccatacaggcaccgggtgaccattgccagcagaaattataggcttgggctatgcccaaggggtccagaaccttttgtgaagaagcaaggcgtcatttgactccacccgggataatcagcccgaaacctggaggcgacccatgtttcc

SEQ ID NO: 50793 - DNA, 442 bp, Triticum aestivum
  Clone ID: PAT_TA_50793
gtggtgggggggtgagtctaaaactgaaacctggcgcatcacgattaccatcacagacctgcacctgaaacgtccacaaaccggcaccacctccatacgaaaaacgtggactatgctggggctgttttgaaaagcaccacgctccatatatgtggggggggggaccgcccaaattcctgacataaaaagctaacctctttgccggggtacgcgctcgcctccgaggcggggggcaccatcaaccaccctttcaggccgccttgggaaatcagagaggcagtttgtcgtagcggaacatggtgtaggaatgggcaaaaaagaaatgtccaaggatacacagaggaccgcaaggaggcgagatgtccatggctgagaatccactgatgcactgggaaggagctccttctccaagcttcaagatatactgttgtggattcagagc

SEQ ID NO: 50794 - DNA, 464 bp, Triticum aestivum
  Clone ID: PAT_TA_50794
gctgcggcgcgacatacctccactggaggaaaaccgcatgccgtacatgaagttggctgtagagctaggccttgcgaactggggcacggatacaggtcttggatgcacgtacatgcttcatgacggaatctcggtgacgctgaccggagaaaacattccatctggctcctaaatggcgaccagaaaggtgaaggatactgaatctgacatggacatgatgcattacctgaccaacatgaactgtggctaaagcctggtcttattcctgctgctatcacagaggctagcctgcgcctttacggaacactcttacttgagctgctaatcgttatagcagctgcgcgggtaaccattgcaggcgacgcgactagaaaccatatacattagctgacgaataatagataagtcattagtcgtgtggtagactgcaatgatactgacatgataagcatgggtggagaaaa

SEQ ID NO: 50795 - DNA, 369 bp, Triticum aestivum
  Clone ID: PAT_TA_50795
cgctatatatgcgggggttgcgtactaaccatcgacgtccaacgtgctagtcgccgtgcacgactttatatgcgctctctaatccacacgcgtctagagaggaagcgcgtccaggcctaaacagttcactcagcaccggccatcatataacgaggccattgcagattacgcaaactctacacgttgatttgcgcatgccttctgcataagtctttgttactagtgactaataatatccgtatgtacactgtgaatgtaacatcatggctagcgaaagcgtgctttattgtgaatgcattcatgagctatctatatgcacatgctttgaagatctacaaacaagaaactggctgccgcatggctgacagc

SEQ ID NO: 50796 - DNA, 621 bp, Triticum aestivum
  Clone ID: PAT_TA_50796
cggccgcgtgggggcgcccctacttcctccctcgcctccgtccggcagcccgaggctgctcaagagcagcagcggcagcgagtggaacgtggtggtgcagaggaacgtcaagtcctcgctgctgctcctgctggccatctccacggtcgtcgccttctccatcctctactcgtcccggagcttgacggtggccaggacggccggggaggcgctgacgcagagccctctgctcgccgccctcgacctgagcagccggatgccagaggatgacgacgatcaaagcgacgaacctgcagaggtcgtctcgttgacagctgctgcttcgagcacagatgatggtccaagtgaggcagccatgcagctcgaggagaaatgcgacatttccagggggaaatgggtgcgggagccgaatggcccggtgtacaccaacctgacgtgcccaatgctgccggacttcaaaaactgccagaagttcggcaaggatgacggccacctctactggcggtggcagccggacggctgcgagctgccgcggttcgtgccggaacggttcctcgacgtcgtccgcgggaagcggctcgccttcatcggcgactcgctggcgcgcaaccagattgactc

SEQ ID NO: 50797 - DNA, 595 bp, Triticum aestivum
  unsure (1)..(595): unsure at all n locations
  Clone ID: PAT_TA_50797
gnaggggagggggggggggggggtccaggcttcatggcgacggctattgcggccctcttctcatggcacaatgggggtgctcctctcccctccccggggctgcggcggcggccggaggtgacccggtcttcggattttgaggcgaggcgttgtgtttggttcccggtgaaaaccttgcagagacctcggttgatgccggtgacgcacggcgccttttggtgtcgtcctcctccctgtaggcgcgttgccaaggagtccaaatcactcaaatccctgtctctgggcgaaggtccatgatctggttttgctggatcgggcgatgacgacgttgtgtacgtcgctacctccatggaggcatcgtcttggagaccttgggtggttgttggtggtggtggtgcggccggcttggggtcggcggtggttttgttctcttctttggcggtgttcgtgctcgagtgctccttggtgtgtctctgctaggcggtgccctgcggctacgccggtggcacacaggtgtcgtggcgcagtctcggcctcgtatgaccgttcgaatgtacccccaacacagctggtgtcgcggccttgtgcagtcttg

SEQ ID NO: 50798 - DNA, 591 bp, Triticum aestivum
  unsure (1)..(591): unsure at all n locations
  Clone ID: PAT_TA_50798
cgacatgcttctgntaagcctaacgtgcccatgtgcccacctagatctgaccataggaaggagaagtcgcttgggctgctcacgcagaattttgtcaagctcttcctcaccatggaggttgagacagtctcacttgacgaggctgcaaggctgctccttggagagagacatgccgagagcaatatgagaactaaggttcgtcgactgtatgacattgccaatgtgctatcttctttgaacctcattgagaagacacagcaggtggactccagaaaacctgcattccggtggctcggtcaggcaaagcgaaaggaaggtgccactgtcacggttgctttaccaccatccaggaagattatgtctagcaagagggcatttggtaccgacatcacaaacattgacaataagaggggcaagttagtcttggaaacagagaacaaacccaaactcatgcagggtggcagcagcatgttgaaaactttcgagagtcagctcgggcaagggaagagtagtggctttgtttatgggcccttccaccctgctggtgcaaggaaacatgaagttgatgatcagacagtgagggagaatgag

SEQ ID NO: 50799 - DNA, 200 bp, Triticum aestivum
  unsure (1)..(200): unsure at all n locations
  Clone ID: PAT_TA_50799
anacattgttaataatagaactttttagtttcttttccctggtatagtttcactaaagaaacgccacgtctcacaacggtcttataagtgctgttaagtttaaatttgatgtgatctctattatgttcgacaaagaaatctggttttttggagttgtgatgcacacgaagttccatgcatggaatgagagtgtggaaggg

SEQ ID NO: 50800 - DNA, 465 bp, Triticum aestivum
  unsure (1)..(465): unsure at all n locations
  Clone ID: PAT_TA_50800
tgccgnaccatcctggcgatcgggtgggggggggggtgggcttancagaaacagcctggcgcgcgtgcctcaaggacccgcttgaggatcagctccccnagatctccatgttcgtcctgccattgagtgtccttgtcgctcggctcatgttttttctttttgctctcnactncaatctggtggggggggggggctctcttcatctcacncctantcacttccttcaccctccataatagaacttcacattacctcaatgaagtcctccttctcctatgctacattgctatcggcgcttgcttctttgttactagacaaccatcttctcacgctaacggcaacggcatgctgctggatgtcccaacgtcttctatgattgtccaggtggcacagcactgattgctttcgagggctgcctcacgattctgacgggcgcgcaagacagcgaccgaggtgtttgagcct

SEQ ID NO: 50801 - DNA, 585 bp, Triticum aestivum
  unsure (1)..(585): unsure at all n locations
  Clone ID: PAT_TA_50801
naagaaaggggcggtgggtgggagcgatggttgggagtgggggaggtccagttcctctttttcggcgggggaggtttgtctgccgccgggatgggcgactctggcggctccgtcgtgtctattgacgtcgagcgcatctccttcggcgggaaggaacatcatatagaaacaaaacatggacctgtatctgttgctgtgtatggtgaccatgataagcatgcccttattacttatccagatgttgctttgaaccatatgtcttgcttccaaggactactattctgcccagaggctgcctcactgctgctccataatttttgcatttaccatataagcccccctggacatgagttaggagccactccgattttaccaaacagtcctgtggcatcagttgatgagttagcggatcaggttgcagaagtacttgatttctttggattgggttctgttatgtgcttaggtgtcagtgctggtgcatacattcttactctcttcgcaacaaagtattagggagcgtgtgctcggtcttatcctcgtttcacctctatgtagaactccctcatggactgagtggttttataa

SEQ ID NO: 50802 - DNA, 593 bp, Triticum aestivum
  unsure (1)..(593): unsure at all n locations
  Clone ID: PAT_TA_50802
gcgttcgcggncgcgtgggccaagccgcggccacgctgatgccggccaagatcggcggccgggcctcctccgcgcgaccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctcacctacacccttcctcgtgcccagcttacaggggttcgtctttcctcgacccaaagggccgtggtggnctctactggctacgacaacgccgtggcgctacccgcc

SEQ ID NO: 50803 - DNA, 604 bp, Triticum aestivum
  Clone ID: PAT_TA_50803
gcacctgggcgcagcgctggtagggagcgacagccgggtacgtcctgccatgaagagaaagagctcgtgatgactatcttgcacatctggtgaggtctgcacgtccggcaggagcacctcataatgcatatcttacatcacaggccgaatgtacgtggaacacgcaacaccatctaaggcatgtcaccggaaaacgtgtgtagcatatgcaggagcttgcaatctttcaaagatataaacgagaacctgcgtcttccgtatatggatctgaccaatgcaagcattgattcaatcaaattctaacctaatgagacaaaagatgccaatcagtcaatcaaacacgatactattacacggtaagatcggtaggccgaattgatgatggaggatatatgactgaactatctatataaccatcaacatggcacttggtacgggcaacacaactctgtcccaaactacaaccagtatcatcgatcctcctctgccgatagcacaatcgcataaaagcaaaaccgactgcattcgtgttgctggaattccgaggtctgcgtggcaagggccaccgccaccacaagaacaggccctcgaggagagccacctg

SEQ ID NO: 50804 - DNA, 391 bp, Triticum aestivum
  Clone ID: PAT_TA_50804
tggttttactgaacaaagtacttatatttacattctcaaggcatgttcaccataataaaaaaatggttatataacattcactggtcacactgtagggacactagggccagaaggctaacaggaaccccatggagactacatggcgggggcgggggaatcacatgcgttacattaagcgccatctcgctgacagattacacgccagaacacggtgcgaaccgagccaaataacatcttcattacgaaatggatgatgaccaggctacattcagtatgcttaagctttctggccgccaacgtggaggctgagggaaggtgttagacgactgttccggcagatccgggatcaaggatgaattgcatctaagagctggaaccctgctccaggtct

SEQ ID NO: 50805 - DNA, 421 bp, Triticum aestivum
  Clone ID: PAT_TA_50805
gcgggggggggggggggcgtcaagaattcaaaatcgagctgagtgcgttgaacagggattacacagcctactgaacccaagacagagcacaacgaggcacgcgaaagcggtgaaatcccatctagcacgagacatgtcacacagagcaaacgaggggaggtgggcactagacggatctaacctcctaagccgtaaagggggcgggcctggggcttgagcgcgtaaacaacatccatgggggggacggtctttcggggggcgtgctcagtgtaagggacggcgtcacgggatgaccttctcaaggaagatcttgaggaggcgaggggtctcctcgtaaatgaggccggagatgcgcttcacgccacccctcctgggcaggctccggatcgccggcttggggataccctggatgttatctcgg

SEQ ID NO: 50806 - DNA, 498 bp, Triticum aestivum
  Clone ID: PAT_TA_50806
gctggggggttgtttgttttttattttttttttttttttttttttttttttttttttttttttggataccaaattactttatttatctcaggggatgtgttgcaagggtacaccaagcatccatatcatttctgctaccacccaaactgggcgcgtgggggtatccaaccccaaatcaacttaaccacttcatgggcatgtacgtaatatgtagtaaaaggattatttatactcctggatgggatttattggggagggcatgggcgcactttccccgggcgcgcccgaaaactcaaaccctatccttcacctggggggtggagctgttctgcacgtttttgtaacggtcccacaccatgatcccaccgtagttgctggcgcccttcacgccggggagcaccccccacctgagggcgccaggggaaaaaaaccccctcccggccgcggccgtcaaggcccgcacccccaggtaaaagcccccggacaccttcacgctgt

SEQ ID NO: 50807 - DNA, 455 bp, Triticum aestivum
  Clone ID: PAT_TA_50807
gcgggggggttgttggttttaaaaatttttttttttttttttttttttttttttttttttttaaagggggggcccttttttaaagatggagggaagaaccaaggcccctctgggggaaaaaaaacggcgtacaaggaccaaggtaaaggagagagaggcgggggattttaataaacgcgccccccggccggcccaagcaagggacaaagaaggggggaggcgggggggtggatacttatacaaaagtccctctaaaccaaggggtcgccctgccgggcgggctcctggggccccggtaaatttgaccttaaaaaaaaaggggcccaccccgtgccccactttcaagggggggaggcggaagccacgggcttcccggcgggcaatttggaaaccagcgggaacccccctttggggaggggggggggattaacactggggccaaaccccccggggcc

SEQ ID NO: 50808 - DNA, 272 bp, Triticum aestivum
  unsure (1)..(272): unsure at all n locations
  Clone ID: PAT_TA_50808
accgaaaaaggtttccccccgttttatatataaaggacgaacccaacagcccaatacaacagcccaatatagactcaccccataacaacacacccggggggggggggggtttttttttggggctaaacntnnnaacaccacccctaggactaccaccgggaagagatgaaacccaatattatgaatcggggggtccaagggggggcctttaggaaggagacgaaaccggagcgccggcaccgcccaatccgatgataaaagtttgccccggg

SEQ ID NO: 50809 - DNA, 266 bp, Triticum aestivum
  Clone ID: PAT_TA_50809
gggggggggggggggtttaaaaattttttttttttttttttttttttttttttcaaaaaaaagccacttgttcaagggagagcaaaggcaagggcccccactgaacaacatcaaggcctacctgcctgtcatcaagtccttccttttcgggggggggggggaggcttcaacatccccccaacccttcccccagggggggggggaccactgggacatcatggcctccaatcctttgaacccttccttttgcggatctccgtcacaag

SEQ ID NO: 50810 - DNA, 510 bp, Triticum aestivum
  Clone ID: PAT_TA_50810
gggggggggggggggttttttttttttttttttttttttttttttttttttttttttttttttttttttttttttttttttttttttggacaaacgggaatcaggcccacttattcatgggtcaccaaagctgcggcccaccaccgggggggggggggggcaaaggggaacactggataaagggacgggccaaaaacaaagacggggtcaggcaacctcagacacaaacgagactcaagggggggccccaaagacgagacttggggacccaaaaaccgaagcaaagctccatggccaggagctttactggccaccacggagacggggcaccaagggaaggggggaccccttctgaagggtgaaaccccccaggggggggccatcctaaagctggttaccaaaaaaaaacaagccctgctggcccggggggaagccccccttggccgggaacttccccttcacgttggcaaggggggcagaagaccccccccccagggggaagggcttgcc

SEQ ID NO: 50811 - DNA, 466 bp, Triticum aestivum
  Clone ID: PAT_TA_50811
gaaacggaaccactttttctttccaccgctgtggcaacaaggggtaccatcagattagccacgcacgaccatggcaagacactacaagcacacactttggggggggaatcacctaacagggactaaagcggcgcatgggttgcacctagccctctcgccacgtgcgggggcgagctggtgtccttgcatgatggtgacccgcttggctgatggcgcaaagttggtgtcctcaaagagccgacgaggtaggcctcgcggcctcctgcaggcggagaggcggagactggaagcggagtcggtcttgaagtcctgggcgatctcccggaccaggcgctggaaggggagcttgcggatgagcagctccgtgctcttctggtacttgcggatctcgcggagcgcgacggtgcccgggcggaagcggtggggcttcttgacccccccggtggccggggcggacttgcgggcg

SEQ ID NO: 50812 - DNA, 577 bp, Triticum aestivum
  Clone ID: PAT_TA_50812
tcctgccgcgtactaacttggatccttaacggcgcgtgggttgggggggttttccaaatttttttacgaaagaactgcaggtagaaagcattcgtcacaacgcacaatccataatgctctggccgaccacaaaccccggggcaccagccacgtgcaaacacgacacgagaggggggggaccgaaatcctcgaaagcgaccgatgacctgcactgcctctgccctggcacgcccgccgacgttcagaacagcgccaccttgagcagagcccccgccgccgcggtgaccacggggcccatcgccggggccagggagcccccggcggaggcgccggacggggtggagcctcccgcggacgagccgcccccggcgacggtgacggcgagcttcatgccgctggcgcagtggccggggatgttgcacatgtagtaatgcgtgccgggggtcgcgagcgtgacggtggtggcgccgctgtcgtctttggccagcgcgttgctgccggagcaggacgtgtagccgccctggctcacctccgtcaccgggtgcactttgctcacgtagctgaacactagcgtgtc

SEQ ID NO: 50813 - DNA, 503 bp, Triticum aestivum
  Clone ID: PAT_TA_50813
gggtggggggtttttaaaaattttttttttttttttttttttttttttttttttttttttttttttttttttttttttttttttttttttttttttttttttttttttttttttttaaaaaaaaacccccccaacaaaaaacagggggggggggggggacaaaataaaaaaaaaccccccctttttttccccaccaaaaaaacaaacctatttagtaataaatttcccgggcgggccacccgaataaaggggcccaaacccacccccccccaatttatttttacccccaaaaaatttgaggccgggttactgggttttattccaaggggggggttccattgggggggaaaaggtaaaaaaaggtcttaaactttaagggggcgggtttaggggaaaaccactttttcacagaaaaaaattttttcccccacccccggggtgggcccggaacagggacctccactttgtttaaaaaccacccggggccccccccggttcccctg

SEQ ID NO: 50814 - DNA, 538 bp, Triticum aestivum
  Clone ID: PAT_TA_50814
gggggtttgttgtttttaaatttttttttttttttttttttttttttttaaaagggggggccccatatattcattaaaaggggaggcacgaggaaaggacagtactggtcaaacacacccgacaggggcatacaaaactacggaacagggggggggggtttattttattaagcgcgcgcccccgcaagcccatgcgggggctggtgataatcccctgggggggggaaaactgggggggatggggcttgcttgcttgccctcctaatcctcgggctcgcctttgccggccggcctcctgggccccggctaagtggcagctgcaaaaggagcagccgcacccggggccccacttgcagggggggcagtcgaagccgccggtctccccggccgtttcaaacccgccggagctccccttgggggaggcggggggcatgaccatggggggggccccagcggtggcctccacctcggggaacattttgcacccgccgacaccgttgccgaacttgcagccggggcccaacccccatttgccccc

SEQ ID NO: 50815 - DNA, 385 bp, Triticum aestivum
  unsure (1)..(385): unsure at all n locations
  Clone ID: PAT_TA_50815
ttttaacagttcaagacttagttggttacagtgtcatgtagtgcactacaaaaagtagtggccagctgcaacgggcatggaagcttattgggtttttgggggccagccacaggtaactanaggctgggttcgttcggctcatcctggcgttcatgncaaagctgcgactgggtagggggagcgctctggtgcaggggctggaaaatatttagggtaaattnattnaggttcttgaaatcctgtaggtgcggtaacatgattgttgttttgacaactgatgagtagggggggagagttgntttnaatatttttttatgttnttnataatgtggtgggtttggtgnttntaggtttgagagagcaaattgtttgtttnaggatttag

SEQ ID NO: 50816 - DNA, 545 bp, Triticum aestivum
  Clone ID: PAT_TA_50816
ggggtgggggggttttttatttttttttttttttttttttttttttttttttttttttttttttttttttttttttttttttttaaaccgggggacaccttgggttaccctaggggaaacaacaaaaacaaaggggcccaaacccagggggggggggacagaaacatgcagttctaaccccaaccaggcggcccgcaggctaactaacaaaaaattcttacccaacgaaaaaaaagcccgatcgggtatgactaattaaaaccaaggcccagggagggaaaaaaagaagtctcttcatgggggccaagggaagggatttacaagaacccctcctttccgagcagcttgaggaccccgccccgggtggtgaacttggcaacctcaaagggcgtcttcccaaccaagttttggaaaaggacaaaaacaccgggcctaaacaaaaaaaccacacactttttccggccaaaaccaacaacgtaaagcagggggggggtcttggtcttatccaggggatttacagaagcccccccctcaaggggaacccc

SEQ ID NO: 50817 - DNA, 548 bp, Triticum aestivum
  Clone ID: PAT_TA_50817
ggggggggtttgaaacgaaacgacggccggtggcctgtaacttttacaagtgtgattcaaagtgagaaacgacattccaaacagggcctaaaactcttctctatatctacatcacagttacaacatctctccccatttcaacgccagggggggggggacataccatcagtatcgccgatcgccgggttagcctaaagcccctcacacctccaaccttttcttcttccatatatgtacctacactctgagattggcccgcgtcttgatcggcttcagcttcacacccatgctctcgggcgagaggagctccggcgatatgcagaacgggttcaaagggctgcgagggctggagcttacatggctcggcctgaacaggccgtatcccatgaggaagtactccattggtatcagcatcgcgtgcggctgctcctccgtcacgacggacccacatgcttgcacctcaacgagggcactgtatctcttatcaagctttgcagtcatgtgaacagcttcagtgtggaactgcgagttctcaccgacaaatatca

SEQ ID NO: 50818 - DNA, 477 bp, Triticum aestivum
  unsure (1)..(477): unsure at all n locations
  Clone ID: PAT_TA_50818
gtggggggggggggggggggaaacaatttcctttggtggaggtgcccaacaacaacctgcccatgggtggacaacacagggaaaaacacttttacttggctgcaacgtggactagcacgcttttttttctacataccnactccaatgagggggggggggggggggcttttttcaacataaactancntacttgnggagggggggggggaacttccccatggtcggacaacatcagagatatgtgggcgggcagctgttctcaccattttggaggctggatcactttggttttttttggctacaatttacttatctgggggggagtcaaaatccgggtattttttttgtgtgtcttntcctactgtttcctgtgcatgtgcttgtggttcggcttcctgtgcctgtgctgcctgtccttcttgtgcttatacttattcatcgtgagccttcttcatctccccgggacgcgtgggggtg

SEQ ID NO: 50819 - DNA, 539 bp, Triticum aestivum
  Clone ID: PAT_TA_50819
gtggttgtgttgggaaaaaattattactttttttggtttaaccaccaatcattttacaccttatttcacattttactatcactaatcacaaacctcgttcctgtttacccatgctacaaacacttatttcaacagcattgccttaaactgggggggggggcacacgcttcaaggagcctccccaacaacctagcaaagtctaattcctcaaaccaatactatcaccgtgttcatgaggcagcttaccgtacctaccgagggagacggtccggttgcacttccaggtggctctcctccaggccctgttcttgggggggcggaggcccttgccactcataccactaaatcggtaaaccgctgactccattccactaagctaacgatgcttgtccacaggctcgcaaaaccttttaatccttaggaccaagctgacagcactctgttcaacatcaacaagccttacctcaaagaacttataggtagagtcctcattcacccagtacgagcttagcacacgaggaccaaccagcctgcgccca

SEQ ID NO: 50820 - DNA, 373 bp, Triticum aestivum
  Clone ID: PAT_TA_50820
gggtaaccagggtccacgctgggtcgggccttctgggaaaaccaccatctctgctggcagtgcacgccctccgaggacaggaagatgctgccagcgctgggtgctcaccaataccaaagttttcacagtacgatgcagagacactcactgccggcgaccaggtgccaacatcgcagactaagctgaacgagccgttgctgcagttcacctagacagcaactgcttggaactccaaggcctgtatgaggggactgatcatagccttcatcggggagctgagattgaacaaaggtgggctaccaatattcacgctctgaagtggggaactggctcttattattgccattaggcttgctgctgatgccatctgctc

SEQ ID NO: 50821 - DNA, 554 bp, Triticum aestivum
  unsure (1)..(554): unsure at all n locations
  Clone ID: PAT_TA_50821
caacttgtacatcttcaatccaagtatgtcgtgaacagggcatgctgacctgaccagattgatgggctgtaaatatccaaagatcagctatgcatcttatgttggacactatccgatgttggcatatttttccattgctgagaatgaatctattggaagggagcgttacgaatttatgcagaaaatgctgcttccctgtggcctccctcctgagagagatgaagactgaggagtcagtactgtagtgctacctccacagcagcttgtgttcagatgatgtttgttaccaaagtcttaagctcaggcactttgtgtggttgtgtttgaacatctttagcactgtgcaccctgttcttgcttgtagtcctctctatctctatggatccttacccgttcagattggtttggttatcccagtaccatctcgtttaaattatggacgcaggtggctatcttttctcatgaatgggtaaatgtaatgtgatgtcgtatctgctntgnattttcnacactatatttgcaagtggagttacatggttttccattgcattact

SEQ ID NO: 50822 - DNA, 581 bp, Triticum aestivum
  Clone ID: PAT_TA_50822
cacttagctagctagcaggcatggccgccctctactatgcagccgtgtccgtaccttgcttcgccggctgcgccaagtggccgctccccgggacagcaggaaggaggtgcgcgcgtccctgggcaacaaggccgacagcgcgggcgcggccatggccgccagcgcgatagctgatggccgggtcgccatatcgcgcaggacgtgctcctgggcaccaacgacagtgtactgagtgatcgagcccaagacttcaacaacaaagacagggagaccattaacttgaagaacaacgcctacgtacccgcacaacggggtgtcctgacgaggacgcggtgccctgaggactacactgctccaaaatcttcgaacaagagtacctaaaaaaccccacagagaacttcttcgtcacgctcaccatcctcggaacctacagattatagctggagccctagacgaaccggtatggtacgcaaggataccaccaactaagctgtcatattagctcttgcaaattgatgcgagtgggctgatcgatcaggcgtgtcatgcatgcatatcgagtaattgcacatacgaacgct

SEQ ID NO: 50823 - DNA, 586 bp, Triticum aestivum
  unsure (1)..(586): unsure at all n locations
  Clone ID: PAT_TA_50823
ggctcatnacctatgcttacaagtttgtgattaaaatggtgggattgacacggaggatgattacccgtttcgtgaagcggatggaacatgcaacaagaacaaactgaaaaagcatgtggtaacaatcgatggctacaaggaggtgcctcctagcaaggaagacttgttactacnagctgttgcccagcaacctattagcgtgggaatatgtggcagcgctagggcatttcagctatactcccagggtatcttcgatggtccatgcccaacgtctcttgatcatgcagtctgctgtagcgataaccgttcttgttgcccccatgactatcctatatgtgacacggctaggggacgctgcttgaagggtaatggcaacttctccagtatagagggaattaagaggaagcaagctttctccaaggttccctcttggaatggtttgttggagcttttggatcaatagacatacaaaaatggtattggatcacaggcagatacacatgtatgcacggtcttgtacaagcggtggggttcactgcgttcttcaggtgccctgccgcctctagctgctggttgtcttgcacgg

SEQ ID NO: 50824 - DNA, 416 bp, Triticum aestivum
  Clone ID: PAT_TA_50824
ctcaaactctaaataagcggatggggcggagtgtttcattgatccgcgccatggtaatcgggtgactagcacgggggccatttgagtactgccaaactgcctaggcggcatgaacacgagccgttctcaggacctaactgagaggtacctataactgcaacggtgttaggaggtgaatgaatatgctggtggacctatgaagtctggaattcgttaatgtgtgtggaacaactaacctgtctgattaacttgctcaggacatggatggcgctggagatggccagcaacaccgcggtcctttggtacagcgccatgtcactttgagtgatatggcgctagggtcgcttatttagatccacgcttacttacgtgttgttgcgagaacttaactattattaatgttaccttattaaacg

SEQ ID NO: 50825 - DNA, 539 bp, Triticum aestivum
  unsure (1)..(539): unsure at all n locations
  Clone ID: PAT_TA_50825
cctttccctctcattccaatcaacttttacatctcaaccatgtgtatgacgcccgtttgccctcaacccgcacccgnagcgaagcgagttaggtccacttaaacaaactggcagggccggcggcgcccgcacactatcaatccgtcaccggcgatgtctttgatgggccgagagacagccgaacgagtgcgagcccagacctctttgacgcatcgcgttgtccccggcggagcgttttcacgaacggctcgcctgcgagcaacgcggaactggcgacagtccaagcccaccggtgcgtgatgcgtgcacgcctcacgctgcagaacggcacggcggcgcaagtctccagccggcgcgtggtcgcgtggcctcgacctcccgcatcagcccgaggcgttcacggcccaggcgcggcgaatctctcgatctccagggcgtcgtttgcatgccgtccaaggcaaacttcggcggcgacccatggcccggacaacgctgcctcggccaggctcctagcggagcggcggaaaccttcggcccgg

SEQ ID NO: 50826 - DNA, 560 bp, Triticum aestivum
  Clone ID: PAT_TA_50826
caacagcgcagggctcatggcgtatggaggaaaccaaacctagactggccctggggtccgagccgagaaggtcgtcccgccgggagtggagctggggctcggccctcgccggcgccgtcaccacggtggcgggagcggacgtgctggtctgcagccggggacccgagcttcgagtctcatgtccatgaacctgttcaccttccacttccggccgcctgcggcgctggacatcggcctgaccctgaccgtacacgccaccaaccccaacgtggtgcccgtgcgctacggcgcctacaacgtctacatcctctacgggggcacgctcctggtcaccgcgcgcctcgacgccggccagcagaccggcacatagtgccggctgttataccttccggcccggctcaacaccatggagctagcccaccacaccggagccatcctcgccgactccacgcgccgccacatggagctggacgctgcaagtgactgatcgggaggcgaagccctactgctgctctgggctcgccgattgtccgttcgtatcgacagccacatcgactact

SEQ ID NO: 50827 - DNA, 592 bp, Triticum aestivum
  unsure (1)..(592): unsure at all n locations
  Clone ID: PAT_TA_50827
ntncnatctganagccctggnagctcatctctcctctcacttggnagcgagctcaagcattctcttcccatcgnactggtagggataggaatctctgtgtcctctgctcattagtacacttgtacattgcatcaaaacaggcaggggagaaaaattatgcggtagctcggtcagcacaaaaaaaaaaaaaaaaaaaaaaaaaaaaaaaaaaaaaaaaaaaaaaaaaaaaaaaaaaaaaacaatactaaaaaaaaggagctgggatgctaaggttccaagactccaaaaaccctgctacattggtcctaaactctatgtcagtggctcctcagtttcacatcttccgcccctggcgcgaaccccgtcgttacccgagaaaaacctgctgttaccaaatgtccaattttgttcggcctcctgtcttttcttcctatttcggcgcctgtccgctttgccctgttccgcacagccttattgccgattaggacgcctcctggcgcattgcaatacgccctgcagctgggaatttcactcgcagcgtgaccggttaacttgcaacggccccgttaccctttcctggtccttgattccc

SEQ ID NO: 50828 - DNA, 333 bp, Triticum aestivum
  unsure (1)..(333): unsure at all n locations
  Clone ID: PAT_TA_50828
gctagncaggacagcctatattgacgtagacgcagcaggagcagcagcagcgaactctgtcagttctctagctagactgctagatcagcagccatgccgtcagttagatctgttcgtccctacttttgtttccgtttgctttacgttgctcttgggggatgaactgaaaataaagtagctacctacatcctctgcattggctgttccactgcatgttgtctaagtgtttctggctttagtttgtgctgttgatgtaataacgatgccactaacaatttggcttctatgtgttgtgttgaaacttggaatcaatcggttattagttggcttgtc

SEQ ID NO: 50829 - DNA, 577 bp, Triticum aestivum
  unsure (1)..(577): unsure at all n locations
  Clone ID: PAT_TA_50829
cagnattttcccaaatgaacagccgacggagtgcggcatgccgngacacgcattgcaactcgcgccggtcgcttcagtttgggccgagcgctggttgctggcttgcgtctccaccgcagccagccgctccgccgcgaggacccagaccaggtgcggacgtggtcaaggccgtgcaggagggagccgcgagcagggccacgggcaccgccacgccacgctgatgcaagcggagggcgtcggcccacttccacttcagggaagtcgcgagaggacgccgatgcgtctcgctccgggctgagtgccatagcaggttgcgcgcccctaccgtgtgcgccgccgttgttgggagagagagagagagaccgcggccggatgccgacatcgtcgtgcaggacggaccgccactccaagcgccagtggctgtccgtgcctgaggacacgccgtctggagtcgcagcgggtcgcgccggccgtcggagggcgtcgctggttgggccaccgccaccaaacaatggacgaaggccacgctgctgccgcgctggcaggggttgcttgccggtcgttgcccgctgccatc

SEQ ID NO: 50830 - DNA, 568 bp, Triticum aestivum
  Clone ID: PAT_TA_50830
gatgagttctgctatgagaaatgtacataccatcacaggcatggtccttacctgcaaggactctaccctcacgctgggatgtgattagcaggggaaagagaggaccgtgctactaaaaaaaaagaccgacaatacaacggagactagcctaaaaaaaagaaagcaacaaaaaaaaggaaacaggggggtgcacgttttaaacatcccaaggtatcaaaaagttccagaccatgtcctacctgtcaccgatcagcacggaagtccaattcaaggacgcgcgactacctaacccggtgcaaggggaaaaccttgccttgacctaactaaagctggttgtatcatacgcgagtacaaccaattcgctgagtactacaataggccggtactgaacaatgttcaaaatagctatgcacgcttacagcgaaacgacacacgccatcaacgaggtgcaataaggtcaagaagagtaccgtttaccctaagtgcgaatgatacaattgcacaacatgtaccacgcgcagtttgtgatttttatcgtcttttagtcaccaggctgcgaggatttccc

SEQ ID NO: 50831 - DNA, 570 bp, Triticum aestivum
  Clone ID: PAT_TA_50831
ggggcacttgggtagaccctgaaccacagacacggactgctgatcctgagctgactttccagaggctggcccgcgagactcgcatgatcaaagacagacctccgattgcacgcccacgccgtgctgggcctacaggaggtcggatcgacgcatacctcgactgtctgtacaaggcacaccaacctgtgcgccatccacgccaagcgcgagaccatcatgcccaagacatacacctaggcacacaaatccgcggccagagggcctacactgtactttctgtgaacgacagtatagcatcgtgatgacccgatgctgatgatcgtttgaacctaatggatagtctatgtcataagcttactgcataataaaaaatcatgttcataggattgatgaaaacaaaccaacttggggtgcgatgttccttttggtttgcgatgaagcaaacgtatgggtatgctgaatacctgataacacattgatgttcgctgcaactctactgctgacgtgcccttgatcccatcctagaattagttcttgattcgtggtgcgcaacgtcgtgactgggaaagc

SEQ ID NO: 50832 - DNA, 356 bp, Triticum aestivum
  Clone ID: PAT_TA_50832
agctgtgtctaatttgccggtactacaccagccccaaactgctattgctgtagccgacagcgctggccctgcggctgatgttcactactgacttaagctagtggtctcccacttgcaatattccactgttgctgctctgctgaggtcagaaagaagggtgttgcatctctagacgacgaccctgcctctggaggatgacatgccagcgatcatgtatagcttcaagaggcataacgactgattcatggcatcaataccagaaccactctaggttgtgaatatagcataaaacctagcatctacttataatataatgctgctcttttgtaccagcaactgtagttgattaattagct

SEQ ID NO: 50833 - DNA, 542 bp, Triticum aestivum
  unsure (1)..(542): unsure at all n locations
  Clone ID: PAT_TA_50833
gaaaggcactggnatgatgcagatgctggttctgaaacaaatagtagagatactgacgtactgacatgcctatcaagccactctaggagcggggcatgggcttcattatgagctcctgggtcacgaggctccttcagccttcagtcttggcaatccttgctcgccaccgtcacagatgaaccgacctccttcctgaaggcccgacccactgcgtaaacaacaaccacatccgttgtaaaatcagggatggattgcaacaaccaaaattgcgttgtaatgtatgatttgctcgaacttcttcataattacgaatcagattgcataccgtagctctatttgattcaaatccacagttgaatgattcccccatttcttattatttactgtcactaaactcagtataaaggtcacttacaagacaaaataatctggtagcctaatcctgcgcaaattctaaataaataatgcgggctctataaagaaacagcttaaagactctggcgctcaatttaatgtctcttatatacatgtggctaatttta

SEQ ID NO: 50834 - DNA, 395 bp, Triticum aestivum
  Clone ID: PAT_TA_50834
cggacgcgtggggaagccgggcagccaccggagcgtcaatgtggaggcggagggtcagaggagccggggaagaggtcgggcaggacgggaatagcagcgccacgcgtctctttctcccaaatcttcagtgcggagctggagtgatgccgcaggcgttgcggtcgatccgtcaagggtgcgaggatgtggcatggccacccatccgcaactactggaagaacacgctggcatggagtgtccccaagagcaaggaaggagatgatgttgtaaataaaggcggcctcactacctgaaggtgagcatggatggcgcccattatccaccatgaaatttgtacaccattaatgcagagcagtggacattggtgtccgaatcatgtgggggagatatttgtg

SEQ ID NO: 50835 - DNA, 498 bp, Triticum aestivum
  Clone ID: PAT_TA_50835
cttggctattccattaccatacttgatatgccgttaactttagctcgcgcaagaggtgagctggcccgaccgagctggatcatggatgttgataggatcatgcagtcgtaccaaggcaggctccctcgtctgtgcagtaccttccatggacaccgacgtattgcccgacaagatcgaggccactggcaagacgaggcaaaacctgaagtgcccgtggaggagaagaaaggcttcttggaaaagcatcaaggagatactgtcaggcgggcactagatgccggaggacactaatgcagggcccgatacgcacgctggtcatcatcccgacacgcacgctggtacgcaccgaagaacagcgccggcaaccagacgcacaggaggggagcttatgtgactactaagagaagaaagtactgatgcgcaagatcatatacaagctgactggataccacatgacactggaggaggacaaggccgccgcacgtttcggcaagcaca

SEQ ID NO: 50836 - DNA, 510 bp, Triticum aestivum
  Clone ID: PAT_TA_50836
gcccctgcgcggggaggcccacgctggctgcgcccccaagagctggcgcgctacagccacgacggcgccacctgtaatggccgaatcgacggcgccatacagatcttcaaccggcgggtggccagggctcggctaccatatgaacaccctgccaggaggcgcacttcacgctacataagacgcctacaacatcttgaacgacatcctgggcaacgccggctgctacgacctgacggagtccaccggagaatgctgcggccggtgccggaacaactgcgaggggacgtgcctgtcgtaccatgcgccctgcgccaacacggaccagaacatgttatgggactcctacaacccgatagaggcgaacatacatcatcgccggacgtagggactaccgctcccactacgccaactacgcctacacgaagggacatgaggacgctcgtatccttgttgattctatatacaaagatgtacaagcttccacaggctatcgctcagacagaggcatgg

SEQ ID NO: 50837 - DNA, 357 bp, Triticum aestivum
  Clone ID: PAT_TA_50837
gtacagacatcagactgaatgaaaaaaactactttagataaacagcaaccacagtgtaaaagcttgcgagcctgcaactttggtacatcactatatggccgggatggccactgactgaacataacttggataacgcattaaataatacgagacctcgctgtgatgccttgctcggtgaatattattgaaatgtatggatgacaacctgactagggagacagggaacagaaaaacagtgcggtacatctagtaacatataatactgagagagtatccaacaggcatgtgttaaaacctgaggcaaaaacatcttgctgaataatataggactatgatagtccgccagaaatggcacct

SEQ ID NO: 50838 - DNA, 547 bp, Triticum aestivum
  Clone ID: PAT_TA_50838
aacagtgctaggtatcatggactaggtaggtaaacaaatccaaacctggccctggggaccgtgcagacaaggctggtccgcaaggcagaggagctggggcttgggcctcgccggcaccaaaaccacgcaggatggagcaagagacctgctctgcatggacgaggtaccctacttctgatttatttccatgaacctgcgcaccttcaacttccggtctccggtgtacctggacatccgcctcaccctcaaggacacacaccaatctcaacgaacggcccgtgcgctacgggagccatcacaagcggatctatcctattatggcggcacagctcctgggcacctgacacgttgacgccggtcagtgaccccgacacatgatgtcctcctaggtgcaccgtcccggcaccgacgtggcatgccataggaacttgcccacaacgctggcgtgatcctagtcgacggcacacatctccacaaacagctggacgctctcgtgggagatcgcagaacaccgtctgcatgctgctcaggaccttccacttctgcc

SEQ ID NO: 50839 - DNA, 500 bp, Triticum aestivum
  unsure (1)..(500): unsure at all n locations
  Clone ID: PAT_TA_50839
ggnaaacctgcgaagtagttggctatacaganaaanaanatccttcgttgactatgaagcatgatgcaaggagagattattttgagcatgttgccggtagttttcctgacagtagatccaacggaagtgtcgtgaaataaaaaacttgcaaggaggaatggaattttggacatttctacatcctggtggacgtacggcgctggatatttggcgacgcccgagtggtgcttccccctgcccagcaaccctcctcttgtgagatcatgcaggcgagcccgccaagggtctccggaagctccccagatgtatttatcatgtgcccttaaactgatgcaataatgtgaagatgttttctgtaaaaactggaaggagtggtacagatatataatctgtagagatctccagcggcaagctgtagatacctcagatcagagcgtgtgacctcaactatgtgagccagctacacttctggatcagcatcaaaagaaagtagttatgcg

SEQ ID NO: 50840 - DNA, 351 bp, Triticum aestivum
  Clone ID: PAT_TA_50840
cccagcgtccgccccgcgtccggtggacgacttcaaaaacccaaagtctcgggctccatggacgcgttcaagaagatcctcgccgccgacggggccaggggtctgtacagggggttcgggccggccatggcccgcagcgtcccggccaacggcgcctgcttcctcgcctacgaggtgaccaggtccctgctctaggcggccagcgggctgccttgtttctacacatggatcgccattcttaacttcgttcttgttcctccactctgatgattcagttatcgtcgtccggacagtcctgtctctgtaacagaaaaccaagccatgtgtgtgaatcgaacgaaatttcattcc

SEQ ID NO: 50841 - DNA, 589 bp, Triticum aestivum
  Clone ID: PAT_TA_50841
gcggtggcggcgtctgccatagttccgcgcgcggggggcagtccctgcgacagtgactcatcaacaacctctctcccattcactctggatgcacgcaatacccccaactgctagcaacttgacctaccagtacctagacctaatgggccaaacctgactggcttgaactgtaccaactaccccggctgcaacacgctgcaccaatgatccgagggccctctgctgtgactggcagtcatgcataggctgactgtgcacgctaatgtgaagacagactgtaagaaaatgggcaccggcaacatcataactctgatcttcctcatgatcagatactctgttgattgctgggctttaacgaataacaggtgttacaactcaaacccatcctgtaagtgagggagatgcctgacgaggctaaggtaattaggatgatgttcaccgttaatggaaggctcattgtccagtgtcaagcaacactatctgctatgctatagcgcccatgatgttagaactgcccatagtagcaggttcctattattatgatacgagatctgcccagcggctttcgtagagctgcagagccggatga

SEQ ID NO: 50842 - DNA, 565 bp, Triticum aestivum
  Clone ID: PAT_TA_50842
tcaaaatttcccatctacaaaaccctagccctcaacccctatcccggtgagcgagatggccaacccgagggtgttcttcgacatgaccgttggcggcgcgccggcggtgcgcattgtgatggagctgtacaggacgcggtgccgcggacggtggagaacttacgagcgctctgcaccggcgagaagggcgtcggcaagagctgcaagcctttgcactacaagggcagcgcctttcaccgatgtgtatccccgacttcatgtgccagggctggagatttcaccacgggcatacgtgacctgaggctagttcatctacagcgagaagttcggctaccagaagttcgtccacatgcacaccaagtccgggatcctctacatgggcaacgccgggcccaacaccaaggctcccagttctttatctgcaccgtcccttgcaattggcttgactgcatgcacgtggtcttttgcgaggtcgtcgagggcatgtcagtcgtcaagaacatagataaggtgggctcctgcagatgcacctgcttcaatgcagtcgtcatcacctactgcggtc

SEQ ID NO: 50843 - DNA, 506 bp, Triticum aestivum
  Clone ID: PAT_TA_50843
gctgcgacttgcactctcgcttcggcggccgagctcaccaccccctatcccaccacccgcccctggaggacgaagatgttgacactgttgagggcggatgagaccgcccccttcttcagatttttcggagcctccgctacactcgtgttcttatgtatggcgtcctcctactgtacagtcacaaacttggtcagatgtgtcctccatggcactcatgcacgctgagctcgtgatgtaatgaatagcgcctggtgctatggctgaagttctccatgtctacaaacttttcttctgctgcataataacctccgccatcaaccacacatccaagccctattaccttttcgactgatacgatcacctgtcttatgggctcgtactgtggccttaccttccttgatgttgacattaacattgacattattggtcattacttagcaaaggtctctatctcactacaaccaagctgaatgaccggaatgcatcctcatcgctgatctctacac

SEQ ID NO: 50844 - DNA, 495 bp, Triticum aestivum
  Clone ID: PAT_TA_50844
ctgttatcggctgtctctgtaccctgcgcaccagactgaggcggttacggagaagagcggtgctcacctgtctaacctgctgacctggaggctcatctgcctgtacagcctgcgcaacattgcagggcgtttggacttggagagagctgtgacgggcccaccccaagatcgtcggagagctgctcactgtttctgcagacaacacacagacacagctatccctgttagataacaagcacagtgcgtgctgctgcaggcgcagacgaatagctagtttgcattcctgagaactctgtgcatttgcacggatatatttaaggcggtctgtcttagatggcattcagatacataatagataatgcacaaccaggtgtatttctggggaacataatgcacacttgagtaacaaaaaaaaatataaagggcgcccgtcctttttgtttttttctaatcaatacaagcattttattcaactaaataatacacacacctctt

SEQ ID NO: 50845 - DNA, 575 bp, Triticum aestivum
  Clone ID: PAT_TA_50845
gggaagccgcggacctgaaacagcacatagccatcacccatgtgaggaggtgtcatgctcaccgccgcggcggcgccgctgctgtccgcggccggggagatccccgcagtggcgccggccgggtcgctagtgggcgtcctgggaggtggacgactgggagttagcaggatgtaggtccgtagtcggcgcccgaggctgacgtgcctctggtcggggggccgacgctggtgttcgccccaccacttcggtaggaggccggagatgccaccgccgatctacggcaagctattgacagggtttattttaatcagactccaatgaaaattgttaaggaacatgatcaatagcttagctagctaggagccgatgcattacattcctgctatgccatgacatgtactgcaggcttttacattgtttaaatcaagcccagaggctcatagcgttcatgtctacctagcatcacataataatgtgtggtactctgtgttgaaaaatgagagggttatggtaatcttacaaaagtcaccagccaactctggacaatacttttactgaaggcactgactctactg

SEQ ID NO: 50846 - DNA, 174 bp, Triticum aestivum
  Clone ID: PAT_TA_50846
cggtgtacagcacgctggtgccgggcctgcagtacgtgcatcaggcggttcgccggcccggcgctggtgcaccggcgtccagaacctgctggcgggcgccaacaacatccccgaccgtcggaccatctggggctgcctggaacaacgtcggcaaggcacctccggcctgcccta

SEQ ID NO: 50847 - DNA, 538 bp, Triticum aestivum
  Clone ID: PAT_TA_50847
gctttctgcgatctaagcttacgggctcgggcctgccactcctaaatacactatagggggcgccacttctagtcgcactagcacccgatgtaacaaggtcaagcccgggaagaagcctcgcatatcgcccagctcattggcctgaacaacattcgcgcatgcccagacggtattgatacccgtagtaggcgagaacacgatagggctgcacctcagatgcccaacattgaatggcgaatgtgacacacacatcaagcactaccttaccaacagttcaagtaagtgtgttctccccaatggacctgtactcgtagctagcttatctagcacaacatgatctactttgcttacattgcttactacgcatgcaccaagaatctcccggacatgctttaacgtgctggctacctttacatctccgataccaacatgctaggcacgctccacccccaaaaacgatgattagactgtcaggtactatgtggtgcattggcttgtatgaaggaaagtactccgtttgactttgtagtgcacactg

SEQ ID NO: 50848 - DNA, 304 bp, Triticum aestivum
  Clone ID: PAT_TA_50848
cagccgtagcgcacctatttacaaaggattcaagtagtagctgctgatggacaaaactgtttagtgctggatttcgaagccaaatcgccagtactatcgcatttgagaagagcaggcaaacttcaccttctttttctgtcctgtattaatgctgaatttggcaatggtggtgacgatctatatgaagtgcgtcttatttctgtataccacagacgatgagtgactgcgtccgcaatcctattatctgctaatatacaacatagtgatatttatttattttccccaccatttctgcatataaaaa

SEQ ID NO: 50849 - DNA, 515 bp, Triticum aestivum
  unsure (1)..(515): unsure at all n locations
  Clone ID: PAT_TA_50849
ctcggcgcataaattgccatctcttggcttctnttgtcagcattgacgtagctcagggagatctacgacaggctggggactccttgagtctgtcaccttgtgcaccgtacctggggacttgctcatagacttggtggatgactctagttttattgactaacctgatatcacatactttgtggagagtgctttgcttcaactactgaactcatatataatgagcccagtcccccagacgaagcacacagcataatgtacgttataggctgatgcaatcgataacttggattgcgatcaagtcattgattaaaaaactttcatgtccaaaagcccatactacaagtgcgctatatatctctaattttacatcaatattgcctcaaagagactacaaacctgacgtactctttctgacctaactaagtgatcattacacctgtggttgacaaaaagttacctgagcgctggggtaaccaatgaattccttgaccttgacttttcactcttccacaatc

SEQ ID NO: 50850 - DNA, 597 bp, Triticum aestivum
  Clone ID: PAT_TA_50850
cccagcgtactacactgtcctctgccacatacacacacacagtgctagctgctatcgtcaccgccatgggggaggacaagcaccaccaccacctgttccaccacagaaaggagggcgaggacttccaacccgccgctgacggtggtgtcaacatgtacaagttactctaccgatacagcggtgaccgccaccggctacgtagggcgaagtaccattcggatcaccaagcgaggagaagcaccacaagcacaaggatcacctccgccagatgggcgccgtcgccgtcggagccttcgccctctaccagaagcacaatgctaagaaggacccggagcacgcgcacaagcacaagatcgaggaggaggtggctcgccgccgcattcgtcggcgccggcggctttgtcttccacgagcaccacgagaagaagcaggaccacaaggaggccacagaggccagcggcgagaagaaacaccaccacttcggctagatcgtcgttgacttacggtggccggtctcttcgaactgcgcgcgtgtgcttactttacgtgagctccataaagtgagagaggctgtgactcgggcccggtctcgtgctc

SEQ ID NO: 50851 - DNA, 546 bp, Triticum aestivum
  unsure (1)..(546): unsure at all n locations
  Clone ID: PAT_TA_50851
cccagaccgccaccgacaacacacggcacgcagacaacacagatgccagctggaggaggagcacaccatgcgcgtccatgaccgggctgacgcggacgcgcggaccccaagcccgaccgggacgcccgcctgcatgctcacccgaggagcgcccgcgccggctgcgactgcctcctgacgctcnctccttactcttggtactagatggcgcatggcaagtagttcgcgctagcttcgtgtcggcttcatcgttggatggcactgctctgacatacgtaggctggtactatacacacgttgcggccatccgactgttcaatatcacgaacagactcagcctggcaccagacaacttcttaaagtgcaagtaacttcacacctgctccctgaagaaccgtttctaactattaccactgcctcttaccgaggagccatggcctatcctaatagtttatcacggacatgctcaatcttatttcaataatatacagaactcaatgcgcgaacattcatcaacaagcttctgctaatgtcctcctacctacg

SEQ ID NO: 50852 - DNA, 277 bp, Triticum aestivum
  Clone ID: PAT_TA_50852
aagggtcattctgcatggccaatggtacgcgccctggagtggcgcagttaagctcgtcggtagttggggatacactcagagagaccaatacacttgacaacactgtagcgcctggtgcttgatgtttgtttcatagatttatgggcatggttgtgggctgacccgacacatgtctaaaataggctcgtaagtttacgcaaccgacgtaaggctatacaagaacgtgacccttatgaacttgatgagaacgatggctcacgtactgattcatccgcct

SEQ ID NO: 50853 - DNA, 174 bp, Triticum aestivum
  Clone ID: PAT_TA_50853
cacctaaccttatactgttccctgatcttcacttacttaatggaagactctggtccattgacatacgctgaccatgagcaggaccgtgcacctgactgtcccagacctcacacagcaaatgtgcaataccaagaacatgatgaacgccgctgatcctcccaatggcacggtacc

SEQ ID NO: 50854 - DNA, 589 bp, Triticum aestivum
  Clone ID: PAT_TA_50854
actagtagtagcatcgtacctctaccactaggccttaagtgctggaactgcaacccatggaacacacacggccagctgtgaccatgcaaggctgtcttggacatcggcattgccatctacactcagaggatgaatgagtcttggctgtaccaacttggatgactgatgtacgtagtaaaggctagccttgcctgcccaagctcttccataccgtgctactataagagccaaagctccttgctgactaatcctagcttgtcttagaatgtgatgatgtgcctgagtacctttcatagttatagaatgggatgcgaatctagatgactgcagccctagcgctagaactgatgcttctggaggacaacatcaatcatacatcgttattgatatatgaatgcactctgcctttaatgaaacctgaagagactgccggatgttaggtttcgacttaaactgcacaagcatgcgaagaggagctgtcatatagcatgccctagagacttactgccgtcttccaaaccttagatcttataaagtggctggcgcgcttgaacggctgggtagtatatggccttttcacaaggtcgca

SEQ ID NO: 50855 - DNA, 233 bp, Triticum aestivum
  Clone ID: PAT_TA_50855
ctccgctcttctgacttctcttgctctgttctcaagaaggaaagaaggaaagaaagaaaagaggccgtctctgtctgcctcagcgcctccccaaccattcttctgctcccgctcctcttcctcctcaccatcccgtcgctcgcctccgcctgcgaccgctgcgcgcgccactccaaggccgcctactacacctcctcgctcaccctcgccgccggctcttgcgggtacggcac

SEQ ID NO: 50856 - DNA, 549 bp, Triticum aestivum
  unsure (1)..(549): unsure at all n locations
  Clone ID: PAT_TA_50856
ccccgcgtccgntcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaact

SEQ ID NO: 50857 - DNA, 191 bp, Triticum aestivum
  unsure (1)..(191): unsure at all n locations
  Clone ID: PAT_TA_50857
cttntanaacctgtgtacaagctcgtaacgaaggcgcgatcttgctcgcgaagtaatgaaattatccgagcagcttgcaaatggagtcctgaactagccgcagcttgtgaagtatggaaggcgatcaaattcgagttcgagccggtagatactattgattaactagataaaactaaagataaagaaggtat

SEQ ID NO: 50858 - DNA, 600 bp, Triticum aestivum
  Clone ID: PAT_TA_50858
gcgtcctccagtcccttgccctcctgctactcgtggctctgtcggcggcggccatgtccgccgccggtcaaggctgtgacggccacaaggtgacggtgcagaacctgtgtggccacgacctgaacctgggaatcaacgcggtctcgaacagcaagatgctcttccccaacgggtggctgctccccaacgggaagcacgagtcgttcgacgtgtgcgcgtggtcggggagcgtgtcggcgcagggcgccgccgtggccaagttccacatcggccatgagggcggtgcgtactacgaggtgagcaccgaccaggcgagcatgcccatccgcgtctccgtcaccccgcacggcagcccgctgcagggccactgccccaccgccggatgcaacagcggcaaccactgcttcgagcactccgtccccggcggcaactgccatggcgtcaccgagatcaagatcatctactacaacccatagatgatagatcgatcaaccgcctacctagtaacgtactgtagtacgtagctgctgcacctactagtgttgaataatgctgcagctaagctcgatcgtcagtggcgttccaccgacgaggtcgtac

SEQ ID NO: 50859 - DNA, 596 bp, Triticum aestivum
  unsure (1)..(596): unsure at all n locations
  Clone ID: PAT_TA_50859
cccggtcgacccagcgtccgtcgaccccgcgtccgcccagcgtccgcccagcgtccgagctcatccagaagacagcagttaccaagagacaataatggaatgctaaagcataaaaattccactagccccagattaccacagnaaaaagctcgacatggagcgaaggtctagattgcctgttccttctcctgaggctaacaagaaccaaaggcaatctgtggataagagtcacttggatacagtatcacccagaagcaaagttagaagaaagcttgctcaaggtgaagatggtcatcaaaatgttgcaaagagcaggacaagaagtcttaaccagcaaggcgatgatatgtctttaatgtcggatggcagtatgagtgttgtatcagagctggacatagaagtaacaagtgctgacagatctgcagaagttaatgcatcgaacttccaacaaggcaatcaaactccactaggaaggaatccacaaaaagtgaaaacctcttatgatgcaaacaaggacctgtcatctgtggatcacgcagcagctgtccctgagcggccaagtccagtctctgtcttggactattcatttgaccagg

SEQ ID NO: 50860 - DNA, 573 bp, Triticum aestivum
  unsure (1)..(573): unsure at all n locations
  Clone ID: PAT_TA_50860
ctagttcttactacagaggtgctcatggaattatcttagtttatgatgtcacgaagagacaaagtttcacaaatttggctgatgtatgggccaaagaaatagaaatgcactcaacaaacaaagagtgcgtcaaaatgcttgnttggaaacaaagtggacaaggatgaggacagaatggtaacaacagaagaaggtcttgcctttgcacagcagtgtggatgcctttttcttgagagcagtgccaaaacaagagaaaatgtggagaaatgttttgaagagcttgcactaaagattctcgaggtcccaagtctgtcggaggaaggctcgtccgtcgtcaagaggaactcgctgaaacagaagcacgagaagagcgggggatgctgtcagtagaaccggccactgtatgcaaccaactagatctacctaggcctagactgttcttggtgttctgatgtaaatgagttgtatctaagtgctcatcggtgcgagtaaagggagaaataacagcttgaggttttggtgtgaaggatgggcggggaagttaattgacctgtacaaatgaagaagaagaag

SEQ ID NO: 50861 - DNA, 576 bp, Triticum aestivum
  unsure (1)..(576): unsure at all n locations
  Clone ID: PAT_TA_50861
tacctgctgnaagtcggtttgccctagntaattacaagaacctggccaacaggtctttggttgacgacacgcttagaaagtgaacgggctcaaacccatcgcttcggagctcggcgtctcgatggcccagctgggcatcgcgtggtgcgcgtcgaaccccaacgtgtcgtccgtgatcactggagccaccaaagagagccagatcgtgngagaacatgaaggccctggaggtcgtcccgctgctgaccccggaggtcctggagaagatcgaggcggtcgtccagagcaagccgaagcgcctcgagtcatacagatgaagtagcggcggtcggtttcgtcagctgtgcagcgtgtgcgtgccccgcccgccgcctggtgggatatttttcctagccggtttattatctccctgtatctatctggttttctgaaactatatacggctcttcctgcgtggtgggtgcgtccagcgtgtgaaacattttgtcgggtggaacgctagtgtgtgctgctgttccgtgcatgtgattctggagtggtggctgggcctgggatgagcatgtggtggctgngcct

SEQ ID NO: 50862 - DNA, 562 bp, Triticum aestivum
  Clone ID: PAT_TA_50862
gccacacatccggggaaagaggaggaggagagcaagagaggagcacggagggatgcacgaagagctgtcggagatgatacttgatgaccatacctgatgaccttcctggcgctgatgcccgtgctgtgggtggggatctggctcaactccacggactgcatcacctacttgctgcggtccctgatgatgatcatcctcatcatcatgctcgcctccctggatgggcttcctcatggcctgctaccgccactactacctgctgaccttgttcctcttcatctagctcttcatcatgttcttgatggtcttcttgctggtcttcttcttcgccttcacctaccgcggcgcaggaccaggtggagatgaaccgccgcttgatccagtactagctctactactacatctgatagttccacagctgggtccgcaacccggtgtactgccccaacatctgggcctgcctccgcgactgcctcccctacggctgcatgtgccgctccgtgcgccaccccgacagcgacctgctcaccaccgtgctcgccgccatgccctacggcctgtt

SEQ ID NO: 50863 - DNA, 424 bp, Triticum aestivum
  Clone ID: PAT_TA_50863
cctcactccatctcttccctctttagtcagtcgggccctatgggcaagccgatctagcatgatcgtatagtggctgactgaggctcactgttttggagcttggttaggacaccaatcgcgacgatgagcattaactgatgcccttgctgctgctgccatgggcgtgctgggggaccgctctttccaaggcatcagctggtaccaaggactaggcttacttcgcagcaaatgctggtgctctggccttaacaacggccggactcactgacgcataaatgtggaccgcacagacgcttctactgttctcaacggctacgagcacctgcgcgctaccaccgatatgcacttgctggttgcgcagcacaacaacctcaaccttgcggtcctttactagatgaccattgaatcattcccacacacacga

SEQ ID NO: 50864 - DNA, 302 bp, Triticum aestivum
  unsure (1)..(302): unsure at all n locations
  Clone ID: PAT_TA_50864
cagnaagtagtacctctgtctcgtttgtctctcatcatcagtttcgacaacatgcgccaggtgcacagtgtaagctccatcgccttcaaagcacctgcctgcgcaggcagtccggcaaggtgctacacagttcactcactacgggccacatataaagaggcattgcggctctgtcatactctgtacattgatttgggttttcctttatcatttactattcatttgttcgttcctaagataagaatatgtgtatgatcatgttccggacaaaaaaaaaaatataatggctgacgttatgacac

SEQ ID NO: 50865 - DNA, 464 bp, Triticum aestivum
  Clone ID: PAT_TA_50865
ctctttcatgcttatggactgacaaccctctcaaacggtgcaatcgcaggtgcggtccaagggccgcgcgtataccacacgtaaggcggtgtccggtgcgcctccggctgcccatggataaacagaggacaccttactgcagacgccaggctcgtgctcataacacgctgacggatgcaaggcgcatcacccttgtggcgcagatgtacacaatgccacgcaaagaggagctccaccactaacgagatcgcgatagcttcggagaacttgcttggcatagaacgactgggctcggtggtccacgtcccgatcccgttgcgtgtagggctattgctccagctgctcacgcggccgacatcggttccccgactaccaggcgcaggacccaccggaaatgcccccttgtggggctttacacgagcatgacacagtcgactcagaactgctaccgacatgggcggacc

SEQ ID NO: 50866 - DNA, 135 bp, Triticum aestivum
  Clone ID: PAT_TA_50866
aaggcttgacgtcaatgccagaactgacagctcctgactatgagagagggtctatattgcgatgggcactgaatgatgaaaaacgccaacatcattgaattacccatggaccagcctttaatctattcacaatac

SEQ ID NO: 50867 - DNA, 412 bp, Triticum aestivum
  Clone ID: PAT_TA_50867
aaggttacttacacggggatcgcaaaagaaccctagtttttggtgcctgtagatcgattttactgacggaaaagatcgaacccatgggatgggggataaccctggactgaccaaacttacaaggtgtgctacccatccctttttgaactgttgatgttttgcataagaaggcactataaacatgcgtcctttcgaacaattgtgcatcacaaactggtaataggaactctacctgatcctggctcataatatcctgctggtgtggcttatccactcagtttaacacgcttcagtacaaactggcctagcacggcgtgattttgctttctaccgtcactttcttgccacatcagctggcttttctagtgctgctctaaatcaaggtcttgatttatggttcgcaatcaaagtt

SEQ ID NO: 50868 - DNA, 570 bp, Triticum aestivum
  Clone ID: PAT_TA_50868
cgctatcttgctatccacctatatttcaatacgcatagcgcattaactcgtaggctaccgctgctaacaaaacccgcacgccttgccatggatcaaggccacaatcgggctcccagtgagacaacgctacagggggaggctgggccggctgagtcaatggcggtagtgatatgggtatgaatgtgagtctatgcgaggcacatcacagaactccgaacacgtgggttacttgttacccttctccaaagggggcctcctgaactaggccgactacctgatccgatgcagtgggcgtcatgccttgagttaaataagggagtgtctgtcttacgtgaacacaacagatttctctgggtactacgaccggcgatactggacaatgagcaagctggctatgttccggtgcactgaccccacgcatgtgctaaaccaagtgaaggaggtcaacaatgacaaccctgacgcctatgtgcgcgtcatcggcgtttgacaacctgcgccagatgcactgcttcaaattgatcaaattcaggccaactggttaccgaggagtctaaaaaggcctaaact

SEQ ID NO: 50869 - DNA, 448 bp, Triticum aestivum
  Clone ID: PAT_TA_50869
tgctgccgcttctactccacctttgactcgcacctcatgtcacaagttgcgatgggatgagtgtggagtcaattgttaatcatactgggatgaagatgaactgtcaggttctagcgcggccttctgccaccgcgtccctttggctgtacgccatgctttgagatgtctgcccggtgtttggactttgtggacaggccggatggtcccgagtcgcctcccttggtgcaaaagacggggagctctcgaaatgagggaggctcaccaccagactggactgctgtagaataatgaaattgtcactgcctgattgctggtttggttcctctctgctaagagaatggcttgattggactctttcgttagtcgattgagccgcacgtgtgctactgttattatgctcttataagttagcgcgatgccgagaggcccatctcgagctgttttattt

SEQ ID NO: 50870 - DNA, 436 bp, Triticum aestivum
  unsure (1)..(436): unsure at all n locations
  Clone ID: PAT_TA_50870
gtgctngaggtggtggtgatcaaggagacaagggtcgcagtacggcgtgcagctcgagagctccgtcaggnaccgcctcgtggcagcggacaaatacgaggacgacgaggaggaggcgctcgagaaggtctccgacttcttccagtccaagtacttccggcccggctccgtcgtcaccttccacttcccggccacggtcaccgccgcgccagagatatcgttcgtgacggaaggcaaggaggaggccaaggtggcggtggagaacgcggccgtggcggagatgatccagaggtggtaccttggcggcgattcggcggtgtcgcagaccaccgtcaggagcatcgctgatagtttcgcggcaatgctcacctcaccatgattctttttttacaagtgctgcttacctgcttttgcaataaatcgataagtcacgatg

SEQ ID NO: 50871 - DNA, 429 bp, Triticum aestivum
  unsure (1)..(429): unsure at all n locations
  Clone ID: PAT_TA_50871
gtaagtgactaccttatcttgttaccctatgacttgagattatgggatgtggtatctctcctaaaagaaaaggaactccatgcaagcatttctanatcaggaagaagatatggatcattttccttcaatcacacagttgcattcatgcaattttgttgctgtccttttttttcagcaccttggagaattttggaggatgcagatcaagctcgtttgtgactgctctgttcagagtctggttttagaaattatcaatcgccttgtagtttgccttttgctttctttatacttgatttaaatactttgcagggtcatcatctagaattttacattgtcattctctatatttgtattattcaatggcttcgtaggtgtgtagttttgagagcatgcaaattttctggaagtcttgaaagaacatgttggcat

SEQ ID NO: 50872 - DNA, 583 bp, Triticum aestivum
  Clone ID: PAT_TA_50872
acaccccaaagcagttgtatgatcctgttctcctcccacatcctttgcgcgaattctgggacctcctaagctcccacaacaggaggacacgtcatctttcagtcacatcaaattcttccatgacctcgttgcacaggttaatggggaaaatccgtggcttccaggcaaaggtatcagagttgtggtatgtagaagagtacgatgtgctagccctagcactgaatggaaagatgagagtgcggaggctccacctcggctgcaatgagggccaagataactgatgacagtaaagagaacaccaccagggtatcagtgcgagatgcatcgtcttttatgagttagcaatgcttgggagtgcctctatgattaacatatactagtgtgtgcctgtagcgcgctactactacttaacagtagcattgggtagggatctacctataaggtatttcctcgtagcgttttgcagtgagctgcttatttttactcggcaaattttttgccgagtagctgacaaataacactcagcttatgtcgttatgcctaccaggagtatgccgagtcctttttgtcgagtgtaacaccc

SEQ ID NO: 50873 - DNA, 589 bp, Triticum aestivum
  Clone ID: PAT_TA_50873
cggctgtgacgctcatcaccttgtccgcctccgccggcagctggacacgcgccctctccaggccgtcgcaactagggtgcttcgatcgccatggccaagctgcacccggccccggcaacggcggcgagtttgtgctggaaccgaggggctttgctggaacaggctggtgtatgtgctacaaggttggtgcctcgccagggaagctacatccagcagcaaggagtgttgtatccaacgttgttcgaatgtcgggagctgcaatcgtgcacgccggagctccaaccggttactgggggagctgcaagagaggatggccattttttgttgatgcattttttgctgaaccaattttttgtttttgttggaaccggtgtatttttttgctggaaccaagataattttttgcttcatcggatgcagagctctcaaatgctcatgtcgtttttgttggcacctaagcttgtttttgctagaagcatttttttgattttgcttcaaccgaccaccggatttcgacccagggtgaagttttttgctggaagatttttgttgcttctagattttttgctgcttggcactcgaacccggc

SEQ ID NO: 50874 - DNA, 336 bp, Triticum aestivum
  unsure (1)..(336): unsure at all n locations
  Clone ID: PAT_TA_50874
ggtccggcctcccggtcgacccagcgtccgtttttttttntaggggaaattatctgatatgatacgatcgtgcattcacacaaanatggactaccgggcatctctggaatcagatgcattcttgctattgcacctattcgtccgcgggtagcccttcctcctgtgctgtgtctgatgacaatggacctaagataccctctgaactgaggagacaatccactctctggctggaatcttaacatgtcagcacgagccattgcctctgcttgagccaacgcctggtgacatgattcgtaacccaaagctggtttttgaaaaggctgatgagatggcgca

SEQ ID NO: 50875 - DNA, 207 bp, Triticum aestivum
  unsure (1)..(207): unsure at all n locations
  Clone ID: PAT_TA_50875
ctatagggcccctttgttggggggggggggccntcnttttacaacntctttcctgggaaacccgtggggttacccaccttattcgctttgcggnccttccccttttcgccggttgggtgnatagggaaagggcccttncggttcgcctttccctccggttgcgctgcctgnttggggattggggcgcgcctttgnncggggtttttt

SEQ ID NO: 50876 - DNA, 512 bp, Triticum aestivum
  unsure (1)..(512): unsure at all n locations
  Clone ID: PAT_TA_50876
ctccacttaagcctcccagctctgcggcgagnactctctctccgccccgcgccgcagccagccatggacgccgtggactccgtggtcgacccgctccgggagttcgccaaggacagcgttcgcctcgtcaagctttttttctagcccgaccgaaaggagttcacgggggggggggggcggacggccatcgggttcgtcgtcatgggcttcgtggggttcttcctcaagctcatcttcatccccatcaacaacatcatcgtcgggtccggctgatctcgtctccgcaggtgaggggccgcaggacgagaggatggtgtccattcatggaggcggcgctggttttcttatcctcgtaccttaaagcaattcatttaggacttcattgtagaggacagttcccttgtgttttcatttgaaacagttgtattggtagacctggagcagttttgaacctgattccggctagaccgtaatatcaagcagtgaatgacaagaattgaaaccctatcaaa

SEQ ID NO: 50877 - DNA, 311 bp, Triticum aestivum
  unsure (1)..(311): unsure at all n locations
  Clone ID: PAT_TA_50877
ccggtcgaccagcgcggacgagctcctgnaaaggctcaaaaaagatgagctttgtgatttggaggaaggcccatgttccacttgtgacatttggttcccctttatgctgaactttgccgcggatatttgctctaatgactttttgggggtggaaagagaaaatgtcctcgagtgcttaagtttcgcagcctgataaatgaatgtagttctctccccgttccaggatgaaagatctgctgcttcagatgttcaaattcgctcttggctgtcttaatgtccgggaaaatgaagactttctggaccatgaggtg

SEQ ID NO: 50878 - DNA, 450 bp, Triticum aestivum
  Clone ID: PAT_TA_50878
ttttaaaaaaaaaaaaaaaaaaaaaaaaaggggggaaaaaaaaaaaaaaaaaaaaaaaaaaaaaaaaaaaaaaaaaaaaaaaaaaaaaaaaaaaaaaaaaaaaaaaaaaaaaaaaagggggcggccctttttaggggtacccaattttacttccccgtcttttgcaagttaatactttttttttggggccccggggggggattccccggcccgccttttaacaccttcttcctgggaaaacccttggcttcccccattttattccctttgaaaaaattccccttttccccggttgggttattaccaaagggccccccccctttcccctttccaaaattttgccccccctgtttgggaatgggacccccccttgtgggggccctttaaccccggggggtgggggggttccccccggtgggccctttttttttcccggcccctttggccctt

SEQ ID NO: 50879 - DNA, 130 bp, Triticum aestivum
  unsure (1)..(130): unsure at all n locations
  Clone ID: PAT_TA_50879
ccggtcgccccacgtccgttcatgttgctgtntatcaaagtataatgtgatgaacanctacatgagcggcgcgtggtcgcccgggattccggaccgtcctgcggcgtccagctttcccttgtgagtcttt

SEQ ID NO: 50880 - DNA, 516 bp, Triticum aestivum
  unsure (1)..(516): unsure at all n locations
  Clone ID: PAT_TA_50880
ctngccttcttttttntcccccgcngaagcagggcgaggcaggcagcngtgtataaacctgaggcgaacgtgagcggtcttcgccttgtcctnccgactctttcnncattccattctatnntcccgcttccacnnacgtcggtcggcgcccccttcgnncgatctgtgtcgtttctttcccgcagcccctgcctgcggtggtggggtgatnggcnntaggcacttcaagtacgntcatccctcggcggncggtgtncgcggcggggtacgcggnncgagggagttcgccaagcaggngcgtcaaccccggcgagctcgccatcatctccaaggaaccagtggccccttatgagcgccctgcactcagcaagggatacctcttccctcagaacgctgcaagactgccaggcttccacacgtgtgtgggcagcggtggagagagactactttctgaatggtactctgagaaaggcattgaactgatcctgagtactgagattgtgaaggccgaccttg

SEQ ID NO: 50881 - DNA, 573 bp, Triticum aestivum
  Clone ID: PAT_TA_50881
acctgctctactccgctaatacaaataccatggcccccgccgtgatggcttcgtcggctaccaccgtcgcacccttccggggctcaagtccacagccggcctgcccgtcagccgccgctccagcggcagcctcggcagcgtcagcaacggcggaaggatcaggtgcatgcaggtgtggccaattgagggcatcaagaagttcgagaccctgtcttacttgccacccctctccacggaagccctgcatgaatcaggtcgactacctgatccgctccaagtgggtgccctgcctcgagttcagcaaggttggcttcgtcttccgtgagcacaacagctgccccgggtactacgacggtcgatactggacaatgtggaagctgcctatgttcgggtgcaccgacgccacacaggtgctcaacgaggtggaggaggtcaagaaggagtaccctgacgcctatgtccgcgtcatcggcttccacaacctgcgccaggtgcagtgcgtcagcttcatcgccttcaggccaccgggttgcgaggagtccggcaaggcctaaactatgagttgaaacaatg

SEQ ID NO: 50882 - DNA, 525 bp, Triticum aestivum
  Clone ID: PAT_TA_50882
tatatacctacatagtacacccatgggcccccaccgtgatggcctcgtcggccacctccgtcgctcctttccaggggctcaagtccaccgccggcctccccgtcagccgccgctccacggcgctagcctcggcagcgtcagcttctgtgtgaaggatcaggtgcatgcaggtgtgggggggggagggcatcaagaagttcgagaccctgtcttacctgccaccggtcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtttgtccggttcatcggattcgacaacctgcgtcaggtgcagggccgtcgctttctggccttcaagcccccgg

SEQ ID NO: 50883 - DNA, 562 bp, Triticum aestivum
  Clone ID: PAT_TA_50883
ctatgaacattactcttattcaataaagcatgggagatttctcaaaaaaaagcaaggccatatgtcctacagatatttcattttttttgctgcacttgagagcattctgaccgatccctatccggcgttagagaaaaacaaattcgattttggtcactactaggcgccggtgcgccggcccaactttgagccggtcataccagcagcgtccgatcgaacaactcatggtcgtacgattctcttctttactttcaccaggcgtcttcttccttcaaaaataacttccagcgcgctaccaagtttgaaagtaccaccccggtgcgctcgcctgtagccgccctccccgccggtcgtcgtcgtcgccgccggccgcagtcgttgccgccggccgccgtcatggtggaagcaaaaacaaaagctggatctagcaaaaacagaacatggtggaagcaaaatttgaagttggttctagtaaaaaattatggtggtagcaaaataatttgttggatccaaacttctaatgatgcatgtgctagcagttagggtggatggctgcatcatc

SEQ ID NO: 50884 - DNA, 540 bp, Triticum aestivum
  Clone ID: PAT_TA_50884
ccatggcaaactttcccggtcacttccagcgctggagcacccaatcagcccaacagtcaaaggcactctgggcggcccgcaagatgcgtatatatagtgcctccaccacccccggggacaggaactacacacggcgcagtgcggccaggctcgtcgagcacatcagcacaaagcaagtagcagacaggaaatggacgcgacagcagaagctagcagtggagaaggagcatgccacgcccacggcgcaaaagatgaccggccggagaagaaggtgccgttgctcggcatgttcaggtacgccgaccgcctcgacatgctgctcatggtggtcggctcgctcggggcggtgggcaacggcgtgtcggagcccctcatatcggtcctctttggagacgtcatcaactcctttggcgagagcacgactagcaccgtcctccgcgctgtcaccaaggtgcgcctcggcttatggtgatcacttgacttgaagggtggcttggctagacgagttaacagagaatattcttttgatcttcaggttgt

SEQ ID NO: 50885 - DNA, 315 bp, Triticum aestivum
  unsure (1)..(315): unsure at all n locations
  Clone ID: PAT_TA_50885
agngctnngctcggggggcggccgtgtttctcctgggcccccggtctgcttcgtccttgcggtccgtttcgccctggtgcccgttccctccntgggcttctctttcttctggtggcncctnncctctttttggggggggggcgcnctctctctctnncttnttgctggctccccttcnccttgtctgctgctgcctctgctctcttttgngggtttgtcctctccgctttgtcgtccctcttgtgctccgccttgtttgtcctccttccctttctcccctttgtggtcctttctcctgttctntgtggccttggc

SEQ ID NO: 50886 - DNA, 502 bp, Triticum aestivum
  Clone ID: PAT_TA_50886
gacgctacaaatcacatgcattattaataggatcgtcatcccacggtggttctttcaacatcacatcgaaggccaaattattagggaggggctaacaactaatctgaactactgtgtaacaaagcacccaagtggtctgaaaaggctcaaagtagaattgccaaagaaatcagctaaaactggtaccaatgtttcttttttttacacctttccaagagctcagattttggaagcgaaatcgatcccctcctgcttcagcgcctggacgtcggccaccggcggctgcgccctggcgaccctggcgatggcctggttctcctcggccgacccgccctcgagaaacacgccgacgaccttgccgtccttcacccagtagctgccgaacttgggcttggccgaggccgggtcgttgtcgccgaacagcacgtcgtcgccgacgttgtcgccgtagaactgccacgccaagtcgaacgaccgggagtagaagtagggcaggtagtcg

SEQ ID NO: 50887 - DNA, 531 bp, Triticum aestivum
  Clone ID: PAT_TA_50887
ggcgaaacagctgacaagaaagttcatcacatcatcatcctcctccgtcaaaaaaggaggtttacatccaaatccaaatgggggggtaagaaaccgacagagttttggacttcaaatacccgcacatagccaaaataaccgacgacgaccgtcgggaatcgcacactaagcaactagccctaatcagcgtcttgcatcctcttcttcggcttctccccctcatcgcgtttgatgcccccctacacgataaacctttttgtttggccgcctatcgcttcagctagtagaccgattttcaccaataaccagaaagccacatcaaccccgcaaaacgaaccccacttgtcagtctaatgccaaccccgcaagcataccataccaccttccaaaaatcgcaaagtatcatcatcatttctactctcgtcactcgcgctcggacaaaaacccttgcagtcatagtgtgataaggagacggtgtgcggctagcgctggccagcgctttcttcagctgccggtgctgggttattgctg

SEQ ID NO: 50888 - DNA, 511 bp, Triticum aestivum
  Clone ID: PAT_TA_50888
cacaaagaacttcatatgagataggccattgtttcaactcatagtttaggccttgccggactcctcgcaacccggtggcctgaaggcgatgaagctgacgcactgcacctggcgcaggttgcccaagccgatgacgcgggcatgggcgccagggtactccttcttgacctcctccacctcgttgagcacctgtgtggcgccggtgcacccgaacataggcagcttccacattgtccagtatcgaccgcagcagtacccgggggagctgttgtgctcacggaagacaaagccaaccttgctgaactggaggcagggcacccacttggagcggatcaggtagtcgacctgcttcaagagggcttccgcggacaggggcggcaagtaatacagggtctcgaacttcttgatgccctcaattggccacacctgcatgcacctgatccttacgccgttgctgacgctgcctaggctgccgctggagcggcggctgacgggcaggccggctgtggac

SEQ ID NO: 50889 - DNA, 452 bp, Triticum aestivum
  Clone ID: PAT_TA_50889
ccatggggtaccattaaaacggatataggggacaaatgggaaaaaattaggcggccgggcatagacatagcccccgataggattaaaaaacgagcatgctttttggagccatggggggacatgaacaggggcatacacatattcttaggaacaaataaaaaagataaagggggaaggaaaacccaaagcaagggcagagttgacaaaactggaaggggactttaaatatggcccggcgggagggagctgttaaggccttgccggactcctcgaaacccgggggcttgaaggggaaaaaactgacccactgcacctgacgcatggtggcaaatccgaagagggggacaaacccgtaaggggacccctttttgaccccccccacctgggtgataacctgggggggggcagggcacccgaacaaagggaggttccaaattggccaataccggcca

SEQ ID NO: 50890 - DNA, 416 bp, Triticum aestivum
  Clone ID: PAT_TA_50890
atagcgttacagtgtaataaaggaaatgagaatttgccttggcactttgacagtttctggaactcaaattcaggatttcactacacgaactcggatgttttggcgaatgcagagggttatattacttgacagttttaggaacaggtctacgcgacaaaaaattaatttgctagtaacgtctaacaccaataaacccaaactgctccggcgcttcagtaaatttagctatgcatcaatcttgtcatgaagattcactttgttgtccagattcgtcagaattggtagctagctaccctttgaaataaaggaaaactgtatctgttcagatcaccaatgtgctttccaccaatgaatacattagggacggtggattgtccagtaaacctctataacacctttagccttagggggacctg

SEQ ID NO: 50891 - DNA, 527 bp, Triticum aestivum
  Clone ID: PAT_TA_50891
ccattggttaccattaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccac

SEQ ID NO: 50892 - DNA, 470 bp, Triticum aestivum
  unsure (1)..(470): unsure at all n locations
  Clone ID: PAT_TA_50892
cccggtcgaccccgcgtcctgagcccccccccccccccaaaatgggggtggggttgtggtggtgaaaccaantaaaatgggggtggtggtnaaaatgggaatggatctttatggtttggttatttttagggttgagggatggatggnnttgagtnggnagagtaaaacgtttttttttcaaggtnncaaactncttggtgggggggggggggattcttaagtcngcatgcctttccatgtattctggaagaaaaaaaacatgacgctcagggatgaccttgagaggctcactacgcgcacgaaccatccnggacttcttctctactggtgcgtgcgtgtacgtggtcgcncacctnctataccggcgggactggaaacaccgcgggtgtctccacctcgctatncctccttcccaagcatcccgccctgctttgcttcttctgtggtgggccctntcccctttctttttg

SEQ ID NO: 50893 - DNA, 600 bp, Triticum aestivum
  Clone ID: PAT_TA_50893
ccggtttgacccagcgttttgcctctgctgtggcagccactttgctgggccagtatatgagatgaaagatatcttgaatggacctgaaaggaaaggattatgggccagctcaactccttcaccattattacctactctgcgtgctctagttcaggctggaatatgcatggggttatatttgtatctgtcacctatgtttgcgctttcacgatttagtgagcctctatattatgaatggggtttctggcaccggctcttctttcaatacatgtcaggatttactgctcgttggaaatactactttatatggtcagtctcagaagctgcaattattatatctggcctgggtttcactggttggtctgattcttctcccccaaaagccaaatgggatcgtgctataaatgttgatattctgggcgtcgagctagctggaagtgcagctcaattgccacttaagtggaatattcaagtgagcacatggctaagatactatgtgtatgagaggttaattcagaaagggaagaagcctggtttccttcagttgttgggtacacagacagtcagtgctatctggcatggactgtatccaggatatat

SEQ ID NO: 50894 - DNA, 555 bp, Triticum aestivum
  Clone ID: PAT_TA_50894
cggtaattcaaaaacctaacatccgtaaggagtctcaatcgtacctcactcgttgccttactctcccacaagatcacactaaatacatttacctttctcgttttcttttctattctttctgttgtttgctcgcttgtactgctgtggtggttgctttataatataaagcagaggaaacccttttttgtcaaattgtcttgaaaataatggtggtccacatatttttactagccatcatctttgaatacattggacatgtattaggccttgtacaatgctaggtgcttaaaaaaataaatcggatttttctaaagcaccggtgtctatttttataggagagacgcctaattaagcgtctgccctgtataaataagcaccgatgcttaaaaaagcctgatttatttcttcaggcacctctgctaagcaccttgcattgtacaagaccttaagaagaaaaaacaaaagaaaagaagagatgagagaaacataaaaataaatgaaaaacgaaatagagaaaaaaggaaagcttaaaaaaatgaggaacatattctgagg

SEQ ID NO: 50895 - DNA, 197 bp, Triticum aestivum
  Clone ID: PAT_TA_50895
gatgcaacataatattcagaggtaagcattactacaaaagttgaacacatcaagcaatttcgatgcaacataatattcattacaaaccgagcactaactattgagaatgcttgttcatagataaaaggtaaggttaaccatggatgacaaaatagaacactgaattttaagcaacatcgcataaggaaagcagtgct

SEQ ID NO: 50896 - DNA, 149 bp, Triticum aestivum
  Clone ID: PAT_TA_50896
agcaataactcattgatttcccattgaagaagcttataactcatcccaacaattttttcccgaaagaaaaaccccatcccgacagtttgcatctactgtaagtgccaagaatctcaggcatatctggtgcaaccaaatcagcataactg

SEQ ID NO: 50897 - DNA, 470 bp, Triticum aestivum
  Clone ID: PAT_TA_50897
gggggaaaacaaatgggggatcagcccgacgaaacaacagggttttaatgattgggcaattacaatggggccaccacattatcctttttgctaaattttgatattggttcacaaagatggaagtaaactgaaaactatcttgacataatcatcattgaagcttcgtaactcatctatgtaaagatcaattcgctctggtcctcattctgccttgggagccttcggcttcacaggtctcgcgggcttgatgacatagcccagcaagacgcatagaataggaacgattgtgccgacataatacacacttttgtaggatgctaagggctcctggaagctcagtacctggaagccaatgcatgagtagttaagcaccatcatggggtatgcacaatttagtaaggacaggatagtgcggaggcctgaattgctcacagcttggtgccatctgtatatgacttttgaaccattta

SEQ ID NO: 50898 - DNA, 237 bp, Triticum aestivum
  Clone ID: PAT_TA_50898
aaaaaaagggcaaacttaaataaaccattttagagtagttacctgatgatccgttgggggatgaaaaaggctgtttttacccatggggggggagggggggtctttcccataatttttattcaaccttcactgaaaaggaaaaaaaaactgcttggccccatttgcaacctcaaagcaaaagttgcactgtcgacataaccccttggcgagactggcattactttctcttagcctttt

SEQ ID NO: 50899 - DNA, 551 bp, Triticum aestivum
  Clone ID: PAT_TA_50899
gcaattcagaaatttgacaggcaatgtcatccttgtgtttctaatggctacgcattttgatttgattcattcaactacttacattaaaaagagggagctctggaggtggtgcgtgactgcgcgtcttcaaagacttccacatcttcgagcttctcgggcttgaggcaagcagggatgtaagcggtgtaaatggtgctcatgttcggcgtctctttcagctgctgacttgccacctcaagaggggttttggcgaatgcaggataaaagcgtgtatggcaagtgtaggcaaagattaagcttattgcgaggagtggggcaaggatagtagaatagtagaacctcttcaggccgatgataccaagcatggttgcctggtaaatcatgagagctgcaatgatccttgtgtgcatgtgtggccacattcgtccgttgctctcataaataggaacataaactctcagaacctggttttttgctataagccaacccagagcaaagtaagcaacgccaaatggcaaaatcaaaggcgcgatgacggagtagcacatcac

SEQ ID NO: 50900 - DNA, 553 bp, Triticum aestivum
  Clone ID: PAT_TA_50900
gtgtttttttttttttttttttttttttttttttttttttttttttttttttttttttttttttttttttttttttttttttttttttttttttttttttttttttttttttttaaaaaacgggggggccaaaaaaacaggggggggggggggggcgctttttcccaggcaaaacagttcccccccccccgggctttttttaacccgccccacaggtggaaaaaagctttaaaacaaggggtttggggttgggggggaccctgggccaaagggaaaaacactcttttccgagggggccagggatccaaaatcctttaatttcaccctggggattcacaaaccccccaacattgttttaaaaaaaaaaaaaaaccccctccttgggggcccagggtttgccctgggggaaaaaaacggggggcataacctttttccggggggggggcttcccctttttgaggggggccaaaaccatttcccccacccaagcggacgggagggggttaaggcggcccttgatgcccttgacggaaaagatgtaaaggtttttggc

SEQ ID NO: 50901 - DNA, 550 bp, Triticum aestivum
  Clone ID: PAT_TA_50901
gagctgcatttcatcatgctccccagaagagcttctactacagcttaactttttttacatgtcagcctttaagcagcaacatcagcaggagctgtgaactccttatttcagtatcttcaacaaacatagaaacgggagacactaaaatagatatatcataacatctagacaacttggtaccaaccagctagatcggtcatacaaagcgatcgatgatcgtccatgtaagaacacagtaacaaccatttattggacctgtgcccttcataaacatggccctcaatcattttgtttcactttgcttgcgcgcctcccctcttttcttctggatccattgcttttcatctggatccaattcaacgatcctaccagcggccatgcacatgagcacatacaagctgaaggtcaaagtcgcaaattccatgcaacgatcaagtggatctagcactcgcatcttgcgccatgtgctgtccccgggtctaggatccacttgcacggcgagctcctcacgcagccgattgatatgtttgcctgccctgccagggatact

SEQ ID NO: 50902 - DNA, 265 bp, Triticum aestivum
  unsure (1)..(265): unsure at all n locations
  Clone ID: PAT_TA_50902
cgaggacactcctaatgcgaccggtggtgctggtcccactatcgtatgagtgccgactaaaacaagcacccatggtaatcatagtgcagaagcacacgtagtacacgcatctataatatacaaaaactagggaaggcgcaatcactgatcatactagggatctcanagacgttatctgtacgtcactgtcatggcgtactgtcatcatctcttatatttgtgtcgacctaaataacaatgactggacgcatgtttacaatcattg

SEQ ID NO: 50903 - DNA, 455 bp, Triticum aestivum
  Clone ID: PAT_TA_50903
gcgttttgtcagtgactcaagcaatctcatattatacacttgggggcagcactaaaactgtggctggatgaatacacatttacctggcgctaggtcttaaaaaccagtatctgatacatttgctttctttggtgttcagacagcgattgttttctatataagacgggaaatgactgtataatgcggggggttccttttcctaaagaagcatggcctggtagctttccggactgtgtctggtagaaaggacagatgtgagacaacatacttcaaaccgttttctgtctattatttctctggtgatggttgtttgagggacgaagtatggttactattggctgaccggaagagtggatgatgttatcaatgcaggtgggcacccgattggtacatcactagttgaatctgttcttgtttcacatccaaaaagcgcctaggccgctgttgtcggaatt

SEQ ID NO: 50904 - DNA, 533 bp, Triticum aestivum
  Clone ID: PAT_TA_50904
tcgcaaagcagttgtcaagctgcggagaaaatgcagctgcggcaccgcctgcaagtgcaggaacggctgccgcagttgtccatgtacccctagcctagtcgccagccaacctgctcactccacacctcctccacaagggagctcccacgggatgctcatggccttcatagaacggctactgtggttgcacccagcccatgtgcgagaccatctgcatctgctactgatgcagctgctagaacatagatcatctatcatgcatgcaccgacacctgcagcatccataatatgaatgtactaatacaataccatgtaaccattacctgaatgatggccttatttatgcacctgatctgcatcagcaatgaggcaccatacaatgcttgttataaacaggcccacctaaataacatctacctgtgttaactcaccaccaacttcgcccccggaagctaaatgtgtttagccgtccgtacgaacatacggccatccgaccaaatatacacaagttcacgtacgcttgcatatcaacg

SEQ ID NO: 50905 - DNA, 510 bp, Triticum aestivum
  Clone ID: PAT_TA_50905
gccgtcaaagtactcccaatccgcacacaattgccatctaaaaaccctagccttgatacgagaccccggagagcgagatggccaaccagggggtgttcattcgacatgaccgtgtgctgcccgccggcggctcgcattgagatggagctgtacaaggacgcggtgccgaagacggtggagaactttcgcgcgctttggaccgacctagaatggcgtcggcaagagcaggaagccgatgcactacaagggcagtgccttccaccgtgtgatcacggacttgatgtaccatggcggagacttcaccatgggcatcaggaccggaggcgagtccatctacggctagaagttcaccgacaagatattcgtccacaagcacaccaagcccgagattctcttcatgggcaacgccgggccaaacaccaacagtctgccagctgtttatctgcaccgcacgctgtaattggttcgacgggcaagcacctgcatcttcatccatgctactgagggcat

SEQ ID NO: 50906 - DNA, 481 bp, Triticum aestivum
  Clone ID: PAT_TA_50906
tctgagtgcacaactctatgtgggacagcacatcgcgctactggagcttggggaaccggcgggggcaacatagcgattctatgggagagcactcctaaggatgatacggggcggcggctagtcatatatactccttcccagtaacgtgcacggggggggaatggacattgttcaagggctcccgatcgatgagacactcaaggaagaagatggatgccaccgtccaggagctgccccaggagaaggttctggcctacttatgcctacactaaatacacattaaaagggcagatgtttctttaatgatgagaataaatgaaacctttcgatgcttagaaactgtggtcttcacccagaacaatcgaacatggatgatacatgctgcttatcgctggttatgccacaggggatgacagaggctagtagctcccattttgcctggtgatttacaggacagtacatttgctgggaaggatgaaac

SEQ ID NO: 50907 - DNA, 528 bp, Triticum aestivum
  unsure (1)..(528): unsure at all n locations
  Clone ID: PAT_TA_50907
gcacaggtgcggcacgctnggacaggtgtggaacgggagcgtgatcggcaccgcaattacagactcgaacgacaggatcctatacaccatggggggcgcactgcaacacaaacctcaccgaaggagcaaggctcgacgataccactcactgctagatactgaaccaaagaaggcaacctgcacaaacaagtcctcgagcaaaagcatacacctgccgcgaaaatacaccaacactgatgtggcgcagaacattaccactacgatacgaaataagttaaccccatacccgccaaggaagaagacactagcacagacacggacgccaggactgtgcgctaatactataactccatatcttacaagaagaaagcatacaccatgccgtcatacgtacagcaaaatactatatacttgagcataaagagcatacatacggtatgccaggcatataattgtagatgccgaagccaccacaagctgaaataaattaaccgttgaataagatagccattgtgccataagagccac

SEQ ID NO: 50908 - DNA, 298 bp, Triticum aestivum
  Clone ID: PAT_TA_50908
cagcccgtcctcaccaacatggagctatgtccgctcaaatcagtacacgcgctcggagctcgacagaggcacacctagccggatcagcacctcccctatttaataggaggaagatgcacccaccgatatccgcgttagactgtcgaataatctgggtctagtgcttccacctgttggttaggctagaagggtcactcggatccacgcggggccatgtgctgatacctttaatttggagacccttgatgaccttgcaccgtgtgaatacggaaactgattgtcaaattgttcattatct

SEQ ID NO: 50909 - DNA, 443 bp, Triticum aestivum
  unsure (1)..(443): unsure at all n locations
  Clone ID: PAT_TA_50909
gtgcacacctgctaactcgagctacgatttctaaccacttttgtcctccttctctctattgacccagcggncagtctccaggacctctacaatccttacccctagtctcatcacttcttcataagcaagatgcatttggcatgaaggaagctgatggtatggagaagacatgctaagacccaactggcgggcaggctggaatcccattgcgagagcacggtcatggcgttggcccccacatggctccagatcttcctgacagggaggcccctattcacgggccctcagttaactatgtcaacaattacgctcacctgcgccaggctttcttgctggacgtcctaccagaaggactcccctcctcttggtccgaacacctagagctgcatatcttatgaagctggcgtagcgtcgacatggccgccggcgtgctcgtgactctc

SEQ ID NO: 50910 - DNA, 571 bp, Triticum aestivum
  Clone ID: PAT_TA_50910
taccttccctcctccaacaccatggcccccactgtgatggcttcctcggccacctccgtcgcacccttccaggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggccaccgggttgcgaggagtctggcaaggcctaaactacgagttgaaacaatggcct

SEQ ID NO: 50911 - DNA, 566 bp, Triticum aestivum
  Clone ID: PAT_TA_50911
gatagtcaaactcacaccgcgaaaaaagccttgatcatggctgctacatggattcagaggcagctagggatttcggctgaaatgtggcttgggggcctgctcgctgcacttgaacaagggcgacctctcccctggtccgagaaccgggccacctacactgatccagaatgttgatatagaactaatgctatgaagggcaggtgttgatctgaactatacatcaagttgatgtaccacagcttgtgcatgcaatccctgaacatccacaggtctaaacctggagtccacagccctactgtacaagctataattactccacattttgaacttaccacttccagtgagatacatacaccagggcccatatttgatatggacatgaagcctgaggtgtcactaaagaatgaatacgtaaaatatcttaatagttgctaaagagaagtcattcagtacactgtattccctgctatatattgtggacattttccgataccctccaaatgaagcatcaaatatagctatttgagctgctcaacaattttcagcgatatattaaagacgtgcat

SEQ ID NO: 50912 - DNA, 572 bp, Triticum aestivum
  unsure (1)..(572): unsure at all n locations
  Clone ID: PAT_TA_50912
catttcttcccgctgtccgcaggnanagaaaagggtaggctttcccccgtcccttatattttccggggggatccatctccgttctgcttgggcggcgtcttctgaggcgcaggctttccccccccctccgctctaccccggcggccgattcgcgcccccctcgctcgaccctccaggtcagggaggtttctttcctaggagaggatcaatgtccaattatcacgacgatcacgtcgaagacatggaggatgattatgacatggacgaccccgctgaggacatggttgacgcccaccacgagcgaggtttaagagactccgattcggaggatgacgagtatgcccattcgaatgataagatcccagatacttcggcagcggatgcaagaaaagggaaagacatccaaggaataccctgggagaggctagctatcacaagggaaaactacagacagaccagattagagcagtacaaaaactatgagaacattcctaattctggagaagcagcagcaaaggaatgcaaaccgactgtgaaaggtggaatgtattatgaattcagacaaaatacta

SEQ ID NO: 50913 - DNA, 482 bp, Triticum aestivum
  unsure (1)..(482): unsure at all n locations
  Clone ID: PAT_TA_50913
tcgctggttctccatcggaagggctgcaaccctggatgtgaacaagcaagctgaagctgccggctattgctgtccattcctggtagtcaagagnctgtgccatgccccaagtgcccgcttactaccctcaagtgtccatgnattggaaaagcgctcggnactcttggggtggcaacggtatcagacctctttagaaccgcctcatagtggctgggggaggtcgctgtatgcaaccttcagaagtctccctaatcnattctgtccattgtgcctagtttaaggtagaaacaccgnnctgcagtaagcaccgttcactgtcagtttaaatgggcccagtgttctattgaagctgctggcagtaccttgctgtgaatctagcttgnngtttggtttcgcgactttgccatgtgcaaggtaaatgtntgcaacctgnnctcggttcgattctngtaatcactgaaaatcctttcttggtgctcccc

SEQ ID NO: 50914 - DNA, 569 bp, Triticum aestivum
  unsure (1)..(569): unsure at all n locations
  Clone ID: PAT_TA_50914
gccggccctccccgtggagcgcgcggcgctgccaacggcgccttagcctnncggcagcggtgcagcaacggtggnaagggannncaggtgcatgcagnngtgtggcccnnatcgagggcattcaagnnaagttcgagaaccctttgtcttannnctgccaccgcttcatgcacggnagggcccttcnnctcaagcaggttgcgacgtggcgctggagtccgctncnncaagtgnnggtgcncnnttgccttcgnnnagttcanngcaaggggtgtgggnnttcattcnnttccgtgnagccaccaanncgcatctcnnnctgggtacctanncgatggcnncggtatttggnacccaatgtggnannagctgcctatgntnntcgggtgcaccttgacnngccacacannggtgatnncaacgaggntnnggaggannggtcaagaaaaaggagtancccctgnacnngcgtatgntnnccgcattcatttcggnnattcgacccaacatgcnngtcaggtgcccagtgcngnntcagctttcatcnnngccttcaagcnnncaccggg

SEQ ID NO: 50915 - DNA, 577 bp, Triticum aestivum
  Clone ID: PAT_TA_50915
cccagcgtccgctctcggccgccgtctggactgtagcaagcggtgctgctgtccgccgcgctccggagccatgcgggaggggatgaaggagagggacagaggtgggagcccagatgcctcgggccctcctcccttccgcggcccggcgtacaagacgaagctgtgcgctttatggagaggcaggggcggctgcccccgccccaactgcgggttcgcccacggcgaggctgagctccggaggccgccccctcgcgcctccttccagcctcgccctcggcctgggagaagggattacagagataatgactttagagttaggcctgagagaagacactcaccctatgggaggttttcccctgaaagagatatcaggcgtcgttcatttcgtgataagagacagagagcaagttctgaagataggggatctagtcattcaagatcacctattaggaagagtgagagaaaacatagcaaaagtcctgatggtggaaaaaccgattcatccgtaagttttagaagttcagataacgaagacaaaggaaaagatgaaaggtacttaagcagtgatgagaaaaag

SEQ ID NO: 50916 - DNA, 468 bp, Triticum aestivum
  unsure (1)..(468): unsure at all n locations
  Clone ID: PAT_TA_50916
ccacggcaggggcgacatcctggcgaggccgcatgtggccccagcccgcgtgaccttcccgtacggagtaccgagggcaacggccgcccctctgcctgcaaggcgggagcggaccgtccacgccgccgggcatctgcgacaagatgtctaaacatgatntaacgaaagcccaacgatacgtgctcggaggacaccggcagctgggacagcgcctctggtatgaaaacgaggtgggagagagctcaacgcgcgcggtcagtcacccccggtacaaggacaacgactaagacacatttaaaaactactgacagagaacccccatacctaccagtgcctgacctacaaaaacagagatgaccacctaatgtgggatggaccgctgatattgaatataaactatatgttcatgtctaataaggatcccgaggaaacctggtatgcctcaacctaccagaacttacacgatcg

SEQ ID NO: 50917 - DNA, 373 bp, Triticum aestivum
  Clone ID: PAT_TA_50917
gttatcagccccaggccttatgctcctgtcaaggagttcgagaaccgctgctttggtactggactccattaagaatacgagtgaaccatcgacgacgactgtgttagccggccaaggcacccatctggcgaagacattaatgctgttgagcagcacatcaagaacctcctgagggcgggcacccagtttttcttcaacaccttgcatgacccttaccgcgaaagggcggacatttgtccgatgataccctttaagacttacggaggttgcccccaccgaggggtttaatggcctttggctgaaaatacgtgactacgatgcacacacactattgttaacaagctcaagagacgaacactatttgtgtggaagc

SEQ ID NO: 50918 - DNA, 528 bp, Triticum aestivum
  Clone ID: PAT_TA_50918
cttctcctccccactcatcctcggttcccggtccggtcccgttccgttcgttagggtctagtagtagcggggaagcagaaggaatggcggacgtcgagtaccgttgcttcgtcggcggcctcgcctgggccaccgacgaccagtccctccgcaacgccttcttcaagtacggctacgccatcgactccaagatcatcactgacagggagacgggccgatcccgctgtttcgggttccccaccttagcgtcggacgatgcgatgctccatgcgatcgaggccttgaacggccaggacctgaactgacgcaacatcaccagctactaggcgcagtcccgtacctccaatgcctgacgcgttatcggcattctatggcggcggtggcggctactggggccacacccgtaggggcaggaagaaattacatgtaccattacatgattctacgtgtccctggttgccacttataaacatgctgctttatgctgcttctcgcacgttgcttactctagcggccaaagttttcata

SEQ ID NO: 50919 - DNA, 483 bp, Triticum aestivum
  Clone ID: PAT_TA_50919
taagccaggcttgtattccttcacgggtgtaccgctatctggccctcctgtttttggttgaaccttatcgagcccagctcatattactgactgccaccctaacttcttcagatgtcataggcacgctaagcctgcttaccatgtgggtggaggagaccaaggccaatggacctaaaaatgaagacagagctaatgcatcagcaccatctgtgctgtagtatgagaggctaactctctttcttcccagagtgtaacctccaccccatacgctgcaactgctgtgttaccaccgctgacccactctgctgcctgagatgtatgcgcatgaatcctaaataaaccaattgcatccattgagggttccagctgggcaaacgttatataccctgcccttcttagaccatgacgtgatgttcaacttatctacatcaccttttgctgatcttgacagcactgacctaacattgcatgctggcctccaaa

SEQ ID NO: 50920 - DNA, 440 bp, Triticum aestivum
  unsure (1)..(440): unsure at all n locations
  Clone ID: PAT_TA_50920
ggcctagttcccacgttctcgccacgcgatggagacgccggcccgccggcacggcggcagcagcagcagcagctctctgacggttgtgttggcgccgccctgggtttattattatgatggtgggggcgtgcctacncgtacggactacgaccaccaccggctgggcacggatgccaatcttccgcgcctactggccttcctgggcctggacaactttgaggcggatgcgcggcacatgctgtaccgcgccaacaccgaccgtgacggccggctctgcgtggaggagttgctggacgtcattaactcatgcgagctctggctggactctctcggcggcgctcctgtgagccctcgccccagttcttgattgcttggcgatgcccatcggcgctcttgctccagacaagctcgacagtgtgctggggatgatgggcaccggc

SEQ ID NO: 50921 - DNA, 460 bp, Triticum aestivum
  Clone ID: PAT_TA_50921
atccttagcacataataccacatggtatcaaatgtcagcagcgttccaactctttccattggcaggacacttgacatcgaaagatgcaaccactgaacctaacgggccttgcataaactggggggaaattcgaagccatgctgtgcccaaatgaaccgattctatgtcctatttagcacccgtggcaagaaagaaatgacccgtgcttcaagtgtgggtgacaacgggccttttggatgctaacacgctaactgagtggtaagagatatcaattgtacagccacacacggatcagctagcggggctcgggtaaccaaactcatccatttgactggatgccattttccttaacattgttgagatgaccttgccactcctaatgtactggaaccccggtggccagtgaatcttgctaggtgctgcaaacgcacaaatctgtgacaaaatgacaccatgtctg

SEQ ID NO: 50922 - DNA, 488 bp, Triticum aestivum
  Clone ID: PAT_TA_50922
gcttaattaatttacattgttctcattttgctataggacctttaacccggtagatcatgtttcagggggacacacaaaaacaaggcaggtacgggaccatccagcagtacaggtcacatgcatatataggccctggacagacggacggaccgacggataaacacatttaacttacgggggcgaagctggaggcgaaggcccagccttagctgttaacaaggatctagaagttgaccaagagcactcaactgtggccgtcccacttgaccatggcctacacgaagaagccgaacttggacaacatgtccaggccgccggacttgaccttcttgaccttgagctcggagacaaagaagggggcgccggcgaggctcaagtctgctcgaacatgccgccatgctacatagatgttgacgccacttgccgaggggcgccgccaccaacacggtactcctcgatgagacacatgagcaccacctgaaccgtcc

SEQ ID NO: 50923 - DNA, 519 bp, Triticum aestivum
  Clone ID: PAT_TA_50923
gagtgaacatgtgataagttcaattttctgtaatacaaccggttagcccatgggcacaaggtctgattcgtcctttcagtaaattacacaatggtacaggaacactacatgggatacaccaacaatgggtggtaaataaaaacttctagcaggaacaccacaaaccagatctaacttattgctggcaacaaatcaaattgtctactgataagtctgatctatattaagggtttgtaatcacagatatgtagtcacacttgagcaaaaccttgtatgaaatcattccatttatcacctttgtggtcctttatactgttctatgtagccttggcatatggggcaaaaatggctttgacatcttcaaacacctcaggaattggttttgcagcatcgatcttcttaaccttgtccttcgcgtcatagtactcaatcacaggcaaactggattcaacaaaaactttgaatctcttcctgatagtctcgatgttgtcatcaactctaccctcattgcgtcccaaa

SEQ ID NO: 50924 - DNA, 451 bp, Triticum aestivum
  Clone ID: PAT_TA_50924
acggataattcatggcgtgagtcatattattcaaacggtaagatagctagctatacacaggtaagaaggcaaggcccacggtcgcaacaccatcggtccaaacagtacacctaaaacctttctaatccaaccacggaaaatctgattggacggaccaggtgaacacactacgctcgattctgttatttacatgaaagacacgacacgggacacactgggcgaggacgactacggtgaccgcaggtcagggcggatttaaagctggccgaacctggcgttgatgacctgcttgaagcaggtgccgctgctgaagcccaccttctccatgttcttgacgacaatcatgccctggacgacctggacctagacctgtgcttgccatagagccaattgcaatggacggtgcagatgaagatctgccagccattagggttgaccccggcattggcca

SEQ ID NO: 50925 - DNA, 472 bp, Triticum aestivum
  Clone ID: PAT_TA_50925
aatcatgtgttaaattgtttgaaactttcatcctaagtactgttctgcattagcacccacctaaatggctagctgcgaaaacctcatctcatacacactggcatactccagggacaaaggacatgcactcacattcttcgccctggtattcgggtgtgtaaccagagttatctcctgagcaaatggcctttatattattcacaaacatgacaggagtatttatcctacgattgaggattctcgcgaggctttagaagaacctcttgcttcccttgaaccacttcttggctgcggcttgcatcttgttcacttagaacttatcgatcgggaccccttgaacaattagccattcactaccattgctcgtttctgggaaggagtcgataaaaccacctgtccaccgtatcaaccatcagagcacacacccatggaaacaattgatccctttggggttcccaaaacccagtgactg

SEQ ID NO: 50926 - DNA, 452 bp, Triticum aestivum
  Clone ID: PAT_TA_50926
caacaacaagcccctctgattgcatcaaattaatgaaagggtgcagtgatctggcacgaacgggatccactgatcccccttgctatatccaacttcacagttccaatatcacaacaaaccacgacacatgcgcctactgcggagaccctgcctctgacttatatgcaagcctctcttgcaggccacataaagagcatcacaaactgtggtaagctccactaacacttttttcttgccatcacactctgaagagggtgacaacacttgttggcctaaaagtacggcattttgatagacatccgccttaatgttcttccttgcggccttcaggacgaccatgaacacgagggggaccaagaactggatgttcttgattacagactcagtggtaatcggctacttgtagatctgatattgatccagcttgtacctgacattggtgctgatcctgg

SEQ ID NO: 50927 - DNA, 315 bp, Triticum aestivum
  Clone ID: PAT_TA_50927
atatcactaacaatgtgtctatcagttatcaatacacaccgtctgccgccttacataccacataaatcaaagggatgatcacatggccgccgtgccttgccgagaaacatactagcctaacccacaggcgtatacatattacccaggttcttcaaagaaaacacggtgtgtggaggaaaacatcctgctttgtattaaaatggaggagctgctttacggtttatttgtcctctgccagctgtgagctgatctgctcttggggctctaccatgttgctgagggctggcttgcatacaagctggctcaactccacct

SEQ ID NO: 50928 - DNA, 330 bp, Triticum aestivum
  Clone ID: PAT_TA_50928
aatgatactgttttgcctgcaagggccccaaccaacataacaaggggactcggtggttatcaaaccaacacatcagactgacacgaacgagaacacagttcaaatgaacggtagggcaccaccgaccagaccacccaggataaaccaaccagttgaactccagggcaattactgaccaccgttggagcatgaacaccagatggcggggggactacttctggatgttataatccgctagggtccacccatcctccaactgcttgcaaataaaaataaagctctgctggtccacaaggaatgccctccttgttctgaatcttagcctttaca

SEQ ID NO: 50929 - DNA, 494 bp, Triticum aestivum
  Clone ID: PAT_TA_50929
ggagctacagcatattccaagttttcatacagcgggagggggggacactacagcaccctccagctgtcatcaaacacatattcttttaaacaacaacaacaaacaaggccgtatcatcatcatcatcattcatcatcaaacatacatccaacatgaagaaaaggcagcggcgggggacaaaaaagaaaagaatcgaattacagactagcagcagggtataaaaatccatcctgaactttcctcggggtacggacgacatcgtccgtctgcgcccggcgagcagcagaaccgtcgttggaacctaataaacatcttatggacggacgcaggggacaaccttactatgatgtaacactgttttactcgaaaccgtccatcatagggtgctggcccccttctgaggaggtgtttttcaacgactgtttccgggctgtgccgcgcctgttcttggctttcttcgccttcatcctacgcttcttctcggtggcgtccac

SEQ ID NO: 50930 - DNA, 544 bp, Triticum aestivum
  Clone ID: PAT_TA_50930
gattcggaatgtccgtccaactatctttcatatgaacacagtccagctgagccttacatacgaacacgggcagcagactatatgggcaatagcggatgctgaataacgatgcgcatgctacactgatatcagtcgttattcatacactcaaactgcatggggctctgctgagctgacgaacaccaaactttggacacctaatacacacaacagtaacaaacgcacctctttaatacccgctgaaaattagcgagcagatggcctagctatatttgatgcttactttggaggggaacggataaaaccacaagatatagcagggagtgcaacgaactgaaagcacattctatttagaaaccttcaaggtattctcgaatgcatactttagtgacaccttagtgctacctgtgcatatcatatatgggcccaactgggtggatcacacaggacacggaaagctcaaaacctggacaaagaatacctattccagtagggaaccggactcgcagtttaacctatggaacttaaacgaatgcttgcacaa

SEQ ID NO: 50931 - DNA, 563 bp, Triticum aestivum
  Clone ID: PAT_TA_50931
gctgataaagagcaatctcacaaaatataccatacttttcctgtaagtccaaacaagtgtagaaggagcaccaaaggctacagagaaaacagcaccaaacatagtagctgtaaccaagaagcaacaaagcatcctcctgcttacagttacattaagaacagaggtcgccagcgtggtatcgagcgaacgaacagagtaccttgcaggatttggaacatagcagccaaagtcacactgtcgaggtaacaacttggcaagaaaaacatgacgtgcaaatagtctttcagtgcatggataacatagtctgcaccacagttctgcaccagcaatattaccaactaaaggatgtaaccttaatctgaacaaacaagcaatctttctatgtgcagtagctcctcttcgtgtccatgaacaatcacgtatgctgaacaatgtccgtatgcgtttggtgctatcactgggtttcagtttttccagtttgttcagggccagtgtcatttgagccgctcgacccagaactggcatcagcactctgatgttcattgtgcacgtcactggttgat

SEQ ID NO: 50932 - DNA, 448 bp, Triticum aestivum
  Clone ID: PAT_TA_50932
ggggtaccattaaaacgtatataggggacaaattggaaaaaattatggggccgggcatatacatagcccccggtgggggggaaaaacgaacatgctttttcgagccatggggggccatgaacatgggcatacacatttttttaggaacaaataaaaaagataaagggggaaggaaaacccaaagcaatggcagaggtgacaaaactggaaggggactttatatatggcccggcgggagggagctgtttaggccttgccggactcctcgcaacccgggggcttgaaggggaaaaaactgacccactggacctgacgcatggtggcgaaaccgatgatggggacaaacccgtaaggggactcctttttgaccccctccacctcgttgaacacctgggggggggtagggcacccgaaaatagggaggttccacattggccaataccgggca

SEQ ID NO: 50933 - DNA, 321 bp, Triticum aestivum
  Clone ID: PAT_TA_50933
ggttaaccggttcacggtaggacgaggtaccggcatgcgacaggccaccgagagcgccttcctcttcgcctggctgggcctaggcgggatcattctcttccagggcctcgccctaggcgactgcggttttctgcccacagaatgggcacagttttttagttaaggacctgtataacaccgatcactccgacagaactctcgaacctggggggtaccactgtatatggcctgttcaaagacttcgaaggcgacaaaagcaaacgttcacacacttcaaaacaaagcatctcaaagcacacgttgcctaactttgaggggtgg

SEQ ID NO: 50934 - DNA, 529 bp, Triticum aestivum
  Clone ID: PAT_TA_50934
aaaatctcaaatactcaaactggctaagaataatacatgaggcgaatacagatataattctcttcgagtctcaggaaacaccagaaaaaaaaaaaattctagcatcgcatgtaatcatgtttgacagcatcacaactcagtctaagcacataaatagctaccaaatatatcaggccctattacccgatgcaaaaggcatacaagtagttttagaagctgacatcgatgtcgtctgctgaaattgcttcctacagctcaaatcgttatcggcgaccgacggcatcgggtcactaatcaacatcaacttcctcatcatcgcccttgtacctatccgcaaaaatattgcttgaagaaacaatgtttccttcatcatcgtagtcacccactcttaacttcttcactgtaaatgattctagtcgatcagttcccttgctatcttggacatgttctagagcatcttcaggtctatagttctctggtgttggaatcatatcatcaccattctctctctgtctcttcccagtttttg

SEQ ID NO: 50935 - DNA, 384 bp, Triticum aestivum
  Clone ID: PAT_TA_50935
ctcacacataatatcacaatgaccattgctttataaaattcccatgtataaatataagttgtcaagactcttgaaattggtaacataccctcgcacaattgcaaaagacccctgacaatcatatgaaagagtaataatactggctaccgtattcattttatcatacagagctatatgtactcccacctctttcactctatgttacagaacaagactagcttggttagtgccttgctgcttgcagaaggaacaaacgactccgatgtgatcatgtatgctctggcctacaaacaactgaccgtgctttaactaggttagaagatacttggtggaatattgaacattttttttttaaacatctacgtaattcacttgaagcttttc

SEQ ID NO: 50936 - DNA, 396 bp, Triticum aestivum
  Clone ID: PAT_TA_50936
aaataggtcatacaagcattataatacaagccatgggcacttgagggctaagaatacaagtgcgtggatcatagtaccagtacagcggaaaacaactcttattttgaagacagcacataagctacaacaagtttggccttgaataaggctagcaacaaactgggtatccaggatctgaacggaggcgcaagcacttctaggctgaggatcctccttaactgactcctggaagtgcgaactccaggtcagaaaaattcataaggaatctctgagctcctaggacatgcagcatactgagttgctctagcagagaaggagggcggcgacaacctaccctaaccaactgggggtaaccggtaggctggggatcacggttccaacggaagtgcagacaca

SEQ ID NO: 50937 - DNA, 550 bp, Triticum aestivum
  Clone ID: PAT_TA_50937
gaacaaaagagtaatatctgataagcataagctaagtacagcacaaaacagaagttacaaagatgcaaactcgacatcactagtactacaggaaaaactgcataactaacagtggcaaccatttctttgtaaaatagctagaaataattactcagtcatctgtagtagcaaatggatcatgcgaaggtcctgtctcttggccaatggttcttgaaaccaagcgctgcaaatcagccataaccttgtgctctctctttgacttctcctcgtagttaaacatggccagagctctcttatcctctgcactataaacctggttttccttccttatacggatagcattcatcctctggtgcctacttccactcatcacataccccaaatcttcaaacttctgaatctcatctgcagacagaccaacctcaccacgccgtgggatacgcttcccctgctgtacatactgtgcaatggcatcaccctcaccaggtctcagtgcgccaccatagctaatatgaccatctgcacgcgggagtggcatcggtccaaccgg

SEQ ID NO: 50938 - DNA, 313 bp, Triticum aestivum
  Clone ID: PAT_TA_50938
atcctactatgcttcgttgatacaataccatggcccacgactggatggcttactcggataccaccgtcgcacccttggcacgggctcaagtacacatcagggctgcccgtcaggcgtcgctccagctgcagcctgggccgggtaaacagtggaagcaggatcaagtgcatgcacgtgatgtcgtattgacggcttcaagaagaactagaccctgtcttacttgccacaccatctacacagaggtcgatcctaaaggaggtagtactacactgatccgctccaagtgggtgcacatgcctaggttcagtaatgt

SEQ ID NO: 50939 - DNA, 581 bp, Triticum aestivum
  Clone ID: PAT_TA_50939
gggccccttggccccaccgatagcttgggcagtctgacgacctaacccttacagtaacaaacttacataatgaggactaaggataaatgggttgggatgatgttcctgttgacctatcaatttttaaggatattgatcacagagtatataaggcggactgcttgctaaaaggcaccaagggacacacttaactaaaacttcgaatgaattgtagctactatggaagaaagccttataactaaatagtaacagaatgagcacctcatggaaacattttatgatttttctatttcaaagaagtgcagctatgcatgtctacgaaaccacgaactcatgcattcaagctgcagaagaaataactattttttagacttaacataatttattttactagaacagcttatacaaagctctgacatgttaaaagacttacaattccctactcacaagactaaaaacatattgcacttcataaagctgatggatgatacgaagaagattttactgatcgatgttagcaacattgataagaacttaaagctgaatactaaaaatcttgactatgtgaatgtaattccttc

SEQ ID NO: 50940 - DNA, 586 bp, Triticum aestivum
  unsure (1)..(586): unsure at all n locations
  Clone ID: PAT_TA_50940
ggcttctctctccctcccacgaatagtttcgtagagccgaaggttgtctgggttccggtgggaactagttctggacggcgaagccctgccggatagatgacaccgtatgtgtgcaactctgtagagatatcgtagtttctgtcttagttcgtgagtgcctcccgaaggctgtgcgtgtgaccgtccgagtttcgaaggtcctcccgaagggctgtccgagtgaccgttcgagtttcgaaggtcctcccgaagggctgtccgcgacaccgtccggggggctgttcgaccgcctcccggagggctgtctgaggagcagatgagggtatacatcctcgcggttgggaggttgtaaatcctagctgcggggatctgcaccgccgatcgccatcgactctacttctcgctgcgctacgagtcggnattgcggcaagatgatgatgccatagaagccttggggtgctaccgaatcttgcagttcttcggctgagggttaattcgtttggtggggcatggcttcatttccaggggtcacctttcccgaatctcatgttgcttgtctgctggaggtctctgaattaacactcta

SEQ ID NO: 50941 - DNA, 535 bp, Triticum aestivum
  Clone ID: PAT_TA_50941
gccgctcgtttcccgtcccgacctcccaatttcgccgtctccccgctcatcgctcgccgctggccggacgcccagagccgcagcctctccgtcccgcccgctcggcgtttggggctcggcagcagccgcgccaccgcaactgtgcgggccgtgcccctgcctctggccgccaggcgcccgtgcaagccggcgcacgcggcccactccgcacaccggcgctcggccggcaggcagcagcaagccagcaaccatccttgttgatttgagatccgccactgtcgtcactcttctccaccactcagacccagcatagcagcaaggaagtggacgggaggatgatgggaagcaacaaccccagcggcgcaggcggagggatggctccgggcatgggggcgggcagcagcgacgggcggcacgatgacgaggccgtactcaccgagttcctctcctccctcatggactacaaccccatgattcccgatgagcttgtggagcactacctcgggcgcagcggcttccactgccccgacctacg

SEQ ID NO: 50942 - DNA, 500 bp, Triticum aestivum
  unsure (1)..(500): unsure at all n locations
  Clone ID: PAT_TA_50942
gctggntttcaacctggtgttaaagcatataaattgacttactacactcccagtagtatgataactaaggatactgatctcttggcagcattccgagtaagttctcatcctggggttcctgcccgaagaacagggctgcagtagctgccgaatcttctactgctacatggacaactgttcaggactgatggacttaccactcttgatcgttacaaaggacgatgctatcacattgagcctgacgctgggagaagacaaccaatggatctgttatgtagcttatccattagacctatttgaagagggttccggtactaacatgtttacttccattgtaagtaacgtattgggctataaagccctactttctctacgtttggaggatctacgaatgccccctacttattcaaaaactttccaaggtccgcctcatggtatccaagttgaaagagataagctgaacaacttggtcgtcctttattgggatgcactattaaacc

SEQ ID NO: 50943 - DNA, 441 bp, Triticum aestivum
  Clone ID: PAT_TA_50943
gctacactactaagcacatacacatctctgcaactgcttcacgtactgcgcggtttccagcaagcaagccgaagcactaaatcctcgatggctcgcgtggaactgctcgccgagttctccactctactgtgactggctcgtggccaaaatggcgtgcagtgcggttacctataccaacacgacggacgacatttttccttacatgagatactcaacagataaaggctttgcgcatcccactttgagccttactctacagcagagaccctgatcggccaagagagcacctagcgctactagttccttgatgcccgatcactaaagaacctgcaccatggcgtctaggggattattatggtctacagaataaccctgcctatttaaagcgagatgtacttatctattccattcaacaccaacgaatgatgaagcatcatgtac

SEQ ID NO: 50944 - DNA, 368 bp, Triticum aestivum
  unsure (1)..(368): unsure at all n locations
  Clone ID: PAT_TA_50944
tttatttttggtttttttttttattaggggcaggcatgaacacgaaaggtcttataccggtacgcaaagagtccatntattcttgcatacccgcgtcgacgttgttctaaagcaaggcaaaggacctcacctgtgacctaatggaggagaaattctggaatccctggactgtctagctctacttgctatgaagtaaactcatacatggggccgcgcataatcaagctgaccaacagaggatgggattacggatcttgcactgatggtcaaagatcactctataagccatggtgtcgcgaactgctgcccattgtgcaagctcaccctatttgaaccataattcgatttctaccttgcgaaaatcaagg

SEQ ID NO: 50945 - DNA, 437 bp, Triticum aestivum
  unsure (1)..(437): unsure at all n locations
  Clone ID: PAT_TA_50945
acanaaaaggcacatacaagnatatcagccaggctgctagaacaatcaaaggaaatcaaccagcacagcaaaaccatcaagtagagaactaaagaggcatgtaactatgtggaacaagtgcacaatgcatcaaacaaaatccaagaccttgctggcgttttcttggaccctgctgcctcgatgtgtgtttctaatatgaagcaagctatcatggagattcacatttcagttgtcgcacttcaaagctctacaattacaacatctcagttcctagaggaaaaaggcatgtactcagatgatgaagtgcctgaacaaggctacagtggctactcagatgaaaattcagccgatgatattcatcaagacatggatgaggactatgctcactatgtccgatccccatgagcgtcatattgagcctgctgaactgtctcgtt

SEQ ID NO: 50946 - DNA, 440 bp, Triticum aestivum
  unsure (1)..(440): unsure at all n locations
  Clone ID: PAT_TA_50946
tggnaggctaagttttagcagnatggnactgaanaaaattaaacagtttacagttgatttaacctcagtggagaccaatatggtattctttgatatctcggatccacgcataacatctgacaaactgtgtcaactcctggaacggcgaatgtgcttgcgatgccaggaagctccaagagcgtcagacttgtcattcactaccaaatttcagatagtgacgtccagtatactttgacatgtatcgagaaagccgtggaggaaatactgtcaggcaatgttaaattcgagcacttgacaaacggcagtaccacgaattcatatgggcactaggccacttcctttggcacccacctatgaagtgcactatcgagcatgtttgtggccatggccttttgtggtaacaacttcgcagaataatatatgttgctgtttgggccgaa

SEQ ID NO: 50947 - DNA, 400 bp, Triticum aestivum
  unsure (1)..(400): unsure at all n locations
  Clone ID: PAT_TA_50947
cggncgcgtgggccaagcccaggacaacctggttccgtgcaacatcaggatgcacggctagtggaagctaccaaagatcgacgtcgccaggatcgtgggtgaggtagaatgacaacctagctgcaccatgttcgctgcagacggcacatcaagtgagtcgcagagctactgcgccgaccgcccctacagggcgacttgctgtgtgaaccatctattgactgtcctccagcttgccagggaagaagacgacggtagagacagggcaccaactatgctggaacattcggacgcacgatccacaggcagatctacatcgacgtgaagggtaccggctccgtgaaccagtgcacgagcatgctcatgagggacgactccttccagtatgaaactgagcatgacc

SEQ ID NO: 50948 - DNA, 369 bp, Triticum aestivum
  Clone ID: PAT_TA_50948
ggactctggagcgaacgtaaagcagtatgagaggaagaaacaacagcagaaactcgatcatgtcaaccagcaggctgcaagcatctccccagatgtcattcagatgcttatgacgcctgtcaccaccgaacagaactgagaacagctgtttccaaactatgctcatcatgctatttatttttgtcagagcatgagaggaattataatatggcccttgaaccaaaaattctttctttaactactgaataacccgtatcagctttagcggcaaccgtgactgttactaccaaaacttgccattatttggtataatcggccaatcaaataatattggtttatattggattttttaacagaaaaaaaatacat

SEQ ID NO: 50949 - DNA, 440 bp, Triticum aestivum
  Clone ID: PAT_TA_50949
aacgttggatgtgcatgcagctagatctatgttctgaaaacctgaacggggtgttgaggttcatgcaagatctttcaggaagcatccagagccctgcatagatattagtctgccgattaacggacattaaggctatggaagatgaatatggttatgaacaaactgttaagcatgaagctgaattatctttatacagatctgacctaaacataacaacaattgcagggagcatattacggaaaaatcgatgaactgataatatccactgatgaggcttcaacatactatcgatacatcatctactgaccgtcttcattgcatatataagagacgggttgcataaacatgaaacactaatgctacagcttgtatagcagctatatatcttgttagattgagacttgcatggattacaggggatcatcctttttgaactcaac

SEQ ID NO: 50950 - DNA, 574 bp, Triticum aestivum
  Clone ID: PAT_TA_50950
gggacagccgggccagacaaaggtgtgcgacgcgagtagcactcaggggctccttcacgccggcacgggcgaaagcggacggcccggtccatccattctgggcggcgctgtcgtcctgcgaaggagtgcacaagcacgagcacggtgtagcaccgcgccggagatattgcacgtgcctgccctttgcaccctaacgcgaataaatagcatgtgattgcgggaaccgtcatggtaaccatcagaataactaaaccgctcggggggctggctgggaaccgtgctatctaccaacactaaactatcgatcatacgcactgtcacacaaaactaaagagctctttgttgttctagaatctataggaaccaaaaaaaagaaccttttgattgtccgcacaggagatactgcagcgcttagtcttatccgtcatctgcaaccatacctagtccatgtggcccgatgtttctgggcttgatggggccaatatctcatctatcaatactagcagtacaggaaaaaggggcctttcgttcagcgatttatgagagcgaaagttacccatggggggctgcgagg

SEQ ID NO: 50951 - DNA, 144 bp, Triticum aestivum
  Clone ID: PAT_TA_50951
accgtatccactacatatacagtgaactttacctgggataatagaagaaaagaaaagcgcagcatgatgttctgagccgacggcgacgggaaccgcatacggggcgtcttgctaaagggcatgcagtccaagtcgctcactctg

SEQ ID NO: 50952 - DNA, 228 bp, Triticum aestivum
  Clone ID: PAT_TA_50952
gtcactattccattggtcgactatgacacatggttcctaacttcctccttgacgtcttaggcagctatctatcacatgttggtgagcaaagggccaaaatgacatggaccattgcacagggcccaccaggcggcaacaggcatcatggagcccacacggtgttgacatgcactgcaacacactggagagccgggaaccttcgccaacagtgagactaaaaactataac

SEQ ID NO: 50953 - DNA, 507 bp, Triticum aestivum
  unsure (1)..(507): unsure at all n locations
  Clone ID: PAT_TA_50953
atctatttctttattgacgcgcttttttatgagtccctctctttagctttagggctatgtgagtctaatcaagggcatgaaccggctcgaactcgaatgaggacgcctttcatactgcacaagtctgagggtagcacaggactccttttggaagcggcccggataatgccattaccttccgcgatcaagaacgcgcccttcgttacgagctcnggcacaggctgacaaagccagccgcagagctgcgtgcaccaggtgctgatccccacggtggcctaaagcccctccaccaccttgcgctacagaatcccccccaaagatctaccgcagagctggcatatgccaaacatgaataccacctgaagctaccgggctaacacctggcatggatacccatgcctgactgaaaaagaaccgtgagcacgaactttttcaataaaatcatcgcgcaatcaatcaacgaaacctactgtcatgcctagtgtccccttctaacttacctactac

SEQ ID NO: 50954 - DNA, 415 bp, Triticum aestivum
  unsure (1)..(415): unsure at all n locations
  Clone ID: PAT_TA_50954
aaaaacaaatacaagacattcaataacctaggttggtncctgcatgaaggaaacccatagcatcacatgctaccacacacttccttgagtagacttataggtcgtcataacacctaaccacacacaaaaacggcactttgctgcacctgactggccaacaggacgcctggatcatcatgcgtgtttaaacaacatccggaataaaacactggcatcggagccgggctccactacacataccaactgtgttcgccttcactcccaaacacgataccaacacgttcggctgcactttggcctactgacaatcacgtacctcaaccttgatgcaccaaaattgtatataaggtgcagcatgtatagaatgggtcttagaatccctatttgttagcgcttgatggaaagtgtgcatccg

SEQ ID NO: 50955 - DNA, 434 bp, Triticum aestivum
  Clone ID: PAT_TA_50955
aggattgataatgaagccgatcgactttagcaggtcttacacaaactagtgagcccaagctgagcacaacaacccccgccaaagcatgaaactgcatctatcacgaaccatgtcaagaaaggagctgcctggtattatatccaatagacggttctgacctcctaaaccgtatagggcagcatgtcatggcgctcaatccaaaccactacgtgcatagcggcacacaggctatggagtggcaggcatcaaggcctgtatacaggaggtacacctgacaacacataagaaaagcctgctaaccctatgcagcttatccatcatgaggcttgttatcatctttactccgaccgtgatgatgcagtctccggatcttcaggatcgatgataccatctatgtggcaagcaaggactcttgctgctagccaataatggcc

SEQ ID NO: 50956 - DNA, 504 bp, Triticum aestivum
  Clone ID: PAT_TA_50956
aaagggggcccccgggattaaaagtggagggctgaacaaggacaccggggggggaaaaaaagggcctacagggacaaaggtaaagaaaaaaacaagggtttaatttaataaacgcccccccgggcgggcccaagcaagggataaagaagggggggggggggggggggggcacatgaacaaatggccctcttaaccccgggcaaagcccgcccggcgggcccccggggcccgggtcaattacaacttcaacaagaacaagcccacccgggggcccacctgcaagaaggaggaaacccaagcccccgtccccccggcgggcaatttgaaaccggcggaactccccctgggggaaggggggggcaaaaaccagggggggggccccgaaaaggccccaaagggggggaaaaatttgcaccccacggaaccggtaccccaacttcatccgggaggcaaaatcagaaatagccgcccaacaaaaaaaactcctttaaaaaagaggggggg

SEQ ID NO: 50957 - DNA, 476 bp, Triticum aestivum
  Clone ID: PAT_TA_50957
aggagggaattgcgtgtaaatttttatatggctagcattattgttcttctaatagaaggaaattcacaaacatgaagctgaaatttacctaaagtcggggagtggagtgcaaaataaactaaaaattctgttcacttttacaggcactcgggagagacaaaagcctgggctcaactaaaacaatacccaactttcagcttttaattgtcatgacacgaaaataaactgtgcaaactaaagtacgactcgcagcggttgccgctcaagatgatcgacgatccgcacagacattatttccatttacacgcgacaaatcggtcgatccacagctcgacggatcaatgatcgaggacgtaggacactaggtccccgagggacgtgtagtcatcaaggtactctccaaagttaacggcgccacagtattgccgggtggacgtcacgtctccctggtctggccaagcaggagccgtcgccgt

SEQ ID NO: 50958 - DNA, 400 bp, Triticum aestivum
  Clone ID: PAT_TA_50958
attaatacctgctctatctactagttttatctagctcatcaatagtatgtaccgggtcgaactctaatttgatcgccttacatacttgacaagctgcggatagttcaggactccatttgcaagctgctcggataattcattaccttcgcgagcagaatcgaggcccttcgttacacagcttgtacacaggcttctaaagtcactcacatagtgtgctgcaccaggggccttaacccacggatgccctaacaggcctccaccaaatcgttatacacagtcgacctcaaagatttctggcagagctgtcatatgccaaacatgaataccacctgaagctaccggtataacacctggcatggatacccagtcctgactgaaaaagatccgcgagcacgatctt

SEQ ID NO: 50959 - DNA, 381 bp, Triticum aestivum
  Clone ID: PAT_TA_50959
gcgggcatgatactagttacataatggttcttgtataacagagcattgtcatgcaaaagtaatctcaacacatttttttatggctattccttctggaacacggggcaccagatggaggcacgaacacatgtggaaagcagaaaccaacacatgccgaagcggcgccagttgacacaccgtgtgggctagctgtacatatagagcctggtgtgatgatgctgacagataacttagtgaatgatgttgcagatgacgttggggtagattgggaaagagactgagacccctcacttgccagagatggtggccgagttgcccatgctgacgccatctgaacgatcccaccagggtattgaagcaacagaacgccgcctgacgtat

SEQ ID NO: 50960 - DNA, 392 bp, Triticum aestivum
  Clone ID: PAT_TA_50960
gctaaaaagaaaattcaattcccccaattcagttacacaaaaacaaaagcttagtacaacccgaacggccccacaatttttaacccacacacaagggggcaccggatcaaaggggccccccaacccaaatttaaaatttacagcctaaaacccttgacacaaaacggacattttgactaacagcacaaaacaggaaaaactgctactggaaaaactacccccaaaccctaagatctttacccaggagtctactttttggcctttttgggggggggggcctttttgggtggcgctgcctttttggggggcgcggcctttttaaccgggggggatcttttggggggccccttcctggggggaggctttttgggccccccgggggggggcgcctt

SEQ ID NO: 50961 - DNA, 536 bp, Triticum aestivum
  Clone ID: PAT_TA_50961
atcatggcgcatgacgattggcaaggagtacatatatgcatcgatcggtttaatgtcataggctcacaaccatcttggtcttctatacattgtgcagcttcattcgtgccaatctggtacaattgcaagtagatatctacagaaaatcatactacaacacagaagcagctagcagtttgttgcagacttgacaattccatttgctcacttaattaccaagcatgaatggcaaactctgcatctcgttgctcctccctgttaatgaagtgccactataattatcctcttcatgaatctggaagtgtgatcagccgagtttttgagtcgtataccatcactgttttgcaatttgcgcacttcacattgtttgttgctccaccactctcgatcgacagtatcgtcccgtagaaggaaagattttcagtgccgcaattcggacacggccccttcaggattaagacatcatttattatggccttggttaccacttgcgccgttaccaatatcagaggcaaagcggcaaaatacgtgaatat

SEQ ID NO: 50962 - DNA, 429 bp, Triticum aestivum
  unsure (1)..(429): unsure at all n locations
  Clone ID: PAT_TA_50962
gcttaatggataaaaacctacatgccccatatacaaattctaactatatatacagacatacaattctctggcagagccaaagtaccttcatgtgcatgaaaaagtctgaagatgaccactaaaaacctcttggttcatggcaagagctggacataaccagttaagacagcgatagctaaaattgcgataggcggcacgaggacgaatgcaccgacagtcgcgaattcacattcaccctcccgttgggcaagaggctcagggaaggcctcaagaccctcaacaccctcactgtctcaagnaggaggaacatcaagaggcaggccatgctcaccaaggatagcgggaggaacgactcagagaacaccgggaatggaggcgcaaacctgcaggaacaggataccgcgagcacgaactttttcaataaaacca

SEQ ID NO: 50963 - DNA, 285 bp, Triticum aestivum
  Clone ID: PAT_TA_50963
gggaggagcatcaacaaggggttcattttattcgtcgcccccaaaaaaaagctgaaaaacgttgttcgggggggaaacaaaaaacaactcctaccaaaaaccaagggcacaaacagacagacaacaaacgccgcatgaaggggcggatggaaggaccaaccccccccgccgggagcgttaagctgggaaaaaacccggcaacccgcgagcccgggcaaaccaaaacccgtttcgcccccggggtccatcaagagcaaacccggggacgacggcacccaacccggg

SEQ ID NO: 50964 - DNA, 451 bp, Triticum aestivum
  Clone ID: PAT_TA_50964
gtgcaaaaatccaacttaaaacaatattatcaaattcagcctgttctaccaattaacggcacagggctggaagcacacagacacggtctgccagctaaagactgctcgacggtttatgtgcctacattcaaaaaagaattactgcgacaagggccatattattattgctcacctgctctgacaacaaataaatagaccgactagcatagttcgggagcagcccttctcagttctttacggaggggacatgcctcagaagcatctgaatgacatctggggagatgcttgcaggctgccggttgacctgttcgattttcagcgatgactcttccttgagacgcttgacgtttgcaccagagtcaccactgctttttgcgacctttctctggaacttagccttcatttgggcacggtattcggctattcccctctatgcgaacccgtgggatgt

SEQ ID NO: 50965 - DNA, 471 bp, Triticum aestivum
  Clone ID: PAT_TA_50965
aaccaacaataaatccccttagggaaaaaacgaactatctgagacgctacaaaaaaccacacggatgctaatctaatacacacagtggctacacaggcttctggccacaaaatgggcaacatttgactgagagacaaggaattaatcactggctgaagcgcgaaggcaggacaagagtactataatcctttggtgcaatccatttctagcaaagtgtgcttggggcaattaaactgcagatgagaccgaagactgtcatgcttggcctccagatgggtttcctcataatccaagtcttgtgatggcgaccagccttggcaagcatactactgtatctttttctttttaacatgattccaagaagcctactgagcctgcttacactctggccaagcctgttgatcctaggttttgtgcaaacaagaatgggagcaacatgagaatggatgaccacaaagtacctgacttaac

SEQ ID NO: 50966 - DNA, 516 bp, Triticum aestivum
  Clone ID: PAT_TA_50966
catgttccactctgaagcctaatcacaagggaggaaaaattctacacaatgcacaacaacacgcaggccgacaacttcagcccgctgaccgctcatcgacgaacaacttacaagctggaattggacggctgaggcctatcctgttcctagtatgaaatggtttgagaaatctagacaggttcctatgtacgtacgtcgaaacgaaagaatggctgatgaaatcttcatcttctcaaccaaaaccgccagaatgctggcgctgctaaggctccgctgcaattcacacggtttcctctttacaagtgtccgaggacattcttctccggtcaaagtatttggacttgtctccgagtgtatgatcagggtgtggttggcgaactttgcggagcggcgaagtagtcgtcttcgacgttcctcagaagattgtcgctgcctacgctgatataccaagagattcctctatccagaggccaggtggatgctggagaactggcagcttctttttgctttgctgcg

SEQ ID NO: 50967 - DNA, 387 bp, Triticum aestivum
  Clone ID: PAT_TA_50967
acgcattgaatatgcacagagttattgtatccacatgctggatctttttacaccaacacggttcaatggttgttgctcttaacaaaatacatccctaccggttcttttcatttcttatcggataaacatcagacgcccatacaggccgcggctggttacaattttaataggcgtcgctatcttagcagtttgcatttgctacactgcttgaacaacacgatcacattgaggctgcttactgaagaactgcctgctccacctcaaaaaaccactcctggatgatggaaaacttacatgccataaactcgaaaatacatttgttccacagactaatccatcttgacattagaatatagaagtgtgtccctgcatagcggcatgttcatg

SEQ ID NO: 50968 - DNA, 557 bp, Triticum aestivum
  Clone ID: PAT_TA_50968
catatgaaactctcacaaaactagcttcttgccagccaggtcatctcacagtttcccagcatatgcatttgcgtttggtacaaattgacaaacattgcatacactgaaaaccaaccgagaccgtacaccaagaaactgttatgcatctacatatgacacacaagcatggcagtgcagacttttactcattgacaggctggcctactgagcctaattctgtaacgtggccacaactgagcatcaccaagagcttgcactctcttctcaagcttaggggttggtggcgccgccgagctcgccgatctgatggccgttcttcgagtataaataacgcgagggctcgcaccgatgccccatgttgagctgaatatccattttgtcattaacatcaattgttaagaacatacacttgcggccacatcttggacatctcaacataaacaagtctcttgacacggtatctgcccacaccactaagcgcttaatactgccacaactattttgccatgcttactcgctcgttgaatcttgtggtcccacccctatttggttgttat

SEQ ID NO: 50969 - DNA, 446 bp, Triticum aestivum
  Clone ID: PAT_TA_50969
ctcatattgaaggacacacactagttatatttgaggttcgttccattcgatcgtgcacagcccagacgacaacaaggggaccctgctgtgctacagaggtgcacgaaccctacacagggggatcctcctaacttgtgggtggaggcgagctagcttactaatcccaggagggtgctaccctgcgctcggaggagataaaatacgtacattggggggagagtctttcggtggagcgtcctcccgtccgtgaccaatgagagattaaaattttactggaaaaccttgcacacaccgcgggatttcttggaaataaaaaccaaaatgcggtatatgccttccatcctgcacaaactatggttgatcacctggcagatgcacctcatgttgtgaggcattatcttacaccagctgttggtggcgccttagcagcccctcttaattgcctt

SEQ ID NO: 50970 - DNA, 430 bp, Triticum aestivum
  Clone ID: PAT_TA_50970
atcctgttctcaagcacacgaagctagatcgctttgtatgccatgacacgaacattcgaggcagcggggaacagaacagcaactgtgtaggggaaccgagaacgactcatgtccctttggtgctttcctcaccaggggctggatcatatctagctaggatattacggaggcgcttacggtccttcgtttcatcggggccgacagaaacagtccagcggatgattggttccacccgacacttacagacacgagcctgcaggcagaccaactttacctattcctagtcggatgagacctcggcgaatcatggacatagcactgccttgagctaaaagggcacccggtcacagttgaacacatgttcgacggcgaaaacctaaatggcgcagcctgggtgcctaccgaggaagctaactaacatgtaattgca

SEQ ID NO: 50971 - DNA, 479 bp, Triticum aestivum
  unsure (1)..(479): unsure at all n locations
  Clone ID: PAT_TA_50971
tttttgtacaaacacagatcatatggtaacagagaaatatgctctggtcgagaaagcagtagtcgtggnacaagaagtgcaagttcaccaaatgtaccatgcattacatacggtccattcggtttcaatcttggtagtcttaaggcactatgcacggnacttacctcgcgaacgctggtagggccttgaagggcgatgatagcctgactgcacttgcacactggtcgcagtgttgtgcgaagtccgatgacacgcgacatagtgcatcaggngtacttcctttctttgacctcgctccaccttcgttcgagcactctgctgtggctgtcgagtgctaccctgaacataaggcgagcttccacatttgtccagtattcgaccgtcgtagtacccggcgagagctagttgtcgctcacgcgaagacataagccataccttgctgtaactcgtaggcagggacacccactttggagcggatc

SEQ ID NO: 50972 - DNA, 509 bp, Triticum aestivum
  Clone ID: PAT_TA_50972
ggcgcctctccaatccaatccaatccaatccaatccgtgccctagccgcaagggaaggaaggccgcgacgccgccgcctctctctccgcggggccgcggcgcggaggcaactcccgagccctgacgcctcctcctccgatgcaagaaagaacataggttctcggacaagcaagaccaagcagtggacatggaaccgtcttcacaacctcagcctgcaacgggtgatgttgttgctggtggatcacaagtgtatcctgcctcagcctatccgcctgcagcaacaatagccgtagctcctggtatcattcctgccgcttcacagccagcatcaccattccctgccaatccagcgcagctcactgctcaaaaccagcttatctacgagcaagcgcagcaattccaccagcagctccagcagcaacagcagaggcagctgcagcagttctgggccgagcgactgtcggagattgatcaggccaccgacttcaagaaccacaccttgccgctcg

SEQ ID NO: 50973 - DNA, 597 bp, Triticum aestivum
  unsure (1)..(597): unsure at all n locations
  Clone ID: PAT_TA_50973
nactcgtactcgcacctagggtttcgtctcgtcgctctcgtcctccgcgaagagccgaagaacaagggtaagggaggcaagaaccggaagcgaggaaagacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggacatcgtcctcgtcggcctccgcgactaccaggacgacaaggccgacgttatcctcaagtacatgaacgacgaggcgcgcctgctcaaggcctacggggagcttcctgacacgctcaggctcaacgagggcgtcgacgtcgatgggcccgaggaaggcgaggagggcagcgactacatccagttcgaggacgaggacatcgacaagatctaagaaatctgttcctgcttacggctacctgtattgttacgtgacgtgttcttctgcttctgcttgcggctacctttattgttacgtgacgtgtactggtatgttgtggtatggt

SEQ ID NO: 50974 - DNA, 580 bp, Triticum aestivum
  unsure (1)..(580): unsure at all n locations
  Clone ID: PAT_TA_50974
gttctagnaccgagcggccgcccgcgatctagnaactagactagttctagatcgcgagcgccgcccttttttttttttttttttttttcgcttgctaaaaaaatctcattggatgcatgtagtgttgaaaactttttcgaggattaggattagcaatgtgtccgtcagttatcctggtgctgcggacaagtcctcccgcccggaatgggaacaaccacacatgtatggccgtataaaccaggcaatcaaagcccccatggaaacagacagcaaaagggcacgcacattcctcgatcacccattcgcaaaatccattaatctggaggtgcacaaactggtccgtcaagccccaccaacgacctgttcgtcgcccgtgcttgaggggctcgagcatgagctggttatgcccatgccacgcaccttcctgggtcacctcttggcacagctcacaacccgtgtcgccatggatccagcagagagtagtgactccacgtacgtccctgactcgagctggggcaaattgtgctcagattatattttgggacagagggagtactatcttgctcatcaaatctttcgc

SEQ ID NO: 50975 - DNA, 511 bp, Triticum aestivum
  unsure (1)..(511): unsure at all n locations
  Clone ID: PAT_TA_50975
acagttcagttctttcacaaccgcaactccgcaagtccagtactactagacatacgcggcgatcacaagccagtctccactctccagcaaggcatcagngaccaagnaanaagagaagagatggctggtccggcgaaggcgtcgtggatggtggccatgagcgtgggggcggtggaggcgctcaaggaccaggccggactctgccgctggaactacgcgctcaagtccatccaccgagctgccaaggccaaggccaacgtccgcgccggcggctcgcagagcacgaagcagcttccggcttccacggcggccctggtggagaggcggcgagcggagaaggcggaggaggcgctgaggacggtcatgtacctcagctgctggggacccaattagtattagcgcttagtagaatgtagtcatggcctcagatcagatttggccggttgccctgatcggttgtaaagacaccacgatgatgatgatgatgaaaatttcggctaggagtttatat

SEQ ID NO: 50976 - DNA, 614 bp, Triticum aestivum
  Clone ID: PAT_TA_50976
cctaacccttcatcgacggcgccatcacccgcggcttctccccttcatcgacggcgccatcgcccgcggcctctccccttcatcgacggcgccatcgcccgcggcctctccccttcatcgacggtgccatctcgtccgagtacgagctggaggagcacgtgtacgtcggggacgcagcaaggccagcacgccatcggtcccgtcttccctggttcctagccgagcgccacgaagaggaagagagaatggtgaaggagaaggggaatgagaagggaaagggtgctggtaaggagaatgggaagccgaagggtgctggtaaggagaatgggaaggcaaaggcaaaggaaaagagcttgaattacctaattaggcaagattcggcgctgcctcctctagttccgaggaagaagagcaaacctaaggtgcagattaagaaggcgaaagactttcccaatgccccaatgggagagttaatttatgactacaggagttcgttaaaaccggttatggtggaggcattagtttgtggtgcaagttatatcaagggtgctcacgttgacttgaatctggtgccgagggatgagaatgaagaggatgatgttgaaaccaccaaa

SEQ ID NO: 50977 - DNA, 597 bp, Triticum aestivum
  unsure (1)..(597): unsure at all n locations
  Clone ID: PAT_TA_50977
acgggttctacgttngagaggaggagggggaggaggttgggacggaggagctgcgagagctggaggaggcgctatcggatgcctcctcgatcggggcggcctcctcggacagctcctcgatcggggaagactccnacgtcggagaaggaggagggagaggaggaggaggtggagagcgaggccaaggcgcccgtggatgaagtgctcgctatggggctcgggaccctcgagtccctcgaggacgcgctgcccagcaagaggggcctctcgaacttctacgccggcaagtccaaatccttcacgagcctggccgaggctgcagccaaggcggcggccaaggagatcgccaagccggagaaccccttcaacaagcgccgccgcgtgctggcggcatggtcgcggcggagggcctcctgcagctcgctggtcaccacgtacctgccgccactcctctccctcgaccacactgtggtggagggggacgaggaggaggaggaagaacgctcggacgacggcgatgacgaggataacggcagcggcaatggcaggagggagaaggccccggcgtcgcccaggttccctccgcgcagcctgcac

SEQ ID NO: 50978 - DNA, 565 bp, Triticum aestivum
  Clone ID: PAT_TA_50978
ggtctctaatcataacccttttctaacgacaccacggcaggaaacaaaactccatcaagtaactagtaaatctctcccatatcgacagacaaaagaaaccatcatataatctactattgcgaaacctgaaaattagtttggatgtcctggctaaactgagggtactgaatctggtggttgctcgcaatgctgtcaaccgctttcagattgctgctgctccccaggatgcccctggtgctgttgctgctcctgaggatcttgccacacatacggcagatggccctgctggccaccgtaccccatcaccgcacctggcacctgctgcggatagtagtacgggtacgacgcgtcagccggagcccccaagagcggcggctgcccggccctgggaagcccaactccctcctccctcatctcatccctggggattatgtccaccaggaagtcgtagacgtcggtcctggtgatggcggcggcgatgtcattcttctgcaaggtccgccgcttgttctcctcggtgtgcatccacgacctcagcgtcagctccagaatgaatatctcgcac

SEQ ID NO: 50979 - DNA, 190 bp, Triticum aestivum
  Clone ID: PAT_TA_50979
ccagggcccacttattctttaaagtccacccaaatctgctgcacaacagcagcaagttcaaacccacccagacataaccctagaccacagcccggtgccaccaaaaaacaacccaaacgaggcccccctgccaatcccatcgaaggacacaaaaaaacaactgacttgggaccccaaaaacaaaagcagc

SEQ ID NO: 50980 - DNA, 405 bp, Triticum aestivum
  Clone ID: PAT_TA_50980
gggtccagttccctttaaaaaaaaagatccagtttcggggccaaataaataaccaaatttaacccgggccaaggccgggtcatcaagacataaaaccccccctctccgcccaaaaaagggtttggggttttttgcaaaaaagaaaaaaaatctcatccgtttacccccctggaaaaataaacccggttccttccttcctccccccccgccggggggggcccccggggggtcgaacgcccccgaccccctgggcagccgccaggggggcccccctgggcagttggacccccgaaacccaccgggactgccccaccaccggcgcccaggggagcgaccagggcataaaccggccggggcagggcccccatccaccggggccggtgccacagaggggaccaccgccgc

SEQ ID NO: 50981 - DNA, 444 bp, Triticum aestivum
  Clone ID: PAT_TA_50981
aggcccccccccaaaaaaaaggggggcggggtaaaatccaggaaaaaaaggaccccaaagcaagagcccaaggggggggaaccccccctatatatcatcaaaaaccaacaaggtaacaaacaggtaaaaacaggatctacgaggcccggcctaaattccccacaagaaaaactaaagccttcggaagggggcccacaaaaaaaaaccccccttaaaaattttaaaaaaaataaaaaacttggaaaaatggggtgggctgggcttttttcccccgggcaaaaaattcccccctttttccaaaaaaccaaaaaattgggaccaacggggtggggtaaccccttttccggggggcaaaaacctcccccccttccccaaaaaaataaaaaactgggacaaatggggtgggaaaaacccccttccggggaacaaaaacttccccccctt

SEQ ID NO: 50982 - DNA, 551 bp, Triticum aestivum
  unsure (1)..(551): unsure at all n locations
  Clone ID: PAT_TA_50982
tttttttttttttttttttttttttttttttttttttttttttttttttttttttttttggccaaaaaaagaccctcggttatcaaccgggtcaaaacggccccgggggggccggttccacaacccccagggacttcgggggagatctttacaattaaaaaaaggggccccccacccaaaaagaggcgggcccgggcccaggccccacccattgggcccgaaacccaaataaaaaggggggccccgagtttggccccgtttgaacctttttttgggtcccggcataaaactcgggggaattcgcccaccggctcaaggtcccccgccaaacccgggtccccccgtgccggttgggggggtggcccgggtttttttgcacctttccctcacccgggttccgggggaggggaaaattcgaaggggttcctggggcccggccacggggttcctttttggggtggcccaanataaaaacgccttgggccggggggcctcgcggtggaagttttttggtgcccctttcccttgggggggggggggcctttcattgg

SEQ ID NO: 50983 - DNA, 533 bp, Triticum aestivum
  Clone ID: PAT_TA_50983
tttttttttttttttttttttttttttttttttttttttttttttttttttttttttttttttttttttttaaagggtacccaacatagccaacagaggagaaccggtcggacctggggctgccgccgaggcgcgggggccgtgccttacgattgcccaacaacaactaggattgcaaaagccaacttgatgaagggataatgcaacaaatacccaccatgaccagggagcccaaatttgattggggaccttatgttctgccgcccgtaggggggcccttcctaaatcttggggagcttttccgccttcaccaccgggttggccttggggagggcccccatggccctggggcggtagtcaaacttgccctcatgcttgtcccagaaacggggcgccccgcagaagaggttcccccaccggctgttggaatccggccagcccaaccctttttttaaaggggctgccccggcttgggcctttgggggtctccctcgcccccttggtgggaccggcgatttaaccaagctgggggg

SEQ ID NO: 50984 - DNA, 389 bp, Triticum aestivum
  Clone ID: PAT_TA_50984
gggggagcaaagcgccaacaaaaacatcgcaccggggggggcccactgggggggtcttaagacacgtaatggctggtctggggggcccccgaccctgaaaacccaaatcttatctttttcctgggcgcagaatctgggccccaaacctttccaagctaaaaacgcggattacatggaatcgaaatggtccagataagtctttgtctgcgggcatttccgcagacaacaggtcccagattgaaaaaggccgccccggtccgttccccccaaccaattctcgggttaaccaccttgaaattccctcatggtgatgggaaggctccactcgggcccatgctcccgcggtggggggcccctttgtcccggccgcatgttttggacggtgttgc

SEQ ID NO: 50985 - DNA, 552 bp, Triticum aestivum
  Clone ID: PAT_TA_50985
gagagaatcgtatgccactcagctatttagatcaccagttctaaattacacaattttcatgaaagtttttggagctgatggcgatgacagagcatacagaactacagcaatacagcttgagcacagaaaaaatctccaacgaactacttgcaatcatttttggtgtcgccggttagttgaatagagcacccatcagtttgcccgacgaaatactccctggcaaagctgctaatcacacgatatgatcattatgttgcactttctccttgcacaaaaccctgttcactcgagtttccttccaaaactccattatcatccagtgttgatatttcaatttcggtttcatctttaacagcctctttttcgacactgccagtgacacgcttcaatcgggcggcagctttgtcaatcgcaaggttcagttggctaatcttgtcacccagtgtctgacgagttttctctaaaccttcatcatagtattgagcattacgtggccttggtacactttggacgccttgctcgtcaggcttaccatcttgcccgtcgtcattc

SEQ ID NO: 50986 - DNA, 408 bp, Triticum aestivum
  Clone ID: PAT_TA_50986
aagattaattttttttaagatgtataaattataaaagagaagaatgggggggaaagggttttttgattgcctgcctagggaaaaaaaaaaaaaaacttttgaaaaaagccaaccccggggggaccaaaaacaaaaaaaaccaaaccgggggggggaaaaaagttttttagccacaaagacccccctaaacaaaaaaaaaattttccaatgggtaaaaaaaaaaaaaaataaaggcaaaaaaacggacacccccacagagaggatgttttatttaaaaaaaaagataaccaacaaaaaaaatgaccaggaccttgagggggaaaaaaatcatggggggaaaagcccggccgaacgaagggggggcccaaagggtcgggacgacaattgggcggagagaccttataaccg

SEQ ID NO: 50987 - DNA, 154 bp, Triticum aestivum
  Clone ID: PAT_TA_50987
cattcatagccaacggggcacggtaacaggtaacacggcaacggtagtcggcgttacattttaacggtagccagacatatttggaacctacgcgtaggagcgaggatctaggctctcgtgaggctttcgatttacacttttggttgataggtta

SEQ ID NO: 50988 - DNA, 448 bp, Triticum aestivum
  Clone ID: PAT_TA_50988
ggggcccggggggacccaaacagactaacatttttgggaaaaactgggtaaatcgcccacaacaacccaaggggttcccaaaggggttcagggggggaagggacccctccaacagttttaaaagaaaaacccccccaaataatttccggattatttccaacccaaaaccaaaaaaatattttggaaggttttgacgggtggaaaaaaaaaaaaaaaaccccggtgcacccatttgttaggacaaaaagcttaccaactagtcattggggaaaaaaggacccctttaaaacgcaactttggtttgtttgcttgggggggggttgatttgctcaaaaaaggaaaaaaaccttttttaaaacaccttttaaaatattccaccagtttgggcagttttaaaaaaaaaatcccccaatcctttgggtttaaaagggttgaccaaaactttggg

SEQ ID NO: 50989 - DNA, 602 bp, Triticum aestivum
  unsure (1)..(602): unsure at all n locations
  Clone ID: PAT_TA_50989
gncgggttcagggcatgccttgccgggggaggagggcgaccttgacggacgccatgttagatcctctctcacccatctactctgtccggttcagttttagcctttatgagcctcgttatactttttatttgctgcttgcatttagaaaatggaatggaattagctcactgctattattacctaaaaaaattcttactgctgatgtgcattttgattagcagcaattctgttttggacacaaatcagtcaaatttcgtttgttgattccagtccatggatttcgagttgctcgactagtcacgactagtcatcgactagtcgatgagtcacactggcagggtcgactcagcctggcgactcgactcatgggatgtgtcaaacaactcaaacgaccagtcttgactagtcacgactagtcgcgttttctgggtcgaacgactcaatttttttggggcccacctgcatatgttaatttcttttttactttatttgcttacccatccccctggaaatctagaccgaagcagttccccgtgccccctgacccaaccctctccttggcagccccagctgcccatggttgctggcttgctgctcctcca

SEQ ID NO: 50990 - DNA, 498 bp, Triticum aestivum
  Clone ID: PAT_TA_50990
gaacaggcttttacctgctctgacgccactgcacttgcattgcttctgcaagtcgtcaaaagtcggtaactacctttacctattttcttccctgttttcttgtttctcatccatcattgttcataatcttacacgcttattactccaatttcgttcacataaatacttcaaacatgttcattgctcagacacagggaggaggccggcaagctaaggggagtactatctttctcgttgcgctttcactccagcgccctcttcctccaacaagctcgttgacacatgcctctttggaggagtccccatggcgacatctttggaggagcccccatgtgtatggctgtatgctatatgaaatatttggaaggagcgcaattgtcagagttttccgacgggcctccttcgacacttgaagatgtaactttgaagaatgcataagtcggtgactgctagcagaacactcatcaatacagagatttttcgttcggtttttctggt

SEQ ID NO: 50991 - DNA, 627 bp, Triticum aestivum
  unsure (1)..(627): unsure at all n locations
  Clone ID: PAT_TA_50991
cccggngtcgacccacgccgtccgtcgnacccacgccgtccggtngaacaanagtgaagtcacaatctcgcttgaagagaacgagtctgttgttctcacccctcaccagggccaggaggcctcttccaagttgctccctatcaacttcgctggactcgccaaggctgtgaagcccggagccacaatattcgttgggcaatatttgttcacgggcagtgagactacatcagtttggctggaggtttctgaagttcaaggggatgacgtggtttgcgtgatcaagaactcagctaccctggctgggtcactcttcacattgcactgctcccagatccatatcgacatgcccacgctgtctgatgaggataaagatgttatgaaaaaatggggtgctccaaacaagattgacttcctctctctttcttatacaaggcatgcagaagatgtgctgagactctccgtgggttgtatccagtcgagactatttcaacagtgggcagaatttgtgctgaggctgagaaggtcttcaaccaagatttgtatttcaagcgaaccgtgaaatatgtgggagaacccatgacccacttggagtctattgcttcctctgcagtgcgggctgctattaaa

SEQ ID NO: 50992 - DNA, 532 bp, Triticum aestivum
  Clone ID: PAT_TA_50992
gttataaggaatggacctatcaggtgtacagctgtgcatgcctatgcatgtgatggtggggtgccggcgatacatctaagagaacccaccaacaagtatgtcgaggacttgacgcacaaaaacactatctttgaaggaaaagaattctgtcacaaaggcagattttgacttaggcgtacgttctaagaagcctttcatattatgtgccactgccgctgcataaaatggcctatcatacgtatatactagcgctggattttatgatcagaatcatatggagaatacaaaattgtaattacatcgaatattttgagctcgcacaagataccccccattgttgaacgaatagccgggcactgcatcataaagcggatgtccgacaagtacattgaacacgaacatgacacatgaactgtggatacattgaagagagctgctgtagttatcacagaagactgcaaattcacagcttagacggatattttgaaatgtattccgatcttacacatttcttcttaatgcgctcattaat

SEQ ID NO: 50993 - DNA, 602 bp, Triticum aestivum
  unsure (1)..(602): unsure at all n locations
  Clone ID: PAT_TA_50993
gtgagngtataggacggngggacggcggctctcggcgaccgaggggcgacgacgtcggcggcgcctcaaatctgggaccgaaggggagatgacgtcgaccggatccaggatagatttcccttcccctgggactaatggatcccttggcagatgttgcaggcacctctggtgagaatgaggggagtaagaaggttaagaagaagaataagaagaaaggcaatctatgtggctttaagacaaggtttaactcaaaaaggttgggtgaacttgggaagcaaatatcaccagagaaacagagaatcataagggagggaccgtttgaagacttgttggacatccggtctttcaaggtgccccatgagctcattgagtttgttgtgatgaacacgaatcacatgctctctgagttcaaacacaagaacaaataaatcaacttcagcaagctcatggtgaaaaggaacttcaacgtgacatccggtgatagacttgtgaagcttcttaacaagagtgatgaacatgatctttgcaccatctacaaggaggggaacagggctccaatcacccatgttgtcaagttgctcattacctacagcgacgaggac

SEQ ID NO: 50994 - DNA, 597 bp, Triticum aestivum
  Clone ID: PAT_TA_50994
taacagctatagccgtagttgccgtgactggaaaaatagctgccttgtgtctgatatcacaaatggggccctggaatccatcggaacgttctgcaaaaatctccatgactttcgccttgtcctgcttgacagacaagagacgataacagatttgccgctggacaatggtgcccgcgcgctgctgaggggctgcaccaagcttcggaggttcgctctatacctgagaccaggggggctttcagatgtaggcctcggctacattggacagcacagtggaaccatccagtacatgcttctgggtaacgttgggcaaacggatggtggattgatcagtttcgcagccgggtgccggaacctgcggaagcttgaactgaggagctgttgcttcagcgagcgggctctggcgctcgccatacggcaaatgccttccctgaggtatgtgtgggtgcagggctacagggcctctcagaccggccgtgacctcatgctcatggcgcggcccttctggaacatcgagtttacgcctcccagcacggagaccgcgggccggctgatggaagatggggagccctgcgttgataggcaagctcaggtgct

SEQ ID NO: 50995 - DNA, 295 bp, Triticum aestivum
  Clone ID: PAT_TA_50995
ctttcccttgtctcccttcacgcttggcctccatctcaccagctcccaaacctcgcgtgcaccactccatgtccggatcagcagcagcaggcggagaagaccacggcgccggtcagctctacggcaaccatcggcatgccgccgacggcggcgacgtactggggaacaacgtcttcttccagagtcattcggcgtgtgccggtggggacgatggtggtgtcatcccgtcgacctactccagcatcaccgactacctgcaggggctcctcgaccccgcggagctcgccaggcacct

SEQ ID NO: 50996 - DNA, 596 bp, Triticum aestivum
  unsure (1)..(596): unsure at all n locations
  Clone ID: PAT_TA_50996
cgccgtagnagnagtaccttggcgtccgacagcaggcgttgaggacgtgggtgtccgaaatcatggatcaggagacccacaanaagcattgtgtgggcccttttcacaccgtcgtgctcgccgcaaaggagtacaatcggtggcagctccggctgcacagcgccgctgcctttcctgaactttgcgtttgtggagggtcctttgcagcctccaccgccgcggggggtggtgacaggagctatgggtacggaggaccgggaggagagtgagcgcattgcgtcggaggccgccgacaaggagtacatggcggacctccaccgcaggtaccatgagctggtggtgctggagcgcaagctcttcgtggaggcgaagcgcggggtcgacggcgaggcatcatcctctcggacgacgaggaggacggcgatgcagaggacgacgaggacttcaacttaaagagttgcggcgaatcttccccgactgcggcgacgacgacacagggccagacctggtgggcggtgggatttccccggcggattggctcgccctctacaagattgacgatgtttagttttagctggagttcatatttgggttta

SEQ ID NO: 50997 - DNA, 368 bp, Triticum aestivum
  unsure (1)..(368): unsure at all n locations
  Clone ID: PAT_TA_50997
aanataatgaggagacgaggatgagcaaggtactgtgtttgaggaggaggaagattctcattttgatgtcaaagcaccaagtgttatgctatgcaaaattgcattgtttggctatcaacgttcaatatttttgttgtataaagttcaaaggaggagctgtccaaaattcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttaaaaaaaaaaaaaaaaaaataaa

SEQ ID NO: 50998 - DNA, 563 bp, Triticum aestivum
  Clone ID: PAT_TA_50998
aaacatactaaagttcatcatcatcatctaaacatagtcaagttcatcatctaaagatcatcaccggcgaaagttcatgaacataaaagtagtgcaagacatggaacatcgtaaaagtaggaacatgaaaggtatgtcacgatggccacaggcacgggtatcattatcgacatcatgcaagaccaccaccgccaagaccaccacctccgctaaaaccagcaccaccaagaccacctccgtcaaaaccacctccgccaaaactaccactctgccagatcggagtgactggggtcgaggaagcaggagtcgagccaccggtccccggactatcactgcctagtgccacccattcatcgaacatgggaatgtgtgggggttctcccgcaggtggtggtggtggtcccatttgtggtggatccgtgcgattactccaagacgccaacatagcctgtatgttagttaaacaagcaaactaaaaggtcggaaggaataaaagtgcaaaaatttggctatgttttaagagggcaaaactaaccgccatcatttgacggttgtaatcatcg

SEQ ID NO: 50999 - DNA, 402 bp, Triticum aestivum
  Clone ID: PAT_TA_50999
gggggcccttaaaattggtggagatttacaccttaacaaaacaatttacgcttgggatgcgtggggtttttcctttcgggggccccgttaatgcccccggttaaaaaaaactggtttttttttggtcccccccaaaaaagcttttttgggcccctgtgggggggggggaaaaattttttaccgccccttggttacatgttgcttttcactctcttcccgcttttttgccaaaatgctttttttttattttttttttcctcggtaattttttttcctttttgtttttttcgttttttttttttttttttgttttttttgggcccccgttgccctcgcattccctttttttttttgttttttttttttttgttttcttctctctttcttcttgttttttttttt

SEQ ID NO: 51000 - DNA, 430 bp, Triticum aestivum
  Clone ID: PAT_TA_51000
accggaaaaaggcacacttggttcacccttttccataaaccaacagggaacaagcggtccacaggatataagggggcattgggggcccttcttggggggggggttttttttttgggggaaggctactccggggggggattacggggccgggggtagcccaaccttgggcggcggttcctccttggtggctccggcaaccctggccttggcatctccttcctttctgaacaggggggggggcatggcccccacgctgaattgctcagcaaggggctttcgttcttcaacgtcgaccttggggaaaacagcggctgggaactttttggggggatccgggaaaattggggccctaatgggggatgggccgccccctggtgcagggggggcattcaccaccagctttttggggggggggggcctcccttggtct

SEQ ID NO: 51001 - DNA, 309 bp, Triticum aestivum
  unsure (1)..(309): unsure at all n locations
  Clone ID: PAT_TA_51001
caattgatcccattccatagnaccagccgattcatcatatgtgatgcagctaagatagcaccctgaccatttcgagtggcatactagcttgcaaattgaggatcaacataganttaagtaaaaggaaagtgcactccttcaatggcccctggcngcntagatcagggggattgcggcccccttggtggtggtggcggcttacacccacaccctgttgcctcccttgttcttcttctgcgcttcngttcctgcgagctgcngctcctctgccttcctggtttgggcttcgttcttccccttcttttcctt

SEQ ID NO: 51002 - DNA, 521 bp, Triticum aestivum
  unsure (1)..(521): unsure at all n locations
  Clone ID: PAT_TA_51002
ttttttttaaaacagtatattgncccgatcatacaacaaggagaatatccacaaatataataaatatctaattatctttaaccaactgatacaaatggatgtaatgttcaccataatatgtagcgaaactgattaaaatagcgctctaataaatgattatccagattagtaagcaagtacatgtaaaccagcctcccagcgggtattccctgaggtaagatgtgttcggcagatttctccagaatcatagagctctcacgtctcttcaagctccaacgagaaagatgtgtccacctgcgtatagctgtaggcttcatttgggtaatacaaagacccacatacagctgttcaagctttgttctttcgtctgtagctccatgatcgattcgcgacggtagaattgttgtgccatgtagtcggatcggacgagaagtgcagacaaaaggagcacaccagcacacagggggggagaaccccgggctataaacaaaataacccccgtgcgatcttcccccgtagac

SEQ ID NO: 51003 - DNA, 373 bp, Triticum aestivum
  Clone ID: PAT_TA_51003
aaaaaaaaccggagggccgggtctcattttataaaaacgggccggaaagggaagggaaccaaaaacaataacgggggaaaaaaaaacggggagcccgggtgcctattgcccaatggccacacccacacacaaaccgggcccgttcgtgcccatgaaaacacccaatttctgcataggcagcggccggaagaaaagcaacacagaacaaaacattaacccccggccacaaacaaatgcccttcctaaaggatcatgcgcggcgtatacgccctaaaggaacggacactgaccccgattgtattcaatgggggaaccctcgcacaccccatgattgaaaaaaaaaaaaaaatgccaagggaccccccctttccgt

SEQ ID NO: 51004 - DNA, 412 bp, Triticum aestivum
  Clone ID: PAT_TA_51004
agccgcaccaagccgtttgatttcctcgccctgcacataaatctgttgctaactttattgtacgtcggatcacgcgcagcaaatcagagccttacgccctaccaagcgtgctctatcatggttttctcccgctcccgaatcgcaaatccgtgggcatgccggctatcaccttcttgaccgatggtctcgccagcagcgcctgccaccatgccttcacgtgcggattcacagggagcacagccgcatgctccgtccgtcgtgaggttgcgcatgatggagaaataggttgaggcccctgtcggtgctaaggtccccgcccatctccttgttcccggccagtcttgcctcatccacctccttccccttcttgggctgctctcccctgtcatccgcctaggccctggtcctccgt

SEQ ID NO: 51005 - DNA, 311 bp, Triticum aestivum
  unsure (1)..(311): unsure at all n locations
  Clone ID: PAT_TA_51005
natccctcnagnanncggcccgctcgcgnatctagnaacttagcgcaggnnacgccgccgagggagcatcgtcaattcgtcatcgcaggcgccggcgtggcaggcctcgccgtcgccctgggacttcacagggcaagggctccggtgcgcggtgctggagtcgtcgctggtgctccggacttccgggttcgctatcgtcgcatggccaacgcctttcgcgcgctggtgccctttgtgtaggcgacaccattaggcagtaacacctgccgtacaaggcggcgtggtgtcatgccctccccaaccgcggaagt

SEQ ID NO: 51006 - DNA, 552 bp, Triticum aestivum
  Clone ID: PAT_TA_51006
gaaaaactataaataatttgattccaacatccaaaacaaattcagaacaacaaaaatttgtacctgtcagtttgaaaaagaacgtgtgtgcccattggctagctccatgcatgcctcgctaattaaggccaaaccgaagctacagacatacagtactatgtacataaacagagtgaccgagttaacgatgaacatgctcataactcatcacggcatcgggaagaacaccggcatgcacctgcatgccaccgtactcggacgaccggtgtgccaccaccgaggcgtcggtactgggcagtgcgtacatgcgcccatagacgtcggtaccggccgggaaaaatccatgatgttgatgctggagcacgtcgagtgagtagacagtgtcgacaccagtggccattagcatgcgcgagccacggtgggtggcgatggggctcgggtgcgcgtggcgaccctcgtaagtggtgacgaccgtggacgggtcctgctgtgaccgctccaccagcttcttcaccccgcactgcgccgccgtgcaccggtagtagctccttg

SEQ ID NO: 51007 - DNA, 267 bp, Triticum aestivum
  Clone ID: PAT_TA_51007
acaaagcaaatcccacaattatcagtaaagttttcaggaacacttcaactatctgacagttacctgacaccaacatatggagagtcgttctgacaacgcatagtatatagagcgaaaattactggaagacagctatagattttatgcatacagtggcggttagcacttgtacctctttcagcccatgtgcaaagttacagggaaagttggatcatcagtttccctgcttgtggtaggcgaacaccacgccgtctgtctcatgcatgc

SEQ ID NO: 51008 - DNA, 292 bp, Triticum aestivum
  Clone ID: PAT_TA_51008
cttatatgccaagcacaacgcgttccgctggaaccttctgaaatatgggtaaacgcaactaccctgggttgcaacagcggttttgaccacccaatctgagcatacgggcgaacggtaaacacgcccttgcaacaccaggataaaaccctggtgcatcgtgggggaccagtattgtggtacacaccatgtcccaaacaacaccaacgctggtgaaagttcacccaccatgcattcgtaattgggggggttcccttgcttgtggggcccatctatcgttgcttgccgagccggc

SEQ ID NO: 51009 - DNA, 347 bp, Triticum aestivum
  unsure (1)..(347): unsure at all n locations
  Clone ID: PAT_TA_51009
tnnttggtttttttctgctnnncacaacaccccggagccacgggcagcnactncacagctcggccggctctggcccatctccagatcatgnaccaggcggagatctatccacagttaacaccatttatttgcgcgnttcttgcgctttagcgcantgtattatatgctagctttccgttgtcctcggtttccaatcaaatgccccgtttagcctcgggcctttacctgccttccctggtcccgacttgcccgcgtgtctctccctcttcctcttgttcccgngagctgtttatttttcaggccgccgttggcttgggcgccctcttcgcggtttcctcgcgtccttg

SEQ ID NO: 51010 - DNA, 556 bp, Triticum aestivum
  Clone ID: PAT_TA_51010
agggataattccacaggtatttaaacacatacaaaattaacaaactgaatacaatgcagaaagtttagcatcctgatcataaaagactacaaatgcttgtgatataaagtggtatgaggtagagagcatacagtccatcaatgacccactgccttttggtattgtcaaactggcaatcaactccgctccacggatgctgctgaggaatgcaggggtcaccattccagccaaatcgaagaggaagaccaagtgaacccttcaaagtccgcagagcagtcacttcttgagttaaggtcttcatttcagctggaatgatatcaaaaacctcaatcgcactaacaatggcatgtgtcccttcaacaggctgcaaggtgatttttagcgttgtcccactgacagcaacagttttattcagaacaagcgcagtaaaacgctctcctgtcatgcggattatatcaatatctttgaaagcagtgtcaccattgataagtacatcaaataccctttgctcttctgcagttattccattatcaatctctgcaaaatgaagccatac

SEQ ID NO: 51011 - DNA, 228 bp, Triticum aestivum
  Clone ID: PAT_TA_51011
tctcttttttttttttttaagcataatccatatatatactgacgagtggacgcgttacaacgtacaataaagactcggtatctgatcaaaggtagtgtacacgaaaacaaccataggggtagtacagtaattgccgtccatgcagagctagctcggcgtacgctctccattatccctcacgtggagatcatatcagagcagtaataaatctgtattaggagacctcaa

SEQ ID NO: 51012 - DNA, 340 bp, Triticum aestivum
  Clone ID: PAT_TA_51012
aacaaaataatttggctaccttaattttccgtgggttcagtgaagtaattcggagcatcatagacaaacaagcatgctttatcatgggattttcccgctcccgaatccaaaaaacccgggggagtgccctttttaacctttttaaccaatggctttgcaagaagggcctcccaccttgcctttcaatggggttccccttgggcccaaaccgatggttccgtggccttgagtatcggcatgaaggagaaaagggtgagggcggcgaagctgaccaaatcccccgccaaagacctggtggttggcaagtttgccctcttacacctccaacaggtttttgagc

SEQ ID NO: 51013 - DNA, 463 bp, Triticum aestivum
  Clone ID: PAT_TA_51013
gctaaaccaaaaaggggtatggggattcttctgtttaactatagtaaatttggtctcttgtgtgctctaaatcggtccgaactcaaaagcgttttcttgggaattgttaatatgttgagcggggccccccaaaaaaaggggagggttcaaaaaccgaaccgggggaaaaaaagggccggggggcaggaaaggggcgggccttacaagggggcggggaaaaaaaaaatggcccggaagaaaaaacgcccccgggggcaaacggggcccgggggggggggcctcccgaccggggacaccccccccttcctgttcggaaggggggagggggccaacggccaaaacacaattggggcaaaaaccccaaagggggggggctggggggaccccgcccaggggccgcgcccctggggccggtgggggggttcattccccggggggggggggggggggccccgggccgggg

SEQ ID NO: 51014 - DNA, 574 bp, Triticum aestivum
  unsure (1)..(574): unsure at all n locations
  Clone ID: PAT_TA_51014
caggaacccanagaaagctaagagctcgcggcagcagaagctctgtgtgctcctgcatccgctccagttgcagagtacacgtgccgccaccggtggcatacctgggcggtgctcgaatggccaggatctgcagctccagctgttgccgcccaagcctcctgtggtgctgcgaggactggagctccatctactgcgaccgatggatgggatgccgttacaccacctgcccctactggatgggaacaacgaagggcttcggcacctgcagcatgaccacctgctactcagaactgcgagtgaacgacttgacccaaggtttatatctactcgcctctctggagctaaggacttcgggcgcggtttattggggaatgctctgttattttccccgtcagtactctgttggtctactctaagtaagtaaatgaaactattacactactgagttatgttagatggaaatatatatttgacttcttggttttgcaggggttgggagttatcaccccagccttttgttactatctcataccaatagcttaatttgaagttccattttgccagcaagtgcatg

SEQ ID NO: 51015 - DNA, 422 bp, Triticum aestivum
  unsure (1)..(422): unsure at all n locations
  Clone ID: PAT_TA_51015
gctcgggtccatttacctgttgactgactaccggtattatctggacagtccaacaggctgccccggnccaggacaacaactcgttatggaccgggctgtacggggcgaaagatgcattgtggaaaggaacgagatcattctttgggcttgcctgacaccaacatttatagcctttctggtggttatgcgatgaccttggactttacgcaccaacgcgtgcaacccattatagctgtcactggggggaccacgccttccattggttagtatgtttcttgcagccatagacaaaatggatgcacattatgcatgacttatgaataactcgttgcaataattatgaatgaataaatacatgctggctcaatgtcgtgtgatcatgttcttatggttcagtggactagaccagctatgtttaattt

SEQ ID NO: 51016 - DNA, 560 bp, Triticum aestivum
  unsure (1)..(560): unsure at all n locations
  Clone ID: PAT_TA_51016
atccgcggnaactgtttggagaagcagtcctgtaatgcctacttatcacaatctacacgtggcatgaggtcactactacgaaagcagggtgtttgcttttctatgcccctttgcaaggccgaaatggagcaggctaccgaagacgacctgatcgaattctcaaaaatccgaacactcaacctgggccagacacttcatatagatgctttatctgaggtggacaacaccacgcagtcgctcctttcgtttactggcaataagagcgttcatggcttatatgatgtcttgttgaactacaagttctttctgaactcattatctgccgcagacgtcccggtgctatactcaccggtgccattccaaaatggttccctccatagtccggaggtgatatgcagggagatgaggaaagccgacagcggcctggccccgtccagcgttttcgacgacgcaggagaacctggatcagaggtgtctgatcctcctcttgcggcgggcagcatgtgctacagcatggagatcaaggacgcggctctcccgccgtgggtcgtctcaggcgt

SEQ ID NO: 51017 - DNA, 449 bp, Triticum aestivum
  Clone ID: PAT_TA_51017
accactcaacccgaacgacgtagtcggcttcttactactcctcgggccagcgcgcggtggcggtggcatgggggaggtcggtgacctgaccgagactagcgcaaacgctggggaggagcaagcttgcgcccctcccggcgccaccgtcgtgctcccgtccgaactggacgatggaccatgctggcaggaccactatctacaaataaggctgttgatttagcgaagttgctctttagaaaacttacttattcctgatggcttggactgtgtaaatatccaatcttgtaaatcaggtcgagaaaaatgcatagaaacctagagcaaacatggtgaggatctcatcttctggtagagtagtacggcatgttccatcatttgacgactcctatgaggtttccaatcaagatgacggatgagcaggagactggatacagattgattagttgatg

SEQ ID NO: 51018 - DNA, 454 bp, Triticum aestivum
  Clone ID: PAT_TA_51018
gcagcattcacttcgcttagggagtggaccgggcatttactctgttacaaggaaagcaagatgctagggagtagtgacttgcgagatgcaggggtctgtgggatatcacaatggcggacatcagaatgcttggcctgaacgtaagaaatggaaaggttactgctgatgggttccacatggcatgcaatggaggcaagggtgcttccttaaccgacatatgaccctgcttcctcaaccggcgaagaccctgcttcctcaaccgaagtcgaccctgcttcctcaaccgtcgtgtcccctgcttcctcaaccgccgtactaccatgcttgcccaaccgtacaccgccctggtgtgacttgagctcaggttggaagtgaacccaaagatgcactatatcaccgctagaagtgcctcagacacaactatcgcttcccctgctgtgactgtaactcatgc

SEQ ID NO: 51019 - DNA, 596 bp, Triticum aestivum
  unsure (1)..(596): unsure at all n locations
  Clone ID: PAT_TA_51019
gcaaattgcattattcacttcacatgaagttagtcacaatcaagacaaggaagctgtttgaatctgccatttatcttgaacctgaaattctcagagctgcattgccattgatgcaattttgctaccttgaaanatatctaaggcaataggcaaatgactctccacacagctagttggctcaagtatttgtggcaacaaatctgcattgtcactgtcaatctgcaccaaggttagacataactgaagaccagaacgtggacatgaagttaatgaaagaatgctgggaaagggaatggtacagattttctcgctttattgaaatgctagtttaccttggatcgtgcatataatttatttggtcatattgtagccctcacagtttcacattgcttcgatgatggacttggtattaatttttgacttaaaaagattgaagaaaaacatactttggttaacataagcaattattgaaggtacagaatgttgttgttggatgcttgatggaagttgttgagctagcgacctaggttgctaaaaaaaatcagtgtctcctaatcgaaatcccaagagttgagtgtaatgagttggtgttgctt

SEQ ID NO: 51020 - DNA, 595 bp, Triticum aestivum
  Clone ID: PAT_TA_51020
cccagcgtccggccacgccacatctgaattgtcgaatctgtcatcgatgatatattggaggaactgaggtttggtgcatagatgtctggcaacagcccatgccagagcactgtccactgtgatccacactttgcttgtccgcgcacatcgagaaacaaccagctcccacactgtgctcgttatagcctcccaggaatgcaagggtgttgcatccaactgctgttaatttattcgcctttgtggatatcttgaagaaatcagcagtatttgatgagacccatccatctgtgttgttgctgttgctgtagaagcacttggaggcaatcaatgtgctgactcgggtctgccctcctgccagactgatgttgtagatctccatttggctgctcgagttatgcatgaacacacgattgttctcgcatgaaacatcgaacccttcactgtagaagcaaccttgaccgatgccgaaggggtatgggatggtgaggttgccgcatgtttcttggcatctaggcttcgccatcctggatgctgtgctgctcttgatgcttgctagcagcagcagggtggctgcaaagattagccatgggtgtaa

SEQ ID NO: 51021 - DNA, 575 bp, Triticum aestivum
  Clone ID: PAT_TA_51021
agcactcactcgagcacggttattactcctggatcgtgcaattagtcagatggcgagcggcagcgggaaggcgacggcctcgtcctgggcggcggcgatgagcgtgggcgcgggcacggtggaggcgatcacggagcggcacgccgggctgtgccgctggaaccaccaggcgctcccgtgtgtcttccagcagcgcgccggcacctcggccgccgggaacggcgcctgcggcaagggcaaggcggcgaccactgccggtggagcaacggcgaggcaggagcaggaagaggagctccggactgtgatgtacctcagcaactggggacccaacaactaactagccgattagtcatcagttacagtgctctagatcttcaaagatggctagactggttcgtgctagctgcaccagttcgtgcgtgtaaggatgatgtgatctgagcacgcatattcactctcgagctcgtgtaagagtaagacacggtagcgtgcatagtactacttccatgatccggaaggatttcagaaagaaaagcataaatggacgtcccttccggcctcctccaggctcaact

SEQ ID NO: 51022 - DNA, 609 bp, Triticum aestivum
  unsure (1)..(609): unsure at all n locations
  Clone ID: PAT_TA_51022
tgnaatttcacaagnatgacattgttagatttagattcattaggtttcaacacatttgatggtaggccatttcaataattctatttgtttcaggcattggtagattgtgttacaactgaagagtttcttgtgctaatacttgcagatctcgacacaccctgaacaatgagcacatgttaccagccacattccacacaggatgtgttcttttcaaaacaaagataccctgatacatgattattcctctttcaagttcttgatccttgaagatacttgctaggtttctagctgattttttggtagtataaggctataagctcgatgtatatggcctgaatatgatctgattcagagtacattgtgttctgaagctttttactgtatggttctctcttgaaagaattcaagccattgttcaatgggagagaatagttgtaatcctcaaataactgtcgtacctattcatcagctgacacaattgccaccgagatcattattttccttttttttcaggttttcaacatcacgaatttcatacttatggagtggagctaccaaaatatctattgaggaaatatgtcgaagcacagaatatattccatatgcagt

SEQ ID NO: 51023 - DNA, 595 bp, Triticum aestivum
  Clone ID: PAT_TA_51023
cgctcctcctcggccaggtctaccgcctcatcacctcccaagagtgaccaaggccgttcagacgaggaagcaggagaggatgcgcggttgcgacgaggcgatcgagcaggagtggccgcggctgcactggcggcggcaaccgccgaggccgaggggcgacaacgcagccacagcagcagccaacggagaacagaggcagcccgccgagcaccaggaacggaagcggctggagaaggaccggcaccaccggagcatggccgccgcccgcggcagaggccggcactggcgaccggcgttgcagagcattacagagtcgtcgtccagcggacacgccgactgcgaggatatactactatccaaatgaactagaaaagtagaagaaggtttttggggagctagaaatgtaggtacattaggcgatctgaatgtatcaatcggcttctgtcccgtttgaatccgttttggtgatacagtagcatgcatcgcccgctcattttttttttttggggtgaagattacctcttcctgccgtccgctccggcaatccagctccggtgggagagagacgacaatggtgcgtcgatggctcgttctg

SEQ ID NO: 51024 - DNA, 517 bp, Triticum aestivum
  Clone ID: PAT_TA_51024
cccacgcgtccggaaacacacaagtagactgatagaccatgcaaagcctcttcatgtcctaagcttcaacccaaccgatgatgtctagctgcggaggaaactgcagttgcagcaccaactgcaagtacaccaaccgctgcggcggctgctacatgcacccagaggccaaggccgctcggcgccacccttctaaaatgcatcaccgacacccacaacgggagctgcggtatcatgaagatggcgggcgcataacggcacgtgtgcgagctgcactccattgcaagtgcaggaccagctgtgactactcatgatgcaggatggtagtatcgatcatagaccatatacatgcaccgctccatgcgtgcatcagtcgatcatatccaatctactactaccataccatgcaaccacaacctgaacgagggcctttatctatgcaactgacctgtataaacagtcacgtgccataccatgattgtaaacagtccccactaaataaaagttgccctcattaact

SEQ ID NO: 51025 - DNA, 572 bp, Triticum aestivum
  Clone ID: PAT_TA_51025
gtcgtcttatttcatgtaaaaaaaacaaactagctggccttatttgcgagtcactttctagtctctgcccatttgttatttgtacacaaatcccgaggagtcgatctgctattggaggatgtttcaatagactgttgacctcggatctttgattggcttgatgtctgatcacttttttatgcatccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcgccccttttaaaaaaccaaattttactacccggggcttgaaagttaaaattttttttatggggcccccaaattcaattcaccggcccggggttaaaaaacggggggtaatgggaaaaaacccggggttacccaaattaattggctttgaaaaaaatcccctttttacaagtgggggaataagaaaaaagcccccccccatagcccttcccaaaaattggccactcctaataggaaaagaacaccccccc

SEQ ID NO: 51026 - DNA, 574 bp, Triticum aestivum
  Clone ID: PAT_TA_51026
gaatagatatggaactagactatgaagtgggccgatgggcctcatcgccatggctggcatgacctcttacactccctggctgcagtgtcctactgctacccgcatgctcgggacccctgtagccacgcaaacggggactaccactcggcgcatgggaccccctccgctgatgccttgtgcctaaaaatgcagctctatatgactggcattggacactacaccattctctatccattacaagggatattgtcatcatgcacaaggtgcccatatctgacgacattaaatgggccacgacgcaaactggaatcaaatgggacgatgggcctggcgctatgtggactccgcactgaaatcctttgggaggaactgggtctggaaatctgttaccttgaggtacataaaccacggcctcatgtactacagctactacatgatcaaccatgttgctgggtgcctacaactgcacactgagaaaggacagtgacatcgcgccgtgatttcggcagccaaaccaagcatccccatgcggtgacctatctctaatgagaggccacccagcatacgcttgtgc

SEQ ID NO: 51027 - DNA, 367 bp, Triticum aestivum
  unsure (1)..(367): unsure at all n locations
  Clone ID: PAT_TA_51027
aattaaacataacttgtgttcaagttcctttgtaccatagttcttggtctcacgccttttggttcagctcggtagagggattcgtgaggatcgaaccttcttgtttatcagcgtgcgttcgtgcttccatttggcctctcggtcggggacttgctttccatgcgtggggttggtcggggcggcgccgcccttgttgcgggcaccgttggtgctgcctttgcgggtcatcgccgngtcggcctgtggggcatcggtgtcggcgtccggcgtgtcctttagggtgatctgcttggcttccttgttgggctttcccactccctccggccctgggcgtgttcttcttttctcccgcgggggcctttggggt

SEQ ID NO: 51028 - DNA, 464 bp, Triticum aestivum
  Clone ID: PAT_TA_51028
ggaccaaaacacaaccacaccaatttcacgattaccattacaaagcaaataccacaattatcagaaagttttcgggacacttaacatctgatagttactgacaccaacattggagaggcgactgacaaccatacatagggcagagcaaaaatactggcgaccccaaagattttagcatactgggccattagcacttgacctttttcagcccatgggcaaagtacaggaaagttggatcagcagctccctccttggagtacgcgaacaccacgccgccataataatgcatgctttcgccaacaaaaaactgaagggccttgagcttgctaaaaaaaacttcgggggaaactcaacattttttttgaaaacatttagggcatccccttaaagcttggcagggaggttcttgatgtaacgcttcatgtgaaaaataaactgcttcttgtaaaaagcaggttgctcct

SEQ ID NO: 51029 - DNA, 524 bp, Triticum aestivum
  Clone ID: PAT_TA_51029
ccatcaattagcagattaatttccagtctgggaagggtaaataacatgtccaaaagttccgccacgtgaataacgacacagtcctccgttaccgttaccctaccctacccacagcgcaaaagctgagcagctggaacttggatatacctcctcctcctacaagcctatcttttcatccatcaagattctacttctactctagatcaacatcatggcgtggcgtggaggagccttctgcttcttctgcccacaccggaacaccaaaaaatggcgggtccgtgcaagcgcaagcacacgcaccgccctttccgagccccgaggcgccggccggggggagctcacgcggtcgtgcgcgcgaggtactcgccgcattcgtagctcaatccccggagcaccgccgagcgcagagagaggaccaggacagcgccggggacgcccagggcctcgcagacgccttccgacactgccgtcgttttcgacaggccgtccgcgcctagggatgccaaggcggcgttcaggcccac

SEQ ID NO: 51030 - DNA, 274 bp, Triticum aestivum
  unsure (1)..(274): unsure at all n locations
  Clone ID: PAT_TA_51030
agcncttgatgaataattccaggtcatagtcgagttcctcccgaccaattcgctcccaccttacngaagtgcgtccctgctcccaacagtgtttctgtgccaccatgacttgtggattccccatgacggtctcgggcctgtgcgcttttgtcctcctcccacccacatttgcttcatctctggggttggctgctcgttcctcattcctcttcctcctcccccccggcgtcgccgccgccacttgccttcctctggttctttctcttccccctgc

SEQ ID NO: 51031 - DNA, 518 bp, Triticum aestivum
  Clone ID: PAT_TA_51031
ataagccaacacttctgcttagttgcaaatacctcacaaattcaaattgttcacttttgactactcacatagtctttatgcggcaaacacaccaaccatcgtcatattgaaagcacacatgataaacttcaagtcaaatcgaaagcacacgggataaaggtaaactccaggtcaattattatggaccaaacagaaccgcctattacagaccaacatgtggtcagctgtctgagttgcagcacaaactcaatcagtgccatctctgatcctcggcatgccagggtgacctccagcatcaacaccatcactggtgctccagttttcgcgccttgttcttcagcttgcagagttttcgcgccttgttccagcatctccttctcaccttcctgagtaccacttgctattgttggtgatgccaaaattgatggtggaaagttgctatatgcaagcggattagggatccatgtctttgaagaacacacccttttaagctggaatgtcttgatgtctagtgagaa

SEQ ID NO: 51032 - DNA, 342 bp, Triticum aestivum
  Clone ID: PAT_TA_51032
tcgcgatctagaactagcgcaggacgccgccgaggagatcgtcaattcgtcatcgcaggcgccggcgtggcaggcctcgccgtcgccctgggactccacaggaagggcgttcggtgcgtggtgctggagtcgtcgccggtgctccggacttccgggttcgcgatcgccgcatggacgaacgccttccgcgcgcttgatgcccttggggtaggcgacaccattaggaggaaacacctgcagatcaagggggcgtgtgtcatgtcttcgacaacaggggaagtggcgcgagagattgatctccgtgtgctaggaaaatggggaccccattaagcccagtgcgtg

SEQ ID NO: 51033 - DNA, 510 bp, Triticum aestivum
  unsure (1)..(510): unsure at all n locations
  Clone ID: PAT_TA_51033
ataataaggacgctataactccagnccagggcactcttcacacttgacaaatcaatccgccggtaaccatttggtcccgcaaatccacaccgctaatctcacccaagaacgtccgtggcactgccattctctcctatcctaggaacacacaccaaagaaagaagaaatggggaaggaaactccaaacaacaaacgagctcggaactagcaccagatcagatcggctagactagaccgccctgagcagcgcggcgaggacggcgacggcggcgtagagggcgaccccggcgcgcggcccggcgagcgcggcggagcggtggtgctgcgcggagggcggcggcgacggcggcggcagcttctgggacttgatggccagccgcatcccgccggggcagtagccgaagctgcagatgaagtagtaggtcttggtctcgttgagctcgaaggccaagctgcggcccttgctgtagttgtagaatggcgtgctggcgtcccaccggttgtacccgg

SEQ ID NO: 51034 - DNA, 456 bp, Triticum aestivum
  Clone ID: PAT_TA_51034
aagcatacatccatatatatacttggaagctgtcccggttcaacgtacactaaagtctaggtacctcctcaaaggtagtcgcaagtaaaaacaaccatagtcgtactacaatagttgccggccatgcagagctacctcggcggcctcactctctttctccctcacatggcgctcagatcagagcactaattcatactgtgtcagagacctcaacaccctcagcggatatggatggcgctatggaacggaacccgtggtgggccgtggtttgttagtatatttcaaatcacaccatcctagccctgtttgcatgcgtcacgcttccgccgcacttggtggggcttcctgcggccttaccaccgttgagcccaccgttgccgctcttgatgccctcccacccccctcgcttgctcctggggcctcaggcagtccccgcccttctcctgcccccgctgc

SEQ ID NO: 51035 - DNA, 450 bp, Triticum aestivum
  Clone ID: PAT_TA_51035
gcacagtgaaggtttctgcttacttcgatgtggccgctggttcactactggtattaagcacgccatcgtcttactcgctgactcgtatcctggccattcctccgctccctatttctgactccgtacggccgcccgctctcaacttcttgatcgcttgtcttcctcccagtgcccctctggttggctctacgtgcggcttcggcatttgcgctggcccctgctctcgcccgttggcagtcaggcttgaggataggaggctgatggcggtcaaaccccttaatttgcgagctgggtcttttgggctggctgtctacaactgccccccgccccatgcttcctgcgtttgtgcgccctttgttccacgccgccctcgtagaggggcctcgcgacaagcggttttgtggtgcggttacacggggtggccctttttcgcgggctccaaatggcggg

SEQ ID NO: 51036 - DNA, 367 bp, Triticum aestivum
  unsure (1)..(367): unsure at all n locations
  Clone ID: PAT_TA_51036
tattattgaatctttcaacggnaaagcctatttcttctaaattgaggtcagtgtattagagatttgttagttggaaaatacgttgatgagcatatgcaaaggccctttagacgctgaagttcatatttctgttgggttttttcacacactcaaagaacgacgaagcaccgtggagctgactgcaaaattatctgaacttggagaagttattacaagaggtcctacaaactcttgaactggctgccaagtcgaggaaggatgttcctatgctgtgttgtattgtgatgcatatttacctgtgaccacatgtatgttaaccactttgatctactctctcccaaccaattcgatcacaagtaagagtgca

SEQ ID NO: 51037 - DNA, 596 bp, Triticum aestivum
  Clone ID: PAT_TA_51037
gcaattgcgtaacatatagtgatggtaacataatcggtgatgatggtgatggtactgagccaatatgtgcaatatgtgacgaaggaggagaattacttagctgtaaaggtcgatgcaagagagccttccatcctacaatagaagctggcacgaaagtctaaatgtgtaacacttggttacactgctgtccaagtaaaggaaatgaataagttcatatgcgaaaactgtagatatgaacaacaccaatgtttcaaatgcggagaactcgactcgtctcatgagcctaatgccaaggtctttcaatgttgtaaactgttttgtggccacttctaccaccccaagtgtgctgcagaattacttcagtctcacagtaatggagcctgtgagttggagaacaagattgcagctgggatgccatttccgtgtcctgtacattggtgctccagacctgattgtaaaataatggaggaagggactgaaagagcaatgtggcttgctggctgcagacgttgtccaaggtcatatcacttagattgtttgccaagggagatatgctttaagtatggtaacggacgtatacgtgcttggtttctatc

SEQ ID NO: 51038 - DNA, 123 bp, Triticum aestivum
  Clone ID: PAT_TA_51038
ccggtcgaccagcgtccgcttggttccgtcgcgggtatcgtgatggtggacgattcgcctctccaaaacatgtctatcccttaacgaaggatttgtgtccttccgcttggcggctgaatcgtt

SEQ ID NO: 51039 - DNA, 630 bp, Triticum aestivum
  unsure (1)..(630): unsure at all n locations
  Clone ID: PAT_TA_51039
cccggttcgacccagcgttcggcacgcagnaacctagcaagcacacgtcaacctggccggtccgcaccgccgcacgcaggacctgggcgaacccaatcgactccggccgtcttccagctccgtgcgcagacctgggcgagacttcgcaccgcagcgcaccaggagagactgaagtagaaccatcgctgaccggcccgcaccgcagcgcgccgaaacagagcaaaaaccaggccaaaaacttaacgtgctcgcaccgccgcgcgcaaggaccggacctccgtgctggatctggtctgcccgagcttcctcaagcaccaacaggctggacggcacccctgctccaggagctgggcgtgcacacgcttgcaaggggaaaccaccagcatccaccggcaccaccgctcccgcctctccaatccaggcgccaccggccatcgagatctgggcgcaggaccgcccaaaatcagatcgggcttggagcccctcaccgccgtgtcgccccaaactccgcctggctcgcgccgccgctgcagcgggccacccaccgcgcgccgtccagggccgccgcgtcgcccagggccgtcgctagcgcgcgagcccccgcgccaccttggccccgtcccgcgccat

SEQ ID NO: 51040 - DNA, 626 bp, Triticum aestivum
  unsure (1)..(626): unsure at all n locations
  Clone ID: PAT_TA_51040
ctcgctccacatcgacctcaaggacaaatggaggaatttgagttttagtgcaagtggactaggttcaagggataaacaaagggttccaaggccgaaagcaccttcgtcctccccatcacctagcccgcagcttctgcttctcccagcaacgaataatgttgctgaggcttctccaccagaagattgtgaaaagagcccacaggatgacaagactccaagtccaaagttgtacagttccatgatcctggaagctctcggcgaactgaaagagccaaatggttcagaagttactacaatttgcaatttcatagagcaaaggcatgaggtgcaaccaaattttagaaggttgctttgtgcgaaattacgaaggcttataggcgtgaacaaagttgagaagattgataagtcctataagctgacggattcatatgcaaaaagggctctggctccaatgaaagatccatctctaaagaagaaggattcagccaagtcatccaaggcagcaaagggtcaaggcctgtttaccgctgcgagccctgcactgngtgcggctgaagctgcagcgacgaaagtagccgacgcggaggccaaatcgcacctcgcaaacgagcacatgatggaggttg

SEQ ID NO: 51041 - DNA, 613 bp, Triticum aestivum
  Clone ID: PAT_TA_51041
tcgcataccaccaccaactacagcagcctggctcctcctaccccgccggcgccggacgctgcagagaccggaggtcatgggcgtcttcaccttgcggtgccgcgagtgcggcgccgagtggtcggccaagcaacacaagggcgagctcgaggcctgcgccgccacgccctagacctgcagtgccagctcgtctccgccgactgcgccgaggacaagctccggcagcgttccagacctccttaaccatggtctcccccaattccgccatcttgcaggtggtcatagctggagcctctggtgctccgatcgctggcggagctggcaggtggctgcgacgcctgctagcagtatatggtgggagctaggtgcacgacgacctccaacgcttgaagcagaagaaggaagacgagaaggaagatagcgaggatgaccttggcttctccctctgggataagagcctctttacgctgctgctcgccagaaatgacattggcctattgccgcagtaattgtgatgccatgcccacaggggtggtgaacctggctagatagattgaaaagggatgcatgtgatactttctgtccatgtgacgattgggttatactattatgc

SEQ ID NO: 51042 - DNA, 536 bp, Triticum aestivum
  unsure (1)..(536): unsure at all n locations
  Clone ID: PAT_TA_51042
tgnagggctggncgacaaggtggngtatcctggncacacagaggggctaccaaaccggtgctgcagcaacaacgacttcgcagcccatacaggaggtggactgcatacagtgccttgttaaataccaccattctaccctgctttgcattcgcattttcatttgctgtctttttgccaccatatgacatctttaaaactgctaagagattcaaactaagaggaagtcgtgttcagtttcggttggcactatgatatcaagtttcatcatgtactgttggtgttggtttgatcaaataaacaggggatttatttaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaaaagggggggcgcccttttaaaagaaccaaatttaacgtaccgggggcagcgaaagataaaagttttttttttggggccacccaaaataaaattaacgggcccgggttttaaa

SEQ ID NO: 51043 - DNA, 608 bp, Triticum aestivum
  Clone ID: PAT_TA_51043
ctcgtgtgtgatggttgtgagctcacagccatgatggcggcggcctcttctctgactctctttgtttacatgttattgtgtgccttgctgctgcaaaactgagggacgacatgctggagtgctcatttcctagcatttatatatgtatctacaatgacatgagcttgtaggctaaaagtggcaccagtttgttgtcttgtgcacagaatggtgatgaagacaacaaagataattgtggcgtgaattggttaagaggcgggcccaccttgtcttgtcctggtgctctgaggtggagggaacttgatactctcaagggccacgtggagtggagtttgttgtcaagatgaagttgctcgacatcaagaccatcctccggcagtccgtacacggtgtcatgatctgggggactaaaactacttaggtacatatgattggttatcaaagaatatccttgtggcgtaggatgttgcgagctcccagccgagacggcggcgacctattctctgactctgtttgtggcgccaacttgtggctcttgtgcccagaatgatgacgacgacagcaaagacaattgtggcctgaacttgttaagaggcaggcccaccttg

SEQ ID NO: 51044 - DNA, 328 bp, Triticum aestivum
  unsure (1)..(328): unsure at all n locations
  Clone ID: PAT_TA_51044
cttgttgtactagatccatcattgcaatgagtgggtaaagtttacaaagttttggcttagggcaaagctggtctgccgtgccaacgcgttttgctgcgtgcttctgttgtatcgctcgttgccgcttcggttggctgctttagctgcggagagcaccctagctgaacatgcgtgcatgcgaaaacatgacctaggtccctgtgaggatcttctggcctcggtcgtggggcgnacctgttttaatgaacttttgccttctgcctcctacgctgctgagggtttgctccccaggctttggtgccttggctgtttggcttgcctgtctgcc

SEQ ID NO: 51045 - DNA, 478 bp, Triticum aestivum
  Clone ID: PAT_TA_51045
aagagggggcataagttactgcagggatctcatctgggggtttacgttcccattcctagcctgttgaatagctctaccctcgcttttaactccggtcaattttctggggtcatggggcggctttgaacctttctttttacatctgatccgcggggggtcgggggttccgaacggctttttccccgttgcttttccggcgcctcccctttcctatttgcttgttgggtcatgggaaggggcttccaaattttcaggtgtcccgggaacgttttttgtccctttggccgcttttccaattttgaatccctgtgggtgggcgcgccgcgtgtccctgccttttgcgattgctttgggttttttcgtttctattctgctccgcttcagcttttcctcactgtcttttgttgggtccccgaatgcctgtgattggcccccccaccttggggatgctgtggcccacctttcccgcgtggtgccc

SEQ ID NO: 51046 - DNA, 382 bp, Triticum aestivum
  Clone ID: PAT_TA_51046
ctcaccaccagctatcaagagcaaccttctctcgtcacagagcagtttgtctataacacgaggcgctatatgaagaaacttaactgccgatcttgttggcattgggctaatttttcacaagacgaaagatgagtatgctccattcttgcctctcagaatgttaactgtcctccgcatattcgtttgaagggagccttcctgatcaactcccagccttgttcagggggtagcaccagggagctcctgccccaactttcctcaacttgacccatgacctgaccttccacagcagctggtgcccctgctgctacaatctttggccaccagcaactggatcttctgctatatgtctgtctccaccactactatgcggtggagctgg

SEQ ID NO: 51047 - DNA, 218 bp, Triticum aestivum
  Clone ID: PAT_TA_51047
ggcggcggggttttaatactattgggcccaatggttgtaatttacatgcttactggaaagctgccggcgcccccctggggccaatcccaaaacaaatacccatccgttctttttgaggcaattgagatgaacacatctcgcgacttataaattattatccaagggaaggatttctatttttttggttttttatctttttgcttctcaagcgccaaatt

SEQ ID NO: 51048 - DNA, 271 bp, Triticum aestivum
  Clone ID: PAT_TA_51048
cgagcacaacaaggccccggaggacccaaacctgtattggatggagcgtgcccattttacatccaggacccacacgaagtcatgattacgttccaaagggtgaatctttgccaatgggaccccagctgacgaacgtcaaaagcaatagcgtccttggcaccggctgcttcgatcctggccctattccacacaccgcccgggccgaaaccacttgtgggtgaggaatgggctgtggcaccaccgcagtaaaccgggggcagacactgcaaat

SEQ ID NO: 51049 - DNA, 396 bp, Triticum aestivum
  unsure (1)..(396): unsure at all n locations
  Clone ID: PAT_TA_51049
aaacgggcaagactaaaaccatatttgggaattcgaagctgcttcaaaacataaccaaatcctcgcctgaacagaaaggacacatacattccttgacaatcaaactaggctgggtgacaaaccctgtgggcatggcaacaaaattactgcggggggggggcaatgtgatttctggcgagcaacacgggaaagaagatctaattggagaggggaagccaaggggatcctcactctcctgcttgtcctgttgcttgttntcctcaggcttggggggccctgcagcagctccacctgctgcagggggacgaccaccaccagcaccaccaccgatcggaccaccagagggaccaccaatgaccacctggaagatagccgaattgtgggagaccatggtga

SEQ ID NO: 51050 - DNA, 565 bp, Triticum aestivum
  Clone ID: PAT_TA_51050
gaatctggatagctttagatcacaaccaaaacaggcaaaacattctcagttcaacctaggactcgaaccgtttacagaaaatggtgttcagtatgtctgcaaacatgacatggacgcaacatctaagaaaatccaacgagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccactgaactgctcctcaatgtgcgagtccagtgtacgtccctgctggcgcttctcaagcttcctctggacattgttgctcttctttgcttcctctgtggcagcagcagcaacctcagcctcttgcccctcagcaggttccttcttggcagctgcagcagctttcttcttcctaccgatttcgactccataatgagtcaggtaccactgcttgaagggggcagcatcaacttgcacaatggcattcttgacaagggtctgagtccta

SEQ ID NO: 51051 - DNA, 328 bp, Triticum aestivum
  Clone ID: PAT_TA_51051
aaaaaaaacccccgggtttttgggccaaaccaaccccaagggggcggggggaaactgggtttcaaggggccaaccgaaacggaacacgatttccttttaggtggaatctttaagcagtttaaaagagggtattgggggggaaaaagaccgcaaaggaaaaggccaaggcaaagcgggggaaaaggggggttttaaaaaagggactggttgcaacccacctccggttgggggtggaaaacctttgttggtgaaacaccggttggggaccccctttgggggtccaggatccccaccttgggggccaccccaaaagggacggggggggccc

SEQ ID NO: 51052 - DNA, 538 bp, Triticum aestivum
  Clone ID: PAT_TA_51052
gtgcattcctctattcacatcgataccgagttttcgaccacagtgaaatcttggcaggatgaaataggaactagcagggccgtttcagctcaggacaaaatcccagcatcccgctggccaaatcacggaaaagataaaagaggatataatcgaccaactggagtgctacgttcattagtgacaagttactttactcacggacaagatagtccttcacatttaagcccccatataccaaaacaactcaaccagcaggaactaatggaaacctgccatctctcacccaactctgttggacaccgtctggtaaatagatttgagctgagtattccacttatcaatggcttgatatttccgcattccctttgacctgtcaccgcattctagcagcttgttcacctgatctatgtggccctggacacggttgtccagaatcaatgacaccaagagctgctcaacatccttttctgggacatttagctcctgtgaaatgaatggaatccttattcttgtgtatggcttaatgagcttgagcagc

SEQ ID NO: 51053 - DNA, 537 bp, Triticum aestivum
  Clone ID: PAT_TA_51053
gctggcaaaagtatattgattgcccagtgagatgaggttacaagtagcggcgaaacaatgcagccgcttggaattcacaaattcatcctacaaattactaaactccaaattcatcctaccaaatcaggaactcaaaacaataacaagcaagcatgccagcagatggctcttcaccacaattccacaaacaactagacaatctaactaatctggtgagagaatccaatccaagacatgagcccagcttctactacttagcagcagcatcatcagcatcagcatcagcatcatgttcatcacggcgcccttcttcaccaaaacgagctgaggcagcgcccgacaacacaaaaaggacccatcacgcactcgctggagctgcaaacaccaaccccactgctcagggaagcagaccaggggcttcgtatgctgaccaatagaaacagaaagttcctggatcgatcctccactgcttcctctaagtagttgtagccaaagaggcagtctcgcaaagcccagatatcacaacgtgtactgact

SEQ ID NO: 51054 - DNA, 607 bp, Triticum aestivum
  unsure (1)..(607): unsure at all n locations
  Clone ID: PAT_TA_51054
anaggcaggtaagggaggaggaggagagcggcggcgaagaggtgtcgctgaagctgcagaagcgcctggcctcgagcgtcctcaagtgtggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggccaagcgcgccaagagcaaggcaagcagggagaggaagcatgccaggagggaggagagattggctcagggccccagagatcatgcacc

SEQ ID NO: 51055 - DNA, 601 bp, Triticum aestivum
  unsure (1)..(601): unsure at all n locations
  Clone ID: PAT_TA_51055
ccanaggngggagcccccgccgncgtcatgtccttcgacaccttcaacccggcgtccgcgctctccgccgcatgactctggagcccgacggcaacctccgcgcctactactgggacgggtcccggtgggtgctcgactacaccaccatcaccgactcgtgcgagctgcccaccacctgcggcgcgtacagcgtctgcgtgccgcccagcggccggtgcgcgtgcctggcgaacgccaccgacggcccgggctgcgccgccccctccgtcgggagcggcctgtgcggcaccacgggcggcgaggttggcgggctgtactcggaggtgcggggacacggcgtggagccggcgaacaaggagctgctggggttcgagcacgcggcgtccgcgggagactgcgaggcgctgtgcgcgcgcaactgcagctgctggggcgcggtgtacagcaacgggacgggctactgctacctcatcgactacccggcgcagctgatggtggccgccgacgagaagaagctgggctacttcaaggtgaggagcgtggaagaggcggctgggcgcggcgggagggcgaccggtgtcaaggcggcgctgcttgcggt

SEQ ID NO: 51056 - DNA, 607 bp, Triticum aestivum
  unsure (1)..(607): unsure at all n locations
  Clone ID: PAT_TA_51056
gcgacggcctccggggcttctaccgcggcttcggcgcctcgctggccggcaccgtccccgcgcgcgcgctctcatggccgcgctcgaggccaccaagagctccgtcggcggtcgcctcggccgcggcgggggtctccgccgccgtcgccgcgcaggtcgtttggacccccgtggatgtcatcagccagcggctgatggtccagacctccgccgcctgccgctacgccggcggcgcggacgccttcaggaagatcctcgcggccgacggcgtgcgcggcctctaccgcggcttcggcctctccatcatcacctacgcgccgtccaacgcggtgtggtgggcgtcctacgccatggcgcagcgcttcgcgtggcgcgtcgtgggcgccgaccgctccgagagctacccggccctgatggccgtgcagggcgccagcgcggccgtggagcgggggcgcggcggccctggtgaccatgccgctggacacggtgaagacgcggctccaggtgatggagacggacgcggcggtggcgcggccaacgctggggagcaccgtgcggngcctgctcaaggagggcgggtggggcccgtgctaccgcgggctggggc

SEQ ID NO: 51057 - DNA, 601 bp, Triticum aestivum
  unsure (1)..(601): unsure at all n locations
  Clone ID: PAT_TA_51057
cttcactgagnaagttcagtacattctcagttttgctgcaaatgctgagggttgtgcaacgcgaatgctcaacaccgttgatgctgaaggcgatactgtaaaccctcttgaccactcgatcatatgccaaccatgttgattttgcagcaaatgtgccatcggcgtggtcttataaccttatgtgtttgctccgtgcagccactccaccatgctgccagaggggaacacatggacaccgtcaagcttctgctcgaagctggcgcatgtcccaagaaggagaatgcctacgggcaggcagccgccgagatggccgatcaagataccgaagtccgggccctgttaaccgccaagcaagtcgaggccagcatacatatggcggactgatgatggacctgtcggaggaaccattggttgatatcagtcatgatgagtgggcagtaaaatgagtggtagtattagactattagtatcatcatacacagcttgcctagtatgagaattgcatttctgttgtcaccagaactatggagttatctgcagagaggaggacatggtgtttctccatttgccctttgtatctgtatttttcgagttatatcaa

SEQ ID NO: 51058 - DNA, 603 bp, Triticum aestivum
  Clone ID: PAT_TA_51058
caacactaccacacagctcatttagctaaggagcagagcagtcacctagctagctttgggtctgggttctaataagagaagctagcgccaccgtctgttgtgtcatgcgcttgtcttaggcgtagccctgctcgcacttggagcccatgggctgagagaggtgcaaaagcaactggaggaattgctggccgacctacctgctacgagcgctgccgccatgagcccaaggaggactttgacgcctgcgtgaacggagccggagtgggttaaaaggagaagaagcaagagggggaggacttggcgctcctccgcggggtccggcggagggacgggagcaagaggtatacgcacgaggatgaggaggaggacgaggagctgcgcttctggcgatgccgacggggcgcgccggacgggaagtctgagagaaaaagaagcaagcgtacgccgtcccagcccagctggtttacaacccagaattctgttccttcatgtgccgccacatacatgacaagggggactgcctcctaaagtgcgaggcagggccaaatgaagtatgagggtgataggtgcggtctccttgcatcaacagcggagggtgcttgc

SEQ ID NO: 51059 - DNA, 605 bp, Triticum aestivum
  Clone ID: PAT_TA_51059
ccccgcgtccggccatgtcgtcctcccctacccccgcgccagacgccggcgccgccgcgatggccgtcgacgactcgtcggagaccgaccagctcgactccatgtccacggaggacatcgtccgggccacccgcctcctcgacaacgaggtccgcgtcctcaaggacgagctgcagcggaacaacctggagctcgagaacgtcaaggacaagatcaaggagaatcaggagaaaataaagctcaacaagcagctgccctacctcgtcggcaacatcgtcgagattttggaaatgaaccctgaagatgaggctgaagaggatggtgctaatatagatctggactcacagaggaaaggaaaatgtgttgttcttaagacatccacaagacagactatattccttcctgtgatcgggctagttgaccctgacaacctcaagcctggtgatttggttggagtcaacaaggacagctacttgatattagacacgctaccttcggagtatgactctcgagtaaaggcaatggaggtagatgaaaagcctacggaggattataatgacattggtggccttgagaaagaggaactcgttgaagctatagtgttg

SEQ ID NO: 51060 - DNA, 470 bp, Triticum aestivum
  unsure (1)..(470): unsure at all n locations
  Clone ID: PAT_TA_51060
tccganatcccggtcgaccccgcgtccgcttctcctccccactcatcctcggttcccggtccggttcggttccgttcggttcgttagggtttagtagcggggaagaggaaggcatggcggacgtcgagtaccgctgcttcgtgggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcggacgaggcgatgcgccaggcgatcgaggccatgaacggccaggacctggacggccgcaacatcaccggcaacgaggcccaggcccgccgctccggcggaggcggcggtggcttccgcggcggaggagggagccgctgctacggcggtcagcgtnccgaaggaggaggcgaactacatctaccaggtcgg

SEQ ID NO: 51061 - DNA, 618 bp, Triticum aestivum
  unsure (1)..(618): unsure at all n locations
  Clone ID: PAT_TA_51061
ccccctgcgcagcgcgcctccgcccacactctcgccctcgactgggaggagaaccagcagcgcagccgagatgctcggggcctcgaggcgatccctctgcgccggcgccgccgcccgccgccacgccgccgccttcgcggtctccggagacgccgccgccgccgcctcctcctccccctccctctccccctcggccccgccgcgttcggttacaaacccagagcctggtgtttctcggcttggagggaagaggttgttctctgtgcttgcggctcccaagcttaatggagctgaaagcttgtcgtccctcaagctgagggagagtgcccttgttgggagacggtatgaatcgagtgctgcagcagttgattcatctgacgcgccacctgccgagaagtttgagtatcaggctgaggtcaataggctcatggatttgattgtgcacagcttgtatagcaacaaggaagtgtttcttcgggagctggtcagcaatgcaagtgacgcacttgacaaattgcgctatctgagtgtcactgatcctgatcttcttaaggatggccctgaacttgacattcgcatccaaacagacaagnataatggaataataacgattactga

SEQ ID NO: 51062 - DNA, 424 bp, Triticum aestivum
  Clone ID: PAT_TA_51062
gagacatgcgcgttgctgcgacgcggggccgcctcctccgctccgggtgccctcctcggcgctctagccctcctcttcctcgtcggctccgcctccctcgccatcggtgccatggccagccacgtcctcgggggcgggagcgagaaccccgccgcggccaacagcctggagaccgacggcctcgcccgtttcgccgtcgtcgagcacatcaagcgcgagaacgcgctggtggagttcgtgcggctcgcggaggccaaggaccatacggtggtcggcgcggtgcatgacctcacgctcgcggcgctcggggccggccggcaggacctgtaccgggcccagggctgggtcgcgcctgggccctacttctaggggctgcaggggctcccctcccccgggtgacgtcggcggctgcagcatctcggac

SEQ ID NO: 51063 - DNA, 525 bp, Triticum aestivum
  unsure (1)..(525): unsure at all n locations
  Clone ID: PAT_TA_51063
gcgttcgtcctcttttggcatcttcatcgtacaggctgatggtgaaataattggcttggacaaattagcccaaanttcttcaagagagtggatatcaaattttgacgcctgcccatttttccactgggggggggggggggggcctattgtaatgtcaaatatcacctacttgtcacctggtgtagagatgtaaacaaaaagtgttgcattcgtcttgttatcaacgtttaagtagtaaaacgggtcacacgaataaagagaaaattcaggttcaaatcaaatcatattgacaaaaaggaaatgtcataactacgattcggtggttgcnaaaaaaaaaaaaaaaaaaaaaaaaaaaaaaaaaaaaaannaaaaaanntaaaannnaaaaanttttattngatngtntttttttttttttntttttttgtttttntttgttttgttttttgttgttgtttttttttttttttttttttgtttttttggggtggggggtttttttttttggggttttttttctttctt

SEQ ID NO: 51064 - DNA, 546 bp, Triticum aestivum
  unsure (1)..(546): unsure at all n locations
  Clone ID: PAT_TA_51064
canaaactctcgccccgccgccgcaacgcatcacgctttcctccgacccctctcccctctggctaacccctcccaccaaaggcggcggcggcgaggaacctggtgctacggcacctccgcttggccgcggcccccgcgtcgtcggtggccctcaggccggcagcggcgctgcagggggccctgtcggggcggcggtggatgtcgtcagaggacgccaaggggtcgttcctggacaaggacgaggtcaccgagcgcaccatcaaggtcgtcaagaacttccagaagatcgacgacccatccaaggtgaaagcagatgcccacttcaaggatgatcttggcctagacagtttggatgcagtagaggttgttatgtccttggaagaggaatttggctctgagatacctgacaatgaagctgacaaaattgactccattaaagctgcagtggacttcatcgcctcgcaccccaaagccaaatgagcaaaggacttggtcctctacttgttcaagtttttaaacagttcctctgcatgctgtacgtttctg

SEQ ID NO: 51065 - DNA, 109 bp, Triticum aestivum
  unsure (1)..(109): unsure at all n locations
  Clone ID: PAT_TA_51065
ncgacggggnacgtgggtctggccgtggtgcccgagcgcggaagtgctcatcgggctctaacacgcgcaccctcagagnagatcgagccgtccccaagacgaggctacc

SEQ ID NO: 51066 - DNA, 594 bp, Triticum aestivum
  Clone ID: PAT_TA_51066
cgccatttcctccgcccacctacccagcccgtccgccgccggccggcctcgaaccttccaagttaagcagctagctagctagcgcggcggcgagaaaggagcgtcgtgtctcgccgtggctgctgctggtggtgcttctggtggccgccgcgtccgggcggaacgcgcgcgccgatccgcaggtgccgtgctacttcgtgttcggggactcgctggtggacaacgggaacaacaacgacatcgcgtcgctggcgcgggccaactacccgccctacggcatcgacttccccggcggagccaccgggcgcttcagcaacggcctcaccaccgtcgacgccatctctcggcttctgggcttcgacgactacatcccagcgtacgcgggcgcaaacaatgatcaactcctgtccggcgtcaactttgcctccgccgccgccggaatcagggacgagaccggccagcaactggcacgtactcacaaacctttcttttctttttcaagaggatctgcgaaaaatgtggcctaattaacgttgcacgcacactgccaaaacatggcacgcagggtcagcgcataagcttcggcgggcagct

SEQ ID NO: 51067 - DNA, 613 bp, Triticum aestivum
  Clone ID: PAT_TA_51067
gttgttctccattagtttcaccaatgagcacctcctagagtgcattggatcagatctggatgacctgtcaatcaagtttagaagcaggagcattcacaacatcgctcacattatcacaacaactgatggcaggcgatgattgccacaaactagacagatttttcacgacgctaacaggacggcaaatcatcttatgtttacaaggttgcaccatcacatgatgattgttacagtcaaatttccagacctttacaaactagcgcactgctctctaatgatggataaatctcccgcctccttgtatagcttgtctatcaaaggacatgtatccatatacatccgtgtcaattcacgccgtcatactatacttttggaccaacaaagcctaacccaaaaaataaaaaagacagtggaaggggcgcatctcatctggcaccgccccaaccattattagaagaaagggtctggaagggtcacttgttaatctggcaccgcacaacaaacaatcaggcgggatatcaaggtattgtgtaactttatatgtagtaatctggatagtttaaatttattagagcataaatatattaataattaatctatagtactttatatt

SEQ ID NO: 51068 - DNA, 446 bp, Triticum aestivum
  unsure (1)..(446): unsure at all n locations
  Clone ID: PAT_TA_51068
gtcatactagttcctacttacagaacatgacttgcggacctattattggggcccattgttatagtgtcaggcggacttgccatgtcttatcctgcttgtgctcaagcgccatcngcatcgacagaacagggtaacatgggtaaagggagggtggactgtgacagttcatatgcagagacggttctaaactaacatccgtctgtgaaacactttaactttacctgtaatggcaaaacacaggacgacttggacattgcctagctatactctgttctataggagagtgacatggtcattgtcataactatagtttgactagcatgcttacattcagagtacacaatgtgcagaatcctttcacaaatggagatagtcaaagactacaactgactgatattagttgcagcctgaattacattacagctttttcagatccaatgaaccca

SEQ ID NO: 51069 - DNA, 582 bp, Triticum aestivum
  Clone ID: PAT_TA_51069
gggcaacatgcacactgaaaacaccatatgttgctgatgctaatggatttgatagagttaccaagtctgaggtcaataagaaaaattaatgccagtatcttatgcgggcaaacttcgctacatgactgaaaacttccatgatgctgtcgctgtttcacgtgtccatggcttacttgatatattcacagacttcacgtatgatccaaactggcctgagatagttcagggtcttgagcatggacaacaagcagtcgatgaggctgattttactgctcaagtgtatcaactgaaactccttgaatacgtggtaaaaaattaagaccggacaggtgtttgggcctgtagttactgtcctccactgcgtggacttccagaagaggactctgccccatgcacatgtccttgtttggctgaaaaagattatgggcagggatctgcgtccactaatgttgatgatgatgctcttgcgattgcacatgataatgccatggaggctgcacttcgctgctttggatctaataactaaagccctgtccacaaagacaagtgaaaattgctttgccattgctgttttcacacgat

SEQ ID NO: 51070 - DNA, 589 bp, Triticum aestivum
  Clone ID: PAT_TA_51070
gtccacccctctcccctcccgcctcccacccagcccatcttctgtccctggtagacattccttcctgatcttgcctcgctcttgtgctacctccacatctcatctccccatggacggcggcgccgccaccgtctgctccatgtgcggggacatcgtgcttccccgacaagctcttccggtgcgcgcgctgccgctaccgcttccagcactcctattgcacgaactactacggcgacggggcaccggcctcagccggggccgacatgtgcgactggtgcctcggcgacgtctccgggaaggccaggaggagcgcgtctacatccgggaagcagcaggcctccgtctgccaggattcggccacgacgggctactccggcaggatcgacaaggcggcaaccggcggcgaccaggagagcgggcggcgagggtcgaccaaggtgggaggccgcacgtacaagctgctcaaggacgtcctgtgttagaaactagttttaggcgccatcttgcaggcctgatcgagcatgaccgataagtaagaccagctagttatgaggagttagcttgtagccaaggtcggtagttatattag

SEQ ID NO: 51071 - DNA, 563 bp, Triticum aestivum
  Clone ID: PAT_TA_51071
ctgcagcgtgggctcgcgcgcggccgcccttttcttttcttttttttttttttgcgcagttccgtttacttctaaagtcctaactggcaccatttggcctatagtatacactatgttcttagtcacaggaggtaaacaccactgcacaagatttaactctctacgtaacatcataaggggcaagtttgctacagggtacatatgcatgttgccatcccaaacacatggattataaatctctgatcatgatactcttgtttccagctcgatattaagccatcccaccactagcagccgtcctgcataatctgaaacacggatgatcctatgaccaccaaaataaatcctgcctcccccggagctcgttagggttctctgttcttccggaggagaaatctcaagaggcggcaccacgctcgagtaccaggacaagctttccgaccattaccttctgtcaaattccttcccgcacaggaagctgtgataacggattactctggtaagtcgatgcccattgtactgttcaaagatcactggatgtggacattggagccaaaccctct

SEQ ID NO: 51072 - DNA, 588 bp, Triticum aestivum
  unsure (1)..(588): unsure at all n locations
  Clone ID: PAT_TA_51072
catcctttacctcagnagtttgagaacttccaaattatactaagaggaaagcctgttgaacagataaacattgccaatgagctgaagtttaagaaagtagttacttacaaacctcaagttgcctatgattctcaagtggtgtcagtgagggtagatattggctttgcaaaagaggctcctgttttgggcatttttgggattaatgtctaccataaaaatcgactaatcatgccattctggaaggtccttcaagaagcatctagtagagggagaagtgttataggtgtacttgaggcaaattttattgagccggcacatgacaagcaagattttgagaggactccactgttcattaggctggaaacaaaactgaaacaaattatcgttgattattggaaagaaaagtgtcatctaataggttaccagccaatcgatccgaaattgagatcccagtataaggctgctcttaaagattcgggcggccctagtgtgaagattcggcatgaagcttccactgctcagaagactggagggcacctctcaaatttgctcccacagacatatgatgatgaagcagcttttagactg

SEQ ID NO: 51073 - DNA, 451 bp, Triticum aestivum
  Clone ID: PAT_TA_51073
cgtattcctcacatccgctgcagcgcaatactcgactccgtcttgcctgtaagaagcgccgccgccggcgcagcagtcaggagggtgagctgggcgattgccggagcaggaagcgggggcttgacgagcgcaaggcgaaggagcaaacccaagtggggctgatggactactataggaagcgcgagcactccacgccggagggggagaaacagcgggagaacattgagcgagagggcgcgatcaaggagatgctagattctgagggtgactggtactacattggggactggatagtggggaggaaaactaaatgatgtagggaatgggcatacggcggattatataagatcgacgggggacgtcagaggaacggagtatgaccaccgcacttaacacgagagctgggaagatgaattccgtataattcaacaagagctgcagaaaatgggca

SEQ ID NO: 51074 - DNA, 562 bp, Triticum aestivum
  unsure (1)..(562): unsure at all n locations
  Clone ID: PAT_TA_51074
gtaccacaccacctcaagcgaagcagcagnagccacagcccaagctcaagctcaagctctcctcttcactcctgcaatggcgcgcatccagctcgtggctctggccctgaccatgctcttcgccgccaccgcggcccaggccccggcggccaccccgatgcccgcgcccgtggccccggtgtccccgcccccgacgatgccgccgccgaccccggcgccggtgtcccccccgccggccgtggccccggccacccctcccccggcgccggcgcccgccgcaccggctcccgcccccatggtccctgccccgactccctcgaccatggccccgacccccgagatcagctcgccgccggagccgtcgatgatggcgcccacgcccgccccgtccatggacgcgcccaccaccccggccggcgccgccggcaccgtccaccccgccgccgtgtgggccgccaccgccgtcctggccgccgccgccgccttttactgggagatccgcacatcggtcgcgatttaatttatccgaggggccccgacccctctccttttgtggtggtgt

SEQ ID NO: 51075 - DNA, 468 bp, Triticum aestivum
  unsure (1)..(468): unsure at all n locations
  Clone ID: PAT_TA_51075
cggncgcgtgggtttatattttttatttttttatttttttttttgtattttttgtttttttttttgtttgtttttttttttttttttttttgttagtgcttgctactgtccgacccgccaacaagcgccgaaccacccaaggggcccccaagaaccaacggaaacccaacgaagcaaaaaggaggaagaaaaaaaaagaaagaaaaaaaaaaaaagggggggggggggggggaaggggggagagggggcagggggggcgggggcgggggccattgggaagggggcggcttagcgcggggcaccggcgacaatgctgcctcgtgccggggccctccgggggatgccggaaggcggaacgccaccaaggcagcaggcccccccggcaggggcgggggcggcgcccccccccggaccgcggccccgggggcggggccgcggacccccgggcggtgcgggggccccgggggc

SEQ ID NO: 51076 - DNA, 594 bp, Triticum aestivum
  Clone ID: PAT_TA_51076
gaagaaaagctcgaagagtgggtggctatatctcgaacgctgaactggctgctattcacgtgggagcgcactcgaagctgtaatgaatgagaaacaagtagcaatgggcagatgctcataaacgctagctcaagctgatggtgaagaagaattgttgttgtgggaaggtgcacctttgtctatgcattacttcgattaacggacgaccctcacttgagggacagccgctggtgtaacgtacaacgcaagaacggcttgcgacactagcaaatagtagaaggaggtgcgctgagtctagcccacgtcaaggtacactcgctcaagcaatgactcgacgcttagatggccacttgtttgcaacaagaaacagttcttttttacgacaactttatctttggttacaaagatgctcacttgatagtgacaatgacttgattactgctgcgatgatggaccaccctagggggtgagtatgtggtctgacacttgctgcttacggtggacaatacctttcttgagatagacgtatacccggttacatatcaagatcccaaggaacgaaccatacccaaccgtactgacaaatctgtgttg

SEQ ID NO: 51077 - DNA, 485 bp, Triticum aestivum
  Clone ID: PAT_TA_51077
cccagcgtgcgcagccgcttgggggggcgcgtcggaacagaatcaaacaaggagtcggatgggatcatgacagtgagggtgtatgagggcatgaattgcgcggacgaggtgatggagctcgccaaatcttgctcgtggtgctggaggagcagggggaagagtggtgctattatggatcgagggggtcacacatgtgaaggatctgatgaacggttactgtgatcgcgatttgaggattttgaactacattgatttcctttgttatggttggatgctgtgagattagcatacccctggtgtaattgcatatgcaagaacgctagatgatcggttcatgtttacatcaaaagttgcggtgctttgttggactgttagaagagctagctgacttctgaatgttatatgatgtgagctatcttctatacttggattggatgtacgcagtgaacaactttgcgtggctctatttctgcgccatatcactg

SEQ ID NO: 51078 - DNA, 595 bp, Triticum aestivum
  Clone ID: PAT_TA_51078
gcgttcgcggccctgcactcctccgccccccaggccccggcgcgcccatcccgccggccactcccttcccccgccgtccccaacgagcccatcccgccggctgcagctctccttgcaccgctgcctgatgatggccaaaggatttctagccaagagcgataatgcagggacaaagaaatctcccctgcaaatccagagctggagagtttttattctgaggtacaatatccgaagccggaggacgtgacagagtatgcggcatctgttggtttgacttacaaccaggtcagaatatggttcaaagagcggaggcggaaagagaggaggcacatggaagctgcagaggttcacatggaaacacaagctagtgcaagatcaaattggcctagatgtagcagcagcaggtcttccaattcaagtcaatctccaatgcaagataccacaggacatcaatcctaccaggatcaaagcgttttgaagaagagaaagatcatgtcgcctactgctcagagatccactttgccatttgagaacaatgatcctgtgaggaagcatggaaagggcaaaggtctaatgacagtgtggcatgcaatgt

SEQ ID NO: 51079 - DNA, 584 bp, Triticum aestivum
  unsure (1)..(584): unsure at all n locations
  Clone ID: PAT_TA_51079
ccttccccaacgnacctcctcgacccggttcctgcactgcctatccaccaacgggatggcggatcttcctgctgccattgtagcgtcatctgagggaagttcatatgtgatcaagatagacggatactcaagaatcaaggggcaaaccgagcatgngaaactacgtgcaatctacccctttcagtgttggaggtcacgattgggctgtggagtattacccaaacggttgccnacgccgaaaagtatgaagccggtttcatatctgtttttctatctctgtattctgttgtttctaacgatgtgaaggcgaaagttggatttagtctgctagacaaggatggggaaccagtggaatcaaacagcatgatcacccacgagcatgtcttctgtagcaaagattcagactggggtttctctaattttatcaaggctgcggatctcgagggatcagtgcatctaagagacgacagtttcagcatcaggtgtgatgttacggttatgaagcctgtccataaagttaatcggtttattgtggttcctccaagtaacttgcaccaacatctcggtgacctcctcgtgagcat

SEQ ID NO: 51080 - DNA, 533 bp, Triticum aestivum
  Clone ID: PAT_TA_51080
cccacccgtccgctcctctggggtcttttttcttcctcggcgccttgggtaaagagaagactcacataaacattgaggtcattgtccatgtcatctctcgtgagtactccaccactgggcatatgatctacaagcttgtatgcattgacaagcgtgtgaacgagaggttcaagaaggaagccgacaagatgaacaacagtctttcaagacgcctgcaagctcgacaagctgatggccaagcgggagaggggtctcaccatggatattgccctgtggaaggtccagaccaccaagtactactgcaccgtctttgatgctgctggtgacggtgacttcatcaataacatgattactggcacctttaatgctgactgtgatgctctcatcattgacttcatcactggctgcaccgaggctggtatctacaatgatggccacaccggtgagcataccctccttgctttcactcttgcagtgaatcatatgatcaggtagtggaacaagatggacgccaccactcacaactactctaa

SEQ ID NO: 51081 - DNA, 583 bp, Triticum aestivum
  unsure (1)..(583): unsure at all n locations
  Clone ID: PAT_TA_51081
gtgtgtataggacaaanagagataaagngatattggaaagcttaaaaccagccccacaaaaccactctgcnatggagaaagaagacaatatttggcatgatctgtttcatctactatagaattttgcttggtaaaggcctcatgtcacttggcatcaaagagctcaagatgctaaaaagcaagttaattcatcctcaagacacatcatatgcttcatcatcgcactggtctctagagcaaggcctcctgaagcactcatgcatagcagatggctaaagcgtgctgatattgtcaagagagatcggggtagaacgaacttgacatgggaggagtccgtaaagagagatatgaagaactggtgtaccatcaaagaactagccatggacaggggtgcatggaagcttgctatccatgtgccagaaccatgagttagatgcattatcttatgggtttcacctctagcctaccccaacttatttgggactgaaggctttgttattattatttttattgttacatttctgccctttctaggaggatttcaattgttttcccaattttccttccaccattttgtaaccct

SEQ ID NO: 51082 - DNA, 468 bp, Triticum aestivum
  Clone ID: PAT_TA_51082
acacacgtccagatccaaagacgccgacctgttttttttactttactttacgcaaccagggcacgtatggtgacggtgtgagaagattacactagggcgctgacagggctggctgcacgcccgcctctcttccttgaggacaacggccttcttttctatctcaatcccattagcccttaggggggagcctgcctgcacacaaactgcctgtaccactatcctttcacacacgaccccgagcacagggacacctacacccctctcttggtggccttgttgaccatccttatcgttctcggacctttctgatttatgttcctggcatgttcatcagcctttgcgcaagccttggcgcccgtaacgctggagtcactacccccatatttcacaccttctgtcgcgtccaatctacggccagtgaatatcaatgccgtttgctgtggcccttccaacaccccttgggagacg

SEQ ID NO: 51083 - DNA, 507 bp, Triticum aestivum
  unsure (1)..(507): unsure at all n locations
  Clone ID: PAT_TA_51083
gnaagnanaacatcttgatgcggtgttggtcnaaacacgtgaaanaacaagagagcatggagttgctgaaggacttgcagacctagcaaagaaatgcctagatatgtgtggtgacagcaggccctcgatgaaagagttgcgaatgagctcggcagattgagaaagcttccaatgtatccatgggtacgagtgggcgtggagacggatggagagagccttctaggtggagattccaccggtgttcaggaagtagaatctgactattctatgggagaaaatgagaaccaacacataaatctaggaagttcatattatgctaggtgacgaaagcaattagatactccattaagctactagcacttgcgtgcatagcttctttccatacgtttttctctctgaatattgttaccatgtgtatttgccccctgactagcattcttgaacgtgttttatgtgtatttgatctggtcacacatatttggttggattggatttgaacaaaaggga

SEQ ID NO: 51084 - DNA, 421 bp, Triticum aestivum
  Clone ID: PAT_TA_51084
ggcgggcggctactcttgggtctgctcgctgtgcggttaatacaggaggagaaagcaaatctctacaacttcacgatgcatggagccaattggacgctaaaaccaaactgtgcttaataagacggtgtagatccgttagtaaaagaagcgcgcaacatataccagttttaccaggtgccatgaatagacatgaaaaaagccggaatgtcaaggctgcacaataaatctaaactggggtcacccatgctgcacataggagcatccagacgcctacaaactcatttgatcgttctctagcactcctactttgtcatcatccatcagaccaactggctgacagctgaagacaatgctagcacagtaatatcttataacgagaaccacaaagcctatgctaaaaactaggttggtgaatgtagct

SEQ ID NO: 51085 - DNA, 579 bp, Triticum aestivum
  Clone ID: PAT_TA_51085
cttcaccgccgaggctcgtcggtggtgcgccgccgtgccggcctgccccctgtagagcctgcgtccgccgggctagctggccggcgcctctccgccgtggatctggcctcatccgcctcgcactccccacccgcatcgttccccaaccgctcctccttccgccaccaattcaatctgacgggacgagagcagggggagcacgggcgcgtccgattcggtgcagtctcgtggtggtgctttggcgggcatcttctcgtctccgagccgccgaatacgacagatcccacccgcggcgccgattccattttacagtgagaggtattggtggtcctgatcatggtgttcagcaaggtggaagtgaacctcagaaggctgcttcaggaggctcctcggcagcagaatcaggccaagcttgcccattacgtatccacagccagggagctattggagcagcttggaacagaaattacaactgaaggagtatcaagggtttcaaaaactaagctcagtgagtattcagaaaagattgaagcactagctgccacactggctgctagtgcttcaaccttttcaaaaact

SEQ ID NO: 51086 - DNA, 593 bp, Triticum aestivum
  unsure (1)..(593): unsure at all n locations
  Clone ID: PAT_TA_51086
acagctattcttgaagattgaaaacacgttantcatctgacgatgcagctggaacagtaaatgagattgggtcaacaatccggaaggtgatgggtggaacaagtggaatcctgtatgacatactctgcaaggctgcatatgcaagcttaaaacaaaacaaaaatattacggcatatgaatgggctgatgctttagaagcctctattgctgctgttagcaaatatggtggtgccagagcaggatatcgcacaatgttggatgctctgattcccgcttctacagttttgaaacagtcgcttaaagctggggatgatccggtgactgcattcatcgcttcttctgaagcagcattagctggcgctgaatccactaaacaaatgcaagcaaaggcaggacggtcatcgtacatctctcccgaccatctggtttcaattcctgacccaggagcaatggctgcagctgcatggtaccgggccgcagcgctttcggtgaagaacaagctgcatgcttcagaaagctagtagtagtgcatgctatgcctcattcacagtccaaaatactatactgacggcgaaatcctcaggggcctttgt

SEQ ID NO: 51087 - DNA, 407 bp, Triticum aestivum
  Clone ID: PAT_TA_51087
gcagcccgtctgcgatcgtgtctctgggtctgcgacgcacccggcttgccggcacggctgtcctcccaaacccctacagccgccgcgtgctttgggccgcttgtgaacggagtgtttccttggctcggctcctagacaggagcggagaggaccgtaggggagagactgccggctccgccttgaaggtgccttgcgatgctcagggtgcgagcggggcgccgtttggtgggaccctcggttcctcgctcggctgggtgcttttcctggtgggcgtagccgctgccggtggggccgtctcgcccgggggcgccgatctgccgctgggcgggaggttaggtcgggggccggtcaggcgctgtgcctgggtggcgagctggggagttcagcctacgggcttttccaagtgg

SEQ ID NO: 51088 - DNA, 585 bp, Triticum aestivum
  Clone ID: PAT_TA_51088
catttttcgaggaagagagcctaagatgatggagaacctggagacttgaagttcaggattaggacagcaccacacgaccgcttcagaagagaaggcaacgacctgcatgcaacagttacaatctccctgctccaagctctggttggattcgagaagaacctcaagcatcttgacaaccatctggtccaaatcggctcccaggtaagtcaccaaatcctgaacagtaagggcctctttgattcataggattttgaaaatgtaagaataggaaaagtataggattggggtggcatgtcaacttgaatcctataggattagcaaggagtgtttgatgttacatggaaaacaaaggaaatgtaaaaagaggttggagtggatgttaggtttcccatgaaatgtagtacaaaagattccataggaaaaattcctatgggatccaatcctatgaatcaaagggccaacataggaaaaattcctaaggatttcaatcctctagaaatcctatagaattcctttgaatcaaaggagccctaaatgattctttttgcatcctgtaggccactaggctcatctgcatctaatcta

SEQ ID NO: 51089 - DNA, 588 bp, Triticum aestivum
  Clone ID: PAT_TA_51089
cccagcgtccgcaaaaagcttaatttgtttctgcattctgccagtcaaactgtggagatgttagtccaaatgtcttgggagcattttgtacagacaccaaccgtccttgtgactttaatcacagtacgtgtaacgggcagaatgaattatgctacggacgaggcccgggatatcctgacgaatttgaaagtacccgtatcattggcaataggcaattcctcaaggctgttgatcttttcaattcagcttctgaagaaatacaaggcaaagttgactacaggcatacctacctagatttctcgcaactcgaagtgaatgtttcttcaagcacaggaggtcagcatcagacggtgaaaacatgcccagcggccatggggtttgcctttgctgctggaaccacagatggtcctggagcttttgattttaaacaaggagatgtcaagggaaacccattctggaggttagtacgaaatgtacttaggccaccgggcccagagcaagtgaaatgtcaggctccgaaaccaatactgctagataccggtgaaatgaaggttccatatgattgggcaccttcgatacttccaattc

SEQ ID NO: 51090 - DNA, 522 bp, Triticum aestivum
  Clone ID: PAT_TA_51090
cccagcgtccggcccgccgccggaaccatgcaggagcgggcctacgctggagccgatcctgccaacaccaccaccaccaggcttcggcccgacggcgcaaccatgctggagccggcctacggtggcgccgcctcctaccccaccaccaggcttcggttcgcgccaggtggcgccgcctcctccgcacctgtcctggggcttgccgttgcgaccgacgtcggacccaggagcgcctacgttcacgcagaatgttcagcctgcaggtccggcaccactctggcgctcggcgatgtcgccgtcttatccggcaccgtgctggggcgcgccttctgggccgccgccggcgcaagcgccttggagctggccacatccaccgtcgagctgggcaccacctcatatgctgcgcccgccgccgacaccctgggactgcatgaggccgattgcacctcctatgccggcgaaacacccgtggcattttgagatgcaggatacgccaccggcaccaggggcgtgctcgggcag

SEQ ID NO: 51091 - DNA, 359 bp, Triticum aestivum
  unsure (1)..(359): unsure at all n locations
  Clone ID: PAT_TA_51091
ttcggttggcctcctgcagtctccgggctggggcggggggcgggctgntctcccggggctgggggctgctctcgtcggccgtggcgctctggggcggtcccgccgccgctgggctcgccgtcctctccctctgtggcggcgtggttttttttgcggtctncctgtgcccccctggcgggtggggggggcggccggcctgggcctccctggcctgggccttctgccgggcggcccctgttgggtggcgcccgggggcgtttgctcgtgtcttctctcgtgtctccgtgttcgtgtcggcgtcctctcgggcccgttttctcntttgcggtgcttttcccctggtgtggtctggtcttctc

SEQ ID NO: 51092 - DNA, 405 bp, Triticum aestivum
  Clone ID: PAT_TA_51092
gtctgtaggaagcaaaccaatttgccaaagcaaatcagttctacgtgcacagcagtaattctacaccgatcggcaatggcgaccaagatctacatcgtgtactattcgacatgggggcacgtcaccacgctggcggaggagatcaagaaaggcgccgactccgtgcccggcctcaaggtcaccgtctgtgcgggtgccggcaaacgctaccggaggaagtgctgtggaagatgcacgccgagcccgggcgcgaggaccattccgtcataacggcgcggtagctggcccacgcctactgtggcctgatctggttcccgacccaagtcggcatgatggcagcgcatatgaagggcttctttcactccaccggcggcctctggcactagggggccctcgccaggtagc

SEQ ID NO: 51093 - DNA, 523 bp, Triticum aestivum
  Clone ID: PAT_TA_51093
aatcgtgttcttgtgctaaacaccgccaatttctttgatgatgaggggatgaaggccctctcatcctcaccacatctggagacactcgagcttatattgtgtcatgcagtaactgatgctgggatgcgcttcattgcacacaccccatgcttgagtaatctcacacttcgggcgtgtcataatgtcactgatgttggaatggctgaactgggacgtgcacataaattagggtctttggtcattgagtattgtggtgaggtctctctgcaagctgcgcagggtgttgccaagtcagttcactactccgaggactttccagattccctgatgaaggcaattggtcatggcgcctagtgatgaagtggtctccaaaattttcagtatgaatttgctgctgaagccattaagttgtttagtgtgcatcattggacaaggctgtgcatcattcgacctagattcacttgtctggactttctattgccttctacctttactgctatgattttttctgtatgacagtcta

SEQ ID NO: 51094 - DNA, 385 bp, Triticum aestivum
  Clone ID: PAT_TA_51094
gtccaacgagagtaggctacggaccacatctccaccgcactggtttgctttctctcacgcctgcaaggcgcgcactaaagcatgaattgtcatgctttagaagacatgccgatgctgaactctattgttttcagcgggtgctggtgtgaaaatttgtgcaatgtctcggaaaattgcaatgcatgcttgtggcactctccgtgtcatcgtatctggagcaatattccgcttgggctgcgacatcagactagtaatacctgccaagaactatggtggtctgtagaatcggtgctcctaatgatgctgcttgccctggttgtgatatgactgttgaatcgatcagtcgctcgtattctgtgcctgggcgtaaaaaaataataaagat

SEQ ID NO: 51095 - DNA, 607 bp, Triticum aestivum
  unsure (1)..(607): unsure at all n locations
  Clone ID: PAT_TA_51095
agccagcaaggcacgtcgtcctcgaccgataatctccgtcggcgctaggaacaatcgatggctgcggcggctggtggtggtgttgcgggggtggcggggtcgccgtgcggggcgtgtaagttcctgcggcggcggtgcgtggccgagtgcgtcttcgcgccctacttcagctccgagcagggcgcggcgcgcttcgcggccatccacaaggtcttcggcgccagcaacgccgccaagctgctcgcgcacctgcccctggccgaccgctgcgaggccgtcgtcaccatcacctacgaggcccagtcccgcctccgcgaccccgtctacggctgcgtcgcacagatcttcgccctccagcagcaggtggcgatcctgcaggcgcagctgatgcaggccagggcgcagatcgcgtgcggcgtccagagcaccgcctcgccggtcagccatcagtggccggacagcagcagcagcagcatcgcctccctgctccggcagcaggaggtcaatagcggcagcttcgccaccggcggaccgcttctgccagagctcatgggtgggngacgtgtccatgctgcagcagcattgcggcggcaaggtggaaggcggc

SEQ ID NO: 51096 - DNA, 628 bp, Triticum aestivum
  Clone ID: PAT_TA_51096
tttagattaaagtgctttagatgattcttgcttccttgtccaacctttccatttcaggcatcatttctaagttgtatggcatccacgaatttcctgatagtttgttctgcacaggctgcctcatgtaggcttttggcgctcgtgatctaccttgattagctgacctgctcctaggcctacttcccctcccctcggacttctctccctctatgtatgatgtttgatatgtgttttggttcaaatttggcatgactatttgattgatgcttggtttagaatggaacaagttctataattggtagaagagtcctatgtcatcctttgtattttttgtcaggatggatgcttcataacaggtgtatggaagcacaaaagtagactcatataaactgcagttgcagtatcagcaataagcaagggaagtattacatgtttctatcaaaactgtgtataaatttaagagcttagcaagagaatagcatctctgttccaggagaaaaaaattaagagcttagcaagagaatagcatctctgtataaattttagagcttagttttttgcatatgcatgtaacagcaactcttttgtgttctggtcttaaatatcttattcatgatacagtaatctg

SEQ ID NO: 51097 - DNA, 635 bp, Triticum aestivum
  Clone ID: PAT_TA_51097
gtgaagtactccttctataaagaatataagagcgtttagttctataaaacatatttatatgtagttatccaacaaatttatgtcctaaaatcttacaacttctcttaagctgttttttgcaggaaagctgtatttgatcataaccttggcttaaatgcaatttaatttcaacctcaaatttggtgattttttgaatgggcacaactgtgtcggtagaggactagaggttgacagttatgaattttgtgataatcttcggttatactgttatatatagcactttccaggttatatggttcacattctctgagccaattcacaatgaccattccagatttgggccttgcatttttaaattattttgtaacattttggttgatctgtgatgttgctccttaattttttacattgactggtgtagaactaaatgagtgttgccattcaagggaagccccaagcttttaaacagtatatgaatgttgttagcttggtccttcacaaataagtcccttgatgtgtgtcatctgtcattgcgtataagatctggtctttctattttgcattgatttttcttctcccggtgcactgaatctgcaagggcgtgtagacggcaggatgagcagcagcatgccggt

SEQ ID NO: 51098 - DNA, 103 bp, Triticum aestivum
  Clone ID: PAT_TA_51098
cccacgcgtccgcttacaatccagtagcaagaactccttgcttctgaagcttcatggcgatggggtctttcctgatccctctatccctgctggttctcgccgc

SEQ ID NO: 51099 - DNA, 603 bp, Triticum aestivum
  unsure (1)..(603): unsure at all n locations
  Clone ID: PAT_TA_51099
caaccgcaccgcagcgcgcgacgcagnanattgattgagagagaatggcggcgccgtcgtccctcgcctcctcccacctctcccgcctcgccgccgccgccccggcgccgcagcaccaccaccagaaccaccagctccgcctcggctgctcccgccgccgcgcgcagcgcctcgtcgccatggccggatccggaaagttcttcgtcggaggcaactggaagtgcaatggaacaaaggaatccattaccaagcttgtctctgatttgaatgctgccacactcgaaagcgatgtagatgttgtcgtagcaccgccattcatctatatcgaccaggtgaagagttcactaactgaccgtattgaggtgtctgctcaaaacacatggattggaaaaggaggagctttcactggagagatcagtgcggagcagttggtggacattggctgccaatgggttattcttggtcactctgagcgtagacatgttatcggtgaagatgatcagtttattgggaagaaggctgcatatgccttgagtcaaaatcttaaggttatggcatgcataggagaactgttggaagagagggaagctgggaaaacttttg

SEQ ID NO: 51100 - DNA, 607 bp, Triticum aestivum
  Clone ID: PAT_TA_51100
ccaaaatcaagccggccgcgcgcggcgaacggcggcgccgccatggaccgctcgtggcttctcgccgccgcgaccggaggcggaggcccgccgctcctagcgggtctacttcttgaccgcgaccgaccgattcgggccgcggtggcattcggctacggggacggctcctgggatacgacggtgacgcgcgtcgatgacgccgccgccggggtggtcgccgtcgacttcgtcgaccgcggcggcgagagacgcgcccgtgcattcctcaacatcgaccgggacggcgtcctgctccgcctggtcgccgtcttcgatacggtggaccacgccacccgagagaacacccgcaacgtgttcgttgtatcgtctgcacgccgccctgatcccgctgcacccccaccggcccctctcctgctaggcctaccaccagcacctgccatccaggtcgattacattgtcatcgatatcccagacaacttccctgtccctgatgtgagtgagcacggctcatatgatggagatgatggacaatatgtacctccacttggtgctgacccgagtgcagctgggggcgggcataacatagcagatgacggggatgctcaag

SEQ ID NO: 51101 - DNA, 561 bp, Triticum aestivum
  Clone ID: PAT_TA_51101
ccatgcccagcattcatggaggtggagccccgcgaagctgcccgcaaactgctcctcttccccatccccgattcctctccaatctccaccgccgccgatccccacccccaccggcaacatcgtctccccgtccccggccccatccccacctccagccgacctccctcctcatctcgtccatccacccatgaaaacctccttttccaccgatccacccaccctcccacgtccacccatggatggatggatggatggggcgcaccagttccggcgacggcggcgccggatccgcacccacctgcgcgatggaggccggccgcatcgggatccaccgcctgctctcggtctggtgcggcacaccggaccacacctgagattgctactgcggtggccgtcgacgacggcgcatctccggcgggacctagatgcccaaggcatgcatccgtggttggtgacctcgtgtgccgccattgccggaggctggctggctggatcgacggacgtccgcggtgctggtgtttgcagccttacatcacagattcctgcagttccaggctgatt

SEQ ID NO: 51102 - DNA, 605 bp, Triticum aestivum
  unsure (1)..(605): unsure at all n locations
  Clone ID: PAT_TA_51102
gccgctactcccctgcctcccccanagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcagttctttgttggcgagagcatgcatgatgatggcggcgtggtgttcgcctactacaaggagggagctgctgatccaactttcctgtactttgcacatggngctgaaagaggtcaagtgctaatcgcactgtatgctaaaat

SEQ ID NO: 51103 - DNA, 439 bp, Triticum aestivum
  Clone ID: PAT_TA_51103
actctgtcttgttgataatttttttttcttatgttaatttttttctgcagcgggaaagggagcaaaacccttttctaggctatttaaaaaacaggatccaacgccggagaaagccccataaaaccaaccacccatggaccctaagatacaaaggggggacaaaaaaacaacgaacggggccaaggccaaactgaaaaaaaaaccttacggggggggggtgcaccacagatataccttagaagggcaaaggtggccgggttaatggagctcgcctgacaaaaaatgggggggccgaaaaaaccaaaagccgggttgtgcaacctttgccgggggaggaaaaaattcccatcgaaacaaaacgttctaaaaaggggggggcacaaacccccggggggagcaaaaaccctctgctttggagtcaaggccaaccccgggtgcc

SEQ ID NO: 51104 - DNA, 497 bp, Triticum aestivum
  Clone ID: PAT_TA_51104
accaacaaccaaatattatcgggctgcgacatttttcagctgatcatgtaaatatcttgttacagaacccgcatgcaagtgcgaagtttcgtcacacgtgatgtggggaatgatcaaccacacaattttcaatcaatccctgaaacagatgcggcgtaaagaaatcagaatcaacagatatccatctacccggtccggcatggtacccaagttcatggttcatctggagaaaattcccaggttggcgtgctgatcttggagttcttgacagggtcatctgaaattcccacacgacggcataccctttggcgtcgtgaaatccatgttaagaacgacactggcttggccctggccccctacatctatatttcctagagtagaactattgggacattggggtccttctcattggcttcagcagatttcttactgcctcgcttcttctgcttgttcttgaacctgaattgctctttcttgttcttctcccaacttttctt

SEQ ID NO: 51105 - DNA, 523 bp, Triticum aestivum
  Clone ID: PAT_TA_51105
gctcgcgactaaactcgccggcaccaccgctcctcctcctttcgaccaaatcacacatccgctccaggaaggaagccgcagccatgtccggtcgcggcaagggagggaaggggctgggcagggcggagccaagcgccacggaggggcggcgggacaacatccaggcatcaccaagccgacgatccggggcctcgctcggaggggcggcgtgaagcgcatatgggggctcatctatgaggagacccgcggagggctcaagcatcttcctcgagaacgtgatccgcgacgccgtcacctacaccgagcacgcccgccgtaggaccgacaccgctctgggcgtcagttacgcgctcaagcgacagggacgcaccctctacggcttccgcggctaagccgcgctcgaactcaccttgtgccggaaaaatagacggttagctgtggttggccagtggccatcgactacagtgtgagggccgcatgtcgctgctgttgctcactggtgtgtgcttggctgctctatgac

SEQ ID NO: 51106 - DNA, 324 bp, Triticum aestivum
  Clone ID: PAT_TA_51106
aggggcctaaacccaaacggtcttatattagtttaccggggggggataattcaggggggggcgggggaataccggcaggggggaatacccttataaattctaacaacactccccggggggggggtttttgtttaaccccttttaatttgtccccgggggcgggggggttcgggccccccggtttcttctcccgcctctttgggggggggtgggggtccggtctctggggcggggggggggtgccgtccgccgtcggggggcccgggtccgcgggggggttgggccctttccccggggtcttggtccgcggggtgtgggggggcc

SEQ ID NO: 51107 - DNA, 488 bp, Triticum aestivum
  Clone ID: PAT_TA_51107
gagccactcatgcagggcttgcgcctcctctaatatatagatatataatatgtagtacaatagtaacttgtaggatcagaattaacactgtataaaaagttcagtacaggttaatcaattgcctgtgtcctgcgttcttctagctcgatctggcgccgccgccgacccgattccaccagctagcagcactctgatagatcgtcgctgaggttgttggaagcttgcaaaatgcatggtttgatcttgatcatgatattcttcttctacagggagtagttggggcttctcatcatggcctgagccaggtactggaggtccccggggccgccttctccgccgccctccaccttgccgccgcgttgctgttgcggcctgggcccgtcccctcccttgagctttggccgtagcggcccgccggtggcgtgcctgccgcttttgccctcctgttgccgggcccgggtggcggtgccgttgctgctgctgtccgg

SEQ ID NO: 51108 - DNA, 370 bp, Triticum aestivum
  unsure (1)..(370): unsure at all n locations
  Clone ID: PAT_TA_51108
ccaagagactgtttatatacttataaaaaattatggacatttgggtaattcaaaagaccaaacaggcattctgaaccatgattaattaacccacttccctattttgacccaccgtgcggggggcgttcatanttcctttttattacacttttttaggccttcccggcccgggacccctggacggggggggaaattattttcggggccctttcctattataccccnncttgcggtttacccttcattattactctgtggcctttttttggggcctttgcacctccgttggttttcttgatgcatctggacagtttctcgggcggtgttttttttttcggttgcttgggtcttccgtcccggtccggccggg

SEQ ID NO: 51109 - DNA, 413 bp, Triticum aestivum
  unsure (1)..(413): unsure at all n locations
  Clone ID: PAT_TA_51109
ggggggtggggggttttttttagataaccaggaggcgtgcatattaaccaaggtgcataacaggttcaaacatacaaggttcttacaacacaacaggttgtaaaacaaacaccacataattttttttttttncngaccgataacagataaaggggggggggcggatcataggattgcagcagcntgccttgggaaagcgccaggaggcaggctctagtactcatcgccctcgtcaccgtcctcgccctcggcggactcagcaccatcttcttcgtgggccttctccagggcggcgcgatcctcacgggcctggggggactctgcctgctgcctgccctggcccgcgagcctgtgggcggtggcgcgcttggggggcgtcggggcgggcttgggggcggtggcggggcgtggcc

SEQ ID NO: 51110 - DNA, 473 bp, Triticum aestivum
  unsure (1)..(473): unsure at all n locations
  Clone ID: PAT_TA_51110
gaattaacaggtttcttgtagggatgtcaatgagttctacatggatcgattgatcaaatagtgaatatctgagaaatctaaatctgaactaaccaaaaaaagcaaacaatcttcaggctatgtaactgtacccacatgtctgctccaaaaaattggttacggaaagaaagggagtacaggggagttgggttcatgcctaatggacgaccaatcgttcctgctactccagcttcccgcctcccagcttgaattggtgctgccactacggccagcaggcatccgcctcgaagattcatgcttggctttttcgcgtacgccaacacgccctgtcttacccccgggatgctgctgttcttcctgccgtctacccgcctttgcggattccgggcaccgggttttttaaattcactgccgactccgttgacctnttctttttcgctgtggcgggggcccccctttcggggacttatttg

SEQ ID NO: 51111 - DNA, 462 bp, Triticum aestivum
  Clone ID: PAT_TA_51111
ggagggaccggcggcccattactaaaacaaaacaaagccaaggagtggcatcaaagcagcagcacccttagggacggaaaacatcaaagggcttaaccaaaacttccacaggcaaaaatcttcaaactcttacccgctaaaacacccagaccagtaaagtaaaggagggcccccctcacaagaacagggggggccccgcccccttgaagggggccttgaccttgcgggggggggggcaaaccttcgggaacaccaggggaaacttgatcttggagtgggggaacggcttcggggggcccctcttgcccagctggaagcccaccggcgcagtcttgatgatctggatgcagggggcccccccccggggccgggaccccatctccgggaacatttgctccaccccgccgttcagggtcgggtcggggaaccccttgcacatgtgggggaaaccggccctgctct

SEQ ID NO: 51112 - DNA, 528 bp, Triticum aestivum
  unsure (1)..(528): unsure at all n locations
  Clone ID: PAT_TA_51112
ttttttttaatcagacaaattcgtctatgtaaaattgtaaatacacantcacgttagaatagctgaatgccattgaggcttcagcattaatactcacttctcgctctgaaaataaaacaaaaacattatcctcacccgcttaatgcctcactctgtaacatacactcgttctacangctggtgcaaacagaatccgtcaggcagctctggcccgctccctgtccacagccaccttgggaaagctcccctcctcgncgaccttctgctccgggttgtagccgagcccgttggtcacggcgggcgtgacctcctttgtgtggggcctgttctcctgccggtcctccgtgccgttcccgttgcggtgggagcgcgcgaaccggccgtggtggggctttgtgagctcgtcgggtcgcccggggccgggctcttcggccccgtggcgccttctcgtgggctggggggctggtgcgtctgttggcgctccccggcttcccgtttggtgggtggttggtgggtgcccttcgcaac

SEQ ID NO: 51113 - DNA, 527 bp, Triticum aestivum
  Clone ID: PAT_TA_51113
agacaaattaagatacaccatctggtttccaattctcaacaaacacttgttccacggcgttaatccgctatttgcttctctagttgaggacgtagcatttcttccttatgcctccgtcaccgccggtaagcacgccgacggtgcccatcttgatcatggactcgctgaaatccctgaagaacgcgtcgtcgaatttgccggtagcgacgcgccggacgtattcctcggtggtggcgtcagtgaggagcgcggcgtcggagcggaagaggcccctgcgcttggcgacgtggcggtagtagctggtgtcgaaggtcctgtagctgccgggatccatctccgacagcatgctcttgtcgtcgacgctcttgcacttcagcctcagcttgtcggcgtactcgctgtccagcgacgggtcgacgaggccgttgccggtggtgttgtagagccggtcggcgaacgacgggcagtgcgccgtgccgagcgtgtgcgcgccggagaggacgacgaggtcctttgggccgagaccc

SEQ ID NO: 51114 - DNA, 352 bp, Triticum aestivum
  unsure (1)..(352): unsure at all n locations
  Clone ID: PAT_TA_51114
ggcggcggcggtaggggccgcttcggtggaggcggcggcgggttccgcgacgagggccctcctgccgnggtcgtcgtggtgtcgccgttcctgcgcgcctgcgagggggacgcggtttctttttttttttancgngnangngccctacttggggggggggggggggcctccannacaanacccanatcggcttagtcggcgagggcttcggccccctccgcgagtcatatttctcggtcctgatgttcgggggagtccttgcaccctcttaccccgccggtgtcctgtctcttcttgnccccctgtcgctgctgcccctctgccgcttcctgccgctgccttgggctcgcct

SEQ ID NO: 51115 - DNA, 542 bp, Triticum aestivum
  Clone ID: PAT_TA_51115
ccacaagcatgagcgcacttgaattcaggtgtgagtgtgaccactcccattcctgtcacgtacaaagaaaaaaactcccgtttcgtacagaaattccatgagaagcaaaatggcgccacgccgtattatttgtattcttcgttctacgaatcagcaaaatctcacattttttgacgcggtagccaggctgcctctcttcctcatcacttatttctaccatggagatggtggcctccatcaggctgtaactttcttcgacgtcactgagttgcagatggtggcaaagtccggacccttcaaagaggcaccgccaacaaggaagccatcgatatcttccttctttgctagctcagcacagtttgctgcatttacggaacctccgtagataattctaacggtagaagcaacatcagctgatacattggtttttaaccaatcacggacagcggcatgaacttcttgagcttgctctggagaagcaacctttccggttccaatagcccacacaggctcgtaggcaataacaacatttttccagtctg

SEQ ID NO: 51116 - DNA, 406 bp, Triticum aestivum
  Clone ID: PAT_TA_51116
aaccaacacatgggcttttattttctctttggcccagacccaatacgacaggacgattttttttacacccccccccatcaggggttttgcgggggaggttcattacccatttttattcagggctccccccccccggggacggattcagttcatgcggccccctccttggctcggccgaccccaaccggggggggggagcgactggttccctcccccttttccctctacgtgctcggcttaatcttgggccggggtgcccgtttctgcccgggggccgcgcccccctgggccccgcttgagcccccgaggccctggttttctggggttccccgggcctcagggggcgcttccccccgccgctgggggaaacggtcttgcctggccgggtgcggggcccggtttctct

SEQ ID NO: 51117 - DNA, 422 bp, Triticum aestivum
  unsure (1)..(422): unsure at all n locations
  Clone ID: PAT_TA_51117
aaccgcaaaaagcttatcttcgaaagatgttgacaagaaagtttgctgcntcattgtttctatatgccatcaaattaaattcttgcctgataacaaatgattttcacagcccaaaccatgaacatcatcaggaggtggggcagctatcttctctaccccccatatcaagtactggtttggctcccgtgcattgggtggggccggagcagctgccgatggggcctgagcggttgccaaatcagagctgactctttctgtgagtcgcgtagacgggcggaggagtttcccttgtggctgatttgattcagtctcgttgctggcganggacttcttctttttccctttggntctacgggttcgctccgttctcctctcccgcgcgggtcttggcgttctccttgttgctcctccggtcgccgctc

SEQ ID NO: 51118 - DNA, 467 bp, Triticum aestivum
  Clone ID: PAT_TA_51118
caacccacaatgggtcaattaatggaaggccaatttaacaaaggcgcaagcccccaaaaccccccaaaaaaaaaacaaaagggggacaggaggaacccgcccagccaaaaaagggggggggaaaaaaaaacggaagggggggggcaaaaaagcccaagggagaacctattaaaagggcttaatctttggctggagggccgcaaccagtgggccaaaggcttccccccccccgttcctaatttgggccccccacaggcccgccggaagccccccctggaccgcctggagcaaagcaacccgcgccccctaaaaggggccttcgccccccccgtatttaaggggcgccccccccacccttttagggggggccccccccagggggaccttccgggtttcccccacgggggctgccccctaccccgtttggacaaaaacggccccggggggggtctttgccctgggggggg

SEQ ID NO: 51119 - DNA, 471 bp, Triticum aestivum
  Clone ID: PAT_TA_51119
ggacaaacaacaaaacatggcatggaacccggagaaaaaaaaaacaaaaggggcaggggttaatcccacccaaaaaaggcggggggcaaaaaccagggagcccggcccaaaaccccaaaaaggggccgggccaacaaataaaccccccccccgaccagaccaaagggaaaccccgggggacagacaaataaaaacgcagccgacacttcccccccccggggaaggccccttttcagcccccatggcccccccctaggggggggagctttcgccggcaacggccaagggaacgggagcacccaggcgggggcccttcaaagcggaaaacatccccaggaaacggggagccccgcccccccccaggggggtcacggtcttccaaaacccaaaccccccgggcgggggcaacaccccctcggagacccggtcccagggggccccccaaaaaattcttttaaggcccccttaaaa

SEQ ID NO: 51120 - DNA, 547 bp, Triticum aestivum
  Clone ID: PAT_TA_51120
tttttttttttttttttttttttttttttttttttttttttttttttttttttttttttttttttcaaaaaaggggcctccagcgggcgtaataaaaaagttcccaacaaagttttttatttcccgcaactccttttaataatggggccaaacgcgggtcccgtcggaaacatcgcccgcacgaccaaaaggggcaccccccccccattaaattcccctcaaaagggggcccccccccaaaaaaaccccctacccaaaaggtcccggttggcttcccatggggggggttttcagggttaaggggcccatcccccccaggccccccatggcggggccctttttcccctttttagaaccccctccggggaggccccccgtgggggccctcggggccgaccccctggcgggttcccccaggggggtttggacccccttcggggggccggggatcccacccttccccggggcccctttttccccttgcccggggccctccccagaaccagggttcttttgttccaaaagctgggccaaaacaagggcccct

SEQ ID NO: 51121 - DNA, 393 bp, Triticum aestivum
  Clone ID: PAT_TA_51121
gctgaaaactgcgtgctattgccacaaacccttggtgtcaaacaaagggggtcgagcattctcattgttttttgtgtcaggacccatcagacaggcgtggggggggggggccctgcgtagagcgccctatactgcgcaacataaggggcctatccattgcggggtcgcaccgattctgtgtcgagagtgtcggtttacaacaagggtcgtcctgctatcagtggatacaccaatcgcccgctctaccgactcgagggatccccgagtgcttcttgcccgctttgccgaccttgacgggggagccgtgcctctggccctgtctgtccgcacgtggcacgtccttcaggcccctcttctggtgctcgaacctctgcaggcctcccgatggggcgc

SEQ ID NO: 51122 - DNA, 576 bp, Triticum aestivum
  Clone ID: PAT_TA_51122
gccgaggagttacccaggtatgtttgcttctcggctagcttctcgctgagttcctccgtccctgatcgaggacgaaatatggaggagcatacatggcgatggtactgctggtggcgctgttcgtcgtcctctcagccgccgacgtagtcggcgaagtagggcgagcacattggctaggaacatatcctaagagacatcctacaaagcacgtcataaacaacgccaacaaccaatggaacgctggacacaccgctgaactcaagaattacactatggagcacactatggataagctgaaagagatagccgacagctaaagcatcaccggctggtgtacggactaaagctcatacaaaaactgatcaaatatcaaaggagttccaaaacgggttcaaatgcagcgggtgaaggacaattggcaaaacacttgataaaagacactgtgaatgctgctgggctttctgcggcgcttatggtgcccaagatcgtttgtaagatcattacagcatgaacaatacactgtatatcacagacctagcgaatgactgaggggctatgtgtggctacatgtgtgat

SEQ ID NO: 51123 - DNA, 602 bp, Triticum aestivum
  Clone ID: PAT_TA_51123
gccacaggtgttcgaggaatgcctagacgggatactgtatcctggaactcggccatggctgcgatggtgcgacagggggagctggcaagtgcgaggaggatgtttgacgagatgccggagaaggatacggtaagctggaacaccgtgctggacgggtacaccaaggctgggaagatggaggaggcgttcgagctgtttcagtgcatgccagagaggaatgtggtgtcgtggtcgacggtggtgtctggttactgtaagaagggtgacatggagatggctcgagtgatctttgataagatgccaaccaagaacttggtaacgtggacgataatggtctcggcatgtgcccagaatgggcttgttgaggaggctggacggttgtttactcagatgaaggaagctgctgtggaacttgatgtggctgcggttgtgagtatcttggctgcatgtgcagagtcaggctcgcttgctcttgggaagaggattcaccggtacgtgcggacaaggcaactggggaggtcgacccatgtgtgcaatgcaatgattgacatgttttgcaagtgtggatgcgtaaaccgggctgattatgtctttgacactga

SEQ ID NO: 51124 - DNA, 576 bp, Triticum aestivum
  Clone ID: PAT_TA_51124
gtccaacccggtgtaccatgaggtcccggtgctcatccacgacggcaaacccatctgcgagtcgctggccatcgtgcagtacgtcgacgaggtctgggcggccacgggcccctcgatcctccccgccgacccctacgatcgcgccgccgctcgcatctgggccgcctacgccgacagcaaggtgcttgcgtgtgtgctgttgccccaacttttcctacagtagtgtttgagtttgagccgggtttcatggtcgtggtgtcttgcagctcttgccggcctgggtaggcatcatgtgggcggcgacggaggaggagagagcggagaaggtcgaggacacgctagcggctatcggccaattggaggaggcgttcggcaagtgctcgaagggaaaggccttcttcgccggcgattccgtcgggtacctcgacctcgtcgtcggctcgcagttgctctggttcgaagcgctgcagaagatgttcggcgtcgtggtcgttgaggtgggtagggctccgctcttggccgcgtgggtgaagcagtttggggagactgatacggccaaggaggtggtgccggacg

SEQ ID NO: 51125 - DNA, 545 bp, Triticum aestivum
  Clone ID: PAT_TA_51125
gcgggcgggacggcgtgcgccggtcggggtccggccccgaggccgggccggcggcgaggaagagggacggcggaggagggctcgacgaggcggcgctggcggccatgccggtgttcaggttcaaggcggagccgcgcggggccggcggcggcgaggagtgcgcggtgtgcctgggcgccatgcaggacggcgacgcggtgcgcgccctgcccgggtgcagccacgcgttccacgccggctgcgtcgacgtctggctgggcgcgcacgccacctgccccgtctgccgcgcgcgccctgccctcccggttccggcagcgaaggacggcggagaccgccggacgggagcttgacctggagagcccggtatagcatgcgtgcgtgcgccatccccgagctgtcagtgtggcttgaggcacttctcttatgggtttgagtacatgtttgtgttagcttgcttcgattgggccgataattttgtctcatggcttatcagttgtaatcctacttgacttgggcatattggcgatgatcagcgccgaaaatat

SEQ ID NO: 51126 - DNA, 615 bp, Triticum aestivum
  unsure (1)..(615): unsure at all n locations
  Clone ID: PAT_TA_51126
cccgcctgctcactgtcgtcgccgctcctgcgngacgctcgtctcttcgccgcgccgtcttcgaggagaccccacccccaccccccccggcgcggcctccacctcaggatcccctcacctctctgtttggttcatccatcatggtagttgtgatggttcagtgattgtcacttaagttataaaggttcgacgtttcctgattgtgcaagcagatgacaaaggtaatggatgggatttaggattcttgaatcatctgaagccaaacctgcgaagagctcacgtctggagaaaatagttgctccggaggctaacagtaacaatgatttgaaagcaccagtttctgcgcgctagcattgtgctgtcttcattggatatttctggtttcttctcccaactattgcatttagccaggtgcgactggattcgctcctcaggtcatcacaatccaaggtggagaggatgtagcagccaaagtcatgtcctattgtgggaatgggtgggcagtttttatcctgtctgccgagggcgccgtgcgcaatgtgacactgaagcaaccagcttcttcccgtggaactgttatttatgagggctattttgacattgtctgtttgtctg

SEQ ID NO: 51127 - DNA, 510 bp, Triticum aestivum
  Clone ID: PAT_TA_51127
ctcacgtgctcaacagcatccaagcaactaccacgcacctactataagctaggagcaacaccgtgcgtgctttggcaatggcgaggcgcctgagagtcgtgctggctgtggcggcggccgctcttctccttgtcaccgccaccggcgcccggtccgacaagctgaaggcgcccaaggaagacaagccgaaggggcctgctgagaggccgcccaaggcccaggggcccaagctgaaggagcccaaggaagacaagccgaagggcctgctgagaggccgcccaaggcccaagggccgaagtcgaaggcgaagccgatgcacgttaagtgcagcgagaactgcaagaaggacctcaaaatcactagttaatgcttatgcttgcaaaagtaacatcccaccagcgcactacatgtgcgccacttgtcgcaaccttgtagattttttttcgtatttgtattttcaataaggttcatctcttgaaccgtgtatccaaattctgaaccattttaatc

SEQ ID NO: 51128 - DNA, 539 bp, Triticum aestivum
  Clone ID: PAT_TA_51128
cagggacaaggacagggtacgaggtagaggtaccctgccttctgcatagtgaacaaggatcaccggcgaatgcttcaagcactgcaccgggcatggccacccggtgaagctggtgccgtacaacccggcgtaccaggactagtcggtgctgaggacggagagccgggacttgggcaagaggcttccgatgattgcgcatggtgaacaacatctgaccttaacttcaacaccttccacggggacaaggtccatgggagagttcacgacagtaccgagtagtgctctggaattggtgcaagggcgacaaccaatgttggaagatcctcccctggtagatgaagcgtcaggagagctggcggattgacatctactcatatccttggattattgcggggacatgcccaacgagtactggtacttgacattcgttcgtccttccgaagtcgatcgttaaactctgctcgctgggggaaaataatgatgctgtgtccaaataaaactgtgtgcgatgtgtggacatggtgtctgtgggctggcgt

SEQ ID NO: 51129 - DNA, 584 bp, Triticum aestivum
  unsure (1)..(584): unsure at all n locations
  Clone ID: PAT_TA_51129
ctccgcccgcgccggccgtcctaaataaacccattggctcgtgccgcagtgcggctgctgccattaaaaccgcgatactatactaatccggccattaatgcccttaactcgagctcgagatcggaggcgaggaggggcgtgcgtgcgcgcgcgtgtacttgctccgccacgtcgtggcccgtgtcgccgtccgtgcgctacgctacgtgccgccccgccatttaaggccgcgcgccgctcccgatttcgctttccgggtctgtcgctgtccgtcggtcagagggggcgtgcgtgctcgcgctcgccggcggcgggatgctcacgtgcatcgcctgctccaggcagctcggcggcggggtgccgccgctgcacgagccgccggaggacgaggacgtcgtcgatgccggcgcgggcgtgggaggcgctgccacgcccagcacccggcaggccatcaaggcgctcacggcccagatcaaggacatggcgctcaaggcgtcgggcgcgtaccggcactgcaagccctgcgccggctcctccgcggnggcctcggggcgccaccacccgtaccaccaccgcggcggcag

SEQ ID NO: 51130 - DNA, 600 bp, Triticum aestivum
  Clone ID: PAT_TA_51130
caccaacgcacgccatttacaatctattcccccgggcgtaggatgactacagtggagcggacgacgtgagcgcacgcaacgggccggcctcgaataggggggcacggctcttattgtgtccctccgatgaggctatagccacgacctttgcaacctcacatcaataaacttcaaattgggagggcaaccctctcaagaagctgtaccgtaccacgaatctcaacaactaaccaaatgaacgttactacgagcccttctgatcaacgtgtaagaactatcttgatgaaaggcaccgacaattaagttagaggctggtcttactagcttaaaactaggagaggataacataccaccacgtagaaactgtgcataagactctcacgactatcttaaaagggatcacgaaagctataatgacacccctgaccatgactctgaggcactcatgagaaagctcataaggtttaaatagaagaccactgtagacagggttagaaacgatcactggcctacagtagcaagagtccttatgaaataagctgagctcttgccaagaaacccactgaccaatatgaatgactccggctgcttccatgtgaa

SEQ ID NO: 51131 - DNA, 358 bp, Triticum aestivum
  Clone ID: PAT_TA_51131
gggggaggccaaataataagaaaggcgggaccctttcttgtttgtcgaggtgtaactatgttttcagtcagatgctatttgcatgcgtcctgatctaagatctcggtttttattttttttttctcattgctaccatgcctgattggggggggggctgttcggttctctgtgttatcacttggcttaactgggtggattttgcatgtggtctgcgctgtaccttccgttcgcgcccgcccggtttccctgtccccgcctgcccgtcttccgctcccctcccttgtttagccggtgggggcccgttttcgggttccagttttccttccccgcgctttggctggcttcgctctttttttgg

SEQ ID NO: 51132 - DNA, 255 bp, Triticum aestivum
  unsure (1)..(255): unsure at all n locations
  Clone ID: PAT_TA_51132
gtcgcctgctctccccgctcgcgccgcccgccctanaaagcccgcgactttctcgccgccgccaacccccgccgccgcaggnatggccgaggacacggagacgaggcccgcgtcggcaggcgcggaggagagggaggagggggagatcgcggacgacggggacggctcctccgccgcggcggcggggcgcatcagcgcccacccgctggagaacgcctggaccttctggttcgacaacccgcagggcaagtcccg

SEQ ID NO: 51133 - DNA, 410 bp, Triticum aestivum
  Clone ID: PAT_TA_51133
ccgttttactaggtctttttctcttttttttttttctttttttttttttttttttttttttttttgatgggcgcgagcggccaccttaatagcaaggggccacgacacgaactccgggcccctgctttgcgaatcggcccgcttaaacggggggggggcggggggttgtccagccgcgcgggggggcagggcgctcccctccgttcttcgccgcgtgcgctcttccccgcgggttctttggggcggggctgccctgggtcacctcgcgttcgtcgccctgttctttgtcgcccctttgctccgcggcgtcccctggcgctcccgggtccccgttccccgccctggcggggcgccgttgcggccgccgtcccgccgtgccgccgccggcgttgcgcctgcggcggggccgc

SEQ ID NO: 51134 - DNA, 485 bp, Triticum aestivum
  Clone ID: PAT_TA_51134
ggcttctgctgaggcatgcatactgaaaccaaggacaaatatggggcatggacctccaactggtacaaccgggggaagggcatacaaaaataacctactagcggttgaaaagaactttcgctggtgacacaaaacgacctccgcctggggcgacgattaattacaataatatgaactaacctggtatacacccccacaccccaacaatgccatggggccgtcttaaaaagggcagaagccttcgaccacatttttcgcaccaggaatcagctcaaatgggatgaacgatcaagttagccaatctgccatgaacacacgggaaactggcaactgggccctccacagaagcgacgaccataatatctcaaccgcgtcaactgtccgggagagcgagcaaagaaaatcagcgctgggaacttggcgatttctgacgaaactgctgcttcaccacctttgctacaagggccccaacggcttccttggat

SEQ ID NO: 51135 - DNA, 460 bp, Triticum aestivum
  Clone ID: PAT_TA_51135
aacggagaaaagggaggcttttcccacaaaaacctttttaaaaaagggacccccccaaaaaagggggaaaacgacgggaaaacccccaactattttactttcccaaaaaaaccccttacgggcacaagggaaccacaaaaaccccttttaactttttaaaggggggggccccccccccccttaaatttaaaaaaacccccccccaggggggggtgggggtccaaaaaacccggggggggaaaccccaaaaggcccaccccaggaaccattcaaaaaacccaccccgggaaaggggggggtttggaaaccccccccaacaccaggtttgggttaaaaaaaagggcaggttccaaaaaaacaaaccgggggggaaaaaaacccccgccgaaaaaaggctagaacccagggggggggtaacagccccccgggggaaaattgggaccacggaaaaaaatttttt

SEQ ID NO: 51136 - DNA, 216 bp, Triticum aestivum
  unsure (1)..(216): unsure at all n locations
  Clone ID: PAT_TA_51136
gggacgaatccgtgcgacctggggctggctctcagtggttcgtggcngcctggcccctctgcnccttatcttgccccgccgcgtctttncgtcgtttgtctttgtttctgncccccgcccgttgggtggggggggggggggcggccggccgcggcncttccgccggcccggcttaggccgtggggcgcccccttgggggcgcgcgctcccctctcg

SEQ ID NO: 51137 - DNA, 523 bp, Triticum aestivum
  unsure (1)..(523): unsure at all n locations
  Clone ID: PAT_TA_51137
agatacaaacacactgtataaaaataaaaataaaaatacanacatgagctcactatatgagcaatcctaatttggagtaactatctatgggaattctatttctgtagacaacctttgaaccatcaccaagactattacaggttacaacaagttgaggctgtttgcacccccacatctcaccatcttgttatttctttttaccagcaagacatgcttcagccttttattgatttattacaaagtagccgcttcatcggatttcactaacttggctttcagctctgcattctccctttgtaaccgttcaagctcggacttcagaaccgcgttgtcacgccgcagcctctccacctcaacttcagcgtttacatttcccccctaaaagaagtacatatatacaaggtgaaatgccaatgagaaggagaaagtgtctgaggttgacaatggactgctcaagagaatgttggtattctgattagatcgctactccgtgtcacctacattttcctgctctggagtcaat

SEQ ID NO: 51138 - DNA, 485 bp, Triticum aestivum
  Clone ID: PAT_TA_51138
atgtatattgtatttttttattttttatgttttttttttttaaggagaagagagggcggccccaacgaaagggggtccgaacacaagcacgggcggaaaaaaggggaggggggcacaaggctaaaaaaggagacagcgccgccaaggaggggccggcgacgggacagaaatgtaaaacggaagcggacggggccgcaccaagggagcaaatttttttgttcaaggccacggggaccaaaaagcgggcggctccaagcaaacgcgggtgaaggggggggcactgccgagcttggcagcggggacgccttgccaagcaaggtgttcccgagggggggggacgccccgcccaggtttgcccgagctagggggggggagctgacgacagggggtgggctcccgcgggccggggggagcgaccaaggggggggagatgtcgtctacctagccggcccgctgagaagcagcgccccccgggggggcgggaa

SEQ ID NO: 51139 - DNA, 204 bp, Triticum aestivum
  Clone ID: PAT_TA_51139
ggaaaaaaacacaggggggtttttcctcgggaaaccagctttaattaaccccggacagagggaccctcgagctcgggatcaaaaaccccacgggactcaacgacccacacgacgactcaaacggacggacacaggaacggaaaataactggctgacaaaaacgacgagaggggagatagatcgaaaacgggggggccccgccgc

SEQ ID NO: 51140 - DNA, 271 bp, Triticum aestivum
  unsure (1)..(271): unsure at all n locations
  Clone ID: PAT_TA_51140
ggttttgtgttttttttttaatggaataggggcaccgaattcattagtccacctcacatattantttagacacttccagtctatctggagaaatggaacttggttccacttacattttgttttgtcttgatagagctatttccccggcgggggggggggggttttcgtcctcccnggggcgaaggccgccgttcgtgctctgtggcgccgcggctgggccgttgcctctccctgctgcggcgcctcccgccgggtgtcgcgtcctcttccc

SEQ ID NO: 51141 - DNA, 538 bp, Triticum aestivum
  Clone ID: PAT_TA_51141
tttcttttttttttttttttttttttttttctctctatcagcctctgtttcaattccttctaagcaattttctttgcatttctaagcatatcgcgcgtacaaattgtagacacgcatcaaaccattccaccgtacaggcaacggggaagagacccaggataaaagttgaggggatagggccatacattcagaaggccaacacttctgtccttcccgacgcactgacaaactcaaaaggacccctgtccaaaatgcggggcatcattctgatgcagcatgccgtctctcatggtacttgtcaatgcaggtcttgccagcgactcgaagtaaatgatcttgggttaattctaggggccaagaggcatactcagcgtcctcccttctgcatcttgaatctaaacatgggccttgaaaaagaagcggaactagcaggtttctcactatcattactccttgggtggtcgatcactgagagaccttcatcgggttcaacaatagatcccgggaaagccttttgcccacctggtagtatctgccg

SEQ ID NO: 51142 - DNA, 294 bp, Triticum aestivum
  unsure (1)..(294): unsure at all n locations
  Clone ID: PAT_TA_51142
caaaacgcaggccgggcgggcctttgcntncntgtnctacttacttttactctcttgttnggntgttcttcacctttcgcagcgcttcgccagcatttttttttttttctganccntngtncnncncgtgtggggggggggggctnggtttttttcttttgtctgnngttcgggtgggggcgttgggcccttctgcttcctcgggttgccgtcggtcggggccttgggtttggggttgctcggtttggtcccggtgggcgtcctgtgtgttggttgggcctgtcggggcttgct

SEQ ID NO: 51143 - DNA, 315 bp, Triticum aestivum
  unsure (1)..(315): unsure at all n locations
  Clone ID: PAT_TA_51143
ctctaaacggccgcgcgggggggggggtgttcttcacttatcatcaccagtggtgcacagtcaagtnggattacanctgatangccttgagacanattttcggcccnatcgaagcaagctaccacaaacatgtattttttttttttngnagagtgcctncagccgggggggggggggggggatggcgcacgcccgcctgctntnccgggctgtggggggggggctcccgtccggcggcctccgccgtccttggctggcgcggccggtggggcggggcgcgcgcggggggcggggcgggtggggtgcgcgccgggc

SEQ ID NO: 51144 - DNA, 522 bp, Triticum aestivum
  unsure (1)..(522): unsure at all n locations
  Clone ID: PAT_TA_51144
gtccataaaacatttcataactatnatatcacgaagcatcatcgaggtacaaaaacataacttgaccacatccagggggccatacaacatataacgagactgaaaagttcaacaagtacgagcagaaagctaagcggggggaaatagtaggggaaaataagcatttggagctaggagcgaaaagctaggaatttaagctggctggcatttgaaataggaagctggtgttgaatgtgcgagccgcactctagtttgatgggcttcctggaccactagaggattcatttggagcagcagtcggtccagtagcacctggagtttcactggccacatcctgtttcatctcctccttctcatcagctgcaagccttccactagccacatcctgtttgatctcctccttttcatcagctgcaaacctttcactggcnccgtccggtttgatctctttttcctcagttagaaaacttccaatgaccacctgaacaggtgaagctgccctcagaggtcctgctaacccac

SEQ ID NO: 51145 - DNA, 185 bp, Triticum aestivum
  Clone ID: PAT_TA_51145
ttttgcggttcctcctaggaatctggtcttcgggatctggccgtcgcgaggcgcatactagagcctcgcgactacaaccctgtatggttgtttttcttgacaggtccctgattttaccagcatgatgttgaggactgtaatctttgcaaccttataagaataaatgaagtatgtgtttgttttgc

SEQ ID NO: 51146 - DNA, 500 bp, Triticum aestivum
  Clone ID: PAT_TA_51146
attatagtaactcttattgaatttcttttacgaaaaaaacccaaggcgagattgaggcgcacacgagagggctgtagccaaggcactcctgcaaggggagggattaaatagtgattgagaggtccttcatgaaggaatcgctgctcttaacgtgcatccaattagactgcgactgcgcccattgaaccttgggcggtctctcaccaggcccttagacttgtccaccttgggctccttcagggggggcccctgggcctagaacgaactctcatcaggcccctaccgcttgtcttcctggggggccttgagcttgtccaaccggtcggcggtggccgcgactaggcttaagaacgaccgccgacacaaccagcacgaccctcaggcgcctggtcattgccaaagcccgcacggggtatggtcctgagcccagagtatgagtcgtggtagggcctccacgttcctgttgattatcccgagcggacgcgtgaaaacgacccgat

SEQ ID NO: 51147 - DNA, 169 bp, Triticum aestivum
  Clone ID: PAT_TA_51147
aacccaaaaactctttagcaaagcacaaaattaactagttcaccagggcaaatagccattaagaaacaagcaaactcttccaaaaaaaaaccaacgggggggacacggaatttcaaggccaaaatagggtcttggccaccggcacgaacccaagcacgggtccggttac

SEQ ID NO: 51148 - DNA, 483 bp, Triticum aestivum
  Clone ID: PAT_TA_51148
caacaggcccaacaggaaaaacgaaaaacccccattaaatctttaagagggaagggtcaaacaacattcggtttaatttccccccaaaaaaccctcccttataaaagggccccatcccaaagcccaaaccccacccaaaagcaaaaaaaacccattcatttccccgggaacaaaggaggtaaaacaccactggggtggcttccttccgccataggaccaaacccaagggaaaccaggggggaggtccattcaggaggaaaaaaagttctggaggccccccccccccaagggggaccccccaaacccggggggggcaccctttttggcgtcccacaccggccccgcctgggcgaggggcacccacggacccttttgggaaacaaacggttaaaggaacagggcagggggaatggaccccccctggcggcccccggggttgaccatgggggccacaccaaacttgatgggtccccaggagcttcc

SEQ ID NO: 51149 - DNA, 529 bp, Triticum aestivum
  Clone ID: PAT_TA_51149
aaaacacaagcagcgggttacatctctttactcttacgaccaggggactacatataactcgtgcaggtaacatatatggtacagttgtgtcgaacaagatgatcttcggagttcaaaatcttacatgcctccttttcctagcgtggatacggtctcgacatcataacgggtacagcataagctgtccctgtccctatgcataaacttgcggcgggattcacttatgatggcgttgatgatgaaccgtttaggggaattagtctgtccaagagcttggttcttcgatacaacgtcatacttccaccttctcttcaccttgccggagccacagtttttcatcttgatcagtggggttcctcgcatgaggtgagcctcctttatgttggcctgtgcttttggttgctgacgctcctttctaaacctggcctcagctatttgttttttaatccttttgggctctggcatgactgcctcactgtgatcgtcattggcgtctgtgtggctttcatggtctcttttgagctccacg

SEQ ID NO: 51150 - DNA, 431 bp, Triticum aestivum
  unsure (1)..(431): unsure at all n locations
  Clone ID: PAT_TA_51150
ggggggggggttttttttttttttgacaggggctaaagcaggattgcctgtaaattccacacgcggttttaatacaggcgtaaaacacaacaacttagatcngttgggnnctgccaanatctttttggggggggcgaanntngancnnnnnnttccatcaatgtgggggggggaagaccccataccnttaaaaaaaaaagtntntcntngatgtttgatgttgagtatgctgggggtngggggtggtgttcgcttgcccggttagtgggtatttgctggccgggtgggcgtaggggctagggtggttgttcggcctggcctgggggtgcgtgggggggtttttatagtccattgtgagattggtttttggggcctttttgctgtgcgggttgacggtttcctgggtccgggtggggttgtccccgggaggg

SEQ ID NO: 51151 - DNA, 461 bp, Triticum aestivum
  Clone ID: PAT_TA_51151
ccgggagccaacaaagcattatacccccgaacaaaggaataccccccccattaagtccccgccccaaggggccaaaacccaaagagggtggcttaacaaaaaaatggcccggggaaaacaacccccatggggaaacattggcccacggataaccccgccaaggggggaaggaaggacaccacccggggcagggggttccagccccacaagaaaggactgggccgaaaactggctaaacggcagcacccccctgctggaaaggacaacccacccccccccccaaaggcatgggggacagcaaacccaactttgatcccgggggccccattaaaccccccaaaacccccccctgggatttcctgggaaatgggcccacccccctaaaagaaggcccccccaacatttggggcgggtttggcaaagccccccaaaaaaacaaaaccaggcccctggggaaacgg

SEQ ID NO: 51152 - DNA, 563 bp, Triticum aestivum
  Clone ID: PAT_TA_51152
atcacatatccctgctgcacggcgcatgccagggagaggggccccggctcaaggtgcccaacgcgatagcacgccacccacgccgactccgcctgagcttagggggtcggaagaagcatccgaggacgctcagtgaggcgcctcactgcttgctctacaagatggcggtgatttacgtcctgaagtccttatctgccgctgaaaaggcaggcagtgccttcatatgctcctcatcctgaacaacagactgaaatatgcatctgacctaccgagaagtgcacgccatccttatgcatctccatattttggctgatggaaaggtgcgcactgacaacacctaccctgctggcttgatggacatcatcgctcattctgcaatgactcgcagagaactacacgcttcagtctgacaccaaggtccgtactggccttcactttgtcacggatgacgatgctacaatcaagctgtacatgggctcgtctgtacatctggtgcagaaaggcatcctctacctagacacctatgatggccggacaatacgttacacagaccctctcataca

SEQ ID NO: 51153 - DNA, 391 bp, Triticum aestivum
  unsure (1)..(391): unsure at all n locations
  Clone ID: PAT_TA_51153
ccccgcgtccgcggncgcgtgggtgccattgnanaactctaccaggactcgcatagttatcgctgatacgaagatccacatacttggatcctttgttaacatcaaggttgccagggattcactctgtagtcttatcttaggttctcctgccggaaggtctattcgaagctaagggctgtatctgctaggatggcagaaaggtattagttgagtctgggtcacattatatagctgcagttttggccttgtaaggtgttgtatccgctgatttgtgtccctgtgctatgcattgtcttgatatgaagaacaacttggaagtgccgagagatctgtggtgatattccttgtgttctgttctcggctttttcttgggaaaatgctgttctgatac

SEQ ID NO: 51154 - DNA, 599 bp, Triticum aestivum
  unsure (1)..(599): unsure at all n locations
  Clone ID: PAT_TA_51154
acccaacgccgtccgnaaatgttcctagaaagacatgagttgtatagttcagcatcctgctttgtggtaggttgataatattccatttttatgattaccctgctttagattattcttgtgtgccttgtgcagcctttccattctaggcatcatttctcaattgtttggggtccaattctacaaatgcttggatgtgttggttcggccttctgttaatctccagatgataggtgaggcaggcaagttaattctctggtttctcatgatacttctaaaatctattgcatagtaggatacgtgcctgaaatgtgtgcacacttacaatttcggttgttgtggagttaaattataaattgatttgacacgatagatatatatagaaaaagctttcaaccaagcagactattcttttagtatataaatagtatggctatatacactgagtgcaaaagctatttgtttgccacttaagcttatatattttctttagctatcgtcctttgacattttctttatgcaatnggttggttgatcaagccgaggacttccctgcggtgcttggttggaccatgtttcattcagctaataaaatatatata

SEQ ID NO: 51155 - DNA, 561 bp, Triticum aestivum
  Clone ID: PAT_TA_51155
cccactcaaggccttactctgctgcggacttgatatcgaatggcctgtacgacgcagaccaggatccagaacaccggaagccgagccgccaaggaaccaggtggcaaccagagcggagggcacgttacctccggacaccagccggctgtccaaaagccagactcgctctcacgagccgctgcaccatcgtgctctcgcgcacagatcccacgggaccatacgaccacggcatctggtactgcgcacgctgacgttccagacgctcggggagacagatagtcgcaaatactttacgaccgacctgacgtggcaccacgtgagcaccgaccagcctgcaatacgcctccgaggcgtaattagcggggatcttcaaggacaccaagctgtgtgccctaccggcgaatggcgtaaccatgatgactgatgacatccatctcgcccgccggatacgtgccgagcgcgcctagagatgaacatagcatactacgacttgcaaatccgctgacgtaagaaatgacatggttgctgctgcagtgatgataagctttccacatgtgctga

SEQ ID NO: 51156 - DNA, 184 bp, Triticum aestivum
  unsure (1)..(184): unsure at all n locations
  Clone ID: PAT_TA_51156
tcggcctctcgcgntgctctgcactgtggctctgagctggttccggnaggatcgctttacgatagtctattggcccggtcgctataagtgcaagtggttgctctttgtcggagccagtgtccacttgtgcacgtcgaaaacttccgctggtggctgccgacggggattgcggggatttgtctgc

SEQ ID NO: 51157 - DNA, 597 bp, Triticum aestivum
  Clone ID: PAT_TA_51157
gggtccttcaccagcaaaactcaatcgatggtggccgcagtggcctggcttctgacatcaagctacctttcatctcggataagctagagtctgtcaagagcctgaggcgacatcttcttggttcagtcagagatgagaagctctcatttcagtatactggagagatttacgtcggtcaagggtgcagcgtgacacagacagtcttcaatggtattaacgtactcgctggtgttggccttctttccgctccgttcacgattcatgaagctggatgggctggtcttgcagttctgtctgtttttgcaattatttgctgttatactggagttcttctcaaacattgcttcgagagcaaagacggcattgcaacctatccagacatcggggaggccgcctttggaagaattggccgcttgatcatatctattattttgtatactgaattatattcatactgcgtggaattcattatactggaaggtgataatatgacatcaatctttcctgacgtcaatattaatttgtttgggattcatgtcgacagtaaacatttctttggagtgttaactgctctggtagttctgcccacagtatggc

SEQ ID NO: 51158 - DNA, 606 bp, Triticum aestivum
  unsure (1)..(606): unsure at all n locations
  Clone ID: PAT_TA_51158
cggctggntattaccacttaatttgtacccgatctgtaccgttgacttgtttggcatcaacaaaaccagtgaccctcgtcttttgtggaagatggatgatacactctctccctctcttaatttattttcccgtcattgatgcaattgtctcttgtgatagagattaatattttgtaatgcagtgttgctgagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaaaaaccaaatttaactaacccgggctggcaaggaaaaattttttttatagggcccccaaaattaaatccacgggccggggtttaaaaacggggggacgggaaaaacccgggggtaccccaattaaatcgcttggaaaaaaatccccttttcccaagtgggggaaaaaccaaaaagcccccacccaatcccctttccaaaaatttgcccaccctgaagggcaaagggaacccccccttaaccggcccataaaccggggggggggggggggtaaccc

SEQ ID NO: 51159 - DNA, 280 bp, Triticum aestivum
  Clone ID: PAT_TA_51159
cgcatgagcaagcacgacgacggcgacgcggcttcgtgccggtcatcgttcagatcctcgggttgatgtggccataatgcttaataacctagaggtggatcctttcgagagactaaagatcttccagattgcttgcgcgtgcaccgcggatgttacttttggagagaaaccaacgagggggcggggccagctgcaagtgggcttgctgcctggggtcgctactcttaggcctggccagttgatctggactcaggcagattttgctgacggtggtctagcg

SEQ ID NO: 51160 - DNA, 558 bp, Triticum aestivum
  Clone ID: PAT_TA_51160
ggggcgcgtgggtgcccacgctcctgccttggcctgctactaataccccgactatttctgctcgggtataactttgaagtatgtcaggtgattagaagactctctgatagaagtactttgactgtgtgatcggttgaccttaaatatactcctatgtaaggagtactcagaattcataacgctcgggactgctcgatttttacttttctacatctcatacggcaacatctacttccataaccgttttatgccagctaatctattatggacagtcatgtacaggaaacaacacaagaaggatattaatgctgaggcttcaaaaattagcgccttccaccaatagccgtattccaagttaattgtatgtgcttcacttgaagttatacagaacaagagagctgataagccggatgtccgtgatgcagccagcgaagcagctctgcgtgatatcaggagcggattaagaagaccacagctgagagcgagctaacttgtgaaggtgacaaaatcccataataccaccgtcttaggcaacgcccccaaacctgtaaaggccct

SEQ ID NO: 51161 - DNA, 606 bp, Triticum aestivum
  Clone ID: PAT_TA_51161
ggtaggctcgacagcttcgagcccgcgccgctgaggttcgtcgaggagctcccgccccccaccttcagcattggccagcttatagctgccttcaaaagccgcagcctcgacgagaaagacctcgtggtgctctctggtgcgcataccattgggaaagctcattgcgccaccttcagcgaccgtttccccaactccgactctgatgactttgtccgaaggctacaagataactgcaccgccgacgtgaaccggcgtcaggaccttgatgttaccaccccggaaaagttcgacaacaagtactacatcaacctcaagcaggggaagggggttcttacatccgacgtgcaactcctcctcaacgagaccacccgagggtacgtgaacgacttcgccgacaacgagtggtggttctggaaccagttcggcagctccatgagcaagatggggatgctccagggacctcaaggaaacgtcggccgcatccgccagcagtgctactagtctcatcgtacgtccaacctatcgaggtgtttgctgcctgcattctgcttccttcagatgggatcgtttttttatattcaaataagaggagatcacatagtaact

SEQ ID NO: 51162 - DNA, 273 bp, Triticum aestivum
  Clone ID: PAT_TA_51162
cttttcgaccaggattctgttttgtgtaggaggaatgaacttggggctctactttgcaggatcttatttgctgctttgtgggcacgatattgagacaactggaaaccgactttgttattgagtccgccctggtcctgggtctgctctgatgtattttaagtagctatgggttgcctaccgaaaacatcaggcaaacatattccggagcccaagaggctctgcgttctgtcttgatgttttacaattgagcctttagtctttctgcggtcctct

SEQ ID NO: 51163 - DNA, 607 bp, Triticum aestivum
  Clone ID: PAT_TA_51163
agttatcagctggactggacacgtatacagggaaaaagtcgacgaagacaaggagctagctatagggctagccaccggcgccatggagctggagctggggcttgcgccgcccaaccacgcgggctcgtgcgggaagaggggcgtggcggaggcgttcggaatcaagaaacccacgctgccactcttcctgggcgacgacgacgacgacggtggccacggccacggcgaagacggcactggcgacactcgcgactgggagatgggcagcaagaggaggaggcttgtggggtggccgccggtgaagatcgggcaccgtccgcgcagcaacggccacgtgaaggtgaagatggaaggggtgcccatcgggaggaaggtggacctgtcccgccacgcctcctaccaccagctccaccacacgctccgcctcatgttcccatcctccacttctcaccatggcgatccatacgccgtcacctacgaggacggggatggggactggatgctcgtcggagacgtgccgtgggaggagtttagcaagtcggctagacggctcaacatactcatgtcaccaccgacgactacacttggcactgctggttgaatgtgg

SEQ ID NO: 51164 - DNA, 544 bp, Triticum aestivum
  unsure (1)..(544): unsure at all n locations
  Clone ID: PAT_TA_51164
cacttccctccccggngtgatttatgagcttcgggtttactctctcttgaggaggcannacatttggagaaattctcacgtccagagcaataagagcggctcattgtttaacttccattcagttttcgcctacttcagagcacatactgttggcatatggacgtcgtcatagctcgttgctcaggagcattgttatggatgcggagacgactggaattcctgtatatactatcttagaggtttacagagtttcggacatggagctggtaagagttcttcctagtgctgaagatgaagtcaatgttgcatgctttcatccttcccctggaggtggtcttgtttatgggactaaggaagggaagctcaggatcctacaacacaatggcgcagacgctgcaagcatgggactgaattgcttcatcgaggaaagtatgcttgaggttcagaggtatgcgttggaaggctgaatgatcatttgcgtcatgagcttatatgtgtaccttccctggaacttttggctacaagctccgtttttgtttaggag

SEQ ID NO: 51165 - DNA, 106 bp, Triticum aestivum
  Clone ID: PAT_TA_51165
ataaggaatggcgcctattaagtgtgcggctgggcggtgtcgccttggatggcgcgggtcctcgtttgcctggatgaggccggccccgagtacaaactagtgccca

SEQ ID NO: 51166 - DNA, 165 bp, Triticum aestivum
  Clone ID: PAT_TA_51166
tactcttgcttgtcttcgctagaatacaattttgtaggaataccgacaggcttcgcaagggatagactgtgacctcgtgtattgctgcagagtctcgaagtgtgctgccatccataaacaccatcgcacacaattgtaagcaccggatggccactaatgcactat

SEQ ID NO: 51167 - DNA, 486 bp, Triticum aestivum
  Clone ID: PAT_TA_51167
attaccattactttgtatattccacaattatcaggaggcccccaagacacccatcatatgaaagggaccgagccaacattggagaggcggctgacttcactagagggggaggggggggctgactaggggaaagaggtcatgatacaagagagattaggactagaccggtttcagcccatgtcctccgcacgggaaggttgttttaaggggtccggggccggtggaggcgatcttcaggttttcatgcgggtgcgggctttgggccccggggaacgtggggtcctagagtttgccttggggagcctgggggagggtcttcgtgttgggggtggggttttttgggtggtgccgggggggcttggggtgcgggttgtcgttgggcggggggggtgggggggggtgtgcctggtggggggggcggtgtggggggggggggggggggcgggggggggggggggcggcgggggggggggggggggggggtgg

SEQ ID NO: 51168 - DNA, 472 bp, Triticum aestivum
  Clone ID: PAT_TA_51168
ggggaggggaaaaaattttttggcaactttattggaaccaaggaacaaaacaactgggaaacataacagccgggggggaaaacacccccccaaaaaaaagtttttttggccccaaaaaagctaatcgaaaaaacaaacaaacccccccaaaccccccaaactaaaaaaaagcgggggctaaaaactgggggggagggggaaaaccggagtaaaaacaaaaaaaaagggccccggctgctgctttgggtttggggggcaccttttttttcacgaggccaaaaaaacccccccggggggtcgcaccaccaccggcggcagaaaaagccttttttttttttccaggggccccggggggggccttggggccctttgggcccccccaatttcggcttgggccatgcccccaaacttttccttggagggggccctgaccacggagccccccacaaagagcccccccctcaggggcccc

SEQ ID NO: 51169 - DNA, 550 bp, Triticum aestivum
  Clone ID: PAT_TA_51169
gaaaaaaatccatatattagtaggtttagctgtggccaagcacgtacactgctttacacccgtttcagaatcattcttttttaaaccatgcaataggattgcatatattccagaggagtctttacacaatcggggatgatcaaatgacccaagctcacaccagcctactgcctagtatcaggatcgatgactctctggagcagcgcgaagacactattaaagcccgctatcttgtccctccatatgctccaaatgaccacggagataaaagcattcacaattttctttcgcccaccctgcattcttgacctagcatcctcgacaacccaggaagtagtctttgctgtaacaacaaaaagaacaaacttgtagggaaagatccctccatcttcaagcaacatccttgaaaggcttagttattcataatctagcgcctgagagctgagattatatcgcacagctgagagggtctcaatagttacataaaagggtaaacattgtagctggccatgaattatttgatagcagaaaatcttgacagaatagcatc

SEQ ID NO: 51170 - DNA, 486 bp, Triticum aestivum
  Clone ID: PAT_TA_51170
ggacaagaatgcatcaatagttaactgaacattttcattaccatttcgattgtgatacggagatacatcaggtaaacttattagcactaccgagaaacctatctcattcccttattacaaccagatcgaataacacgaaactgctacgggcaaaactgagagcgctccccacagatgctgcttgcaacctgagagacctatgctacatgatggcgacaccactagagacacatggcacacagacttgattgaactcaaacagccccagcataaagcctcggcggcctactagtattgagcagacggaggcagactgaatcctgagggcggacttgaagctctgagctatgtccatcactaggcgcatccaaggggagcttgaggatgactaatccgtgctctttggacttgcggatataccgagcgccagggactggcgaatcagtggtcttcacccgcggtgccgagccgattgcgcgccacttg

SEQ ID NO: 51171 - DNA, 429 bp, Triticum aestivum
  Clone ID: PAT_TA_51171
aaagagaaaaaccactcatcaattattcacaccccgctgcacatgggaaaaacattatttggatccacaagacacgatccaactccaagcaggaacgcgatgccaagcgcgtacgtgattcatcgattaacttaggtggtgtagtccttgaggatgtcgagggtgagctcgctggcgtcggtggcctgcacgtcgatctgcacgccgtccagctccttcttgagcccctccgtggagctggcgtacagcatcttgttcctcgcgtccgccgactccggcgaccagtggatgaagaagatcttgctgcggggggtctcgccggccgagtcctcggacacgaagtccaggtcgtagacggcgtagcggcagtcgtcggcgggcatggccgccgccaggtcgtcgaaggtggcgttttgcgcgcccaccttg

SEQ ID NO: 51172 - DNA, 189 bp, Triticum aestivum
  Clone ID: PAT_TA_51172
acaaaaagaacacttcttccttggtgcaaaccagtaaagcacacggttatgtacatacgaatcggagttacctgactgtggcttcacggggcccgagtccccctttttttttttgcccccttcctccccttttttgggggtgggggggggttttttccctctcccctcctctccctttttccgggccgg

SEQ ID NO: 51173 - DNA, 377 bp, Triticum aestivum
  Clone ID: PAT_TA_51173
ccccgggcgcgtctgcctgattttaagttgtaggcatttaactcccatcaccttaaggggggggtccgaatcaccgctacccgatccttttttttttttttattaataatacgcatcctggggggggggggccgtttattccaggatcgggggagttccgccgtctccggaccgaacccgcccgcgggccctcccgactaggcctcccgggcgtaggcgggctcctggagggcggtctcggcctcctgcccctccttctcggccttgcgcccctttttgctcttgtcgcgggcgcttctgagggcccccccggcccctttcttgtgccggttcctcctcgcggcgccgcgcgtgccccttcccgccgtggccccttc

SEQ ID NO: 51174 - DNA, 263 bp, Triticum aestivum
  unsure (1)..(263): unsure at all n locations
  Clone ID: PAT_TA_51174
aaagaattaacnttgcttggtcaanccnncntacgnattagtcgggagagnnaacttncggaagcagtctgtgtcctttgctgctacctgcgggagctgtttttttttttggcncgggnccatttttgtcttggtggggggtgggttcctcctgtacggatcgggtcctttncgtcgggggacctgggctccttcttgggggtggggtggggcctgtccgccggcgtggggggcgggtcggtggggcggggtggggccgcgtg

SEQ ID NO: 51175 - DNA, 422 bp, Triticum aestivum
  unsure (1)..(422): unsure at all n locations
  Clone ID: PAT_TA_51175
ggcgtatggacacactgacagtcatcatatcataaaaagaagatcagatgatcagccgaagcatacataagtattttgttggcgtacaaataacaaagataccaagcaagtgcaaggaaaacatacactgggcaatgcaacagaaacaacaatctgcaggcaaaacaatgggcttcagaagaagtcaacaaccgaacaagagctacaacaactctcagcacaccaccatcttagaagaaaaaagaacaatgcaaaggcagcatcgaacaaacaaacagccacacacacacacaaaaaaggaagatatcatcggatttatttatgcgccggaatgagaaactggggatgtggtgaactgcccgtcctcgaanngatggatgcactgctgcggcnntggctgctccacccagncgccttcactc

SEQ ID NO: 51176 - DNA, 203 bp, Triticum aestivum
  unsure (1)..(203): unsure at all n locations
  Clone ID: PAT_TA_51176
acgccctatgttttgtgtgtttgtatatgcgctactattgggggtctgaccctgttaaaagattctcgatgcattcttgctacagtgctcactataatttgcttgtagaggctattccgggtcttttttttgctcctagnatccctctttcgttggggggggggggccttttttcttcnctncccttttactgcccgcctgtt

SEQ ID NO: 51177 - DNA, 237 bp, Triticum aestivum
  unsure (1)..(237): unsure at all n locations
  Clone ID: PAT_TA_51177
accatagatcactctcacatatggtgagcatcctaagaaccatctttcacactgctccaccactggtttgtgcacccatatgctgcattccgacagcgaccgctggtttgagcgcatcnctttctcnccttggggggggggggggcatgctcctggctccggccttctcgttgctcgctgggggctccgtctcgcgctttccgcgccccccgtcttgcccgggggcctttcccggtt

SEQ ID NO: 51178 - DNA, 357 bp, Triticum aestivum
  Clone ID: PAT_TA_51178
accacgcttaacaaagcatatattattcaaccttgaggggagaggggaacaagccaacaaaaaaaggtttttttttcttaggttcaacacaacggtaacggggggggggggggaaaggtgggctttgctagattttcggtttcctcggagggcgcaagctggtaacgcctgctagcgcttgcccccccctatatatcctgcccccccgttatttggctggtttgcctgggcagtctgttttggggctggcggttgctccgacccccgggaccttggggggctcctttttcccagggccggcctgctccagggcgttcgggccgttcctcctcgggcccccctggggtgggcgggccg

SEQ ID NO: 51179 - DNA, 280 bp, Triticum aestivum
  unsure (1)..(280): unsure at all n locations
  Clone ID: PAT_TA_51179
accagnacacgcgacaaagcactacaggctcaattgtcaaacatcaagacagaacacagagactcttgggctccggactatgattgcctgatgtcttcggaaggcaaccctaatctacttaaaatacaacaagaacagactgccaggacctagggcggaacacactatcaaagacctttcccagttgttctcaatattcgtgcccaccccgcacgaataacatcctgcaaggagaaccacaagctcatcctacacacaaaacagaatcctgttcgaaaag

SEQ ID NO: 51180 - DNA, 140 bp, Triticum aestivum
  Clone ID: PAT_TA_51180
acagcccactgggaaactaagcatatagcccgaactgcagagaaacaccccaaaactaattctgtaatagggacagcactttagccacctttaaaacatgacaggggggacactatcagcacattggggatacaaaaatt

SEQ ID NO: 51181 - DNA, 467 bp, Triticum aestivum
  Clone ID: PAT_TA_51181
gatcaacacaccactgagaaaaattattacagaacccttgccaaaacttgaacagaaggaacaaggtccattccaatttctaccgttgaacagtttctgtaccatgtaaaaaccccaaactaagggggcgggccctcgacaaaggaaaaaaaaagcccggggtgcaaaagttcacagagggaaggggggatcaggaggggtcaaaaaaaggaagggggcctccggacccacaaaaaaataatacaagatggcaagaggcgcaaaggaacgggggcaacgaacagcggaagggcggggacgagcagcccccgaaacacttacaggggcccgggggagacacctactccttggtaaacctgctgacgcagggggcggacttggagaccttgccgaacgcgcgggggacgcacaaagcgcccgtgaaaacgcacctgggcttcatgagggcagacccgcggttggtcacc

SEQ ID NO: 51182 - DNA, 388 bp, Triticum aestivum
  Clone ID: PAT_TA_51182
gtacgctaagatcacagttcgcataaaaccgccatcaacatacaaaagacaggtcaaaaaataacggttcgccgaaccagcattgttttttttggggcgatcaaccacctaaggaggggggggggccacacgcaccaccgattcgacagcagttgtcagacacgggggatatctagcagacagctggacgaccggctgaggtcaggggggttaggcatcctcttcctcctcctcgccgtactcttcctcctcatcggcggtggcctcccggtgctgcgtgggctgaccgccgagaccgttcatgttgctttctgcctcggggagcctgctctcatcgctgccctcgccggggggccaagggcagaaagccttcctcctgaccctggcc

SEQ ID NO: 51183 - DNA, 231 bp, Triticum aestivum
  Clone ID: PAT_TA_51183
gaccggcatagggtcgttcgtttaactgcctcacttctgtctctcccatctactcgtggcgcgatctgccggcaaattttttatgttgcaggaccgcgactgccgctggggggggggggcgcggtccctcggtcttggggcggccgggaaccgccgggcgggccctcactccttgctcgtcgacccccctctcgggggccctgcccgcccggaccggcgttcttcctcccg

SEQ ID NO: 51184 - DNA, 555 bp, Triticum aestivum
  Clone ID: PAT_TA_51184
ttttttttgttcattctttattttttgtatcattttttctttcttgtttgttttttttttttttcttattccccgaccgaaagagagtggtgtccgccccacccccgtttgttttataccccggacggccggtcaacacggggggggggggggggggactctttccgtctgggcccgcccttgcccgcgggggccccagagctgcatcctcgaaacgaaatcggctccttgcacgacgccccccgcttcgaccccggcctccgccagcgtccccccctccggcccggcggggcgcccgtggccgccgcgggggggcgcgccgcccccggtgcccccctggacgggcccccgcggcgcccggcggacccggcgcggctcctgtcccgccgcctcccgcctgcgccgaaccgcgggcccctctcggtgccggcccccgtgggccggggcgcccccgggtcccccgcgggggtgccccgggtggcctgcccgggccccggggcccccttggcccccccgggagtcggcccccgttagggccccgccccgccccgcccg

SEQ ID NO: 51185 - DNA, 531 bp, Triticum aestivum
  unsure (1)..(531): unsure at all n locations
  Clone ID: PAT_TA_51185
actcgcccacccctcagccagcaccaagganggcaagcaagctgtaacggctgcccggcgaaggtgagtggtgaccatggacgcggcgagcggcacggccaagcgcaagcgctcgtccgccgaagccccggcccccgtcggcgtcgacgacgtgtccgacaccgaggtcgaggagttctacgccatactccgccgcatgcgggacgcctcccgccggctcgcctcgggcggggtcgccgccgccagggcccgcgccccggctccggccccgcgcgcgccggcctggtgccccagcttctcctgggaggacttcgcgccgcccgccccgacaccgccgcctgccccgcagcagcaactgcccgcagacgagcgcgtcgccgagaacgccacgccgccgcggcggcccgtcccccgcggcctcgacctcaacgccgagccggagccggaggtcaccccctcgnanaggcgcgaggactacgagccctgggacggacggacagacgtggggcgagctggccggcgacgatactc

SEQ ID NO: 51186 - DNA, 608 bp, Triticum aestivum
  unsure (1)..(608): unsure at all n locations
  Clone ID: PAT_TA_51186
ccccgcgtccggcagcatcagccaagtgacatcgtccatccattaagccagcaccaacttctcagttctcttcgtgcgttagcttttctactctgcctcgagtaatggcgaccatggtggctttgagttccttccccgtcgtcggccggtccgccatccgctctccagtggcggccccgcgccggaggaccctcgtcgtcagggcccagaccgaggtgagctttcacgtcacacacttgactgtttcgcatgctggctagttcgagactcgaccttaacgtgagattgcttgtgtatgtgcagcctggcatggagtcaaccaaggagacaacgagcgcatcgacctcctcctccccgagcacgagcgcgaccccgaccccgatcccggcggcacccaagcccatgaccaagaaggcgaacccctccgtgtgggacgcgctcgcgttcagtggcccggcaccggagcgcatcaacggccggctggccatggtgggattcgtggcagcgctctccgtcgaagcggcgcgcggcggcgggctcctcgaccaggccggcagcggcgctgggcttggctggntcctggntaccgcgggggtgttctccgtggc

SEQ ID NO: 51187 - DNA, 601 bp, Triticum aestivum
  unsure (1)..(601): unsure at all n locations
  Clone ID: PAT_TA_51187
caagctcaaaatcgccgtgttctcgcggnagtggcccgtggccacggcccccggcggcatggagcggcacgcgcacacgctgcacacggcgctcgccgcgcggggccaccgcgtccacgtgttcacctcgcctccgccgcataccgaggccgcgccctcgccctccgccgatgggcctcagctgcatttccttgacggcacccccggccagtggcggtgcgacgaggcgtggaagctgtacgaggccgagggcgacaacgatccattcgacgtcatccactccgagagcgtggcggtgttccaccggtacgcgcgcggcgtgcccaacctggtcgtgtcgtggcacggaatctccctggaggcgctgcactcgggtatctaccaggacctcgcccgcggcgaggatgagcccatgtcgccggcgttcaaccagagcctgtcgcagtcggtgcaccgggtgctgtccgaggtgcgcttcttccggagctacgcgcaccaggtggccatcagcgactccaccggggagatgctccgcgacgtgtaccagatccccggccgccgcgtgcacgtaatcctgaacggcgtggacgaggcgcagttc

SEQ ID NO: 51188 - DNA, 622 bp, Triticum aestivum
  unsure (1)..(622): unsure at all n locations
  Clone ID: PAT_TA_51188
gcccgtgtgatcttctggttccccngaggctgtggtttattccgtgtcatccgttagtgcggggtgtgttaattcgaggccctcgtggaggattcttgttgtaccggctgatctcggttttggtatgtctttgtcctctcaccctatgtagatgcagaggaagccagagggtgcgctagttctacagaggtggaggtttgatctcttctcatgattattttgattcattggttgaggttcagcggctgtcctgatatggtcagatcttctcgggtgatgaagcttaggatctcttaccaacctgaacctgcgatccgcgtgtggataatattaataaatccctcccaattttagtttcttggtctgcacactagtcaacggcaattctgatctgaattcgttggttctccaggaattataatttggattacacagcatagcaggagccgggagcaacatctgcgtttggatgattaattgccccctctatttaattcctccatctacacagttcaatcttagtcggttttgatttagatttgttgatggttgtccagaaattgggattatacggcttagcgggagcgacttgtcatcttcctcacctgtgtttggacgatca

SEQ ID NO: 51189 - DNA, 545 bp, Triticum aestivum
  unsure (1)..(545): unsure at all n locations
  Clone ID: PAT_TA_51189
aaacagggnaaatcccatgatgagaagcggccaagagctcggaaattgatggaatttcataatatcaagattagccaggttgaacttcttgttacttacgagggatcgaggcttgcaataaatgacctaaggctgcttatggatactttccaccgtgtagaatttactggtacatggaggaggttgttctcaagagttaaaaagcatattatttggggtgttctaaagtcggtgaccgggatgcaggggaagaagtttaaggcccagaaccagagggaaacacttgatggtgttgttccagaaaatgatcttaatttcagcgacagcgatggcagtcatcatggaaaacctgatcagttcccagtatcatggttgaagaggccaggtgacggtgcaggtgatggatttgtcacatcgattagagggctattcaattcgcagcgccgtagagcaaaggcatttgtggtgcgggcaatgcgaggcgatggagataatgaataccatgaccaggggagtgagagtgatggcgagtatccttttgctag

SEQ ID NO: 51190 - DNA, 507 bp, Triticum aestivum
  Clone ID: PAT_TA_51190
tcgcactcgccctttccctccaaccagcccggcacctgaagctccagcccgatcgatggcgcccaagccgagaagaagcccgcggctaagaagccggccgacgtggtcgccgataaggccgagatgacccccgccggcaagaatctatggcggagaagcggctgtcggcgtccaattccgccaaggagggcggccacaagaatggccgcaagaagaacaagatgagcgttgagacctacaagatctacatcttcaaggtgctcaatcaggtgcacccggacatcggcatctgcttcaatgtccatgttcatcatgaacttcttcatcaacgacatcttctagaagctcgccggcgatgcggccaagctgtccaggtacaacaagaagcccaccatcattttcagggagattcagacctgcgtgcgcctcgtcctccccggagatgctgacaagcacgccgtttcctatggcaccaaagccgtctccaagttcaccagctactagggt

SEQ ID NO: 51191 - DNA, 582 bp, Triticum aestivum
  Clone ID: PAT_TA_51191
cgaacttcttgcttcttccctttgattgttggtggacgtgtgattttgttgttgttcgggctggataggtcaagctgcaaagtagttgtagccagattactactaatttttatagattacttaccaggacgttgaacgaattcaattctttctagtttgtgtgctattgtatattttaacttttgtgttcctaactacggccctctgaatgtaatgttgttgttctgaattttaccctggcctgcccctaatcagtgtttttttggtttggtttcctgtgtaatgcattttggatacggtgatgcaggtgactagccgtagatgtggcctggtgtcccaagcttctgcatggagctcgccatgcttcaccaagaatcatgacgatgctgccttgtgctcgccatgcgcagaactagggtcgtgaggaggaagacaaggctacacacgaggaaattcgagacggaggcggcaccaaacataacttgagcctgatttttcttgctagcttagcgttttgctttcataggtttggagctctaaatttaagcttttgctctgaatcttcaattgatccacaggttt

SEQ ID NO: 51192 - DNA, 596 bp, Triticum aestivum
  unsure (1)..(596): unsure at all n locations
  Clone ID: PAT_TA_51192
cggncgcgtgggtctcgatctgagccgcgtaaaaccctagccgtctccaaatcagtcatccgccacccccccccccccggggccgccgccgccacctccatggacacttccctggctgccgccgctgtcaccgcagaggcctccgcccccgccgcggcatcaacggaaccttccgcggctcctgatgcctcccctgcagcctcctcctcctccgctgccgccgccgccgccgaagacctcgcggggggcgtggcggcattgagcctggacgagcggttcgacttgctgatgagcataggcgaggagtgtattcagcctgacgagctcaagcggctgctgcagaacaagcccgtccctatctgctacgacgggttcgagccctctggccgaatgcacattgcccagggtgttgtgaagacaattaatgttaacaagatgatcagagcgggatgcaaagtgaaaatctggatagcagactggtttgcacagctaaacaacaaaatgggtggtgatctgaaaaaaatccagactgtcgggcgctacatgattgaaatatggaaagcagctggtatgaaccttgatggtgttgaattctt

SEQ ID NO: 51193 - DNA, 512 bp, Triticum aestivum
  Clone ID: PAT_TA_51193
ccaaggcgatggtgaccgcgaaactcagctccccggccaccgcccggctcgcccccgtccggtccgcgcagcccgcccgccgagcctcgctcgtccaggtccgagcctccggcggatactacgccgacgagctggtgtccaccgacgaaaacagaagctcacccctgggccgtgtggatcattgcgatcgaccattgccagtgcaacatgacggaaagagattggcatccattggtcttggacaacacggaaagtgaaccagcaggcttacaggcagcgttttgctgaccactgatggtcttggagaatatatatctggagctaatatttaagaggaaactctctatcagtacaatacagatggcaagactctttgaagacgtcaagaaggaccacattattatgcaatgagatgaagtttaagacgggttaggatccatagcacgacaccaagaacgaattcgtgggccatggagcacaatgtgtaggcctccatgcgcaatgagcactac

SEQ ID NO: 51194 - DNA, 384 bp, Triticum aestivum
  Clone ID: PAT_TA_51194
aacaggcccccggacatacaaaagaaagggccacacaccgcaaagcattgaccgcacaatggacaaacacccatcggggggggccgttctgaaaaggaggcacacatcgagggccccacggggaaaaattttcgggggaggggcttgctagaaaaggagcccccccctcaaaatcaacggcccccgggttatggcgaaactttgaggggcttcgggccaaagaacaaggcagttccccgcctgggaattggaattctttggtaagggaaggcgcgggacagccttggtggggcaaaccgccaaccttgggggcagccccgggttgcctggaacagaaccccgttcccgagcacctctcggggggcgggccaaaaatttcccccg

SEQ ID NO: 51195 - DNA, 460 bp, Triticum aestivum
  Clone ID: PAT_TA_51195
aaaaaaaccggccgggtttaattaattaaataaaacagccgaaaacatggggtggcccgcgtcgaaaaaacgggaaaaaaaacccttctttaatggttaattaataataacgggggaaaggaaacaaggacccgggaaccgtggctcccagaaagaaaaaggcatctaaggtttttatgcgggggcaaaaaatttctctgggctggtcttctcttaacttaactggggggcaaaggcaacccccttggggatgctttgggccagctcgccctgggccttttccagccccgccctttaaaactcgttaaggggcccaaggggaaggacctcctgaacccccgaccggcccagccgaactttggacgcaaaaaagggcagctccgccaccggacaggctatgaaaaaccactccattatccgggggtcgccgggcagccttttaaggcccgcgtccgaaaat

SEQ ID NO: 51196 - DNA, 476 bp, Triticum aestivum
  Clone ID: PAT_TA_51196
aaaacgggggaaaccccaaccccaattgggccctttatggaaggcccatttaaaaaaaggcgggaggccccggaaccccccaaaaaaaacccaaaagggggacaagaggaacccggccaaccaacaaaagggggacggaaagggacgaaaggggcggggcaaaaaaaaagaacccaagggaaaaccccccaaaagggccccacccctggctggagggccccaaccaggggggggaaggcccccccccccccgttcctaatccccggcccccaaagggcccccgaaagcccccccttgaccgtctgaaaaaaaaaaaacccggccccccaaaaggggccccccccccccccgaatttaaagggcggcccccccacccctttaagggggggcccccggacgggaaaccccccggttttccccaggggcccaaaacccccccacgtttaaaaaaaaaccggacgcgggggcccccccgg

SEQ ID NO: 51197 - DNA, 505 bp, Triticum aestivum
  Clone ID: PAT_TA_51197
ggaaaaaaccggcgacagaattgggaaaaaagggagaacaaaagataggcacaaacaaacaaacagcccactcatttaactaacaacggggaaaaccaacatttaattaacccacggcctcggggggggcagaaaaaaaacccgaaaaattctaaccccatccggacatcctaagggccccactctctcaaccagctggaggcccgacgcttccaaaatctccagggcagggaggaaaatccccggttccaaaggccggaccacccctttcctcgggaccttgttcgggaacaaaagcagggctccaatcggggccggaaccccaacggggagggccatggggggggggggcctgccgttctgggtctttccaaactccaaaaggggcgctgggggcttctcggggggccgcccgggggggaaccccacctcgacttgaggggggagcagaaccatatccggctaatgggggccaaaggccattctcggttccattcgtgggaaa

SEQ ID NO: 51198 - DNA, 440 bp, Triticum aestivum
  Clone ID: PAT_TA_51198
cgagcataactgaactgggggagaaaaagaaatgaacagaaggggaatgatcgcccaaacacaggggaggaagaagacaggtcgttcccgctaagccgtttaatcccatttttggggcgcccttcaccaaatctaattcagacccgcctaagattgaactgggtggatgggggatttaattagagggggcatttaatcatccaaacgcagatgttgctcccggctcctgctttgctgggtaatccaaattatagttccgggggacccaccgatttcggatcggatttgccgttgtcttgggggccgcccgggaacctcgtgtggggggggattttttatttttttccccccccggttcgcgggttcaggttggtgggagtccctgggcttgctcccccgggagggtctgcccctttcgggccggccggtggccccgcccc

SEQ ID NO: 51199 - DNA, 497 bp, Triticum aestivum
  Clone ID: PAT_TA_51199
ggccacaacggattccattcatgaagaaaaggaggtttaccaagtacaaggagtagaacactcccaaacattggcacatcagtggggagttcatgaaacactggagccccttgactatttgccactactccaaaatccatcgtacatgaacaagtctggggccggggtcgatgtccatataaatacgggcgaaatcgcaatgcaaagctcccaaagcatcaggatcatttttcaatgggctgggactacaaggaagggggaatccgggaggcgcttccgttctcatttttctttacacagccagagtcaaaaagaatgggagagaaaggagcacacagtacatgatccaggaagctatcgatcagtcgacgcgatcttaatttacagaggagcagggcaagggatctacgaggatacgtccaaatccttgaagtactcgggctcgagggcggttcgggcgttgattcttcgggtgggatctaagcagagcattttaa

SEQ ID NO: 51200 - DNA, 486 bp, Triticum aestivum
  Clone ID: PAT_TA_51200
aagcaaaaaacaaacaaaccctcacttttgggccctttttggggccccgggggcccgagcgggaaccgcacccgggggggggggggcaaaaaccctcgggccccgagccaaacccccccccccccgggaaaacttcccccccctggttgccttgctctgggggccctgggccccaaacggggcaaaaaggggcttctcttttgccttcccaacctgggaccgggggaaaccccccaagaggacccctttggttttgaacaaggtacccttgaccctcagggacatggcaggggacaagggcttggaaaacttttgggccccacgggacttgcccaaaagggccctgaggacccccatcccccggatccaaaagaactggggggggagcccaaccccccggggacccctacccttaccaaaaccaaaggggcggcccttttgggtggcctcatgggccccccttgcccaaaacccggaggggacctt

SEQ ID NO: 51201 - DNA, 497 bp, Triticum aestivum
  unsure (1)..(497): unsure at all n locations
  Clone ID: PAT_TA_51201
aaaatatgggaaaaaaatatgccattccccatgatatgcctcatttattacacggggtttccgagaataatttgataatttcccgccaaaaaaaccctacactggagtagtactctatttggcagacgtgttagagccaaaccgagcctgaagctttttggcaaacaccacgggggggtcggggtccggcacaacctccctcgccatttgggttccgggaaaccgctccgcccacgcggccaggagcggggttttgcccacgtcaaagaacgtccccccaaactttttgggtattgcctcgagcccgaacaggttgcatccgacggggagggcggggtacccgacggagtcgccggggaaaaaaggcttcccttttgagcnctgggggagggccttttccaggttcggtaacaccacaagcgcctccttggccttttccgctcttgcttcctcagtcgccgcttttttgatgccgtaggtctggccgggaacacctt

SEQ ID NO: 51202 - DNA, 127 bp, Triticum aestivum
  unsure (1)..(127): unsure at all n locations
  Clone ID: PAT_TA_51202
ggggggtggggtgtgtttccaagagtagtgggtgtatatatatttgctttggatccattctgatctctagtggggtcctcctattttggacgtccggattagcagcntagaccattttttttttttt

SEQ ID NO: 51203 - DNA, 469 bp, Triticum aestivum
  Clone ID: PAT_TA_51203
ggaacaaaaaaaaaaaggggccctttcttcgcccgcaaacatcaaaacatagggggaaaaacaaaaccccaatttatcaaccaacggcccagaggggggggaagcagaaccccccccccaaccgaggggccaaaacaaaaccctggccccaagcaaaaaagcccaaacttcagggcccaaaaaataaagcaggccctgggggggcgggcccccccccacaaaacccagggaaaacagaggggaggggggaggaaccgacgggcttaatcaaacaaacggaaccccagggtttaaaaaaaattttccttttttaaaaccttccccccctttttggacccaaaagagggggcgggggcccccccaaaggcagaagggggggcccccacagaaggggccccccccccgggaggcccaggggaaaacttcccccttccaaaagcaaacactttggggaggccccggccttggg

SEQ ID NO: 51204 - DNA, 363 bp, Triticum aestivum
  unsure (1)..(363): unsure at all n locations
  Clone ID: PAT_TA_51204
aagaggcattggacattccatttcagtattattggatggacttttcaaggccagggggatataaaaaaataggggggttccaaatcaatcaaaaatttggtttacgggggggaacaaaaagggggctgcaccaaccgggggattcccccgggaaaaccaacttacatatggccctattctataattaatcgaaatcccttgggctttcngcagattgaaagccctaacaacaaaaggggtaaccgtaaaactcttgctgggtgttttagccgttgggcccattttcgtggggcctggnnctggcccccgggtcttcgggtcggacgggtggccttcgggccccttttttggggcccggtggtt

SEQ ID NO: 51205 - DNA, 505 bp, Triticum aestivum
  Clone ID: PAT_TA_51205
tttttgttttttatttattattttttattttgtttacgtttttttttcttttcttttttttttctttttttttttgagagcaaaaacccaaaggtatttcaattcaaattggggccccggaaaaccccccgacaacaacaaaaaccccaggcccgcgggggggccccaaccaaaaacccacccggccccacaaaaaaggcttgggagacctttcaaagggcccccaccaaaccgaggccggggaaccttttttagggggccaacccccccatttggccccggggggggcccccggggggccccctggaaagacctatttttgggaacggggggggcaacaccggcccaaagttccccgactcacttttttaagggccccccaagccccgggcccaaatctgggccgggccccctcccttttggggctccctcccccccccccggggggggggggaaccccccctcccccgcccccttctttggaaattttgcgggccggcccccg

SEQ ID NO: 51206 - DNA, 259 bp, Triticum aestivum
  unsure (1)..(259): unsure at all n locations
  Clone ID: PAT_TA_51206
cgcagnanagcaanatttttgtgggggggtgggaacttgggacggncacacatgagccgttttattgttggttctataattgctaccttgtcataggccgactttatctactggtccgtcactcttccttctgtttgcgggctgcctgcgtgtgcagactgcccaggattccgatgaccatgtttcgggttggntggncccccgtncccccccttttgcgcatcttcagttttggggggaactttggctccgctgtacg

SEQ ID NO: 51207 - DNA, 475 bp, Triticum aestivum
  Clone ID: PAT_TA_51207
ggcgggggacaaaataaaaggtaaggcaaaaatttctcaaaaggcccaccgcatcaaaaaaccccggcgactaagggtggcctcagacccaggggaccccaaacggagcatctcggcccctttatgggaaacaatccacagccagttaaaaatttcttcggggcggaccccccccccttactaaaaaccaaccaataaccttaaccccgggtcccaagggggcccattcaatttttttcacaaaaagcgcccccaaacaaattccccggccaggaccggcatccccctcattcggcggggacataaagggggggcgggaagaagtttgtttggcgcgagccccactgggccaaaactttcccagaaacctcttaaaaaaggaagccagctgggcccgggttaagcgggggggacaggaacccttgcccctcaaaaaaaaacgggagcttaccatctttggggggggaaacccccc

SEQ ID NO: 51208 - DNA, 559 bp, Triticum aestivum
  Clone ID: PAT_TA_51208
ccttgttttttttttttttgtttttttttttttttttttttttttttttttttttttttttttttttttttttttttttttttggaacaaaagagggggcctggaaggccccaggcttcttgggataaacccgggggcccatattacaccgggcccaaagggggaagggaacattacataaagccccggccttttacaggggggcccccaaccggaaagcaaaaaacgcgacggggcccttgacagccgccgcccaaatggacccccgccgcggccggggacaaccccctgggcccgacaaaaccgccggggaagcatccccgggtcgccataccctccgggccgccacgggaacggccccccttcgggcccccaggccggggggaatatggcccgcccccctccggttaaaaaaaacagggcccctacgagaaccgggggccttgggggggccccggcccccccccaaggggacctcggggggttggcccgaccctcccctaaaaacttgagggttccgggacctatccgggttctcttcccccaccgggggaaccgg

SEQ ID NO: 51209 - DNA, 569 bp, Triticum aestivum
  Clone ID: PAT_TA_51209
ggtggcttctcttcttcgatgccggtgccggcgtacacggcggagttggtgtcgccttcgtctggggattggacgccggacgccgcgtggaggggcctgctggcttcgcgccggtactcggccaccttgtccttgaactccgccacgctggcccccagccacgaccgcagctgcgccaccgggcacacgcgcaggtctgaagacgagaacgtctccaccaccttcttgcctgtcccgtactgcaggatgtatgcgtcagacgggggcgtcgacgactggcacggacgggagcgacgccgaccgcatcgttctaatggcctcgatgaccttggtgcggatcgccaccgcgagcactgtctcgcttgccgtgccgagctcacggacggtgcgcgacaggacgccgtcgagctccgagccgagcgcgcgcaagaacctcaccacgtacatctgggtgagcatactgtacaccggcgccgactccaacagctgcacagacaccacgttgtccgacgagctctacagcggtaccagcgcgcagtgcacgcccttgctgaacgtttacatgcagt

SEQ ID NO: 51210 - DNA, 506 bp, Triticum aestivum
  Clone ID: PAT_TA_51210
aaggacaacatagttgagcgtgctagaacactttgcacaatcactcatgtgagaccagggtaaattcaagaatactcgtgcatcggtatagttcacagttacataccatatgacctatgaagcatttaactagccgttgccccacgaggattcgtgagctattatctcacatggatcaccatgtacattccaaacttggtgtactagcactcataggattactgaggccttggcccactactgaacactgaactgtacctatcacctaagcaaaatattaactgcaccttgaacgcaccattgaagcccattattcattcactaaaggaccataccttcgcggcataagttaaccccagtacaatgatacatgagcttagcttgacacccttgagcaccatgaactccgccttaaatgttgcattgacccactttgtaaatcgtcaattttggggagcaactaacgctcactgcacatttttgtaaccatcggctctgtactggca

SEQ ID NO: 51211 - DNA, 345 bp, Triticum aestivum
  Clone ID: PAT_TA_51211
gttgcctggctaccgataaatgttcaccggccaatcgcagagggcaaaaggccaagcaacaaacaccaggaaaaaagccggcaagggacaagggaaaggaagaagacccccaagggggggaaaggggaaagacagggggggcgaccccagaagccggggggggcgacccggggacccccagccggggccagagagggggccactagaccttggggcgagatcggggggagctgggccctgtgcccaatagggatcctgcctggatgcgcgggacaaccgggcccgtggcgccaaccggacaaacgggggggcttacggagtaagctcgagggcccgaatcggggg

SEQ ID NO: 51212 - DNA, 540 bp, Triticum aestivum
  Clone ID: PAT_TA_51212
atgtgcatgtgcatatacattagtctttttttgtttttacatacttatcattgttttctccagtcatgtctggaacatggtcatacacatattcttaggttaggaacaaacaagagaaaaaaaaggccatggaaaacccaaagcaatgtctgaggggacaaaaccgccctggcactttgtatgtggcccgtggtgagtgagcgtgtttaggccttgcccgacttctcccaatccggaggcttgaaagcgatgaagctgacgcactgcacctggcgcatgctgtgcgaatacgatgatgcggacatacgcgtcagggtactccttcttgacctcctacacctaaatgatcacctgcctagcgagggagcacccgaccataagttgctttcacattgttcagcaccttccattggagaaaccagtggatgcgttgtgcttacggaagataaacccaaccttgctgaactcgatgcaaggcacccactctcgagcggtcatgtttttgacctgcttgaggagggcctccgagctgacctgagg

SEQ ID NO: 51213 - DNA, 401 bp, Triticum aestivum
  unsure (1)..(401): unsure at all n locations
  Clone ID: PAT_TA_51213
gcgccgctcgcgatagttctaacgcgagcggagcctggtttttgctgaaaacgcgttcatcaagtctagcattaatagattccatatacaatcactgcgatatagctcaaacacatgtatgcgaactgatgtggttgttaaaaatccatgctctaaacgaggggggaaacagatcatcccaaattaaagcaggactacgcctacaaaaaccagaatcggagatgtttttgcccccaaaaatgtagttcctgctgcagggtttttcttttgttcaatgctccactcattaaggaggccttgttgcgtnccnttttattttaccagctgcccttgggcttctctccgaggattttgtactctaaaccagggcttgttttacccttttatgctttcatcacttg

SEQ ID NO: 51214 - DNA, 497 bp, Triticum aestivum
  Clone ID: PAT_TA_51214
ctcaccacaaatattttgcactaccacaatgggatcaagggcacgtacaacagcatatttgctgcgaacagcattggttctgaggtcttcaacatacacatacgtttgcttcatcgcaaacgagaggacacataagatatcatgttgactcgacttacttatacctaacaaccatagttggttgtacacaaaagcttaggacctagaacagcacttgggaacaaactacatccggaataaacttatccacgatccactaccgttaaatcacggaaaggacagtttaagccctgtccccacggatgcagaagcctgagctgaatgttcttgtgcatgaatttgacgcacttggtgaacatggggcataggttgttgatcttgaacacacagaaaaggcacaccttttctttgttcttaaagaacagaacacatgtgtgacctgcaagacgcggtgcttcattcaagtactgcccgatctgtacctccaggcgctccaa

SEQ ID NO: 51215 - DNA, 540 bp, Triticum aestivum
  Clone ID: PAT_TA_51215
acagaacaataggagtcgactattgcctacaggatcagaaaccggagccacaaacacacagttacattgtggcaatccagggccggaacgttgccaaagctaatgctcgacctaggctcgcatgcctaggaagcagtgcgccagaccatagttacagggtcacagatggagacacacctggcaatggctggcgcaaagagacaggatcatataaagcccaacatacaacgccttcttggctcttacaagcccaacagggtctggttttggaacatgaaagacgcgttgaacttcttgaagatctacatgaccaccggcttgaactgctgcttgggcatgatcagctccctgatatggaacaactcttgtatctgacccaaacccgaccctccaacactggaaattccagggtctttcacaccctcgagggaggacgaaacactacgcgctgtgctcagcgctcatgggtacatccataggctctttgcggcaggcgactttgcggcaaagaaacatagctccctatgtgaaattgcatac

SEQ ID NO: 51216 - DNA, 512 bp, Triticum aestivum
  Clone ID: PAT_TA_51216
gttgcacgaacaaccaatcggtttttcgttatgtggatctctcaaaataggtttctgtccacataaagaggagctctcctgccatctcaatcgtgcctttttgccctggatgctacgccgtccaatcctatccccaaggctagggaactcaccaccagccctccactcccatgccctattggctattggaatcgatcactgaatctactacggcctgcgtttaagccacccagtggtcacccccatcagtattgctcgcggagcctgactatgcccggtaccgccgatatcctgccacgatcatgcaagccttgagacatgctgcaccacctcgtgctacatttctggacgccttggacctgctttcataccgcttgatcctgatgtaggactcccgttccatttggtttccatcagaggatactcgatgtctttattcatgccacgtttcagaagccatgttgaaccagactgctgctgaccgtgacctccacacgtaccagctttcccta

SEQ ID NO: 51217 - DNA, 141 bp, Triticum aestivum
  Clone ID: PAT_TA_51217
ggccacaaagttttgagaggtacttgtataataaattgaaatacaaatgcagggcgccggtcgaattgaaacagacaccggcactactgaacacaccgacacatgaggtgtggagagccactgcatgaacagcaaccccac

SEQ ID NO: 51218 - DNA, 553 bp, Triticum aestivum
  Clone ID: PAT_TA_51218
cagacttcatcttgcaatattaattaacacgatttatttgccacaggcttgaaaacatgcttgttgcttattgcaggattattatattaacacaggcgaaccaaccggttgatatgttccatgtctacctcgagggggttgcctacatactttttgatattgaacacacaagcacggaaccaccagggggtgctgccttttctgcgtgaacttccaagctgtcttcacactggacccatacaggacaaatgtgatgtgccaaagttgcacacttgcatagccttcaatgcctgtgctagtggtttgttaaagaaaggtttcttaatccagtgaaataggtggacgaggtaccagccacaggggccggccagaacttcccagaagcagactgcacgatttaggtggactgtgaccgctgtgctgatagataaatcggaagaggcctgatcttgcacctggcattgccataaccatcgctatatcttcgcccacagcggcagaactgcttcgtctgacttaactgcaagacactttgtcggacgtacatgcatac

SEQ ID NO: 51219 - DNA, 441 bp, Triticum aestivum
  Clone ID: PAT_TA_51219
atgaaaccaattttttttggtttttttttattatttcatttttcaagtttttttcttattacagggaaccggaagaaagccccatcacaaaaaaaaacaacctatggaggttgcaaaaatagtgtcaaaaaacaaatggggcaacaaaacaggggatcacgaaaatacaaagcacacctacccgttatcgccaaaaaaacagtgcttgaaagccccgctgataaaaaaattgaggataagagggatgacaccacccccattaatggtgcccttgaagagggtgcccaccccctcaaatccagggatggaaaaaaaaacccggcgaggggcgataccctggaccttgagatccttggtggcgctacaaaaaaatttaaggaccaaggccgcgaggaacttaaggaccgcatggagattcacaggggaagaaaaacccacccc

SEQ ID NO: 51220 - DNA, 528 bp, Triticum aestivum
  Clone ID: PAT_TA_51220
cacgcatgctaatgtggccctaaatgggcaaaataatgcataatccctggtttacaagttagatcgtccgtatgacagaattgcagctaatgttggaacaccttgtaagtgtgtgcctaagtcaccactgcacatctgatgggtaaaccaatagacctacaacacgtataaaattaacctaaaatttgaaaccttcacaaaatgtttgtatcctcgatcctgtaccatgttggttggggttcgtaaaccacacgtttgggtaggtagaaacaattaactaacctgcatattaatctgatatgaccaattcacagtactgcacaccgactacctgatataatggatgtcttgcctataccaatgatatatattactatagtaatattctcgcctaggaagtgatacctgtgctggtctgatatattattaacactataagtgtccatgctacttgctggcttgttcaatttgatatccagatcgatattttcaagatcgttatcaaatggaggaatatcgctctgatat

SEQ ID NO: 51221 - DNA, 547 bp, Triticum aestivum
  Clone ID: PAT_TA_51221
ggcgcgcgtatcattcatgatcttaaatcatactcattttttacagtctgatcgaaccccattcttctgagctcacatttcaaacttgctcaaatttcacatcaaaatttagcttctccagggggaatggcatctataaaactggagttggctctcgttgtcctctgttccatttgttgttctccagagattaaatattctcccaaagcctatgcgctcatgtttacaacgatggtaaaagctaaagagtctatgtttacagtgctttggcaaagtccatgttgtatatggttactccagttctttggcaaagtcaatgttgtcaacaaacaccgatttccacccatcggggtccaggatggccgtgatcttggtgccgatccctggcaagggacctgcctcccgcaccactttccctccggacagcttcaccacctcggcggtcttgtagacatcgtcggtgcctatcgcgatctgagcataggcactccccttgtcatattcagtgacaccgtagttgtaggtcaactccagaaccgcattctgg

SEQ ID NO: 51222 - DNA, 395 bp, Triticum aestivum
  Clone ID: PAT_TA_51222
gagtatacaatccatagattagaagatcacatgggacaaaggacagctaaactcgggggagtggaagaacaaccaaacatcgatacaacagtgtgggcggacatgcagagatggttggacgaacgcactcaccatatgtctgaggcagtgagataagatgagaacctttattcatctatatcagtgggggggcgtgtgtgcgacctcaaagtactaagcgtagatccagcaacagtggcgcaagggacgatggcaacagagatggcagcaagtgcgagatcagccaatgttagagcatccgaccgaagagctaatggcataagggacgctaaccccgcactttgtgagagatgccagcagactagccagagtagaggccagcagtggagctcttg

SEQ ID NO: 51223 - DNA, 539 bp, Triticum aestivum
  Clone ID: PAT_TA_51223
cattcatgccgaatggtacgggcgcttcatgcttcatctgacttttgagacaagaagaaagcacggtgcacaggcgcacaaggaacaataaagctcgataggtcccactataatcatgtgggagtggcggagtgcctccagttttccacatcttactgatagaaatacaggtaactgggagggcaattcacatgccactgattaaatgcccatcacataattcagatctactgtagtacattttgatggccgagcagtgaataaccatcaaccgcaagctggcaccccagaagaagaagaaagaaaatcaagaatctaggggcacttggggcctccctccttggtcttccagttgttgtagcaggggcaggcgcccttgttgccgtaggtgcccggcggcacgcagaggcaagtggcgcagcacttgttgcagtaggtcaggcacgccttcttgtactgcgtccccgagcaccgcgacgagcacttggacgagcactcccatggcttgagcttgccgccgccgccggcgccgccgttgc

SEQ ID NO: 51224 - DNA, 523 bp, Triticum aestivum
  Clone ID: PAT_TA_51224
ggaaggtgacctatttaaaattacgataacaggtaaccttcaacactgagaggggctaaacattattgaggctataacataaaactatgagggcaggttgacacacgaaattgatccaaccacaaccactgaacataaagctaatgaccgaagccggggcgggcatccaactcactgccagggtgggtacgaaacgtcccgcctgttattcctaaaagcgcatacccaacacattgacaatgatgaggaagatgaggaatatgatgctatactgtagctattttcttccagtcattcttaacattagagagcacgccaaacttgcatgactgccaatgatactcagaaggccctcggataatacgaccactggataaattctgcgacgtaagataagcacaatcctttagactttgcccagacagcatctgtctgggaggcgagagtgaacccacctgggggtttgaacattccacactgaatctgtaagaaagtggttgggacgaactgctgcaggaactaa

SEQ ID NO: 51225 - DNA, 490 bp, Triticum aestivum
  Clone ID: PAT_TA_51225
gaacgggccaaacgaatgtgcattgcatgatctaggttatacacccagatcacaccgggcatgcatgacccagaggcttatcacctgtgcacaagaaagtcacagcctccacccagaacacttgatggagcagaacggaacattatgggcaaacctaccctggctccagatgtataacttggcccacaaccagggaaacggatacgaggcacggccacctgtagggccgaactgctgtctgcaaagtataagcaggacggctcacatggccagggtgggaccaacatgcactgattgggaccagacccggcccttccggacgacaggtggatgccggcgatgagaccctctagagcgagcggctctgtcatgataaggttaatgatcaccccgacgaacggcttggcctggtgaacactggccctgcttccaatcttaccaacgacgccgatgatcatgccaggatgtggcctgactggctcaaggttat

SEQ ID NO: 51226 - DNA, 226 bp, Triticum aestivum
  Clone ID: PAT_TA_51226
gatctattaattctaacggatccaataccggttgagcccttaactgcaacgatccatgttcttggagtgtactatgctattaggtgttttaggagcacattgaatcctggagaggagagttcttgagcccggcggtgataaccgatctgctcagaggctcacaatgtcaagaggcaaggtcgttcctggcaccgaatctgtcttggtagatccctctcatgctaca

SEQ ID NO: 51227 - DNA, 263 bp, Triticum aestivum
  Clone ID: PAT_TA_51227
acttaggtagcaaggtctctcctggcaaatattgctggtggggggatgcctaccaatatacacgtgccaatattttttttgaaagggcaaccctttccgtggggcgggggggccgaaccttttgggtgggtcacatcaagggggccgacggggtggcccaattcctctttgggaagccgaccttgtgtttccgacacacacggtggccttaaaacacctttcatcggctttaatagattcaaatagcgcggggtaacaacatt

SEQ ID NO: 51228 - DNA, 193 bp, Triticum aestivum
  Clone ID: PAT_TA_51228
atgaaaacccaacagtcatggcaccggtatattttaacaaagcagagatccctaccgcgaatgaacacaatatttgtaggtcgacacaaacaaacatgctgacactggctggggacaaactatggcagctgtgtaacatggttccttcacgggtctcacttatgactcacatctgttggaacagtacgtggac

SEQ ID NO: 51229 - DNA, 408 bp, Triticum aestivum
  Clone ID: PAT_TA_51229
gtataacttacacgagggataacttatacattaagcactcacatgacatatgatacgcgcgataacacgactcgcacaataaaacagtcaccactctgctctgcttgcaggagcctgccgacccccaatgcaaaacacacagggactgcttgctcacagacccatagtccttgaaaccacaccttattagtaggcggaactacacgggcttgggctgcaagggctagctcagcttcatgacttgtggggccatttaattatctggacatggtactgctatgacggcagaccttccttgactcactgtccaagggctttgacttaaattaatgaaacaaggtgtactctattgtgtggctaatcttggacgggagggtaatcttcatcttgaacgtgatcgccttgaac

SEQ ID NO: 51230 - DNA, 431 bp, Triticum aestivum
  Clone ID: PAT_TA_51230
aaaacacagtatgtacttattttatattgtgcatagctatataccaattcgttagactgaatttatatactagcatgctacagtattggctgatcaggaacatgaacatgcacacattcttctattatgagcaactactagagctaatggtggagggaacaccacccaaatgaactacaggtcaaatccctaacgtcgctttatttgccgccagccgggattgagctgcataggccttgcaggcctcctctattcaggcggctagaacgccatgaagctgccctgtggctctggcgcatgtacgacaatcctatgatgcacaccgttcccgtgggcgtactcggtgaatgcgacaccggtacctgatgacgttccagatgaacatattgagaactccattagacttctccgaaatgatgcccataatgtgc

SEQ ID NO: 51231 - DNA, 521 bp, Triticum aestivum
  Clone ID: PAT_TA_51231
ataaatgaaagtttaatatagtgagagatcattgcaaagaactgtgttcagcaggtgcatggcaacgaactgagctttatacaatcgcgagtaaaaatgcgcaagcgcatagaggatttatataaacgcctattacgatgacactgtatatgtgattacactataaagggtgaaaagcttgatgaactaattatactagcaagagccatccgccatttgataccattgcccttgcctatgtatgcgccaaggatgagacactgggaggctgcctccattatatgctaaaaattgatgctcaagagatctaacacactctgaggtaaaggcagagcgaaaagtccaggaataaggaaccttgataacccaaacgaatgaactatctgcaagcaaggcttatgattgacataggtgcaacaggcactcgtgctgctaggttaaatacgttttctaatgtatgattgataacacaatagataccgatgagcgctttgtctggtggccttatgacatgcaagttc

SEQ ID NO: 51232 - DNA, 548 bp, Triticum aestivum
  Clone ID: PAT_TA_51232
gatgcataacataaaagacagattcccaccgggaagtagcgactagggcaaccaagcggcatgggtccacaatctacatatacatggcaacaccccaaacagcacaagctctgcactcacagcccaccgacccacaagagagccaaaaggaccttgatcgttacctgcgctcatagaactggtgactctaatctaccgactaagcctctaggtccgcaaagcgtcctgactctgtgggctctttgagacaaggcctttaggtcggatcgcgctctcttagaactgcatctctctatgcggtcagctgtcgaccaacacgataaatccttgctgcagaacatggcacctaactggtggctgactctgccttacatttgctggacggatgtcgattcgccaacaaatgtggactccatgcagagcccggtcttgcgtgatgcccagaccctggacttcacggtggtcttgatgcactgagaatagtaggacgagttcttggtctgcaccttgatcatgtgcttggcacctggcttgttcttatttttcca

SEQ ID NO: 51233 - DNA, 557 bp, Triticum aestivum
  Clone ID: PAT_TA_51233
aattcataggctatgcatatatatttaacactgtattgatccatgatcacccacaacaaaaagaggctagcactagggccacatgaaaacaagggagccatgccatgccttaccatggtagggcagatggcgcatcctcccaacgtaaacaagcagggttgaatacaggcaggagctttacattggaagacagcaatggtttaacttggcttggcgttggctgggccttctcaaacaggacagactctagcctggctgatcaccgactgaacatcacttgctaaaaggatcctatggctggggcagtactacctaccaaagtcttcagggggcatttggagtggtgggaccattttatcaaattttgccagggtgagaggaaaaccctcttgctgagcggtctcggccctataatcgggaatttgtgaccctggcccaatgaagatccatcactgcctatgtcgtgtagagggatagcatcaccgccacaactgaatggcatttcgatgcggaaccttgtcttatgttctcaaggaacctctgtattctagaacatt

SEQ ID NO: 51234 - DNA, 550 bp, Triticum aestivum
  Clone ID: PAT_TA_51234
aactgcaaccacataaaagagctcatctatatgtcgtcttcatagatatacatgatacagttaactagtttcagtactaaacactacacacacgtacacatacacacactatgtattgatgtgatgccatcctgttggtggcactctgtcgtagacaaagtgtatgaagaggctcaacaagacacacagagaaaaggtcatctgatatatcggcctcatatacatactacatgaacatgatacagttaagtacttcgtttctatacactaacacacgtatatataagtactatatatgtatgcactgtatgttgacgtcatgccatcctgcctgcatatgtacatcttgtcttgtactactagagtctcctctctatctgtatcgtagactaactgtatcaaaacttggtccccagctcgctagatggcgactagagttcgtctgagcttcgtctaatttcctggaccctttgtcgcaaccttctcctgtggtcttggattttccatagcccgtggccaaggaccaccgcggagtatatgccgtgggtga

SEQ ID NO: 51235 - DNA, 525 bp, Triticum aestivum
  Clone ID: PAT_TA_51235
gaaaacagagaatcccaagctgtgggaatcaaagaaggtagcaaatcgggatgcctcctgtggcaccaggcagccactagccgggagggaacctgtacgacccgactgaatcgggccacatctcaactgggacaacgacctgaagaagcatgcatattcgcactagaatacagcaagtgccaccgtctcatcctcctcctaaaagccaggccaggccaagcaagctaaagttgaccgctcgttcgttcctgactggttgcttctccgcagcttccttccccagtcgcggtcgaggtcaccgattacgcacgccatccattgccgcccacgagcaacatgacaaaggactgatctgaagctgattcaattacacatctggtgcctgcttcgggtgtcgccacaagttacaggcaatgttggatggactattctggcagcagcttcttgtttcgctgcctcttttttatccgcttcaacaaatggatcattccagttaccactgtttcgcagatcattaagatattg

SEQ ID NO: 51236 - DNA, 536 bp, Triticum aestivum
  Clone ID: PAT_TA_51236
caccaagtgcagaataatacattcctaaaatgagccagcccctcctgttccttgcagacctcatcttgtaccaccaaatacagaatagacctaccctaaacaccacactaaacattcgatccatgaacatcttcccttccacaccccccaactacaggcgaccattatccacacggttcagtaagaaatatagttcaggccaaagccttaacaccaccgcccacagtgagtggccttttgtacaggcaaaggttttcccggtttttcgacgcagcaggtctagaactggaacctgctcggccgggacttggtcatcctggccatgccatacgactcgtcgttgtcgtccctcttggcgttgcggaacgcggcgcagccggcgacgtagacgataatgaggatgataggcacgacgatgttgatgatggccaccttgcgccagctcttcttgatgccggccaggacgccggccttgcacgagtcgcactggaagcacagcgtctgctggtcgttgctccatttgaggcagtcggggt

SEQ ID NO: 51237 - DNA, 520 bp, Triticum aestivum
  Clone ID: PAT_TA_51237
gtcatcaatccagaggtcccgacttaagaaactttaaaactctgcgcttacatgctaagagattgaagctcgacgcaacgttatacagtaacaaatgaccgaagtatcgcagcggacaacctaaacaggagcgacaggcgtgtctaaggagaaaccaaactcatactaaatgaaccccggtgactgcttgatgaacacgccggcgacgtggctctccttctgcttctaggaactgttctacgcgcagagagaggcagcccgcttaatgaccgccaggggaccgaacctattgaacgatgagactgcctacaggggaggggcatgcacaggctgtgcctgatagagtgcatcaagctgcccaggctgagtggcaccaggagccgaaaattctttacttatgggggccaacggagctatatagcatgaggtacccttgagacttctggatgtaatgaccgacatattcgtactaacagctcaacccactctgggaaatgagtcgcattgtgcccagaggcat

SEQ ID NO: 51238 - DNA, 547 bp, Triticum aestivum
  Clone ID: PAT_TA_51238
gtacttataatattatgtgcatgtgcatatacatagccatcggtagcattcacatacgagcatgctttctcgagtcatgtcgggaacatggacatacacatattcttatcttaggaacaaacaagaaagataaatggaaaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgcgtggcgtcggtgcacccgaacataggcagcttccacattgtccagtaccggccatcgtagtacccaggggatgcgttgtgctcacggaagataaacccaaccttgctgaactcgaggcaaggcacccacttggagcggatcaggtagtcgacctgcttgaggagggcctccgtgctgagcgga

SEQ ID NO: 51239 - DNA, 510 bp, Triticum aestivum
  Clone ID: PAT_TA_51239
ggagggaacatgtacatacacatatctttatacttaagaacaatacaaaagggattaatggaaaaggaacacccacagcagagtcaaaggcgacaaagccgggatggcactttatacgtggcccgccatgagtgagctgacgaggcctcgccagactcatcgcatcccggaggttagagggctatgaaaaagaaacactgtacctgcagcatggtgccgaatacaacacatcagacatacgctgctgggcacaaaccattacgaaacctggccccacccgagaacacctgaccatggccaccaggcgatccagatgcccctatacagagcgaaaccgaatggactgccctgcacggtccatagctcattactttatgaaaagagagaggcctcacactctcacacaatattccaaccatacacaaaaaatataaaaccggtggatgctaaggagaaagcacactcacattaaataagtgggactgactggccggtttaccttctttaaac

SEQ ID NO: 51240 - DNA, 446 bp, Triticum aestivum
  Clone ID: PAT_TA_51240
atatctaggtcatcaagggcgtctaccgcaatcgcactgaaataggcccggcacccgtagcacacaagactgtggctcatacaggactcaatcaagaaggggctaagaaaggtacatcaccttggccagcgagaaaacgccgtgcgttaccagctgccccacatgctcctaacgaccaccttaaaggctaactgcccggggggcatatccccagggttgccctataatgacttcaccaaactgaatgccctaatcggacccaggaaacctgaactacctggtatatcccaaacatgacaaccacctgaagctaccggtttaacccctggcgcggacacccggttctgactgaaaaagatccaccgagcaccagcttgtttaccaaaatcatctttcactagaaaaacaaaacctaaggggattacgcgttatagctctaacctacc

SEQ ID NO: 51241 - DNA, 517 bp, Triticum aestivum
  Clone ID: PAT_TA_51241
atcaagattaacacgcagacaatggtccgatagctgattatataaagactgacactgaacggggactgtgtgatgtcatcgctcgaatatacatgtgctggctccatagcctatggactaacaaacacagaacgtatcggcaggaaatatacccctggtatggtaagcgaacggctgaccaaatcgatggtctcaaacgattacatgaatggctcacttgctgtaactgaggcttgaaggcttaccagacgtcccgcaaccctggaacctgaactgccgagagagctgacctagtgcaactgccgcaggtatgcgaacgccgaagacaccagacatagtactgtaggctgctccttgttgacctgctccacgtagatcagcacctgcacgtactggatgcaccccaacatgtgcagcttccacattaggcacgctggactgaaccactaccccggaccaggtgccgtgctcaccttagacgaagccaaacgtggtaacactcacgtacggcacctac

SEQ ID NO: 51242 - DNA, 218 bp, Triticum aestivum
  Clone ID: PAT_TA_51242
acagaaaataatcatatatgaattatattaggtaaaagtaattgggcatcacattatgagatactaaaattggaattaatcaccacgatatttagtgaggatctgaactatctcatacttcatactctgcttgcttgaacttcaaataaacatgctatgcaccaattggaagaaccagatcacttagatcaaaatgttatcccacaaattttggaaaa

SEQ ID NO: 51243 - DNA, 465 bp, Triticum aestivum
  Clone ID: PAT_TA_51243
gggccacaaaagtttcgggggggcctgcataataaagggaaattacaaaaaccgggcgccggtggaattgaaacacacaccgacccacgacacacaccgacccatgaggggggggagccactgcatgaacagcaaccccacttattcaggcccccggaagcttaacccccaaaaaaaaacacccccgggcgaacacaaaaccgggcccgcgtcccaaccttttttactttatggaacacacgtaacgtaagcacacccacggccgggggggaggccggccaccgcacgttaacgacaatctaaccgaagggggggggctttttttcgccgctggcctccttggcccccttgggggcctgctttttctcggggggctcggggaaaaaaaaacccccggcccccacggttggggggggggccaccccctcctcgatcttgggcttgggcccgggctccgggtccttt

SEQ ID NO: 51244 - DNA, 461 bp, Triticum aestivum
  Clone ID: PAT_TA_51244
gggaaaaaaacagaacaggcaggaggggagcagcagggtttgggttattcacaggaaaaacaaggaccgaccccgggggaaaaaaaaagcggttttaacaaaaaaagaagttcggaaaagccgctggagtaaaaaacccgggggggggggggggggccccgaaaaacccgccgccaaaaacggcgcaccccccggccgggaacaccggttttgggtcggcgaaggaaagggactccctttccacccccggggcccttgggaaggggggagccgggccaccggggccggggccgagctttgtctccgggtacatttgggcggcgaaggccccgccgcccaccagggcgcaggcccccatggggaacacccagacgctggagctggagcccccctccggggccggggggggcgatgcacaaacgggaccccccgggattcttttgccgccggggggcccgggg

SEQ ID NO: 51245 - DNA, 548 bp, Triticum aestivum
  unsure (1)..(548): unsure at all n locations
  Clone ID: PAT_TA_51245
gattctccacagctatgtttgcatgcttaatgttcttccaaagttaatttcgatacacattaattgtgcaggttagtaatgcagcatggtaagaaggcctatctataagggtagagagccctcttccatgtcttgacgtcgatatgtctcagatgcttgacacatcgatcctgaccatcaccattgtctcgttctttgcataccgtcagcaactccattccttgagatgtttgcatcttaggcttgagctacctgtcatagtgccttgattgtcgacaggagttgctttcttctgaatatgcaatagataattgagctttgtcggtgtcgattgctgctgatatctcggcgtgaccaagtcccgttgagcatcctttctgggtggaaatgaaggcagccgtgggacagcttgtagacttacgagtcgatgaccttccaggcttggaagcaggggatctcgggtgctcggagatgaagttcgagccatcgccacgagcaacgaaggggngctggggatcgatgcggactgcgacacggccgccggcggg

SEQ ID NO: 51246 - DNA, 485 bp, Triticum aestivum
  Clone ID: PAT_TA_51246
gggggggcaaaaatgtttctcattattaattacccgaatacataggcgacagattggataaaaaattatgggcatgggcatatacaaagccaccgattggattcacatacaaacaccctttttcgagccatgttgttacatgaacatggacatacacatattcttaggaacaaggaaaaaagacaaatggggaaggaaaacccaaagcaatggcagagttgacaaaactgcaatggcactttatatggggcccggggggagggagctgtttaagccttgccggactcctcgcaacccgggggcttgaaggcaatgaaactgacccactgcacctggcgcatgttggcgaatcccatgatgcggacgtacccgtcagggtactcctttttgacctcctccaactcggtgaacacctggggggggtcggggcacccgaacataggcagcttccacattggccagaaacggcccgcgtagaacccggg

SEQ ID NO: 51247 - DNA, 147 bp, Triticum aestivum
  Clone ID: PAT_TA_51247
aggggggcctaaaaaggaaacataaattcaaggggatgtacaaagaacccgggggacgggcaactgttaattaaaagtatcccccacggggcgaaaagacaatcgtttgctttttgttcccatacatccaaaattattacaaaattt

SEQ ID NO: 51248 - DNA, 467 bp, Triticum aestivum
  Clone ID: PAT_TA_51248
gtcgacgacatgcatgccaacaccacactctccatgataacgtatcggcacgggtgggcgggcacagtcatcccactctgctccgacatggagtgagtggctcggcgctgaggcgccgcggcgtgccgagccaagggcgggacgccgccgttcaacgtggaggcggttggcccggccacatgggatcggacagtcggtagtggctgctcatagaagatgagacccactcgtgttgccgactacacctgctacaacgtcacgaatacacccgaagttacacgccgacgtgagtgcacatggacaccatgaccgctgcgcgtggctatctagcgcaataacaatttgaggcagcactctcaggagtgtattttgtgatgatccctgcctggcttacaagacaaccactaatgacaaggtatgatctgtttaccagaaatgcagggaccgttctctcgatctgtgcacgc

SEQ ID NO: 51249 - DNA, 114 bp, Triticum aestivum
  Clone ID: PAT_TA_51249
tcgcgtatgtatatataaggcagcgagtgttgagcatggatgctatatctaatacgtgcgatacagcatcatggaacatctgcaatgcacaggagtttggacgacaaaagaaag

SEQ ID NO: 51250 - DNA, 500 bp, Triticum aestivum
  Clone ID: PAT_TA_51250
ttcgtcatcacccacccacacacacggccatggcagacacgagacgagtcctgctgtacccgtgcacacacacctaaccttgaaccatgtgcgcgcgacctgggtggggcgtgaccagcgccgggcgtgggagagcgtgttcgcgctgccgtagaactttggggtcctccacgacgtgccggtgtgcgacgagcaccttcaaggcggtcggtggctcgactcgaacagcaacagcagcagcagcaaggggcggcgctccaccggcggaccatgtgcatggcctttgcctcctacagtgacctagagatgatcaaggaggacatccgcggctacagcagctacaagatcggcgcctagattagtagctgcagaggctgcgcgcacgggcggcacggctcacagcacacacgtgtacggtgttcctaattcgtgcgtgcgtgcttgccaatgtgctgtgcggcggtctatggcgtcttcgggtctcgcgcgcgcgggggagc

SEQ ID NO: 51251 - DNA, 601 bp, Triticum aestivum
  Clone ID: PAT_TA_51251
gtcggtgactcaagagccccatatcagacacttggtggcagactgaaactggtggttttatgattacacctttacctggcgcttggcctcagaaaccaggatctgctacatttcctttctttggtgtacagccagtgattgttgacgaaaaaggacgggaaatgactggagaatgcagtggatacctttgcataaagaagtcatggcctggagctttccggactctgtatggagataaggacagatatgagacaacatacttcaaaccgttttctggctattatttctctggtgatggttgtaggagggacgaagatggttaccattggctgaccggaagagtggatgatgttatcaatgccagtgggcaccggattggtacagcagaggttgaatctgctcttgtttcacatccaaaatgtgcggaggccgctgttgtcggaattgaccatgaggttaaaggtcagggaatctacgcatttgtaactttggtggatggtgttccttacagtgatgatctacgaaaaagcctcattatggcggtccgcagccaggtattttcttctgatagtttcttaaagtgttggttgctactgacact

SEQ ID NO: 51252 - DNA, 460 bp, Triticum aestivum
  Clone ID: PAT_TA_51252
ccgaatcaaggatgtcttgctgcggtacgaactgcggttgcggcaccgcctgcaagtgcggcaacggctgccggggctgcaacatgtacctcggcggccgaggccgccggcgccaccctactcgactccgcaccggcacccacaaggcgagctccggcggcatggaaatggcggccgacaacggcggctgcggctgcacccagtgcaagtgcggcaccagctgcggctgctcctgctgcagctgctagatcattgatcatcgatcatgcatgcaccgcgcgtgcagcatcgatcatatcgatctactactaccataccatgtaaccgctacctgatcgagggccttatctatgcacctgacctgcatcagcagtcaggtgccatgccatgcttgttgtaaacaggcccccctaaataaaatctccctggtttaactttgcgcaaactgaatggcgaatgg

SEQ ID NO: 51253 - DNA, 506 bp, Triticum aestivum
  unsure (1)..(506): unsure at all n locations
  Clone ID: PAT_TA_51253
ttctatgttgcttcaagcagaggttgctggtgcatgaagctgctactgctgcaccaagcagcctgagcagaaagacccgcgtcaagacatcaagccagcacatgcagaacatggtgccgccaccctgggaaggtggacacgctagctgaagtgaanacgccagtatcagcattgaaaagcgcgatatctgatatctaggtgctgaattggtccacccgagaatattgatctgcttcatggccatgcacataatgtactctttcatgcccaacatttttggcaagctcgaacacagagtgacgacaaaatatgtgcggtacaacacataaaccataccatctcgtcgccctgagattcatacctcgcgctcatcttgatcttaatggctgagctcgtgccacatgttgtattgcagggcgccatgaggacaactagaggcacctagacatatgctactgtcgctatgatactctggtgattttactctaaaccaatatatgagatgc

SEQ ID NO: 51254 - DNA, 550 bp, Triticum aestivum
  Clone ID: PAT_TA_51254
taaccctctctaagtgcgtatgccctgcgtaggagggaaggacagaaaaaggacgtgcgtagacatgcccgagccgccgggtcctgcacgcgatccgatctgggatgagcgcacgtcttagccttgtaagcctctcgccatgccgggcaacgaccgacgtccccggcggtggctctgcagacccatacagaccctgtcaggggggggcacggggggcgcctcgcttcctgtgtaagcgcaagaacgtacaatgctaactgatggaggctgacgagaataatcgggataacatggagatagcgggctagactacggggctggaggagtgatactgccctagggacgggcacggccggatgatggacccagcgatcagacgaactgtgagaaggaagcaaagagaagatcaagtactgctaatggaacacaggctactgaccaaacattggatacagctactgcatgccggagcatcctgaccaagagtcaagtgcagtgacagctacaataaggatagctcttgatgagccgtgcggaataccaccctatg

SEQ ID NO: 51255 - DNA, 592 bp, Triticum aestivum
  Clone ID: PAT_TA_51255
cccacgcgtccgcctcctagcaagctatatacctacatagcacagccatggcccccaccgtgatggcctagtgggccacctgcgccgctcctttgccaggggctcaagtccaccgccggcctccccgtcagccgccgctccacggcgctagcctcggcagcgtcagcaacggctggaagagagcaggtgcatgcaagtgtggcccatccagggcatcaagaagctcgagaccctgtcttacctgccaccgctcagcacggaggccctcctcaagcaggtcgactacctgatccgctccaagtgggtgccttgcctccagttcagcaaggttgggttcatcttacgagagcacaacgcatctgctgggtactacgatggccggcattggacaatgtggaagctgcctatgctcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgagctgagaagagtccggcaaggcctaaacagctcactcacga

SEQ ID NO: 51256 - DNA, 576 bp, Triticum aestivum
  unsure (1)..(576): unsure at all n locations
  Clone ID: PAT_TA_51256
gcaaacacacaagnaagcttcatagcccaatgcaaagcctttaccatctatcggaagctccaaccgaaccgaggatgtcttgctgcggacgaaactgccgctgccgcaccgcctgcaagtgcggcaacggctgcggcggctgcaacatgtaccccgaggccgaggacgccggcgccaccctcctcgtctgcggcaccgccacccacaaggcgagctcccgccgcatggagatggcggccgataacggcggctgcggctgcacccagtgcaagtgcgacaccagctgcggctgctcctgctacagctgctagatcattgatcatctatcatgcatgcaccgcgcgtgcagcatcgatcatatcgatctactactaccataccatgtaaccgctacctgatccagggccttatctatgcacctgacctgcatcagcagtcaggggcccatgcccctgcttgggtggacaccagggcccccccctcaataaaaaaaatttctcttccccttcttgctttggttttgtgttgggtgcgctcggcgttctttttttttttttttttggggttcgtgcggtg

SEQ ID NO: 51257 - DNA, 583 bp, Triticum aestivum
  Clone ID: PAT_TA_51257
gtgaaactgctgtgagttgttgagaggtgaccatgtcaagtgggacctcgttcgcgtcgagccaagggacccggagctccaggtctgccgaggattgcccggacctccgggcccagatggagaagaggaggaagaggaggaaggagtccaaccgggagtcggcacggcgatctagggtgcgcaagcaacaacacctcgacgacctctcctcgcaggtggatcagctcaagaaccagagccaacaaatgaacatggtgctgggcatgaccacacaaaaccttgtggcgctgcaagcacagaactcggtgatgcagacacagaagatggagctggagagcaggctgtgcgccctaggcgagatcatctgctgcatgaactcaatcaccaacactgtgaatcccaccgccgccatgggcgccacagcaagcagatcctacgacgtttttggcgccggcagcgcatggagccagcccatagacttgtaccagtgcttctagggaagaagaatggatggttgatgttgtcatagctggtagggtctctatgaaggcatcaggttctgtatcaatcatgtagggccttc

SEQ ID NO: 51258 - DNA, 493 bp, Triticum aestivum
  Clone ID: PAT_TA_51258
gcgaccgatacttgagatggatcgcagagatctgctggcaacggttacagacaaccgcgacggggagtggttacagatgccgctatcggtgctggcttaaggccaatcaataactactaaggatgtgggcacatgactgagttaatgcgaaactaacatacctggtcagataaccgatgtactcgaatcctatttaaacacaatgtacgcaggctgtgaaagcatattacaatccactcttgcactgagatgtacaggaaaataaaatctaacgggatcaagactctataccttgccacactaaacatagaaaagactggtttatctatactaatcaatcttaggttaatagaggagcgcaagctttcatgaacattaccttgaacgacaccaactaatgttctccatgtcaaacaggatgttcactctatatactgtgccaacacaccaaatagttacatttcaaggaccactggttgggatcaatacccac

SEQ ID NO: 51259 - DNA, 313 bp, Triticum aestivum
  Clone ID: PAT_TA_51259
ttcacgcgtacggcggatggagcaacatcggccagcagtacgactccttcttcaccaagtatagccctacgtgcccaccaagtactacaagggccccttcaagttgtgctcagcatagaaaaacaatggatggatgctacgtgcactgcaattcttctctcgccactctgcccattgaagactgttcatagcatgtcttacttagcctgcaacctctgtcgagcttcctcttacagatggacattacttctttatccttataataataatatatgccggagcgatgtttgctgaaaaaatattacaagaacac

SEQ ID NO: 51260 - DNA, 255 bp, Triticum aestivum
  Clone ID: PAT_TA_51260
atcggcctgccaacctctgctggcctaatgcgatcaccaggaagccaccaggcacaacgccggtggccaaggtgctcagcttttactactgcaccgaaaatcctgtgaaagtaggtcttcgaccgccgtgagacgatgtcatatcacgacatcaaggctgtctactatctacctgcatatctgctcttcctttgttctgttttgatgattctagcttacaaacaaaaagcatgcgaggtcgttctatcatgatat

SEQ ID NO: 51261 - DNA, 265 bp, Triticum aestivum
  Clone ID: PAT_TA_51261
ggactgttgaggaaggaacagcgcagtaagatcgatcggagcatatatacatacatacgattaatatcattatcaattaatgcaatggtgatatatacgtgagttttatgtattgggttttccatctcgcgggctatgaattatgcgccccccgttgtcgtatcatgcgtggtgatggctgcacaagatgagccctcgtgaacattactaatctattgtcacggctatgtatgtatgtatgtatgtataatactgagactttaag

SEQ ID NO: 51262 - DNA, 581 bp, Triticum aestivum
  unsure (1)..(581): unsure at all n locations
  Clone ID: PAT_TA_51262
ggngcgccccaacaataccaggcagcgggcaccaccttccctctcctcccccgccgccgccggcgtgcgccgccgggcgaagcctttgcggtgccggcggcggtgggactgttctctcgcggcggccgttttccctggcatcatggaactgcgggtgggcgctgctagaagcggatctggcgttgttcgcgtggcctgtccgctcaagatggtggtgctcggcccggcagcgtcgtggtggttcctctggcgaaccatggtgctgtagatctggcggttggcggcgttttggtggctcctggctcgtggatccggcagatggcgtggcggccgacagcttctgtcggtgcgacggtgcccttttggcggtgcagcggctgctgcggggtgcctaggcttcggcctggcagctcagctacgggatggggcgggatggcgccccccctcttggcttggtgctgcagatctcgccggattgctagcccggtgcggctgacagcatggtggagggtgccggggcggcggccccggattcgatgatgtgctagatttgctctccgacggccgtggtggcgcgcgtc

SEQ ID NO: 51263 - DNA, 588 bp, Triticum aestivum
  Clone ID: PAT_TA_51263
tcggccagccagggctccagactagccttggattaagatgagtccatacagagcatcaaaccaagcagaacagattcaggggacagagggcacgccttccgcgtggactgggggcggtagggggacgccaacatctacgaggaggacctcaaccctggccggaccttgcagaacgatgcgggggggaacattaccctcttccgccgcctggtctactgaagcggacaacagctgcactgcatcggcgttctgtatggtaggtcctgttatctaccggggggctacgccatcggaccctcagatgctcaccgagatcaacctctgggacggcgccggggtgcaggatgtcatcaccttgagggctgccgtacacggagagcgacaccctatgctaccaccaagaagaaacggctgtgcaccacgaggcgcatgaccatctgcttcatcgaggtctgcaacgatccttaccaaaccagcctgttactaactcatacatgaactacgaactattattagggcaaaaaatgctcttattgtaatgagaggaccatcgatgtgtactgatgtgaataagctcaaacatggtgg

SEQ ID NO: 51264 - DNA, 580 bp, Triticum aestivum
  Clone ID: PAT_TA_51264
agcgcgaggggataggcgagcaggcccatccctcccgagtcatcctaccgacctcaaccttgggcggatcctatgtccgccgccgccacgagatcgcaggtagtcgttactcgcacatgttggtcgactgtcagattaggggtggagaccaactacaagcagtcatatcgatttcttatgcaagacttggaacaaccggtagactctgctcggttcttttctgcactaatgcgaggatgatgatgagttctgcatgaaacaaagtttaattggtgttcagcatagttctggtcaaatgattcaggcaaatattttggctggttctcatattttggttcagggaatttttcaatctacaacggctgctagccagtggttgaaagattgtctaccaaatatgtgtacggcaatgattatcttcattcggtggttaaaagatcgttcatctcggccgtcaattgaggtttagatagatggagcctgacactctctgccctcaagaaccacttcggtgctgccacacctggcagcgacaagttcggtggcctcttctctaccgaccagctcgcccttgagttcc

SEQ ID NO: 51265 - DNA, 190 bp, Triticum aestivum
  Clone ID: PAT_TA_51265
gcacacaacacaaagcgactgcagaaaaacatagacctctcgcttggaatgtgtcgagcgtagcagacaccgcatcccatcttgatcacgaagaggcggacgttgtatacattgtttagcggtgcatatagaccgtccacttcttatattttgtgctagtgagcgcacttctcgcattgtcatgtgtggc

SEQ ID NO: 51266 - DNA, 528 bp, Triticum aestivum
  Clone ID: PAT_TA_51266
gcagctaatacgtggagtatttttctgggatgtgatccaacaatttacatttacagcacacttgacttggaagatgcaactcccgaacctcaaggtactgaataaatcaggggaatcatgaggccatgcgtgggacatataaaccgatactctgtactatttagcacccgaggcaagaaaaaaaatgagacgtgctacaagtataggggacaacgtgccattttcatcctcacacgctaactgtcgctaagcgatatcagctggtcgaccacaccaggatcagcaagcgtgctcgtgtcaccaagctcatccagctgcctggaggcaattttccgcaatattcttcgaatgaacttgccgctccgtgttttcgggagccctggtgcccagtggatcttgtcaggggctgcaaacgcaccaatctgccacaaaatgacaccatgtatgtctttacactcgtttcaaaaatttagagggtcaagaaaaaagtgttgcattgacccaaaaaccttcagaaggaaagttcca

SEQ ID NO: 51267 - DNA, 524 bp, Triticum aestivum
  Clone ID: PAT_TA_51267
gaaagcccaataaagaccttcattagagcccggagcaacaaaacagacaacagtacaggttctaaagacagccaggaaaatcaggggcccgagaagctacttcaagcgagagcacaaatcatataggccagcgccgcgaacataagacatggggctgcagacggaaagtaaaaggaaaacggaacagctgactttgatgtcgatacaaagcttcccgacggaccataagggtggggccatggaccggacctaagaggctcatcatgccctcatctcaacataagaccctgacatccctgaggcgccaataacggtgagcttttcccactcagaccctatgccacctgatcacatttccaggagaagaatttctgaccccaacttgttctacacctttttccacagatagagctcttcaggaccaaaagaacccaggaatgccataaatccggctataggcggaattcacagcttattctaaggaaccaggcaaggggcccacattctcgcccgtttgaccacaa

SEQ ID NO: 51268 - DNA, 508 bp, Triticum aestivum
  Clone ID: PAT_TA_51268
accaagaaaacgtatataggggacatattgtataatattatgcgtacgtgcatatacatagccaccggtgagcattcacatacggagcatgctttctccgagccatgttgggacatgaacatggacatacacatattcttaggaacaaataataaagataaatggggaaggaaaacccaaagcaatgtgagaggtgacaaaactgcaatgggactttatatattgcctgtcatgagtgagctgtttaggccttgccggaactcctctcatcccggtggtgttgaaggcgatgaagctgacgcactgcacctgacgcatgttgttgaatcccatgatgcggacatacgcgtcagggaactccttcttgacctcctccacctcgttgatcacctgtgtggcgtgagtgcacccgaacataggcagcttgcacattgtccaataccggccatcgtagtacccaagagatgcgttgagctcacggaagatgaacccaaccttgctgaactcg

SEQ ID NO: 51269 - DNA, 426 bp, Triticum aestivum
  Clone ID: PAT_TA_51269
agttaaacgcagggatgaactatttaggggggcctgtttacaacaagcatagcctggcacctgactgctgtagcatgtcaagcgcatacataacgccctatatcaggtagcggttacaaggtttggccgtacaacatcaatatgatcgatgcttcacccccagcacatgcatgatctattatcaatgatctagcagatgcagcaggagcacccgcatcttgtgccgcacttgaactgggttcatgcccagccactgttctaaggcgacatctccattccgccagagctcgccttgtgggtggcggaaaccaagacaaggagggtggcgccggcggcctccacctctggcaacatgttgcagccgctcgcagctgttgctgcactttcaggcggtgccccagccgcagtttcctccgcagcaataca

SEQ ID NO: 51270 - DNA, 553 bp, Triticum aestivum
  Clone ID: PAT_TA_51270
cttgcacaacaacttgtttaactgaggttacaatgcagcaagcaattcaagggtccgtgcatggccaaaaatggcctgaaaagtcgcgtaagcgtcgatttaaacaccaaattgcaccctcgcaaccaaacaggcaaacacatcgactttcaaaagaaaagaaaaataggcggcactccatttcttttttttccttggagcagcgtaatatccgtatgtgtgtatcttggtctctctgtgttgttctatgtgcacattgtatgcagtatgtacattcaccaaccacggcttacgctgacacgcctctcttctgcagcccgatcatgaaaccgagtgatctcaccgcgcgccgtagccgctcaacggggagccttttcagtgtcgggtgagacaagtcagttactggttgtccgacgctttctttgccgctaggttcgcctgaggtgccgctgccatcttcatctgttgtacagacagcttgaactctttccagagatatgtcatcggcggattccgtttcggtggactgacagtaagcggaatgaaggccctc

SEQ ID NO: 51271 - DNA, 392 bp, Triticum aestivum
  Clone ID: PAT_TA_51271
agtcgacagattggataatatattatgtgcatgtgcatatacataaccaccgcatgcattcacatacgagcacgctttctcgagccatgttgttacatgaacatgggcatacacatattcttaggaacaagtaagaaagacaaatggagaaggaaaacccaaagcaatgtcaggagttgacaaaactgcaatgggactttatatgtggcccgtggggagtgagctgtctagggcttgccggactcctcccaggccggtggcttgaaggtaatgaagctgaagcactggacctggcgcatgttgttgaatacgatgatgcggacgtacgcgtcaagggactccatcttgaccttcttcaactccgagatcacctgtgtcgtgtccgggcaccc

SEQ ID NO: 51272 - DNA, 460 bp, Triticum aestivum
  Clone ID: PAT_TA_51272
ccggggacaccccaaaactttatttgggggtaataaccacccggggagagggcctaaacccccaaaaaaaaagcccggggggggaagggcccccccaaaaatatcccctaaaaaagcgggaaaacatcacccccccaaattaaagttaaacggccattgcccgaaaaaaaacacggcctatttggaaaaaaaaacccggggcgttattggaaagttaactaaaagggaccccctgaaaaacgggggggcccaaaaccccaccctgaatgaaggcgttaacccggttaaactcctccttgggctcggtaaccaccgcccccaccaaggggccgagggaaaccatcccaataatttgggggccgctgataaccgggaggggcccgaaaccctggtctgaaataagcggaattgctttaaaaactttggtttaaggtttaaccgggaaaagttggttcttttg

SEQ ID NO: 51273 - DNA, 255 bp, Triticum aestivum
  Clone ID: PAT_TA_51273
ccagttataaaataacaaaagagcgcagcatgatcgatgtactggatttgcaagggtgctctccgccaaagatcagaaacacatgcagagcgtaggcaaatccatggagaacctatgttacattagtgttgagttcacagattattgcatagtaactttcctcggaccgtcatggaagctatatgaccctgccgatacgggtatcaaccaccgtaggctttgaaacttctgaaatctccaatgcttgggccagtg

SEQ ID NO: 51274 - DNA, 304 bp, Triticum aestivum
  Clone ID: PAT_TA_51274
ataagcaaacaacgcaccggtttattttattattacaaggctacatgtacaaagtcaagcttagaaaggaaacccgacagaggttacagctagcgaagcctgccatgaacaggcccctatggccatagttaggagaaaaaaatacagatcaaggggcatgcatacattgatgctcgttatgagacacacaccataggggaccttgctttctttgtggggcaccaagggcatatctggtgacgaccgtgtcggactgcttgcagatgttgtcctccgaaggacacgaagctcgcacactgcactt

SEQ ID NO: 51275 - DNA, 234 bp, Triticum aestivum
  Clone ID: PAT_TA_51275
atgtttgtttgtttacttgagtctcaacataccgtatcaggagctgtatggggtctcgggctagaaagtagacagcgttgatgttgtgcgataacatgctatcacaccggtctgaagtacgacacttgtgacaagaatctcggctgacgagaaaaagtctagggctttgccgccaacgaccttcctcctggctttctcgggatccatgatgccagcagaggttgtcaggacgat

SEQ ID NO: 51276 - DNA, 265 bp, Triticum aestivum
  Clone ID: PAT_TA_51276
cttaaagtctcagtattatacatacatacatacatacatagccgtgacaatagattagtaatgttcacgagggctcatcttgtgcagccatcaccacgcatgatacgacaacggggggcgcataattcatagcccgcgagatggaaaacccaatacataaaactcacgtatatatcaccattgcattaattgataatgatattaatcgtatgtatgtatatatgctccgatcgatcttattgcgctgttccttcctcaacagtcc

SEQ ID NO: 51277 - DNA, 460 bp, Triticum aestivum
  Clone ID: PAT_TA_51277
ggttccccttaaacagtgtctaggtgacatacgggcaaacaaggggggaccgggccaaaacacaagccccggtgggatccacataccaacctggtttttcgggaccggttggtgcatgaacatgggcttacccttttttttgggaacaaataacaaggataaatgggggaaggaaaacccaaaccagtgtcaaagttgacaaaactgcaatggcactttatatatggcccggcaggagaaagctgtaaaggccttgccggtacttctgggagcccggtggcttgaaggggatgaagctgacccactgcacctgacgcatgttgccaaatccgatgatggggacatacacgtgagggaactcctttttgacctcctccacctcgttgatcacctggggggggttagtgcacccaaacatagggaggttccacattggccaataccggccattgtattaccc

SEQ ID NO: 51278 - DNA, 431 bp, Triticum aestivum
  Clone ID: PAT_TA_51278
gatgactgcccaactcaactgagctagaattcactccaggcggcaaattcacagcttgtcagagccaattcacctgggttgcatctcccaaaccgtgatcatacacacttcgacagttacactcacgcaccacaaactgtacttgactgacctacctacctgctgatcccataacggcatcctattcaaaactaaccagggaagacccggatcccttcatcctggaacaccgttaccggctccagaaataataagaactatgtctgcaactacggggcacacgaaacatcacacggccggccacccgggcactcccatcctaagctctctggttacatctgcgcggcggagacctcctcgccgacccggtcacaggaactacatggtggaacatcacgacgctgaagccgtcgtccatcagcgggcccacc

SEQ ID NO: 51279 - DNA, 516 bp, Triticum aestivum
  Clone ID: PAT_TA_51279
gcatcaaacgatttagtttgttcaccagaacacacccatacagcctgcacccaaaaggaggaataactgtacctacatgaacaccaaccacggcgcagcatgttgtcgggaaaagaatgactacataaaagggcaaggccccattggctgctgacatcttccatatactacatacatacttatgtagaccatacatgataacctccatggctaactgagttgtcaggctaaggtaaaacaagagggcgcacaagccgcgtacatggggaacatgcctaattggctaacaggtactagactggtccactggggatgacaggatgatgcccatacagagaccgttccaagacaacgcctgtgcaaaaatgaggattacgatcatgccaacatacagcttgggctggtgaacttttgccctgacttcacaatcaccaacaatacacgattgctcatgccaacagcatggtccggcctggtcacacgcaagctctgacaacaagtgggcctaaacatccg

SEQ ID NO: 51280 - DNA, 217 bp, Triticum aestivum
  Clone ID: PAT_TA_51280
gcattcggaacaaaataggatatgggcgaagcttaaggtataggcagcaggagacagatgttacaaagaagcatactgcgcatctgtagttgtacaagaaaaagatgccttggtaacatgggcaaccactgctggggcaaatgtctgtaagggggactcagccttcggctggggcgaaggggttatgtgaaggtcctgggtcttgtccaatggatct

SEQ ID NO: 51281 - DNA, 567 bp, Triticum aestivum
  Clone ID: PAT_TA_51281
tgagaatggagagagcttacgcaagagcgcatggggttcctgctagatctaaagggaactagctcttgctaatctccttgtcttgagagactaagacagagcaaagcaaggcgtagaagatgctggggactcaaaacaagctcttagtataatagaacaagcgtgcattacaacgaggcaattcttggacaggtgagacactgttgatatcacaagctactgctacactgggagctctcatggctcaatgctgaacgctagggggtgttactaccaatattagcaacatgaagtatgcggacaccaacccatgaatcacattcatcacttgttgcaaaataaagaaatggatatacaggatgcctgtcttattatgaggattggtctgtgcaaaaaattatgttcatatactgggggcgaaagtatctagatgtgcatggtcacagacaaaaggcttcatcgtgatatatgttttgatcacagagccagtacaaataaagagatcatgattggagaacgtacaatactggataaaactggtgttactacccacacaaaaaaaaatag

SEQ ID NO: 51282 - DNA, 572 bp, Triticum aestivum
  Clone ID: PAT_TA_51282
gccagcctgccctacctacttagtcaggcggcgaccagcggggctggggctatgctatgacccccggtgcgctctttctttgcatggccgggtggatcggacgggtatgcgcagaactacctgatacgacggcaggcgccgagcaagaagcccgccatacgggagatcatgatcgacggggagctggccgccaggatcatccgcaggggcttcatgtgacccgtcaccacctaccgctagctcataaacggcgacctctgcggctacaaccccacacattggatactaaggagcgtgccataccatgcgcggctggatcaacagcgccaactcacacagccagcggatgatcgaggactcgtggccgtgatctgcgtgcgcttggagtacgagctgaaaggatcattgagaaacggaagctagatcttttgcgtttaacaaactgagcccagtctcgtatgactattagtgttatctctacaaaaaaaaacaaaaatggcgggcgagtgtacacggacactaacttacctgcgctatacatgcttagcgaatagctgctgctatagtggaac

SEQ ID NO: 51283 - DNA, 528 bp, Triticum aestivum
  Clone ID: PAT_TA_51283
cacaccacgcacgcgacacagacagcgagcgcgaccggtgcagcaacaataggggctgggctcctcctcctccgccgacaccgccgacgtggcagctgcccagtaatgggctggacgagagcccggagctgcttcctcggcgctgacggcaaggaggcggccgcgtcgcgcgcgtccttcgtcgagcgcgccgaggatcccaagacgcccatctggttccccgggagcacccctccccctggctagagggagccttcaccgagacttgggctttgacccctggggtcttagatcctacccgaagagcttgcggtggaacatgcaggcagagctggtgcactgcctgtggacgatacttggcacagcaatgatcttcatacccgagctgctgaccaaaatcaggatactgaacacaccgcaaaggtacaccgccggggagcaggagtgcttaaccgacaccaccacccctttgatcgtggaactcatactcatccgctgagccgagggccgacgcttggcagacatcat

SEQ ID NO: 51284 - DNA, 389 bp, Triticum aestivum
  Clone ID: PAT_TA_51284
attgatggtaagatggttgcagtcaagactgtttcgtggcacttgcaccctacatggtgacaagaactaacacatctgtaggtgcagatatgacacatgcgctctgtgatgccaccgtccgatgttccgggcatgctcatgtgcccacatggcggtcttggaatggaacaacaagtattttatggacattcacctacaactattgttaacacacagacctggatgatacttacagctacatatgatgtctggaatgagaactggggtgcttgcaatgctaaattatgcattgcttatgccgctgccagattagcagacacttcactcatctcaatggctcgcaagtcatatgggaatgaaacaaccaatgccaatggttgattaactga

SEQ ID NO: 51285 - DNA, 583 bp, Triticum aestivum
  Clone ID: PAT_TA_51285
cggacgcgtggggtgtagtcagcgtcaggcgaacaaccaccaccagcaagccatgaccttccgcggctcatccctcctcctcttcctcctccttgcgctagcgccggccatccaagtccaagccgctcccaccgccggcgcgccggtcgtcgacacggtggcggactcgtgcaacgcgagccgcgacttcgtggactacgccttctgcgccgccgcgctgcggtccagcgggccgggcgcctccacggcggaccgccacgtgcacctcctcgtcgcggcggacctcgccgcggcgcgcgggacgtcggcgcgggacgccgccaccgcgatggcgcgcgacgagcgggacccgggcgcgcgcgacgggttggaggcgtgcgggatcctctacggggccacctccgtcccggcgctgcagttcatgcgcggctacgcggcggcgcgggcgtgggaccgggcgcgctcgctgctgtcgctcaccgggcaggccgggatcggctgcgaggcggcgctcgccggcgcgccggaggccaaggggaggatggccgccgccaaccgcgagtttgaccagctcagcaccatg

SEQ ID NO: 51286 - DNA, 586 bp, Triticum aestivum
  unsure (1)..(586): unsure at all n locations
  Clone ID: PAT_TA_51286
gatcgatcctcccgcgtaccaagccaccgaccncatggcagcgtctctccaagccgcggccacgctgatgccggccaagatcggcggccgggcctcctccgcgcgaccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctcacctacacccttgacgagatggaaggcccgctcgaggtcggcgccgacggcaccctcaagttcgaggag

SEQ ID NO: 51287 - DNA, 397 bp, Triticum aestivum
  Clone ID: PAT_TA_51287
gcgttcgacccattgtctgatttcgctacttcgacttggtttgtcttgctcccaagaaagccatcgagtaggatgaagaccgcagatatcctcaaggatttgcatgacatcaaagaatctctcctcttgtaagcaatccatattctgatgaagcgatattcgtacttgcatgtcagattatccccggtctccctttaagtgctggagctggttcatcaacataacgacaagctgcaccaattttgtatttcttgtcaaattatgggtagccggaggcagtttatgatagttacacctagcagatcatatttaggtgtacgcaactgtgactgatgtgtaatatccacttaatgagtattcattttgaggggctctgaagagtttgaccccattactg

SEQ ID NO: 51288 - DNA, 476 bp, Triticum aestivum
  Clone ID: PAT_TA_51288
gttatagtagtaatgagtaagttcatactaaccagttgatgcttcacttacaaagcgaaacaggagagagtttcagagacattgaaaatacagtgcttttagttaattttacaggatggcactaccattggaagcctacggaaagaggtcaaattaaccaccgggcagtgtggcgattaagacaaccacgtgcttatgcttaccaagtggtgcatgaaggacttcacacaactcccagtcgaagccatttataaggacaaaaaccccaggcctaacagagtcatacttgatgaacactctctgggcgttacttgatcaaatggtacttcatctagtacagcaatgccttgatagtggccttgtcttcaccggacctggcactggacatccacacttgtgtaccttgcaggatttatcctaacataaactccagaccggccccgtaattgaatagtgagatgcatggatacaagatc

SEQ ID NO: 51289 - DNA, 104 bp, Triticum aestivum
  Clone ID: PAT_TA_51289
gttagaggccatgatctcccacatttacatggaaggatttattcaggaacatgcggctaaaacttgcatgagagggtcgttccggtaaccttatcacatacaca

SEQ ID NO: 51290 - DNA, 363 bp, Triticum aestivum
  Clone ID: PAT_TA_51290
gaaagatcggcagcctaacgcttagttgcagattatcttgtacttctcagcctaagagcagaacaaaatcatgtcatcattctggagactataactaggaagcagggggagcagctgttgcacgagccgttgaagaactcaccctacatgactggccagggaaccaagagagcatcagccgacagggcggcgtaataccagcggtgaggggtaccaaactcgacactgaggcttaaggacaccgtcgtaaacaccttgtacgtgtctcatgggatccaatcgccttgctgtatgcattaacggacaggtgccccttacgggccttagaccagaataaggccgtgccaggtgaaaaaactggac

SEQ ID NO: 51291 - DNA, 399 bp, Triticum aestivum
  Clone ID: PAT_TA_51291
gtgaaaacggaaaccatcagaataatgttgaacaaacaccactgattatacaatcatctgttccggagatgtgctgccataacttacatagactttggtgcctataatgctggggacaagcacatgctacatactgcgacagccaccagatagatcataaaaaatgggcacaccgtcgcacgcgagcgagagaacaatagatttcatccaaaaggtttgttctgatcagaacgctagaggttttgataatagtggagggcctgcttgtgaccatggttatattagttggtgatgccggctaacgttaaacgctaggacagaattacccccaaacaatggttcgatcttgatgatatcacagacatccagctgcatcatagattctgcatctatttgcat

SEQ ID NO: 51292 - DNA, 469 bp, Triticum aestivum
  Clone ID: PAT_TA_51292
gtaagagaaagacaattgttatacaagattggggtcagatacttaaacacatgaggtcgggctgccctttctacataaacctatgagtgcctgaaccaggccgacgcagcacgccaccacaagcccttaatacgacgttgcccatagtgaattgggactgggtagacctccacgcacgcgatgggacctacttagcggctggtgtcggaagccgtcagataccaggcacggcgaggatgagctcagaaggaggcggcgacggcccagatgaactccctggtgaagatcctggaggcgagctcgacggaggtgatgatctcctgcatggacaccttgttgtgcgcgatccacggcgatgaggtagatggggacgacccacccgatccagacggtgatgtagaggaagagcacacccggggtgatgaacttggcccacagccgctggtcctgcgtgacgatgaagcggggc

SEQ ID NO: 51293 - DNA, 469 bp, Triticum aestivum
  Clone ID: PAT_TA_51293
atcactaatcattgtccatatttaaacaaatatcactggctcaatgttacaacaccatctattaacttatgacaccaaacctagacactcccagggttgagagcaccactcacatgcagtaaaccaggaaacaggccaaatttcagcttaatatgcaacacagccgtccttcagagaatgcacaaccagctggtcagacgggaccttggtctggtgctgatgaacactggggccaacctccgataggttaggtgggcttttacttcactgctttaagcggctcacttagtagaatgaacctcagtctggtacattttcaaaagcttaccggtatacctttgcatgctgatcatgctccatgtgaacactcaagtgaatgcaaacttttaccaaccttctattcgttgtgtgatccggcggtatacttactaagaacagatgctaatgctccactataaacttgctgcaa

SEQ ID NO: 51294 - DNA, 562 bp, Triticum aestivum
  Clone ID: PAT_TA_51294
aatatagtactcttggggtatgtttatgatatttgagctcgggattagagtaacactctcggtacgtatagagcaaacttgacatctacatgtaaacgagacttctctcttgtgctatgaacaaagcaaactcttctgtctgcaaaaccaaggtaggccagagagagtttgcacgcctgccatccttgaaaactgacagagcatctagcgtcgcgctcatttttttatgtactcgatcgtgcagttctccttgagccactccagcaccttggcagcctccagaacatcctgaacctgctgcttgatgttcccctcatcgtagtcttgattatagcgtttgaactcttctatagagttctcgacttccttgacgagctggtctgtcgagtactgcaaattttcggccttgaatatttcaccaacaaccagcatttgcttaatgatcctagtaatgttctccctctcaccttttaggtactcctggaccgacttctcgcttgaaagggatgctagctggtctttgtctagcttcctttcggcctgaagttggagaagtttcgct

SEQ ID NO: 51295 - DNA, 405 bp, Triticum aestivum
  Clone ID: PAT_TA_51295
accattaaaacgtatatagtcgacatattgtataatattatgcgtccgtgcatatacatagccaccgatagcattcacatacgagcatgctttctcgagccatgttcgtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacataggcgtcagggtactccttcttgacctcctccacctcgttgatcacctgcgtggcgtcggtgcatc

SEQ ID NO: 51296 - DNA, 479 bp, Triticum aestivum
  Clone ID: PAT_TA_51296
catgggaactcaaactgggagcctggggttttcataattaaaattttacatgcgcgggcttactagtttgatcaaggaactagtagtccgtagtaataatcaacacagggaactctggtttttaacacaagaagaactccggggccccggtcgacggggggggcatgctgccacgtcacccctgacgatcgaccctgttgagcagcgcgggggccatggggctgagctggtcaaactcgcggttggggggggccatcctccccttggcctccggcgcgccggcaagcgccgcctcgaagccgatcccggcctgcccggggagcgacagcagcgagcgcgcccggtcccacgcccgggccgccgggtagccgcgcatgaactgcagcgccgggacggagggggccccgtaaaggatcccgaacgcctccaacccgtggggcgcgcccgggtcccgctcgtcgcgcgccatcgcggggggg

SEQ ID NO: 51297 - DNA, 537 bp, Triticum aestivum
  Clone ID: PAT_TA_51297
atgactctaattaaagttcaacagaccacccaccgttccagaccagccacaggaactacgccacaaaccacatgacatgggtacgatttgttggaactttataagactccatgaagagcatggaacgccttggttatttgctgggccacatacacatcaaaacgcggaacaccggggtgggggtttaaacggccgacgccttctgcgagccctcaagagtgtttggggtgttcgaagccttattcgacttgagggtctccactgcaggcttgaaattttaccggatgccggaattcttgaacttcagagtcaatatgtggtgagcccactcggagatttcccacatgctgttgatgcaagcaaacgtcacgcccttcttgtgcatgtacttcaaagttatgtacggcggaaaggcttgcatttagaatgagccgggaggtgcccttctgcctcatgatgagccgagatctctcgccgccagataccaagcagttcaccttcagtggaccctttatcttttccttccagacgccgtcg

SEQ ID NO: 51298 - DNA, 505 bp, Triticum aestivum
  Clone ID: PAT_TA_51298
ctgttactaccattaccagcacgagccaaaaggaaaggagacttacccggacccggcggtcaagcatgaacaagaaaaaggggagggcgggggcggataaacaaaaacaaccaggggcaggggccccgccctgggtttgggctaggggtgtgggcgtgtgctgttgaggatcatcatgggagtgggagtgccccatctgcaagggtgaggacactggctgtggctgaaaaagaaaaagaagggcttgggtttgatattgactttgggcgtgagattgacttcaccagccataggagagctagagccaggccaatgaggaggaaaaagtgaaatttccttactcaaagtgcaagcaggggccatgtgcatttgctctgaaagggaaaggagggaaaggaaaagcataagaactatcacggtgaaggtgaagctggggctggggcttggttttcatttcgcagaggaggtctggaacagttactgctggacccgggagcggacgcgg

SEQ ID NO: 51299 - DNA, 428 bp, Triticum aestivum
  Clone ID: PAT_TA_51299
atccagagaaaaaaaaccggcttccatttaaagcggaaccccaacaaggccgccccccaaaatggaaacaaaaccaacccctgggcaaaagaccccggcacacccaaaaaacctccttgaaaaataattgctgcccgcccaacaaaaaacaaaaggaaaacgggggccccggtccccccaaaacaagggaaactagacccccccccccccttaaaaaggaaactgagggttttgcccagctttttcccccccccctcaaaaccctggaaacaagaaaaaaaaaactccttttgcctcgggcactataaataaacctgcaggttcaagaccacgcagtaaaaaaaggcccaaatccccataatccaaggctaaacgaagccaccaaacttttttaggttaaaaaacaacccaactttccaacccaccct

SEQ ID NO: 51300 - DNA, 448 bp, Triticum aestivum
  Clone ID: PAT_TA_51300
tcgggtggactgtcagggagaacaacaagaccagaagagcacgaacctgatgatacgtaagctgactgtacagcgcctgttcctctagatcgctcaggactccaagacaggcctataataacagtcacacgccgggctgtgcctacagaggcgggacgtgcctacctaggatggcctgtgagaggcacaccaatctgtgcgccatccatgcaagacacatgatcatcataccaaatgacattcatgttcaactccatatacatgatgagagggtctaaactatactatgcgctaacaacggaagtggaattgaataagttaactcaatgggtaaacaagaacataattgctgtaaataggaacataagattgaccacctaagaaaacagggcaaccactatgactataacgaatcaacttgatatgagaagctctatagacttagcga

SEQ ID NO: 51301 - DNA, 518 bp, Triticum aestivum
  Clone ID: PAT_TA_51301
cccacgcatccgtgtccacttggctcacgcacagggctcagaggacaagctaggtacgagcgagcatgcatggattggtggggggcttgcgcaggagagcagcgttgtcggcacccgggtggggtgcccggatcgcgagcatacggtggcatagggttgcggtatgagcttgtgcaggaagaaagtgacgtctaagataggccaaggctcatccaaccaccgtacgaacgttgtggtaacacagtgcgcacgcgcccaaatacctgaactgtacgcttgaacaacactacggagttcttaacatattgacgcattaaggccgacatgtaccttgcatgtataaattatacttgctgaaccaaaacctgatcaatgatctgtatggcgagatcatcggcacccggttcgagggcgccgccgtctagagcatccaatttcaggcatacgtggatgcgatcggactgcagaggtttcgcgagtgctagctcattacagtcgctgggccatgctagccaccc

SEQ ID NO: 51302 - DNA, 420 bp, Triticum aestivum
  Clone ID: PAT_TA_51302
gcagcatcaagttcccacttgtgtaccaaacgcgtcaggacaccaaccgaagacctgagcaccagctacaaggggagaaggccgaacctgtacatgtggatggtgctgcggtggatgctactgttttcaatggcccacaaccacaaaggcagagacgttatcttagctatgtgggatcttctagtgcattaacacgattgatttgctgcttattcatctcacaaagacttgacgcagaaccttgtgattgtggtcttatcaggtgatcttgatacattctatctgtgatatgatatattatctgcctgaatgccgatgtgctttatctgttctgctaattgagaagggatcttactcttacgattgtcttcactgttcacctgaatattatcatatcaaaaaaacaaagagatgcacacc

SEQ ID NO: 51303 - DNA, 596 bp, Triticum aestivum
  Clone ID: PAT_TA_51303
aagctatatacctactagtacagtgcatgggccccaccgtgatggcctcgtcagccaccttcgtcactcctttccaggggctcaagtccaccgtcggcctccccgtcagccgccgctccaacggggctagcctcggcagcgtcagcaacagtggaaggatcaggtgcatgcaggtgtggcccatcgagggcattaagaagttcgagaccctgtcctacttgccaccggtcagcacgggaggccctccttaatcaggaccactacctgatccgttccaagtgggcagccttgcctccagttcatcaagggtgggttcatattaacgagagcacaacgcatccgctgtgtactaccatggccgatactggacaatgtggaagctgtctatgttctgatgcaccgactccacgcaagtgatcaaccaggtggaggaagccaagaaagagtaccctaactcctatgtccgcatcataatgattctacaacatgcgtcaggtgcagtgcgtgagcttcatcgccttcaagccaccgggctgcgaggagtccggcaaggcctaaacagctcactcacgacaggccatatataaagtgccatt

SEQ ID NO: 51304 - DNA, 672 bp, Triticum aestivum
  unsure (1)..(672): unsure at all n locations
  Clone ID: PAT_TA_51304
gtgccaggcgcttcctgtcttccttgcacatctgcaccgaagaccgcggttgcatgacgactttactccttgcattactagaatgactacacgcgcatcctgataatgcatgtgagatgcatcagtgcacaaagtatggaatactactggatagctgggagcacacgcacatgcagtgagagtccaggaatcaacgtataaacgcgtgcgccactcaccacgacacgtccagagtgactcattggtcgtgcttggtactgagccaaagatttggcgcggtggtacgacgagaaaagctatacctcgcaatcatgtnctgatcgactacggcactcgtgtgaaaagggttgcatggcccacagcatgccctataccatcatgcaccgggagtgcctgactgtgatcaacacaaggctttgcctggagcatcttactgcaactagctggtgatgtatctgaccaaagagatcgctagatatgcgtattgagtcaatactcattcaaagaattaacatctatgtggacaacttacgctttatagatgggcttggtgggggtatgaatggatcatactcgagctcgtgggggatccggttctgtggctatgaatgaatgagctacggcatgagatgtgtgtgtcgttggttcttgaatcttaaagctattgtcata

SEQ ID NO: 51305 - DNA, 606 bp, Triticum aestivum
  Clone ID: PAT_TA_51305
acaaaactaggataaaaaaatagaccacaaacagagtggacatcagcttagatgtgacataactatgtcacatctagatgtgtcctaggcagacccttacaagaaacccgctagatccacgaccactcactcatggttctcttctctagtttttgcattattgaaggcccagagacaatacaagacttcattcagatgcaatcacaagagattcaagacaacatcaagagtcggcgcagcaaaatattccttttgatggaagaggtcagacgactgcgggtgcagcagcgaatcagagctgctgaaagcagatgttccagcagtgaagaaaatgagatgccggagatgccatctaccattccgtttttgccttatacggtgaccgaccccgaccctgaattattttatgtgcaaatggccttttgagttctccttggtaatattcatttcttttgttttgtatgaagtagtcaccaaagacaatgaagcaactctacctgacatcattctctttcatatctgggataatcatttttggtggcttaatagccccaatacttgaactgaaattagggcttggtggtacctcttatgaagattttatac

SEQ ID NO: 51306 - DNA, 249 bp, Triticum aestivum
  Clone ID: PAT_TA_51306
caccgtgcacagggtgcagagactgcaaaccgcgtctgcgagaacgcaagacactgaatacgtgatagcggagactgcggcgatggctgcaggcggtatattaaggcagctgcagcactgtcctagagggcgcgggagaaggccggctaggagctcactgatgaattggagaagatggatgagaagctcaagtagacaaagtctctactacatagcactaaatctagaactactaaatctagatcgcga

SEQ ID NO: 51307 - DNA, 395 bp, Triticum aestivum
  Clone ID: PAT_TA_51307
ggtgtcatgctacgacttacttacgaactgcaagcgcatgcttcatgagggtttttagcacctactccctcggcccgcgctacacctacaggctcgatggtaacaccggatgatcatttgttacatcatcttaaccagaaatggtacttgtttacttttaccattataatctcactgtgtgtccagctgtacttgatataatcaatgtgtggctttagggtataaaatggggggccatagctgcgcattactgatgaagctatgagaaagagtatactcggtaaggtgacacagactcaaaattagctcggccgggcatgtgcaatgcagggcggacgctctggacggtccaatctatacgatccaagcatgcgacgcgataattctactatata

SEQ ID NO: 51308 - DNA, 599 bp, Triticum aestivum
  Clone ID: PAT_TA_51308
gactagttctagcgatgagctgcacggccgtccggaccatgagcaggaggcccagggaggaggagccctcctcgccggtctccgacgacgacgtcggcagcaccgccacctcctccaagcggcggccctcgtcggccgcccgcgtgccggtgccagggaagctcagttccctcggcaaggtgtgtgatcgtcagatattcagataggcttttctctgtcagttcagttgttctatctgaactctgaaccgatgctgcgaattttgccatttcaggaggccatggagcagagggagcaggcgcagaaggtggcgctggaggcgctgcgcaacgcgtcggcgacggataacgtcgtcaggatctacaagtatgttgtccatcaatggcggttcttgttactcattgcgatcttgagtgacactgtctgtctgtctgccacgagctgagcttaccagaatgaatgtgtttgatggttttgttgccaggatgttcgccgaggtgagcaaggcggcgaggccggacgcgcccgcggcctgcttcgacggcttcctcagcttccaccaggaggccgcgcaggccgtggccgacatcgagtccatc

SEQ ID NO: 51309 - DNA, 353 bp, Triticum aestivum
  Clone ID: PAT_TA_51309
cgccgagcggcgccgggagcctggcgccgcgcggggcgccgaggctgcgcgcgccggccgggctgggctacctcggcctcggcccctccaggccggccctccgccccgtcgccctcgcgaggcgcgccgacccctcgggcgcgcggtccccgctgctcatgagcgccgcggccgcggggggggggccgcgcagcccgcctcggcgccgctctttatcacagcagaacaaggtggcttattaggagggaccgtacctggtcgtcctgtatgatgactgcacttcactttagccattttgaaggtgcaatgcttgaagagcgcctgggggcgcgcacatgggagcgctcctgtcc

SEQ ID NO: 51310 - DNA, 533 bp, Triticum aestivum
  Clone ID: PAT_TA_51310
catccccctcctcgataacattgagtatacgtataagctcagtaccattgccgatctccatgatcagttttctgaaagcaaagggatccttacagcggacgcaaccgttggtcaactaggaatacatgtacatttagccgtcgcgagaagcccgaagggagtaaaccgcgcaggcaacactggtatgaccctcctcctcaatagcaacagtttatccggccaactccctgcaaacttgggcttctccaagttgagctacctcgccctcgccaacaacaagctcacggggccaatcccgccatcaatcgcgcacatgaaagactccctcctcgagatggtcctcctcaacaaccagctctccggctgcctcccccacgagctcggcatgctcaccaagaccgccgtcatcgacgccgggatgaaccagctcaccggcccgatcccctcattcttctcgtgcctcagcagcatcgagcagctcaacctggccgggaaccacctgtacgggcaggtccccgacgcgctctgcaagc

SEQ ID NO: 51311 - DNA, 474 bp, Triticum aestivum
  Clone ID: PAT_TA_51311
gtgtacatcattccatgctgctccgagctggtggatgagatcaagcctcgttggttgtccaacagaaatgggttctggtgggctgcagcgaaatgcacctaagatatattgggaagccattccatctaacggcccgtccttcatagatatcattactgaattagaggtttccggcagcagatcaggagcaaacatgaagatactgtggagacaaggcaagaagaagaaacagtccaggcaatgaagagtggcccctctgctcatactccatgatagttcttcccgttaactgatcggccaagcgaggataggggctgatggcactagaaaagtagcgtatcgcctgattttgtcattgcttcttcggacctgatttttatggtctcattctcaatttcagttacagctctagtctggattatctcacatagagcaaaccggagtgaccattatatctagctttctggtttcgtt

SEQ ID NO: 51312 - DNA, 584 bp, Triticum aestivum
  Clone ID: PAT_TA_51312
gccaatcaaccactatcaacttagctagcaggagcaggctgggcgccctatcctctgcagccgtgtccgttccttgcttggtcgccaagtggtcgccacccgcatgcgcaggagcgaatacacgatgggggtgctcgcgtatgctgagcaagaaggccgatagcgccatggaggtcgaggcggataacgcaatgctgctggacgggacaggcgatggcgcaagacttgcttctgggctccaaccgcggaatgcgtggagttcgagcccaacgactagaaagataaggccggggagaccatcaccttcaagaacaacgccgggttgccgcacaatgaggagttctgacgaggactccttgccctcctgcgtggacgttttcaacatctcccacaaggagtacctaaacttctccggcgagaccttgtcctttatccttaccgggccaggcacctactgcttgtactgagagtcgcacacccgagcctagcatggtcggaaagtgaccgaaaactaataagcagccttatagctctcgcgaattgttgcgggtcggcagataaaacgggcgtgtatgcatgcatgc

SEQ ID NO: 51313 - DNA, 590 bp, Triticum aestivum
  Clone ID: PAT_TA_51313
gccaccttctctcctccacaccatggcccccactgtgatggcttcctcggccacctccgtcgcacccttccagggtctcaagtcgaccgccggcctgcccgtcagccgccgctccagcagcgccggcctcagcagcgtcagcaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctacgccaggtgcagtgcgtcagcttcattgccttcaggccaccgggttgcgaggagtctggcaaggcctaaactacgagttgaaacaatggcctatgtatgaaggtctttt

SEQ ID NO: 51314 - DNA, 594 bp, Triticum aestivum
  Clone ID: PAT_TA_51314
cgcctcctctgtgctcgtacgcgccgtacacaaaagtccccgatcagtggcgcgcgctcccgtggcctgctctccgtcctggtcggagggagtgaagtagcacccgcgggtcctgggcgactcccgccgcttcgggctgctcaagttcacacgccgcaacaacggcggacagaccaaggggatgcgggtgcccgccctcccctgccctgactacctcgacagcatgttgtacgtgggacacatggattacacccgctgtcgctggcggaggaccctacagacctgcgtcggatcgggcacgcagagttgaggaacggacggtgggcgatattgtgggtgagcacagatgcatgatcctgggaagctgactaaccgaacgcggctgctgcatgaacgcaccctgactatactacgacgcacaggagacctacttgtgatcatcctggacgctgttggtaatagagatcatcctgttgcactacgtcgagatacggcagtggacagacatcaagaaccgcagctccgtaaatcaataccctatattcaagagctacagcgatgaggcccgacgagtgctagatacctcagtaacga

SEQ ID NO: 51315 - DNA, 562 bp, Triticum aestivum
  Clone ID: PAT_TA_51315
acggtatatactcgcatacgcagcgctggcgccgcaccgtgaggtgctaggagtcacctaaggtgcttgttttcagggactcaagtgccgcgctgacctttgagtgagctggcgatctaacgggagcttgtctaagaagggttaggaacggctgaaggatcatttgcatgcaggtgcgggcgatcgaggtcacttaagaagcgtcgagaccatgaggtacctgccaacaataaggacggaggtgctgctaaagcagaggtactaactaatgcgcttaaagtaggcgtcttgctctgtgagctcactgggcaagctgtatcttaacgagagcacaagacattatctaggtactaccatggaagtcactgaagactggagaagcgaccaatgctaggatgcaaagacgcaactcaagggatcaacgacgaggaggacgataagagagaatacgttactaggatgctttattatcatatcatacatgatgcatatgaagcattgcgatagctttattgactgcaaggcactgttgtgtgataaattctgagaggactaaacatgt

SEQ ID NO: 51316 - DNA, 247 bp, Triticum aestivum
  Clone ID: PAT_TA_51316
ggcggcacactgaaaacctggtcaaaagttattgggcgacaacacattggaattattccttgggccacagctggtggtggatttttgaaacccaaagggccggcccccaaaatggtttcttacagacagaccacccccctggccgactgactgcctgcaaagggggtgggggacctggcattcccttgttacattccacccctcccccattctattgggcctacacaaatgggcccctgattgttcc

SEQ ID NO: 51317 - DNA, 414 bp, Triticum aestivum
  Clone ID: PAT_TA_51317
gatctattaactatcccatctaacctgagatgaatcggccccatcacacactggctacgggactggataacgacacactttgaggctacaacaaaggatccttggtccaaagacctccccatacggttgcttgtcgcatccatggggctctagcatatgaactggtccgacactactaatccctgacaaccagatttgttatccacacaatgttaaccatctagtagcaccatattaggaagctaaggtacgacacgcggcaacttcaagctctatccgcagactccatctaccagaaggtcagaaggcataggacagcttagggcctctctgcaatcctgcgggggccaaccatgttgcatttgatactgaaggtgactggctagcattggatggacctcatgttaggagaac

SEQ ID NO: 51318 - DNA, 461 bp, Triticum aestivum
  Clone ID: PAT_TA_51318
gcaacaagataaccgagcagaggtggataataaaagagctcaaaacttttacattgaacacgttcattgacaagccccaccaaacggccccaccccacatcgttaacaaacccatgaaacgggaatacagcgccagcacaaccaactgagacctcgcccaaaacatcccggtcaaaaagaaccgaaaacggggacctaacgcatgtgatcttaaagcgggttcagtcacagggtactcaaagaacaacgtctttcccacaaaccctggggaagactgcagagaaggcattcacctcgaattcagaggcggtgggctcctttgggaacaaggagatcccgatgaccttggcaccatccacaacagttgctgacacgcttacccacaattttagatggggacaacacatcctccaagataccataatgaacagctgccacggccctggggacgagggcgctga

SEQ ID NO: 51319 - DNA, 398 bp, Triticum aestivum
  Clone ID: PAT_TA_51319
gcattcatagtcactgtaagtattcaagtttgaagaatacatgaaggaaatgtccttactaatgcctgagaacctgctaagactgccgaaggatgtttatcactccagttcaatcattagtacttggcaccaaaacgaaaaggaataacttgacacgctcactaaataaggcattgccatccacgaactgacgaaaaccgcttacttcgctccccttgtaagacgagcccaaggagcccaagatgactacaggtaccggaactgttacccggactgccctctgtgcaagcacaacccttgcctgaaacatctgattttacagaaacatgcgccacatggtccccattgtgaagccaacttcataaagcttcttgagctgacgagtgtgcttattctgc

SEQ ID NO: 51320 - DNA, 538 bp, Triticum aestivum
  Clone ID: PAT_TA_51320
gatacaaatatattccaaaaaccatgaaggccttggcaagaggaactacacttaaccattagctaacgaaacgaaccaccaccgggtcctaacattgcattgcacttgcccgtagcctgcatgcagattactggttagaacacgatctccaggttcaccgaccatgtggtttgacgggtaataaggaaaaacaaactcggcggaatgcttttaaagatccaacatactaagagaacacctacaacacttggtgcctctggccaacccaaataccaatttccaccacagaccaatgacgtgaacagggtcggccatctcaccttgtacgaggtacttcaggttcccggatggaggactgaccttttcgcgcacaagggggaacttgactttttgggaggcttgggtatgaccgactaattgcgtgaccagggcctacacgaccaccagctatggctatcttgaggagggtgagaacttgctgtaatcaacggaatagctgctgcctgtgggaaagggtgatacgctcaaaattgcacac

SEQ ID NO: 51321 - DNA, 448 bp, Triticum aestivum
  Clone ID: PAT_TA_51321
cggcacaagctggttgacatattgtcaataggtgagcccattctacggatgtctgcccgccaaaaaattgcccgcacttacagcaactcgggcgtttttgcgattcttgtaacactcgcttggaggaggacatcgaatggaacctacggggaaaattggttaaaattctgggtactcaaaaacaactatgggagtgcaatgcttgtggaaagctattaaaggtggcgaacaaggtttgggactattgcttgcaagtggagatcttatatgccgagctttttgtaggacattacggatttgattcaagaagagccacttgaatgtcatatggggggggatcctgtcacaatatacacgtgaatcctgtagtagaaattaaatgggccaccgaggatttaagggttgcatgtccttagtccaaacacccagtgtatgggtacttgacagg

SEQ ID NO: 51322 - DNA, 407 bp, Triticum aestivum
  Clone ID: PAT_TA_51322
cttgcctcaaacaaatgaaaggacccttaacatacacaagcaagcgttttgacatagatcatctgcttactacatgtaataaatgtaaaggcggtgtgcaaaatttctgctgattttcatgtgcaccagcctagccaccgcagaaacgcggacctggcggtttgtacaactatgccacagtgccctacctgtcggacgactgggtttaaatagtttgtccatgagtccgggacaaacccttcctactatggggtgggctcattctcaatgggggcccacggactgatcatttgcggcgcggggaacagctaattttttgggacaatcctctttcttttaaggttggtttagccactactgaccctctgtgaataagaaaggactttggtctattcggacacgggggg

SEQ ID NO: 51323 - DNA, 556 bp, Triticum aestivum
  Clone ID: PAT_TA_51323
aacaacaaagcaatttttcagtatttgatctgatcatcattactgcgaacttcatctcgctataactcgtagtatacatcaaagactgattcaagccctaccacagccattagaaaacaacagctagatagaaaaaggaaatagcataacaagcagacacacgtcaaattgcccaacattagtcaaagggatctatacgtgggtcatgctcacttgccattgccattcccgtgcacaagcatgttgggcacatcacctggaaatcaccgacaggcatgaattaagatagactgggttctcaagtatgatagaccatttggttgtttttctgctgaatcttccagaaagcatcaaaacgagtattgtgaaaataaacatagattagacaccataccttcccagctcctgaacaattggaacagcgttcagttgtagaaagtgaaaagcgtttggtgcccaacaacattttgctggcagagcaacgggcacatggcaggtatcctgtcccatggcaatatgggcatctgttcttttcttgctgcctcacatttttcac

SEQ ID NO: 51324 - DNA, 117 bp, Triticum aestivum
  Clone ID: PAT_TA_51324
tcgcgatctagaactagtagttctagattctagctggtcgaggagacctctgtcacatcgagtcttctgatacagcttgtccaattcatcagtgagctcctccacggccttgctccc

SEQ ID NO: 51325 - DNA, 480 bp, Triticum aestivum
  Clone ID: PAT_TA_51325
gcaggggacaaacccgtgcctgttgaataaccaaccttgtcacattataacacatactttgtcactactgagcaaaagggaagcccgttttatactgccaaactcacaccttggccaccccaagtgcatctctaccctattgcgggtcacacgggaacaagtactgtctaacactagcaggtgcacatacctggcgaaaagaatataccgactcccattccagatttagcttgtagacctcgcacgctccgttcggtccgaaagaacaccattaggagaccctcttgaataagcacttgctccctaaacactccaactagcactatgaggcccccaagtactatgtacggcccatgcttgcccagcttgtgctcctgaaggacgcccacttgaacttatacctcttggacaggcaatacggccccttcgtcaacttcctagaaggtgtccacaactttgttgagagcagggagacgatcc

SEQ ID NO: 51326 - DNA, 370 bp, Triticum aestivum
  Clone ID: PAT_TA_51326
aggaaaatcattcatttttacatattcataaccccatccataggggggatagatgaagcaattacggggacacgtgcccccacatacacacaaggacaccaagggccgaacaaaagcggagagcgagcaatttaaccaaaagcacacgcaaacccacccttgctggactccattaaataaaagggacccccggtatttaaggataccctcacaccattacaagagtgcatgcattttaacagttgaagaggttacaatttaagttttggccgcaaattgaacccttgccagactggccggcggcaaccttaaactgcccccccttttttttaggcccccccccaagaaaaaccacaaggggaacctgggc

SEQ ID NO: 51327 - DNA, 560 bp, Triticum aestivum
  Clone ID: PAT_TA_51327
cgggtgcccggccttccggctctcgccgccgctctgctccatctccacccagttgatcacccggagcaccagcgactgcgggcagccctgcgccgccgtcgcccccttgccggtagagctgctcgtgcgcttcttcttcagcccggcctccagcgcggcctccaggaactccatgaaccagctccccgcctccgcctgcatctgcttcgccatcctcagcgacgaccccagaggcgagttgcccaccgccaccgctgccggagccgacgacctcttgctcttgtcgtcgccgtcgccgacgggcgtcttgtccaggcacttcctgctggcgctggagctccgggcggcgccgtccggccgcgacgaagggtcctgcagcgtgcccggcgcgaaggacaccgacttggacacgctcccgaacccgagcaggccgcgccgcctccccggcgtggtggccctgttctgcgcgatctcctggagcacgttcggcgccggcgtcgcctcagcctcggcgagcacgtcgctcgtggccgccgcggcagccatggaggtggccgcct

SEQ ID NO: 51328 - DNA, 400 bp, Triticum aestivum
  Clone ID: PAT_TA_51328
gccccggggaaactgggcattttccatcccccccaaaaaattttttaaatgtttgggccccccctttttgggatacaatttgaacccccaacccccccttgggtttttcccgattaaaaaaattggccttttttaaccaaaactttttttccacggaaacgggcccgggggcccccccttttggaaaaactgcccccccaaccccgggggaatgggcaccacgggggggtcccccccccccttgggggcccccattaggccctagggcccccccgggaatccccccccggggccccccttgggggggaaccaccaccccacaatgcccccccccacgggggaggtgaccccctcccccccccccaaaaagcccccggggcccggggggaggcccaaaccc

SEQ ID NO: 51329 - DNA, 433 bp, Triticum aestivum
  Clone ID: PAT_TA_51329
gataagccgtgctacttgcctttaccaaataggtatcctcaatatctttatatattaacaaaacatgcccagcaatcgcttggttgccatgcgggacttaggtgcaaaggataaaacatcagacttaaattggcttgcttaaaaggcgtaaaggcagatgtggtagtcacttctcgacgctgggtcgaagtttttggcagtgtggtcggtgcattctgacggcacaggcaaagtacctagctgagcccctttaccttctcctatgcagcaagagatggtggttgggtatggagaatggtctaaccgctgaaggcaccagactttatcacatcctggttagcataacccagacctgcctggctcatgtaggtgttagcacgccgcacacgcttgagattgtcctagtcctggacgagcatgtgcccgtactgta

SEQ ID NO: 51330 - DNA, 487 bp, Triticum aestivum
  Clone ID: PAT_TA_51330
gctccaaactagtccattgatacgccatgtttaaaataacacgcttgggtgatgtttcacgtgcagtccctattcaaagccatgggcgaattcccaagcaacatatttcacccccggtgctttcagattccaacacattcttgtactgttcagctcctcctccacactttgttcatgctggagaaccccaaaataacaattcagaccgcactgaaaccttcccggtcggtgaaatccacggatttattggccggagatggcctggatgatggtgttgtgccctgggtcgtccaagggctgctgcatgttctactaacggccccttcccggtcacgttgtgctgcaccaggaactccacgaacgccagcttcttctggctcccgttggcgagctccttctccttgttctcgagggtgggggcgaacatgagggggttgaagactctgccggagtagcctcactcgtaccgagggaggctgtagctctt

SEQ ID NO: 51331 - DNA, 391 bp, Triticum aestivum
  Clone ID: PAT_TA_51331
ggaggaataatatgccatgctaactaacccaattccgtatgaaacaacatgcccttgtaatttcatgaggatgtccatatacatatctctaacatgcatgtacgtacaaaaaaagtagcctagagtacttagggtaacactgtggtacccttgttctccatcttcgtaacaaccgattattggacttgtaggactaaaacttgctcacggtctgattgggctaatttgggagggcactttttatatcctcggcctcgtttgagctgagtatggctagtgggcctacaaccttcctggttgctatacggccactaatgtgaacctcttcacttaccacatgtagctcaatcttatgatgcggacattcctgtgacggcactgcttcttgagc

SEQ ID NO: 51332 - DNA, 507 bp, Triticum aestivum
  Clone ID: PAT_TA_51332
aaagcgaacaaacccggtatccaacggagtcgattaagaggaagcctttgcttatgccatttcgcacagacgatatcctacacggtaagcaccagcatgaataacatgtagaaagggcacagggaacccgtagcttgagaaactgagaacccgtggacctatcctgacagggggggcaactaattgcttgagaagccctacacttccaacacaaagggtgccagctacgacatgccttggggacacttgacactggtcattaagtttgtgggagcctcctactgtcacctagaaccaacctactatggggtgtgaacctaggtttcttaagcccttcaaaatcatttaagggtggtttggtggcagcttaaacgcccttcaaaacacttgggacactaaaaacctaaacctggaacggtctttgctcgatacagggacaccggtaccctgcaggactatacatctagctagaacaaaatccaatcctggtagatctccaacaaggcg

SEQ ID NO: 51333 - DNA, 585 bp, Triticum aestivum
  Clone ID: PAT_TA_51333
cggccgcgtgggcgggcagaccgatggttgcgccgccgcgttttgcgcctcgtgggctgcctctgcccgggctgaggaccgcgctgccgcacgccggccgatggccgccgccgcagagccgcgagacaccgtgtttgctgccggacgttgccatgccgggcaccggacgttggccactgctgccgctgtgcgttacgcgcctggccgcctcatcgaaaaatatgcaggcccggagtgcatcctccgccacgccggggccgtggtccacggccgcctcggggtgcagcgctgggagcagccgggccgaaggatgtcgccgctccgcgaggagcctagccgaggtaaacgtcgaccgggccatgggttgctgccgaagtttgctttggacgacattaaaaacgatgcactagaggttagtataacgaaatcggaattgaatcacctgattgatgtatgatgcagagttggtctttgcattattgtcgttttgtacgagatgtgtacagggatcttgtatgttttcttctgatccccttgccgttctgctgttcttgacctttctctgaattttgtgctttctttctc

SEQ ID NO: 51334 - DNA, 295 bp, Triticum aestivum
  unsure (1)..(295): unsure at all n locations
  Clone ID: PAT_TA_51334
cggacgcgtggngaaaaaaaaaaaaagggggaaaaaaaaaaaaaaaaagaagaacgaatctagggggcccggcttacatgctcagagccttacaaactcatagcgtcgcgtctagcgacatctacaatcatttcacctggccgtcatatctacagacgcctgttctgcaaaaaccctccctgtaaaaagcgtggtgtcctctaattaaatcccctttacgccaattccccttttgccataagaggccaataccgattagccttcccaccagttcccttccctgaattgccaatgg

SEQ ID NO: 51335 - DNA, 592 bp, Triticum aestivum
  unsure (1)..(592): unsure at all n locations
  Clone ID: PAT_TA_51335
gnaacatggataccctgncggcgngagaatggtgcaaagcattaacaaaatagcctggttgaaatggtttggctaacgatgctcatttaacgcttaattttcttgtttcatgcgtgctcatcactggctgtcatcttgcaggcgtcgctgtacgcccatatcagaaccagactggaaggaatcatcctgacttcaccagctgtgcgtgtaaaaccagcgcatccgatagttggggtaatattactattccggtttcctattattattccgaattatcctgatttgagaacttttgatattgtacgctcatatcaaaagcagagctactttagaagctctgcttttgaattcatccacaaatccaaaacttaaaattggccacacatatttgttttacctgcatgccaagttgtgtttcatcactgagacttgcctgaatcaatgcaggccgtggcaccgatattctctctgatagcacccaagttccaattcaagggagccaacaagcgcggcattcccggtgtcgcgcgaccccgccgcactgctagcgaagtactctgacccgctggtctacacggngccgatcagggtc

SEQ ID NO: 51336 - DNA, 584 bp, Triticum aestivum
  Clone ID: PAT_TA_51336
aaccgacgcccgtcgcctgcagaacgtgcctggcggcggaaaacggaatcacgctcggtgtggtcgaatcttctgtataggcagcaaggaggcctgtccatcttcttcgggaaggctgagcagaatggagaagttaacagcaagtctcagttagcacccttgagagataccccatttgctctacgaggagctcttggtaggtcaagctcataccttgagcaagccaccggctacacgtgttcccctctagcagctctgctaccaaggatgacttctactactgcaaatggactcctgcactcgagttgccccctgtcatctcctgtaacaaaccgcccgatgtcgccccaccttcctctgaagaagccacagctcagcgcgactttatgaatctcgacatcgtatattcggtgccgagttgggagacgccatcgtatctgctcctctcgacaccaagttcagtctaatgtaacgtgtctgagagcgatttgctgcgtctcatgagaaacatcattttccgttgctgtgactgttattcatcgtctcggataccttgcgacacaactgatagtgccgttggaata

SEQ ID NO: 51337 - DNA, 538 bp, Triticum aestivum
  Clone ID: PAT_TA_51337
accacacgtagccagctaacctagcctattactgagagtcttcctagcaagctatcagactaaatctgcagatgatggctggcactatggctacaactgtagtgccggaggtcgtgctggccgcactgctggtggcaatgctcgaggcagccatctactgggggaacgcgaactgtgacgtgaactcttgcctgtcctactgaaaatgcaacgcaaacggcacggctgccagctggtctggggcctgttggagattggtcaggttatcgggcagctcagcgcgcaagaacgcgcgatggaagtgcataaacaggggcgtcaagagggctaaccgcgggctggatcccagaatggcttccaagttccgcttcaagagccgctactgcatcagctactccatggactgatctaagaactgctgtaagattacttgatggaataattgccgatattatctccaatgatagatgccgagatcgatgccgtgtcccttgccgtacatatacacatatatatacacatatacatgcacaaatgc

SEQ ID NO: 51338 - DNA, 427 bp, Triticum aestivum
  Clone ID: PAT_TA_51338
tgcatggcttcgccgacatccacggctacgggctcgtgctcaactatctggaggtgcctgccgacgagcacggatcgcgccttcatgaacatcaagtctgacggcgcccagagctgcctgctccgtgacgaagtggccgacttctagagaaaaggccacacgcttgtcgcctacagctgcaggtccattctaaccagtcgacgcgacgcactaccataatctggaagaaagaccttacttaaatggactgcgacacttcctcatctgcggagaggttccttacatgggctcccgagcgacaggacagattcacgccgcgatgaacctgatcgctgccccacacccatcgaagttcgagctatgaaccatcaggggtgaccttacttgcgcgggtggcaagaacagcgtcacgtacatcgcctacccc

SEQ ID NO: 51339 - DNA, 476 bp, Triticum aestivum
  Clone ID: PAT_TA_51339
gtattcacataactgccgtgctggatggatgcctctgtcaccaccggcggactgcttccgatgccgtcagaccagcgaaggcctgcccgtctaccaccagatcaaacgccccgctctcaaatacctcagagagagagtgaatgttcaggtgcatacacgtggggcccaactgaggcggcgagagctacgagacactgttttgcatatacaccacggtgctggacgttctcttataaagggtcatctacttgttacgaagctgtgtctgcttgttctagagagataaaagatagctacgtcatacgagagctcacactgccaagagatgactacatatgattcttatcttcacattgttgaatatgcatatgttggtatgcagcagaccagaatcagaagctaattgagatgctggcaaacaggaacggctcacatgtctgatgtgtgcgaagatctaacttagaaacctgctccag

SEQ ID NO: 51340 - DNA, 619 bp, Triticum aestivum
  Clone ID: PAT_TA_51340
agctcgcctggtgtgacatccacacatcgcacaaaaactaccttagaatctgtccctcaagtcgggcatgtgaaatggttatgcacaagtgcaactccaaaacctaatgtgggtaatgccttctactcacgtcttccacctgggatgggagccatctgagtatcttaaacttgcacggtgtgtaaacaatgactcggacaacatacgaaaaagctcgaggcgttgtcacacaaggagctagaagatctatgcctcatattgaacatgaaacatgctgaacctaaacagctaccaagccttgctattgttcacaacactacaatgctaaagttaaaccacccactcactcaagcacaaaatttactctatacataaatgccggaacaacctgaaatgcaagaagttcttatttgaagaagcaccaaccattgactctcactcacgtgagacaaatgcagggcagcaaatgacttatacaccaccacttgggttatgtaaatgcaacaaagcagctgacgcgtccaccgtacatgcaatcttgaacctacttgaataactaccttcctcgtgcatactgttacatgggtggcttctgtagatgcctcctgttacactttac

SEQ ID NO: 51341 - DNA, 447 bp, Triticum aestivum
  Clone ID: PAT_TA_51341
acggcctattacttagtagtagtataaatacaataatgctaaacatacaaaggtttacatggttttttacactgacttggatctttttaaactaactaacctctccccccgatttttataggggtaggccctttctcccccttaatctccgatcaaaacccatctttgtgtaagagcatgtatccttttgtacgtatagcattatgaagaatacacacctgcagattgatgcacaattattgcagatatatacaaagatgcatgcatgcgaaagtagtttaaatttcacaaggtgatcgagtgcgtaatggcgtgagacgtgcggagagcggcttcttcatcgtcttcaaaaagccatccagctttgtgaggtccacgacggcgttcgtcgcaggcgcccactcgaactcatgcacgagtgcagccaaaaaagattcatggtagcca

SEQ ID NO: 51342 - DNA, 543 bp, Triticum aestivum
  unsure (1)..(543): unsure at all n locations
  Clone ID: PAT_TA_51342
ataggtaaagaatttattatttacgtagtaaatactattatccatagcaggagattgacgaaacttatgcaggggacatgtgcattctcttgcacatacagaccactgggttaaagtctaagcaggagagcctgcaagtacatgaaaagctctcgcccacgcaaaattggtccactttattagataagctggaccttagcaatctaggcgttctgctacattgtgtccctagagcttgctgatgaactgcggctgcgtccgcttgtgtgcgaggcctggcgctggtgcttgcgtttcttgatggcgctcctgtgcgccttgaacgactggttgtgcgccgaggggctcttcgactgggacatctgcgatcccttttgctgcggctactgcgctcttgggttagacaggggacgtagaagggattaaggtttggatgttattggtgaagggctggcaactctgaagaaatggcatcagatatgaatgacgaattggattggcaggttaccttgatggattaaatgnatgacaacgcggatagag

SEQ ID NO: 51343 - DNA, 531 bp, Triticum aestivum
  Clone ID: PAT_TA_51343
agccaacaatatctccatttcaccaaccaatcaaccaagcggtaggtatatgtacacattcttctttggttttctcctttcactcccagttactgcaaaaactctgatcacccgtgacccccgatttaccgtcacgaaactatacccgtataaaaggcacgtgcacgctcccctatcccctttttttgcaggagaggcgcgcaaatgcgtaagaaactaagatttctcgcaaacaatctactgccacaccacccgatttactgccacgccgccattgtccggttgtcgttcttcctgccgattcgcaccgccttttttcgcgtggagggtcgaaggaagaagaccggcatggatgtttgttcaccgatgctagtatcctaggaccatgctatccgggaaatgcttggcgagaaggtggtgtttcaggttcatcaccaatctgaagatcaagtagcagggcagttgcatgaacgcgaccgcaaagtaccacaaaggcgccagattagacgagaggtcgaggaacgggtaggg

SEQ ID NO: 51344 - DNA, 455 bp, Triticum aestivum
  Clone ID: PAT_TA_51344
cccatgggttcacctccgctttgtttgccgggtcctatttgggccccacccttgcgggatgcgaggcgtaccaaagattggccgaaacagagcccgagggggtcccggggtcaaaaagttaccgggtgaaaatggcacacggatacaaagccacaaacaaaaagaggcaagaaccggggagcccaaagagtgaggcgaccaaaaacaaaggcgaggcacaaaaagtccgctttggagacgggaaacctggcaggccagaaaccttaatggccagggccactaacgaatagaggaaatctgggaaatagggggccagggggtttttcttttaagcagcaagaccggcaacaactgaaaaaaccaaaacggcagggcccgagagagcttggcccagcgggacacgcaagaatggcccaacaggggaaaagcctggctggcgaaagttaacgacgggg

SEQ ID NO: 51345 - DNA, 550 bp, Triticum aestivum
  Clone ID: PAT_TA_51345
ccttaaacagctaagactggtattttataggctgattaacttattacacacgtctgcaagcatgggaaagtatattattccaacgggacctacaggggtgccgcatgcgtaaccgagacgtgaaaaaacacacacagaacggaaaatgatgtccctcatgagacgcaccaaatcggtcttagacaccaaacattaggctgaacttggtggccagaggaacagatccaatggcatctcccaacgcgacaccgaatgtacgaggcgagattgagaaagtctcgctgaactgtggcttcttcacacgaaggtggggcaacagcggtcggtatgttacaggagatgacagggggcaactaaagtgcaagagtcaattgccagtagtagaagacatctttggtcgcagagctgctagaggggaagacgtgtatcccctggcttgctcaaggtatgagcttgaactaccagaagcaccacggctgagcaaatggggtgtctctcaagggtgctaactgagtcttgctgtaatacttatacattgctgcacaacctt

SEQ ID NO: 51346 - DNA, 512 bp, Triticum aestivum
  Clone ID: PAT_TA_51346
gatggtggcctcccacgaatagacgttggtttcttgctaatcacaaccattcatctccatccgatgggatggtcacgtctctcttcgttttcattccaactcatcaacccgaagttgacctatatatgcaaagtgtgtaaaacaggatgtgttgcgtgttccgatgtctgcacgttgacacccaaaccaatcgaaggatctagttgatgttggcggccctgaactctgggtgcaggagccggccgatctcttggtcgtcggcatccagcggttgtccggtgtcgttcctgacgcgccacacggccgtggtgctgagcgactcgtgctggaacccgtagaggccgagtatctggtcgtccgcgaagttgagcgcgcactccatgccctcacggcacgccacgacatcataggtcgcgtccggctccccgcacggcttgcacccgacgaagtgcgtcacgagcggccaccggtggtcgccgagccccggccgtcacctgctccgcatctcctcg

SEQ ID NO: 51347 - DNA, 313 bp, Triticum aestivum
  Clone ID: PAT_TA_51347
aatcttactttctccatcaaaacaagcgcctgagggcgacagtatgcacggaacattacaattgctccgagcacgctctataatattcaaggttcaaacaaacaatggatatttcttcaggccttattgcatcatatcaagacaaggccaagggccacaccgtctgagaggtggcccgggtacgggtgttattgcactctgccatggagctaaaggctaacacggaaagggactgaagcttcattgattgttctgaagaccatgcatcacttacttgacaccacgtatacacttgtcctccttgttggtgcaa

SEQ ID NO: 51348 - DNA, 379 bp, Triticum aestivum
  Clone ID: PAT_TA_51348
accagggccgggggcaaaaccggaaaacccgcaccggccccgggaggggaaccaattgccccaaaagagggccgaataaaacatcggagaaaaaagggaaaaatccagccccggggggaaaagggaacaccgataaaaaatccaaaaaaaagaaaagccgaaacaaaaaagggaaaacccgggggggcccaaggaagaaaccacctcaaaaaaaaggggggcgacaaacaccccgttttcaatgagaaaaaccgggagccccagctgcttaaaaaaataacccaacccccaaaaaaaggagcaccccaaatgagaccccacattggaacattttttaaacagtgaaacgacaaaaacatgttggcctcatacccccagg

SEQ ID NO: 51349 - DNA, 501 bp, Triticum aestivum
  Clone ID: PAT_TA_51349
gttcaatgccagaagatacagtggtggcatctgctttgtatatctataagtatcacacgcgtgtttgcttatggtgcttacggttctagaatctacatatgcttgtctctgagcaccctatgatcttacatactcacggagaccctatttaaagtaaataatgctccagaccctctattagagccaggacctgagcttattcaacacatgatctgactagctaggcaatagatgctactcgttgtttacgttttgacaggactgctcacacccagagggtctgacagtcttgaatcttgcacagtgctcatggcgcaagttgcctgaattcttgagcccaccatatgcgtaggggcactccttttttgactctttcctagtgacccctaagtcttgcagtgctcccgacatacggagaccccagattgggcactttattgcttcctagtacccgccttatctgttcagctacccgtataaaactcctaccttcttgttctc

SEQ ID NO: 51350 - DNA, 465 bp, Triticum aestivum
  Clone ID: PAT_TA_51350
caattcgttcccacataattattggggagttttaccccccccccccgtatctttagacccttggttaccgcccatatcccccgccccggtataatcgggataatatatgagggcagcaattcagcgacccccgtccacagatatgcctttttcaccccatctatgagttgaccaccttgcatttgttcctgatctggcccctggccccggggaggacccccatctggcccatgcccttgatggagttcttgaaatgggcgaaaaaaacccccttgtcctgcaacttgtcaaccagcccggcggcccgggccttggtgaccaccgtaccctcggaggggaacaccccctgcccccccttgagggtgaccaaataatggctgtccaaggaggtgctgctgccggggtccatgggccccaccgtcgtgttggcgttcgggtcctgctggttacccctgcactgcccct

SEQ ID NO: 51351 - DNA, 436 bp, Triticum aestivum
  Clone ID: PAT_TA_51351
atagcatattttgagaacatgggccaaaaaagatacctgcggacttgcgtcttaacagtggaattccaacatacagggccgccggtaccagtgtttcacacaccgaacacaccaaacgacacaccgccggcaagaggtgaagagagccactgcgctgaaacagcgactcccctaattaaacgcgcgaaagggtagccctcatagaaaaccacccacaggggatcaccagaccagtcccaagttccaccctttataacttatggaacgcacgtaacgtacgcacacgcacgggcagagatgaggccagccaccacccgttaccggagaccctatctaagcggtggggctcattgtcatcgctgacctccttgagcttcttgtggcccagcttcttctacgggggctaaaggaagaacaagcccccgtccccaaccga

SEQ ID NO: 51352 - DNA, 418 bp, Triticum aestivum
  Clone ID: PAT_TA_51352
ggggtggggccaagtctggggagggggggggggactacagaaagaacctcgttcaaaaaacgggaaagaaaagagaatattacatgcgaccccgaaaatatcaacagaaaattcaaaactcaagcccggtctctctagcagcatcgggtagagctttgaggcggccatgggagaggaaacccccccgggcaaagaccacttgggggattcctttctccaagcaggacttggcaaacacttcaccaaactttggggccacttcaggggggggcccaacagagaacccaagctcctttgaaagagctttgggcattggtgaggctgaagccaaagggcacgactttggatcggcaatcacctgagcatacaaatgcttggttgagcggaaaacgctgaggcttggcctctctggggggcc

SEQ ID NO: 51353 - DNA, 504 bp, Triticum aestivum
  unsure (1)..(504): unsure at all n locations
  Clone ID: PAT_TA_51353
cccagcgtccggnagcacacaanaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcagcatcgatcatatcgatctactactaccataccatgtaaccgctacctgatcgagggccttatctatgcacctgacctgcatcagcagtcaggtgccatgccatgcttgttgtaaacaggcccccctaaataaaatctccctggtttaactna

SEQ ID NO: 51354 - DNA, 378 bp, Triticum aestivum
  unsure (1)..(378): unsure at all n locations
  Clone ID: PAT_TA_51354
ctactgtggnanaattcgacaacgctggtgccatgatgagtgtagatgatacattgatgtgctcgttccaaatattgaagcctgcaaggaagatgatgggtggttcaactaataacaaatctggcttcaagtcattcaggggatggtgacaacggcctgatggtgggcacgctgcgttcgacagggggtacatcttacagcggctgcaactaacaggcatatgcattttcgcggaaacctgcttgggccttggaagggcaaagcagatgtagaactgtgcatcttccatgttggattaacacttgatgtaatgtattgttatcggtttttactgtgcggatctccttatgatatgggaggatgtgaatgagtactgcc

SEQ ID NO: 51355 - DNA, 452 bp, Triticum aestivum
  Clone ID: PAT_TA_51355
acaatgaataggtctagctcactataaaatctcatctcaggtgcataattagctggattacaacacacacacacacacgcagtctaatatcaaccgaaagtggatacagaaatcccagggggaaccaagcaagccaacagcgcattggagctcttccaccttaagattttactcggcaccattgcctggatgcctccaagatgttgtcaggtttcgggctttccggtctaactggatgttctctagagcagtggatgtacgcaatacttcctccgaaagatcatccgcatcatatccccagttgtactcatctttccttgtattggaagcggaagagccccctcttcggtctgatgtctgcgatggtggcatttgccttcccataggaggcatgccagcgactgaagatgaacggacgcgtgggcggacgcgtgggcggacgcgtggggtcg

SEQ ID NO: 51356 - DNA, 456 bp, Triticum aestivum
  Clone ID: PAT_TA_51356
atactaaaattttttttagcagccggattggaaaaaaaaaagaaaaagggcaaacaaaaacggggaacaacggagagaggggcgggaaccaaaaccaaccaccacggggccggaaaaaacccctttgggggggcccccggccggacggggaccgcaaaattgaaaaactgggcccccagcccccggaccaagttccgggccaccaaagccggaaccccggcaaccgggagacgcgggggggtgaaccccaccacatccccggggaagacatccgcttgcaaattcgggaggacgggaaccaccccgggaaaggaaaagccccccgccccggattgaaacaccccagaaacaaatgccggggcgggggagccccagggaacggggacataccccccgttgacaccttccccaaagtggaaaatccaaaaccttctcccgttcctgggaaaaggggcg

SEQ ID NO: 51357 - DNA, 298 bp, Triticum aestivum
  Clone ID: PAT_TA_51357
ggttaaaccagggagattttatttaggggggcctgtttacaacaagcttgggttggcacctgactgctgatgccgggcaggggcataaataaggccctcgatcaggttgcggttacctggtttggtggttgtggatcgatttgatcgatgctgcccccccggtgcctgcttgatcgatgatcaatgatctagcagctgccgctggagcagccgtcgttggggccgcacttgcactgggggcagccggagccgtcgtttttggcctcttttttcgtgccccccgattggggttgtgggt

SEQ ID NO: 51358 - DNA, 424 bp, Triticum aestivum
  Clone ID: PAT_TA_51358
aaaaaaaaacccccccccggggcccaaaggcataacccggggaggggtttttccttccccacaggcagtccaaatataaaacaaggggggaatttttcccccaaacaacaaggggacgggaaaacagttaaggggggctccagttaaaaagccccggcctggccaaaaaaacctaccaaaaaaaaaaaaccggttgaagttgaagttgaatcgccccctcccaaaaaaaagggggtgtttacaaacccccaaagaaacaaaatggcacaaacttaaaattaagtttaaaaaaatcccgggcccgggtggacggtaattccccaaacacaaaacccaaggatgattggccggggggaaatggggggcccaccttagggcccccttttgggggggaaaggaaagcccccggagggaaagggggggc

SEQ ID NO: 51359 - DNA, 485 bp, Triticum aestivum
  Clone ID: PAT_TA_51359
ggcggattgcgaatttatctatgatgttgctccaaagtattttgcagtgcgctaaggacaaatgaagcctgacctaacgggccagttacagaacttggcatatcaactctagtaatgatggtacatggactctaatctctgggcccaaaactggcatgcaaatattcagcgatttaccggatcagctatacatgtataacctttgccaaggccatgaaaaataactagggcattcgcaagcgattaacagcagcttttcttaagcatcgcaaacacaggggaggatcactgattccggttggccatgtgagtttaaccatgaccatttgtcatttcatgcttgcgacagctcaatcatcatcgggttgatcatttccgccgtgacggttgtccccgtagttgacccatgggagcagtgattccaggaagaccctcgcagcgttgcgcccaacaacttcaagaggggcatgtattctctcaggccc

SEQ ID NO: 51360 - DNA, 368 bp, Triticum aestivum
  unsure (1)..(368): unsure at all n locations
  Clone ID: PAT_TA_51360
ggcggtgctcattcacatcctcccctttcatagggagatccgcacagtnnaaaccggtnncattcccttncatcaagtgtttatccacttggttgatgcacagttctacttctgctttgcccttccagggccaagctggtttccgcgcaaatgcctatgcctgttcgttgcagccgctgtgtgatgttccccctgtcgtacgcagcgtgcccaccatctggccgttgtctccctcccctgtttgacttgtcgcctgttttgttgtttgttgtgcctcccttcatcttccttgctggctttcttctttggttcgtgctctttattgtttgatctcctctcgtcatggcccccgcgtcgcccttttctcc

SEQ ID NO: 51361 - DNA, 617 bp, Triticum aestivum
  Clone ID: PAT_TA_51361
ctggcttatattctgtctgtggtctacccatcctccttctcatagctgacaccgagggtggcctgtccggttacaaacagcgtgctgatgtggctacgaataatacagacggctacatcaggtaactaacctaaccacctggcgttgacttattgaactcatggaaaataaacaagctcgcatgcacaaagtatctgttgaaactatatcacagaatggattatgcttgtcgctatgtgtgtatggaactctgccgactcatctaacgattgtatattatgaacgaaatttcactggattcaccacccgatcctgaaagaaaaaccaaaaaagtgtcagcctaacttcccaaattctagcctctaaccatatttctgtggaacgaagaaagaataaacacccaaaaaacataagctcactgtgcattgtgcaacgagatgagtgattgactatgataaatgctgattggtgatcatagagatgtgaaaaaaaaaaaatgctggaggccagtcctgatgatgccaaacaactctcaagagcatatctacctgtaggatggtatactagggcaaccatttttaaagccacttgcattgcatctcatagttgggactcat

SEQ ID NO: 51362 - DNA, 586 bp, Triticum aestivum
  unsure (1)..(586): unsure at all n locations
  Clone ID: PAT_TA_51362
cccgggtcgaacccacgccgtccgggaaggagctaggagttctcggtctcgccgcagaacaacttggcagagcgagtgagcaaggcaagggcgaggaaagcaagggaaggatacatggcgtgcgcggtggcaccgggctcgccggtcttctcgccgtcccgcctcggcctgctccagcagttggagcagcagctccaccaccaccaccaccacggctgctccagcagcggcgcctccttcctcccctcctcgccgctccgccccttcgcccacctccgcgcgcgcatccaccccgacccctccccgtgcgccgccccgccgctgcccgccgtcaaggctgaggattcttcttctgttgctccggctaaggccccggtcaagcgcaggcgcccggcgcctctgctagttccggccgcggtcaccgtcgcgccggcggtgctggaggccgccgcggcgagcggngtggacgaggtggcggagcagggcgacggcttcgcggccttctgccggagggggaagggccggaagcgggtcgagatggaagaccgccacgtcgccgccgtcgcgctcggcggggaccgcgcgc

SEQ ID NO: 51363 - DNA, 243 bp, Triticum aestivum
  unsure (1)..(243): unsure at all n locations
  Clone ID: PAT_TA_51363
cggncgcgtgggaccanaanaactttgacatgggggaagaggggacttggatctcagcttgtgaggagatccattagccttttgatgaaggttggagccctgacttgtgtgtgcattatttaagtagctaaggagcatcatcgagcttgggctcttgaccaggctcctcgcccttggggccttggatttctcagactttgccggagggctcaaaggaatctccaaactagttctagatcgcga

SEQ ID NO: 51364 - DNA, 338 bp, Triticum aestivum
  Clone ID: PAT_TA_51364
gggggggaaaacatatggggccatttaatacatagcaaaaaaggggctcctagatgactttttttgttaaaaggggagacaagaaattttttgaaggggcgggcccctcgttaaacatcctaggggggcgggccccccttaaacccctccaaaaaacccctttttaatttattcatcccccggaatgaaaatggaatcccagggggcaacacttgacacacacacaggagtacacgggacccacgacgcccttcccctaacaaaaccaaaaaatttccaccaaccacacacgcccgaaaacttaactccacaaaaaaaaaatatcccggacccctggg

SEQ ID NO: 51365 - DNA, 530 bp, Triticum aestivum
  Clone ID: PAT_TA_51365
attgcattcacagagacggcttaattatgacagttgatctctttgcacaaactgctgttactattcaacaacaacatatcaggagtcatcctgatggaatgtggaaatccagacatggccaaccagccccaggatcggcatgactaacctacctacaggaaggaacgcatgcgagggcgcacgatggactgcgcgccgtcgacgtagatggtggtgcccgtcatgaaacgggactcatcgccgaccaggtagagtacagtggacgccaggtccttctccgggtccagccaccgccgcagcggcatcacctccccggtcgccttctcggccttctcctccccaacagagacagggaacttgtcccccaggtgcaggccgcggcagacggcgttcaccctgatcttgtgcttgccgagctccatcgccgacagtctgacgagctggtgaacggcgcctaaacttgtgccatatgccgccgcccccggatacaatcctctctcggcgccgatgatctgggtcaagcataccac

SEQ ID NO: 51366 - DNA, 206 bp, Triticum aestivum
  unsure (1)..(206): unsure at all n locations
  Clone ID: PAT_TA_51366
agttggcacaagtcacattttattncaccaaagtaataccatcagtgccaaaattacacaagcattcgtgtggcagcatcaatagagcaacatatatatgacagtagagttcttgtagatgccttaggaataaggatcacaatataagtagataaagtaggttcctcataggccaaggagctggcagttctcccagagcgttttgg

SEQ ID NO: 51367 - DNA, 212 bp, Triticum aestivum
  unsure (1)..(212): unsure at all n locations
  Clone ID: PAT_TA_51367
gttccatctcaaaagttttcacaacgcctcatnagattcggcattttacagtgtctgcccgctgggtgctattccggcctctcaaggccttttgcgctttgtngcgtctctctttgttgaangtgccacacatatcagcgttctggggcccacggatgctagatcccgtcttgtttatgacggttttttggggaccatttttgcggtgagct

SEQ ID NO: 51368 - DNA, 401 bp, Triticum aestivum
  Clone ID: PAT_TA_51368
gggggaaacgcggggcaaaaacgctttttggtatataaagataaaaaagggtcgacaaaaacaggaaaggggtaaaaagcatgggtctggtcgttacaatccggcataaatgacagaaagcaaatcgcagggttacgttgggagcttgaatggaaaaatacatcaaaaacagacagggccagctcctgggtacaaaaacgatgcttgggaggaacatgcactcgggtaaaccaatctccaacttggagggctttgtttccttaggagggcactggtatgctataaaaatccggggtacctgaaaaaaatggggggccgagctcgactttaatgggggtccctgcactaggggggcatttgggaaaccttctcgggtaggccattgacggccccttccgttt

SEQ ID NO: 51369 - DNA, 582 bp, Triticum aestivum
  Clone ID: PAT_TA_51369
atccgtctatcagtctgctctcatcgtcaccggcatccttggccatgaaatgctgtcgacgtcaggcctgaagatcaggacctgggcaaatgttcctcggggaagcggactcggaacttcgagcatactagcggctgctgtagtcaagtgtctgttccaactcatggaagacgatggaggcgatgataatgtcgccagggctgtgctggtagtagagcagataatgggcaccggcggcgggtggcaggaccaaatcggtggcctgtatcccgggatcaagtgcacccagagcttcccaggacagccgttgcgcttgcaggttgttccattgttggcatctccccagttgatccaggaactggagcaacgtctccttgtcgtgttcaccggccaagtgaggctggcgcaccgggtgctggagaaggtggtgacgcggtacctgcggcgcgacagcctgctgatctccagcatcaggcggctggcggagctggccagggcggggagggaggccctgatgaacggcgaggtggacgagctgggcggcatcatgctggaggcctgggggctgcaccaggagctgga

SEQ ID NO: 51370 - DNA, 600 bp, Triticum aestivum
  Clone ID: PAT_TA_51370
atccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctcactgagagtggtaacactaaggatgacctgaagcttcccactgatgatgttctgcttggccagatcaagactggatttgctgatggcaaggacctgatcctgtctgtgatgtccgccatgggtgaagaacagatctgcgctgtgaaggaaatcggtggtggcaagtaagcagctgtgcgtggttgcctacctgcgatacttggtatcta

SEQ ID NO: 51371 - DNA, 558 bp, Triticum aestivum
  unsure (1)..(558): unsure at all n locations
  Clone ID: PAT_TA_51371
aacactgcatagtctaaacctttttgtcaaatgcaggagtgtgcacatggtccttgctcccacaatacaaaccggataactcagtttgagtttcctgacagattcagatcaaaagctaccaagaaaatatagcaaacggattgtctaggttcagaacggtcaacgatttctaaactatggaagaaaactggtgcttcaaatcttctttttcctaataataatgaagtgcttcaaaactttctctaatggagtgcttcaaaacttgatgtgccttgatatgtctactgtatgtatgttccttctaatctctacctgctcaggctcaccaagcgtgcacccctatcccctctagatggcataccagactgcgtgcgggctcttccatcgtggaaccgtgaaccgccaccaccatagcctccacgggatccctggccactcctgtcgttttggtaaccaccaccacgtccagaacctccggttcgcccggcatagcctgacctcccaccgnctcgccgnccttgtgatgatacaaagttctcctgccacttgcccaaaccg

SEQ ID NO: 51372 - DNA, 195 bp, Triticum aestivum
  unsure (1)..(195): unsure at all n locations
  Clone ID: PAT_TA_51372
ggaaactcttaaaagggcggccttttttttttttttttttttctggttccgtgctttgcctaccattcntagcagccgccaccttagtggctctcattggtcacgtttttgctgcccttcggtcctttggtctatttgctggctcttttttgtcntggcctcgccgttcggggggggggtccgcccgatgcgagt

SEQ ID NO: 51373 - DNA, 523 bp, Triticum aestivum
  unsure (1)..(523): unsure at all n locations
  Clone ID: PAT_TA_51373
ctagnaagcactgacctctccaggataaggcagaggcaattatcaggttcttcagggatccgcagttctacttaagccctaaaatcaactaatttttgcaggcaaattaaggtcgattggctgctgaatctgaactgggatgaactcaaccgactgccgaagccattggtccgtgtctgctactgactgccctggtagcgtttaacgatgctatgttgctgtagagtgccacagatgtgtgtttgtgaggatgtagtgcggtaacgatgccatactgcttttgcttcggattttttactgcaaaaaatcagctggttggcttaacacggcgatcgttcggacagatttgcccaactcttgtgctggaatacttgaacggcaccccagcctactctgcanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaangggggcggcgcgttttaaa

SEQ ID NO: 51374 - DNA, 237 bp, Triticum aestivum
  unsure (1)..(237): unsure at all n locations
  Clone ID: PAT_TA_51374
ctgntaccggncgaggnaactcagtttggactaatctcacttatttccgcattgatggattttcagttttccaataatgtgagcaaatcaggataggctagttcacttcagaatgctggngaaatattagcaacctgctattaccatctacagtaataggctaattatgggtcacttgctgtaagcatgtgtaattggtgcctgaactcctttgaagtgcttctagcttgttccttt

SEQ ID NO: 51375 - DNA, 526 bp, Triticum aestivum
  unsure (1)..(526): unsure at all n locations
  Clone ID: PAT_TA_51375
cgccgnaccaccgcccgcggcggcggggccgcgcctccgcctgcacgcggagacgcagaggacgacgcgcgggtgccgcccttcacgggngaacaacaccgaccacaacccccgggagctgcgttcctgggcccgccgcaccggcttccacccctccgccttcttctccggcgagtccgcggtctccaactcctccaccgccaccgcgcgtcccccgccgcctccgcctcccccggcatcctcccgccgcccgccccgccctcccgcggctgcggaggacgaccccgatcccgcgccgccgctcgacctcgaccgtcgcggccaccaagtccgacctcgccgccgcatcgacctccgcggcgagctcgagatcccgcccgccgccggccccgtcgaggtgccagcgcaggcagaaccggcgaggaggagggacggcgtcgagcgcctgctcggcgagagggcggcgctcaatgtgggcaggagcgccaacggcgtgcgcgccgacgtggatgcggatacgagtgcg

SEQ ID NO: 51376 - DNA, 582 bp, Triticum aestivum
  unsure (1)..(582): unsure at all n locations
  Clone ID: PAT_TA_51376
ggcggncagctaccgcgcgctgctgcgcaccgaccagctccgccgcggcggcattgcgcccgcgctgtcgccggcggtgccggagagcgtggccgtgctggagcgcgacctgccgatgatcgacttgaagcgcctgacgagcggcgacgcgggggagaggaaggcgtgcgcggacgccatggcgcgcgcggcgtcggagtggggcttcttccaggtgatcaaccacggcgtggggcgggagctcctggaggagatgcggcgcgagcaggcgcggctgttccgcctgccgttcgacaccaaggagaaggccgggctcctcaacggctcgtaccggtggggcaacccgacggctacgtcgctccggcacctctcgtggtcggaggccttccacgttccgctcgccagcatctcccgggaggactgcgactacggaaagctcagctccttgagggccgtgatgcaggaggtggcggacgcgatgtcgcgcgtggcggacacggtggcggcggcgctggcggaggacctcgggcacgatgcgtggggcggcgagccggcgttcccggcggggtgcgacgggacgac

SEQ ID NO: 51377 - DNA, 580 bp, Triticum aestivum
  Clone ID: PAT_TA_51377
cggccgcgtggggcgccggcgcctccacttctctgctccctcgtctcctcgcgcgcagggcccggcgaaagggaagcaagatgtacaccgccaggaagaagatccagaaggacaagggcgtcgagccctccgagttcgaggacaccgttgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggagctggagaagaagtttagcggcaaggatgttgtctttgttgcaacaagaaggattgtgaggccacccaagaagggttctgctgttcagcgccctcgcaccaggaccctgacagctgttcatgatggtatcttggaggatgtcgtgtacccagctgagattgtggggaagcgtgtcagataccgtttggatggtgccaaggtcatcaagatctacttggacccaaaggagcgcaacaacactgaatacaagct

SEQ ID NO: 51378 - DNA, 402 bp, Triticum aestivum
  Clone ID: PAT_TA_51378
ggcaaaggaggcgggggggccgcccaaggatcccagcacaaggaggggggcaaatcggcccaaacgaacgccgggtaaaaccaaccagctgatttttggcagaaaaaaaccccaagcaaaagcaggaggggatcgttaccgcactaaatcctaaaaaacacaaattgggggccccctacagcaacaaagcatcgtaaaacccccccagggcaggcagtagcaaacacggcccaagggcttgggggggcgggggagtccaccccaggtcaaattcagcagccaatcgaccttaatttgcccgcaaaaattaggggattttagggcttaaggaaaacgggggacccctgaaaaacccggaaatggcccctgccttatcccgggagagggcagggctttttaggg

SEQ ID NO: 51379 - DNA, 474 bp, Triticum aestivum
  Clone ID: PAT_TA_51379
acagtgagcgaataaacacttgaatcaagtggagtgtctagaaacaaggggttccagacttccagttaatcaaacatacatacattgtctaattaggcatagcagattgcatacccagaggataaggatcatctcgatgaaggactttgatgtaactttatatacattatgtggcaggcactaacaataactcctaggtaacaattagacatgatgatacatgacccctcggacattactatcacaatcagaaagactaaaattcatctctctattcgtcattaaattagtgcaacgcagggaatagcttgaagcagaagagcagggaactcaccccacccggggttctcggagacgccgcagcggagccctgatggccgattaagaggcgccgtctcctcgccgtggacaccgttggcaacaccgtcctcctcgttggcccactgctgctgttagtacgcggccagctccgcg

SEQ ID NO: 51380 - DNA, 508 bp, Triticum aestivum
  unsure (1)..(508): unsure at all n locations
  Clone ID: PAT_TA_51380
atcaccatagcatcatgttatatattccattgattcctccatcattatcgcgtggtatagtacccttatcacctagnggcccaaaaggnggccgaaaggaaaactagaatagaaacagaaagaattaaaaaaaaaaggggggggagggggggattatctccgattccatactgcgggcgcacgacgcttctacggtgagatttgagtatttcaacagtactactgtacgtgttaagtacagaggctgtgattcatggcgtcaacgggagactgtttgagaaagttggggagcccaatttttttgccggttctcttgacatcgtcctgcaccttcctccggtactccccgaaggtaaacggcctgtacggcgacggctcgccgcatgtgccgaccagcgagtcgtacgacgggcacaggaagtaggcgacggataggcgctccgccttggcgttggccaccactttgtgctccacgctcttgtacctgttggtgctccactcctgaaac

SEQ ID NO: 51381 - DNA, 535 bp, Triticum aestivum
  Clone ID: PAT_TA_51381
ttttttttttttttttttttttttttcaaaggcccccaaactttatttgttgttccattccggtggtccaggccggggcaccgggccccacaccaaactgaaaattccaacgcagtccctgtaatttgccgaagggccccctaggggcggggggaggaccgcattcgggtccaagccactcccgatcgactccaaactcgccggcgccggggccatccccccttggtccgtcgggttcttccccgcggctggccgtgaacatcgcgcttgagttgccctgcctcccttattgcttcaaggcttggaggaagaggtttggccgccctttggccctaggtttcggtggcgcggcggcgctgctcgccggttgtccgccgggggcgccaaggctcacccccctttcatgattcgctctggaaccggtcctaagagccgttttcttccccttcccccgtcgccttgcccccccccttggttgactgccgttggccgtgagcatccgatggggtttccctgcttccccggggaagaacat

SEQ ID NO: 51382 - DNA, 486 bp, Triticum aestivum
  Clone ID: PAT_TA_51382
aagaactcatccaacaaattcataaataaaaattccaaggggaagaaagaaactacttcatttcaacaacataatttaaatatggatttccctttcgggaagccccgaagggattacccgaactaggaaggataccttatttttcttggcgattacagcgccttcgatatgggggctattctacaagggggggggggactactactaaaagggctctggaggctgctctttttgctcgagggagactttaggctctgcttgggttgctgctccgttcttgggaagccagcctctccttttatagtcgagggaggcgttagggagccttctcttttttattcatatggcaaagccttctggagcgaggataaggatgtcttcacgagaacggctggcagcttctcgttatttgcattccggcctcctcagctcctcgttacttgcattgcagccttctcagcttcgttactcacattctgtcttgac

SEQ ID NO: 51383 - DNA, 521 bp, Triticum aestivum
  Clone ID: PAT_TA_51383
gcccgcaacaagcaattgctaagctgactacgaccgagcgcacaaggacgatctttttttttgagggaccaaagcgaacggcgggccaatggcgaccgccaggacagggatcaagtgcacagagctggtggcatgggcaggccgttacgccgatctcgatcacggaggtggatgtggaagccgcggacccatggacgtgcaagtaaagatcctttacaccatcctatgccacacttacgtttacttttgggaagacaatgagcaaactcctgatcctccaggatcttgggccatgatgctggcagcattgttgttagcgagcaacatggcttgaccaagcttgagccaatcgaccatatcctgccctgcgttcactaacctattgtcacgattgtgctgactggacctagatgatagcaaccttaatgtacctcctcaggaccaatgtctacctagcaagatgatcacctataggcatttcctgttcaccatcagcgtgaaaacgatattccacttgttcg

SEQ ID NO: 51384 - DNA, 587 bp, Triticum aestivum
  Clone ID: PAT_TA_51384
cacaattgaaacagctgcacagcatgtcacactttttcgacaagatcatcagtatcccccaaaaggagagacattcgggaagaccataactgaaaatgcagaagttattcttaagaaactcaggtacttaaggagaagaggataccaaggagcattacttcctcaggagtggccgggatttacttcttcaaggaagaaatgaaggagtggactgggatgagggttggggaatcaaatggggaatcaaatgctgtcctgaacgtaggaaatggaaaggttactgcaaatgggttccacaaggcagggaatggaggcaagggtgcttcctcaaccggcgtcgaccctgcttcctcaaccggcgtcgaccctgcttcctcaaccggcgtcgaccctgcttcctcaaccgccgtcgcccctgcttcctcaaccgccgtcgcccctgcttccccaaccggcgtcgcccctggtgtgactggagctcaggttggaggtgaacccaaggttgagtgatttagccgatggaagtttcttaaacatcactttttgttgcccctggtgtgactggagctcaggttggaggtgaacca

SEQ ID NO: 51385 - DNA, 360 bp, Triticum aestivum
  unsure (1)..(360): unsure at all n locations
  Clone ID: PAT_TA_51385
ccgngctcctcgggtgtgcagccatcgccttgttcatcggaggagggccgcatctcaagatctgatacacaaaggagatgcagttccagttctaagactccggagtacagcaaaataagccccccatgccctacattatccagcacggggactgtccgacccctcttgatatcttacagaagcgatgcatttttattcttgtagtacctccattttcgtggccaaatgttagctgcacaccttggcagaggcccacatttctttcgactccacttttatcattattggtttgaaacatgagcattggatgagtccaacattcgaccgaaagaaatcacggcatcgccttttttttttgcg

SEQ ID NO: 51386 - DNA, 573 bp, Triticum aestivum
  unsure (1)..(573): unsure at all n locations
  Clone ID: PAT_TA_51386
caacattgctggnaaacacattgttgctgctcagcgggagaaggttaaagatgccatgacagtgttaaccacttctaccaagtctgacaactctaaattgggtgtgtctgacacaaaagaatgatactggaaccaccatcctttttgaagggcacaatgngagaaaatagtcgagtttattctcaggaacgggaaggagtttgaacaaaagctcattgagcaagacaggatgacagggaggtttccatttcttctcccgtctaatccatatcactcgtactatctcaagatgcttcaggaaacccaagagttcaagtcccgtggtggttcttcagagcacaaagacagaaggagctcttcagagcgccaagactggaggagttcttcagagcgcagagacaggaggagttcagaacgtaaagacagaagatctatggatcgcaaagatagaagttcttcagacctccgagacagtggccacgacaaggggcgggngaagtgctaacaaggactcaagcacttctgatagaagctccgcggaaccatcacagaagcagctttctgacaaacaag

SEQ ID NO: 51387 - DNA, 603 bp, Triticum aestivum
  unsure (1)..(603): unsure at all n locations
  Clone ID: PAT_TA_51387
gnctagttctagnaggcaggtaagggaggaggaggagagcggcggcgaagaggtgtcgctgaagctgcagaagcgcctggcctcgagcgtcctcaagtgtggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggccaagcgcgccaagagcaaggcaagcagggagaggaagcatgccaggagggaggagagattggctcagggccc

SEQ ID NO: 51388 - DNA, 509 bp, Triticum aestivum
  Clone ID: PAT_TA_51388
gggaaggcaaacagaagccgccgcggcgccgagccctcgtgtcgccgtgcagccccggccccccactttccccccgtgatccgtccgtggcatctttcgtcctcccggccggccaccagaacaagccccggcccaagcctgacttggggatccttatctgatcgctgggctctatgctgtctgactctgcttgaggagtatgacggtgcaggaacggcgattgccaagcacctaatatatcagattggcgggatctacctcatcgtgcgccgagtctgggtcctccaccaaccatgggcaagctaccccaaaggaagatgcacggcctggcatctgagggaattcttctgcgtgtgcacacaaacgacctacatgcacgacaccatttccttgctattgacccgcattctggtacagtgccttcacaaattacacaacccactagacgtcccttatgattttaaagatagaaagcatccatacactctcatatcccttagacctgcctg

SEQ ID NO: 51389 - DNA, 565 bp, Triticum aestivum
  unsure (1)..(565): unsure at all n locations
  Clone ID: PAT_TA_51389
gggcaaatgattatttaagaagnatatgcttgagttggatgcgctctctcatttccactttgccccaaagccggtcattgaggatatgtccatacaagttaatatacctgctctagcaatggaagaggttgcacctgtagctgtttcagatgccgcaatgctcgctcccgaagaagtttttgaagggaaaggggatattaaagaagacgtggagcttacacaagctgagcgcaaaagaagaagagccaacaagaagaggagatatgcagaatcgcacaaggagaggccagccaagctgcggaaagagaactcatcaaatatataggaagctgctgcttacatgctatatgtattgcaaacctttggagttggttggagggaggaccgccaccaacagtgtaatgcctttcgtgatctgatgcctggcctgcaatttcaaggctctgatgtagccagttttcgagctttcatgcagtgtaaaagcatttccttttagaatttctcacagggagtgagtgtcttctcgagtagaatagaattgaactcttgcgagtataagagtgtc

SEQ ID NO: 51390 - DNA, 519 bp, Triticum aestivum
  Clone ID: PAT_TA_51390
actattacctttacaaatcaattccacatttattattaatgtttttaagacactcaacatatgcaagtatctgacaccaacattgcaaagaagactgacaaccatagaaaacagcaaaaattctgcagacgggatagattttaacatacagtgcgattagcactagacctctttggagcccatgtacaaagcacaggaaagttggaccagcagatccctccttgaagtacgcgaacaccacgccggcatcataatgcctgctctatccaacaaaaaactaaacgtccttgaactaactaagaaaatactcatgtggcggactaaacatacttcaagaaagcatctagggcatcccctccaatcttggcagacaggataatggacccatcactgcatgtgaaagataaactgcttcttgtcaaaagcaggaacgctccctgaatacggaaggtgtcaacaatgtcaaccaccttccacggcctggtcataaacaccctcatgatcaccaccaccctcagc

SEQ ID NO: 51391 - DNA, 397 bp, Triticum aestivum
  Clone ID: PAT_TA_51391
gggggcggccttgggggtcaacccaaaaatcaaaaaactaaaaagggggccaggcgcccaggtttcccccaaaaaaactaaaaacggggcgggcgggggggcccccccccccccaattaaaacctatttaaaaaaaacccaaacactttgggacagggacccacaacccttcgggggagggaaaaaaaacaaaaaaccccccggggggaaaaacccccgggggggacccaggggtttaagagggaaaaaataaccccgggggggggggcattttggggggggcccccaaaagaggaagagctgaataaggctttgcccccccttggttggggcggggcccccaaaaaaaaaaaccggggaattggaatccccgggctttggaacaaggccggggaat

SEQ ID NO: 51392 - DNA, 496 bp, Triticum aestivum
  Clone ID: PAT_TA_51392
gacatcaaaatggtcttctaccctcttgtcattgtaaacatgctgcgccaaggtggattttcccatgcctccaagtccaacaatggctagaccagaatacctacgtgtaccagactcaacagcaatcggcttcgttagaagatctataatatcatcacgatccttgtcacgaccgatcactctcggaagtcctattgatgtggccactggaataacagatgtcagtactgcggaggcctcaacaccattaccagcaggtaagcaaagcaggtcgcggaagtccttgactttcgccaggatggccttcagttccttcagctggtcgaatagctttttattctttgggcgcatattggacagcctgctcgacacagtacgcatatgcttcattatagcgtcactggaagatgcatgctccagcgaatgatccttcccgttctcagcttcgcgcttgaggatgttgtactcatgctcatctagcaggtcctcagcttta

SEQ ID NO: 51393 - DNA, 516 bp, Triticum aestivum
  Clone ID: PAT_TA_51393
gcatgaaattttgataacagtgaactcggtaatacagtgtgcaccatgaacggcagactcttaccaccaaacttacacagatatactatggggccgcaaaaacagaattgcgacaagataaggccacagaatgtgaattcctccactaaacggagcatgagaaagttctaactgtatattcactgtagccatccatctagcataaaatctaaatagaaaagtaacaggttacggtacatttacaacactacattggaagaactgtattggtgcctcgctgcccggacacactgcttgatgctcctcggttcgtcggttatgataggcggtcctgtacagtcgggccagtatacatgccagggcgcatgttaatgtacacaggtgagtttatggcttcaatccaggcataattatctgggctgtcaactgtctttgcgcgtccgcttgagaagctagaaaacggataatcattaaaataggtgcaaattcgaccagcatcttcagcatatggtgggg

SEQ ID NO: 51394 - DNA, 523 bp, Triticum aestivum
  unsure (1)..(523): unsure at all n locations
  Clone ID: PAT_TA_51394
gcaactggcgagnaaacatatactaataacaacaacggggacacattacacaatgaacaaccggaaaaaagaagacatacttcaaactcatgcgggctgcattcaaatccaaattttggttttccctgggtttttctttcgacggcatcacacatcagagctctcccatcctcttggcgcattccacgctgcagtccagcgtctcctccacaccatacttgaacctgaatcccagatccacaagcttgctcgaatcacccttcaccctcaccccctctcccgccaccttcttgagcagtatcttgtgctccgggtagcgggcggcgaagcgggcgaggtagtcctccatgttggggtacccgacggcgcagaggaagcggccggccacggacggctggtccatgcagaagaggtgcgcctcgcagacgtcctcgatgtgcaccagcggcacggagccgcagagcgcctgcatgaacttgagggagttgtggtgcatctcgttgccggtgagcggcgccaccac

SEQ ID NO: 51395 - DNA, 392 bp, Triticum aestivum
  Clone ID: PAT_TA_51395
caccacaaggggctggtaagcattcgccgccttacaaacgtctaaacacacagcagggcgggaaaccctcttggaaagctcattggtaactttattcaagcctttgttaaagaacacagcggcacgctttatattcacaaacctggccaccgttctgaccaaagcaaagcccaggcccgcccatgcccaagtccttcttcaacgccgtgtgtatcctacgggacctattggacccaaaatactcctgccctcggggaggaacctggggacgccagaacgcagcaactgcatatggttaaactagcgccgggggccggcagaccattgggaggcccgggtccatttgaacatcacgcaaacaacccccgggccccgggcaaggtgaccctttg

SEQ ID NO: 51396 - DNA, 387 bp, Triticum aestivum
  Clone ID: PAT_TA_51396
ggaacagggggcgggcccaaaagagacccggagctttcattaatccccagcagtgggaggacaaagctcaaaccaggacccaaaggaaaataaaaccccctcatagcccctgaaacttacaagggggaccctatccagagaatcaagattccaatcaagcccaaatatcaactttagcacaaacccagtcttgccatccccggggacaaaaccacttgggaccaccggacccccaccactccatttccggcaaaaaacggaaaaggaaaaccccctccccaaactgaaaagctgcccccctaaaggcatcaacccgggaggaaaaaaccaagccaacccaaaccccagggtttcacggggcccgctatatcggccaaaaaggccccc

SEQ ID NO: 51397 - DNA, 413 bp, Triticum aestivum
  Clone ID: PAT_TA_51397
gggaaaagccaaaaaaccggtaccggccccccgggcaggggggcccccaaaaaaaaaggttacacaaaaaaaccaaaaagggaaccggtcggaccggggggtgcccccgaggggcgggggccgggcaaaaaaaaggcccaaaaaaaactaggatgggaaaacccaacatgaggaaagggaaatgcccaaaaaaccccccaagaccagggagcccaaaattgattggggaccctatgttttgcccaccggaggggggcccttccaaaaatttggggaggttttccgccttaaacaacgggggggccttgggaaaggggcccaaggcccggggggggaaaaaaaaattgcactaaagcttggccaaaaaaaggggggccccccaaaaaagggtcccccaccgggaggtaaaaccc

SEQ ID NO: 51398 - DNA, 466 bp, Triticum aestivum
  Clone ID: PAT_TA_51398
cctttcttcgatttagactttctataaagtcaaaaaaattttattcactggccgaaatttaactgcaaataataaaatggtccttgttttttaaaaaaaggaccccaataactagataaaaaaatcaatcggcttattgtacattttttgcatggccataatttcagcatattcattgatatttacatttgtaaacaactaagcttacatggtaccactccataaactccgtgcaaaaaatgatctgcctacatttaggcattttgtccggaaggaaaaattaaaaaggccgacctttggccatcttgtacaatgaaataatggatcctacttgccagcaaacgccgaagcttgtgccaaggccactcccaaacaacaacctgtataaaaaaactgacccgatctggttttccatctcttctactattattgattcaacaacttgaaaactccactatctaataaa

SEQ ID NO: 51399 - DNA, 482 bp, Triticum aestivum
  Clone ID: PAT_TA_51399
ggcatcaagttccagacaatagaacaaagcatgtcagtacaaggacaagaattgtccctcctaaccgcccgaagatttggtaagtgagaaagcaaaaacaagttcccaagctgtcaaactcctggaaatcctagaagacttgagcctagaacaaccggtacaccttccccatcgggcttttcaggtacaagcatttgacggtttgccagtttttttttaacagagagaccaggaagttgacgcttatttgcaccttctggaagaactgcttttcctccatacccaggggggcaacgggaacacccaagcaaagaacctttttcaactggaactagactggggccctgggctcaataaccttggactcaagggattcccggggagacaccaaaggtggaaactttcctgccttgttaaaaccagggccaagaagtcggggaaaatgcttaataaaagccccacatgcaaggaaagcatgatac

SEQ ID NO: 51400 - DNA, 433 bp, Triticum aestivum
  Clone ID: PAT_TA_51400
ggtgcacaaagacaatcacagctattccaattacactacaacagaatcgtaacattatatgttcatcataggcaccaaacatacatgaaataatgccaagcccctgacgcctatatatggcgagagacttgcctgcccttcctagagacgcgctatacaactgacacacgcgcctactcgggccgattgggatatgaggaatcggcttcactcattcgatgcggaaaaacgggggaggtaggttcagcttcttacttgtaggtacaaagcggacacaatggcggcctaataaaaatgagacatgagcagaacaaaaattgaatgtgcgggccatcggttagatgagcctatatacgcattgacctggacagtggggaagggtatgatatcagtgtcagagaccaccgaaagggtgttgagaacaggcggttcg

SEQ ID NO: 51401 - DNA, 503 bp, Triticum aestivum
  Clone ID: PAT_TA_51401
gatcggagggatctagattcttcgagtgtcctattttctactactagtatcaaacaagcaaacatattcgatcgataaccgcacctaaccagacctcacacacaatatctttagaccaattacagcgctcaccaccaaaatcatttaatttcatctagccatccaaattaccctatggctagccaactgtgcgcttagcaattttcgctggccccgcccatcccacgtccgaaatcaggcatgagaataggaaactgatcgtaatcaaaaccccttaatttgtgagctgcgttgctagcgctctctcaaaacaactaccccgcgacccatgccggctggctatgggcgcccttggcgacaagccgacgacgaaaagaggcaaggccagaggcggcggcggacgagggtcatacggcggcccgtctttcgaaaaaaaaaaaagaagggggccgtcgtcgccaccgatccgcgttgggcttcgaacccgcctctgctggccggcc

SEQ ID NO: 51402 - DNA, 590 bp, Triticum aestivum
  unsure (1)..(590): unsure at all n locations
  Clone ID: PAT_TA_51402
gncccacctgacttgcgacttcccgcgcctgctccacgccagcgacgaggcctacgagccgatgaagcgctactttgggcagacgagggtcccggactactggtggttcgtgaggggcgtggagggcgtcaccggcgtcctcatggtggtgctcatggccgtcgcctacacgctggcgcacccgcggttccgccggagcaagctcggcgccggngaacccgcttcaagaggcatcagcggacttcaacatgttctggtactcccaccacctcttcgtcgtcgtctacgtcgccttggtcgtccacggagtctgcctctacatcaaccggacatggtacaagcagacgacatggatgtaccttgccgtccccgtgctgctgtacgccggcgagcggcttcttcgggcgctgaggtcgcacggactcaccactgtgaggatcgagaaggtggcggtgtatcctgggaatgtgatagccatccacatgagtaagccccacggctttaggtacaggagcggccagtacatctacgtcaactgcggcgaggtctcgccgttcgagtggcacccattcaccatcacctcggctccc

SEQ ID NO: 51403 - DNA, 486 bp, Triticum aestivum
  Clone ID: PAT_TA_51403
tccgccccgcgtccgcggccgcgtgggtttcacagcatccatccattccagagcaataacagcttcctgacttcccatctcatcgagtgtttttcgatcggttgccaatggcggacatagcgatgctggtggccgacgaggcgttcgagaagaggctgcagcgaggggcgcccttcgccggcgccggcgaggaggcgtccaagggacgggagaacttcggggccgtgaccaaggtgtggggctcctgggcgtcgggggtcaaggtgcgcgtcgcgctgctcgtcaaggccgacatggtggccgagcccaagaccccggtcgccctggcagccttcgacggcttcttctctgcttgatgagtgtgaattaattcggaggagtttaccgggtggagtacctcccccccttaaaccagtgtcatggaactccgatttgtacataaccgtgtgctttactgatttgcaacaaagagaagtacactttttg

SEQ ID NO: 51404 - DNA, 502 bp, Triticum aestivum
  Clone ID: PAT_TA_51404
aaacgctagatgctcaggaagattctgcaatgttagttgagtcgccactcctacgacaaacatgccgttggaaaatgaaaaaaacaaaaaagaaaaaaaagaaaataaaatagaaaaaaaaaaaaaaaaaaaaaaaaaaaaaaaaaaaaaaaaaaaaagggggggcctttttaaaggaccaaagtttattaccccttccatgcaagaaaatacttttttttttgggcccccaaaattaaattaattggccccgtttttaaaacgtgggaattggaaaaaccttgggtttcccaaatttaatggttttgaaaaaaatcccctttttcccagttggggtaatagaaaaaaggccccaaccaatcgcctttccaaaaatttgcccaccctaaatgggaaatggaaccccccttttagggggcttttaaacccgggggttgtgttgtttccccccagtgtaaccttttaatttgcaagccccttaagcccccctcttttggttttt

SEQ ID NO: 51405 - DNA, 510 bp, Triticum aestivum
  unsure (1)..(510): unsure at all n locations
  Clone ID: PAT_TA_51405
tcgtcccagcttacggnctagttctaggcggcttgattctgaggaaaccctagcggaacggtagatctggccgagtgcccccattacaggagcgcgactagcatctcttggcggttggggatggaggtggaacacgaggtgcctcctgactaccggctgttcggctcttgcgttgagtgtgtgtgtgtgtctgtttcatacagacggagagagagggagatgtttgggattgaacggtcctgtggtgcttggcatctggtgttccacattcaaaaccccttgctcctgctgctcggtgagctgctggtgcatttgcatgggttggcgcgcgctaggatcaccgtataccatggttttactgccgctgcgaaggtttcttagttacgcaatcagcaagagtgcgaggaattatccagggggggtgcgttctctgagatccgagatcacctccctgtgaactgaacttgatcagttttatatagcgtgacctaatatgaattcactggccgc

SEQ ID NO: 51406 - DNA, 540 bp, Triticum aestivum
  Clone ID: PAT_TA_51406
tcgcgttctagtcgcgagggccgcccttttttttttttttttttttttttttttttttttttttttttttttttttttttttttggttttttttttttttttttttttttttttttttttttttgaaaaaaaaaaggggagaccttaaacgggaaggttactgaattggaacacaaaaaaaaggggggcaaaaaaaaaaaaaaggtcaagagggtcgggggaaaaatttttcaccccaaaaaaaaaaggtttttttaaagggttatccaaaaaaagggaaaccttaaaaaacccctccccccggaaaaaaacagggggggacttccaaaccatttgaattacccggggggggggcccaaaaaggccccccctttggaaaggagggactttttttggggagaaaggttgattttaaaacccccatactcaggggggagcacaggggcccctttcttgaaaggaaaaggggaaaacttccctttcttggaacgggtgccagggccaaaagttttcaccttaccaaagttcaactggtggggg

SEQ ID NO: 51407 - DNA, 520 bp, Triticum aestivum
  Clone ID: PAT_TA_51407
aaaaaaaaaacatgtgaacccttcattcgtttcttgtagaagaaaaaaatgtacacctttcacgagcactcaaaatctagcattgactatgttgagaccaagtaaacaaaacaaaaataaaaacaaaagctaagcaaggcgtaggcaggcggatcggccagccagctacgacgtctggccagcgaccaaccgccgccttcttctccggtactcgtcgttgttggacgacggctccaccacgtcgtccgcgaaccgcaccttcttcttccccgtcgccggcctcacgccgcccgccatctggatctgaccccctgaaccaatcgatcggacgagcaaaacaagttcctgccagatcagcacaggagagcgcgcggcatgcatgcaagcgcgtgccgttgactcaccgtgctcctggagccggatcttcttcctgaagtcggactcgaggccgcggtagaggcgcacggtggcgagcgtgacggcggccgacaccgccgcgacggcgacgaggcccgcgcag

SEQ ID NO: 51408 - DNA, 421 bp, Triticum aestivum
  Clone ID: PAT_TA_51408
ggggcggggaagcaaacatatatgggggttacacaccccattcacaaatgccccgctgggggaaaagacacccaaccggaaagagagagagaggccggaatcgtttaacacagcaaaccaaaaagggccccctatcagttcaaatcaggggggcccccaacaaacaagggggacccccttgggcagtttctcctcctcggatcgccggggccgccctgccctcccaacaacggccccgttgccgttggcggcctgggaggaggaggaggtgaggaaccccggaacggcccgggggccgggaacaacggcccgggggaaaaacaagcggagcccttatccccaggggcacacccccgcctggtccttgagcgcctccaccgccgccatgctcgtcgccaccataatagaccccctttttttg

SEQ ID NO: 51409 - DNA, 499 bp, Triticum aestivum
  Clone ID: PAT_TA_51409
aaagggtatctatgtcaatagtactccctccggcccgaaaatatgtcgcaagggacataaattttgaactaaacacaattttcagttacatccttatacaattcaaaagttggctatccgctcctccctttccctcccgatcccctccctcgcgtcgtcacctccacagctcgccgccggctccaggcctttgctcctccccgcaaatccaagcctttgctcctccttgcagaccgccccaggcattgccacagggagcgcgtaggcctttgctcctcctagcgagctcaaggcatgggggagctccaggagagctcctagcgtgtgggagcagcagcaaggggcaccttgccgccctagtttcctcgcacagcctccccaggctccaggaactgcaaggccgtggtccaccgccaaaacgccttcaccgcacgaaccaacatgaatgcacaacgtcgaaaccacccacaagcttgagcacccaagaatcaccaaaatt

SEQ ID NO: 51410 - DNA, 515 bp, Triticum aestivum
  Clone ID: PAT_TA_51410
gaacaaatagtcccatatcagaattatcagcaacatgacaaaataaaaggaggtccgtacatatcagaaccgagactccaaatctcatgtctcagacatgaaatatattctttatcagatttgaagtaccacaatgggctaataatgactgtcaatgtagggtaggtacaacatgcctttcttttcttggtcctctcacaaaggcatggctcactacacagtcttaaccactgggtgtctacctgaataaccaaaccaatcagcatatcaattacaactacattagaaccaaaaggatccctagtaaattcaaatttaaaccaagagattgttgttagtatgtatctagtgagatttatcatggtataaacatcagcaaccacattggttacttatagtggagggtacagtagaaccaaacctatacattttcaccgtatcttcatttactcgtacgactggtatatcctctgtactcatgtgtatcaattagcaagaaattaatattggcaaac

SEQ ID NO: 51411 - DNA, 514 bp, Triticum aestivum
  Clone ID: PAT_TA_51411
actataaagggtgtaacataaactagtaacatatgcatgttgctagtctaagttactttcattatgagtaggcttatactagtagtaagttacagagagagtataaactagaggactgagatacggggatgaagttgttgtttttgaggaaattaatgatttgagagatgctctcctacttgtattagttaataagatacgcaaagaagaaaggaagaaatgtgcatacccaatgcaagaccgtacgtgtctgatactactagcaaacagcaagcgaataaagtgtatatgttctacgttcatgtatatatatagcctaattaacatgcatgtcgaaattcaggtcagaagttctccttgtggaagacgaacttggtggtggtccggtgcgagaagtcctgggacagccgcctgagctccggcgtgagcttctggtcgccgcagtaaaagaccccgacgcgctgcccctggtggtcgcaggcgacgcgcttgaagacgtcacgccagcagggcc

SEQ ID NO: 51412 - DNA, 302 bp, Triticum aestivum
  Clone ID: PAT_TA_51412
aaagccgaatatccagccttcaaggaaagcatataattatccccaagttacaagggggggcatccccaaaacatcaaaacaacccagacatatcaggaaccaaaagaaccctgtcatcccaacagactggggtagggatacaaggttaagccttctcctcgggggtcccctcacttggatcgctgcctcaattttcggcgcttccttttgagcctccccatccttttctttttccacttggccctcatcggggagggggagcgggcgcaccaggcggactgggcctcagaatttgcggcacc

SEQ ID NO: 51413 - DNA, 373 bp, Triticum aestivum
  unsure (1)..(373): unsure at all n locations
  Clone ID: PAT_TA_51413
gccctccacctcgncgtcgcgggcgtccactccggcgccggtggtggggtggtaggacgcggcggtggcgtgctccttggcggcggcgttgtggcgcatggcgtcccgcttggcggcctccgcctcgtggatccgctcctgcttcctggcctccgcctcggccttggccgccgggtcgtgcgccttggccttgttcaccgtctcctgcaccacggccatggtcttctccttgctcgcccacgccgacgtgcccacgttcgccaccgcctccttggccgcgcccaccgcgctcgagctcttcccgccctgcatccctttctctatctacctcgcaaaatgaaaccaacacgatctgtctcggtgtcggtcgatc

SEQ ID NO: 51414 - DNA, 481 bp, Triticum aestivum
  Clone ID: PAT_TA_51414
gtacttgcaaagttgcagtgccacctgcagcactcgtcttattcatgccaagatttcgatcatgtggcagagaaaatcaaagaatggacaaactagaaatgtgaaaagatgaagagacggatactcaacaacacaacataataataataattcatatgtaccacagctagtaaaattttggttccttttctccctccttctcccttgcatgcatgcttttgcagcttctgatgaggataagtacatggaaaatcgcccatggatggaagcccggctgccctcagtgatgcaacgggttcgggcctgtcggcacgagcctcttctccacgccgtaccgggggtcgatctcctcgccgtccccaggagcggcagacggcgggaccctctgccagttccatttgcttgggaggcggtggtgccgttgacggtggtggtgaccaccacgatgatgatgatggtgatggtgccgttgttgatcttg

SEQ ID NO: 51415 - DNA, 381 bp, Triticum aestivum
  Clone ID: PAT_TA_51415
aaggaaacttgaccggggtaggaaacccaacggagacggtgatccaagcgcgcgccaacccctgtcaacgcaccagcagcacatctagcaccccgagcacggggttttgaatgtggaacaccaggatgccaagtcccacatcggaccgttaaatgcaaacatttccgtgtctctggctgtgtgtgaaaagtcacccacacccacatctgataaaaacccttcagtcgtcgtgaggggggccttaggttacagctccatccctaacctctatgagcttctcttgggggtgctgtaatggggggacgcggtgaagatttaccgttgccatctgggttcctacaattaatgcgactataactagtcctgacacgtgggccctca

SEQ ID NO: 51416 - DNA, 595 bp, Triticum aestivum
  unsure (1)..(595): unsure at all n locations
  Clone ID: PAT_TA_51416
tccgctctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgnccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccagaacacacagggtctcatctttgttgtggacagcaacgatagggaccgtgttgttgaagcaagggatgagctccacaggatgctgaatgaggatgagttacgtgatgctgtgctgcttgtgtttgctaacaagcaagatcttccaaatgccatgaatgctgctgagatcactgataagcttggcctgcactcccttcgccagcgacactggta

SEQ ID NO: 51417 - DNA, 570 bp, Triticum aestivum
  unsure (1)..(570): unsure at all n locations
  Clone ID: PAT_TA_51417
canatctactttaatctcccagccctcattattaggtccctgccctagcagaagaaggaatggcgacgcccaactcaacctatccatatattcaacagaacagagcgagatgaagaggggggctcggcgggtacctggtctccttgaggaaggaagggaggagatgatcctgctcgaggcgaagcttgtatgccacgatcatgtcgaggtcgtggcggcccttggccttgtacaccgcccggcgtggacgtcggggcggtccggccgtgaaggaatccgcagggagaggagggccgccgccgccctgcgcctccaccggcgagcctcagcggccgaggcgcccccaagccgcctcgcttggccgaggagccagcgcgggctgtcgaccgaccatggccgcgccgttcccggtcgtggagccgagacgagccatcctggggactcgggggagtgggtggagagattctcgcggcggcggcggcgccgggatttgggggaagtggttggagacggagccggtcagggcaaagtggggtttcaatccaaaaatgttattctgatttatgtttt

SEQ ID NO: 51418 - DNA, 604 bp, Triticum aestivum
  unsure (1)..(604): unsure at all n locations
  Clone ID: PAT_TA_51418
ggcggctggnggcgcgggcgacgcggcggggcccaggcagcgggaggcgggcgccgcggctcacggctgttcgctcgctcgcgccgctgggcgcgacgcggcggggcccaaggcggcgggaggcgggcgccgcggcccgcggcgactggagctgcgcggcacggcagtggcccgcggcggaggggagcaggctcccggctgttggctcgcgctgctgcggctgctgaagcacccatggagtcgccaacccccaagtcgccgtacgagttggagccaacgaatgaactagcactagcgcacatcatcccttcctaggttgtcatcacatgcgcagatgaactggatcgatctattcaggttaaatctaggaaatcgtatgtcgtcaaaactctaacaagccatcagattgttatgacagtatccttactgcaatgaaaaatcacttcaaaagattcatattctcattctgatgaccaatacgaacaaagtatatcgcaatttctgtgtgctggaaggagaaactcacacacaagaaaagctatgggcaccaagtaacgaataattggatctcaaagctcatatatgaagaaccgatcttggtagt

SEQ ID NO: 51419 - DNA, 538 bp, Triticum aestivum
  Clone ID: PAT_TA_51419
atataaacataggtcgacgattaatcgataaaaaaccttgcttcttggcatgcagtggcaagagaaacaagagtcagtttacagattggcgtcagtttacagattggccgagattcgacatgtctacagcagacgattaagctaacttttccacccagatttttggactcagcaggatgacttgcgtttgaactcgggtgacctctggagaagcagctggccttccatgcccgagggagaaggcttgccccctgggctgtgcatgttgatcgagctgacggagagctggtggaacacggaggagctcagcgcgtcggtggcggtgccgcacatgataccgccggaggacagctccgggaggctctggtcggagacgctgaagccgctcgaggcgaactgctctgagacgatcttgcaggccttctccagcagggtgttgatgtacgtcgtgtacgcgtccatcctgatgtccacatgcttctgaacctccacttgttcatgcaggcttcgttgcatctccatctgtgctctcagggct

SEQ ID NO: 51420 - DNA, 446 bp, Triticum aestivum
  Clone ID: PAT_TA_51420
aaatatagagagaaagagaacatataaaagagagggggctgagattaaggggagaaccgaaaagggatgccaattcttaggggaaaaactttccttctgggaagaaaaactaaacaggctgggatggtagctgaaaattcaaacaaaaataaaaaaaaagggcgaataacataaccaaaaaaaaagccacaggataggaaaaaaaaagaaccagcctaaaccaaagccaaaaacagggcgggccttcctgggggcaagcaatgaccgggcaaaaccgggggcaagccaggggggaaaagagccgacaaatagacagcgcacaaaagaggggaatgaaacggaaaaaaaggggggattaacagcctaataaaaaaaaaaactgaccaaggcttagaaacaaaaaccgccaacttgccgagagggaaaaagcaggggctggggaaaga

SEQ ID NO: 51421 - DNA, 433 bp, Triticum aestivum
  Clone ID: PAT_TA_51421
ggaacggggaggaggggggggggggggccccaagaaaccaggttggccccgccaaagagggggggggcgaagcagggacaaatccaaagagggccaaaaggggggcagggggggggggaaaaagccggcccggaaaaaaaaaaagggggggggattaaataggggccaacccaaaggggctcaaccgggggtcattcggggggggaaaacacacccatttttttaaaaaaaacccagggagacccccggtaggggggggcccccggggggggggaactggggggggggggacaaggggggaacgccaagggcctcccgggccctaaaaagggggggggactgggaaagagcctccgggggaaggggggccccggtttaaaaccgccccggggggaaaccagcggccaaaaaggcaggggggggggccccggcc

SEQ ID NO: 51422 - DNA, 535 bp, Triticum aestivum
  Clone ID: PAT_TA_51422
agcaaaatcaaactcaatagacttgtaactacgcagctagtgaaactaccagggaaggtatcacaatcgcccaaatgatccaaccaggaagaagtacagctccggatgagcatttcaatggcccacgaactcgcaaccaagatcacatcatgaggaaaacagaacgggtgctcgatgtcgaacacttggggctgatcagaggagtgtcgcgccgaccagagcgacagaggccaccatggccgcaatgcccatgcccaccgcggtcgcgccgttcttgttgtcggccttgtccgcctcctcgtctccgtccggcgactcggcgggggccgtgtcaggcgtatcagccggcggcgcgggcggggaatgcgctggcgacttgtgcttcggtttcgtcttgtcggtcttgggcgagggcgccggcgcggaggaggtttctggtgcaggggccgacgcaggtgcatcgaccgacgctccgggtgccggcgacggcgcgccgccgaagagctccggcggcagcagcacgctgtccaccgtg

SEQ ID NO: 51423 - DNA, 437 bp, Triticum aestivum
  Clone ID: PAT_TA_51423
ggagaggaaaattccatggcaaagccaaaaacatttttagaaaactttaatcacgaccaaatagccccaaacaaaaaaaagggcatacatgctaacaacagggataaagggacaaaaggacaaggggataccccatgaaaggccccggcctctcagctaaaggccccaaaaccccaacatttgaaaaaaaaaaggggaaagctactagttcctaattccttttcctcggaaccacctggatcgccaccaccacttgcctttttcggggttttttttttaacccggcctgaagggccccccccaaagggacttgtcagggaaaaatcaatgggcttttcggattcaaccctcaccaaaaacgacgggacattgacaatctgcctgccaaccctgatggggggttgcctgaaaaaaacacgggcatggggggaggattt

SEQ ID NO: 51424 - DNA, 533 bp, Triticum aestivum
  Clone ID: PAT_TA_51424
gacagggaacaaggagtaaaacatcatttcacagagtctcaagtgagaacaaacaatcaggttgcgtgacacacccaacaaccttgaccctttttaacccaacttagcacggccacgaacaacaggtccttcccctccacaacagcaacagcaccagcaatgtgtgtgtatcttgtacatcatatagaaacatcctttgttgggtaaaacaagacaaagtgacgctattgccctagcgacagagggactggaccgactcttgtgtagtatctagcttacagttacaatatcacctcacaacaatacacgacacatcttgggtgctggatgttcctcttctgtccagtcgtttctcttggcgggcacacaaattattgtcgacggtacacttgacattcatagtatagtacaagagcagcgagtggtcttaggcaacttgttcgtcttcttgtctggttttgacttcgcggatgatggctggacaacgacatgcattgttataacagtgctgggaagatcaccaaaaggtgctc

SEQ ID NO: 51425 - DNA, 462 bp, Triticum aestivum
  Clone ID: PAT_TA_51425
agatccccaaagagataattccttttttcaaccatttcaaccattggttacagggggccccatgaggaacaaactgaaaaatcgcaatgggggatgactagcacttgcaacatgggtgcagggaatttattctacatgccctggatagctccaagttagtccactggcactgggtgcattgcctcaacctccttcctcaaacccttgaatagcgcccacgaaaagtatcgctctcctgcgctcggatgaacagtcacgaagagcttccccttggtttctggcctttttgcgagttcaatcgctgccactggggtggctcctggagaaatccccaccagcaggccctcctgcagggccaactggttcgccattttaacggggtcctcgcctttcacctccaaaaccttttccatgaaatccatggccaaaatatctggcttaaatccaactccatttccaggg

SEQ ID NO: 51426 - DNA, 384 bp, Triticum aestivum
  Clone ID: PAT_TA_51426
gggaaccccgcacaaacaaacaaatatgggattaccaacgacaataaacccaagggggcaggaccagcaaaacctccagcaaaaaaaccggaaacaaagagagggggggggggggggaaaaacaagacccatgatgggccgggttattggtttgggcccaaccaaacagcgggggagcccccggggccccccccccctaaaaggggaggaggaggaggagccctcttaaaacacgggatcacggggaggagcccaaactccaccaaggacacgggggggccccccctcaccttgaaaacggccgggcccccgggggccctgagcggcccccacttggccaccgccaggggcaccgaccccttggacaaggcgcaccctggcctt

SEQ ID NO: 51427 - DNA, 531 bp, Triticum aestivum
  Clone ID: PAT_TA_51427
agtcacgggaaaaaagatcattccataatcacagttatatagctgagcatacctagggaactcacggcttagacaaactatttcggtatgttgaacaactctttacatgataatcagtactcgggccatatctgacttgcattctcccgacttgagagacaaatgcaatgcatagtgaggagaaccggagatacattcgcgaactggtcctctaaatgtaactatgatcctaggccattcatgataaatacaaggaaaaaagaacggaagagcggtcagccagattttgaacccaatgcactgacatacaccatccaactgtggttcgccaaatttcatcctaagaactcgcctcccgccagaacttacagtccaaaagcatttcataggcggaatgagccgcattgtcctctaccaccctacgggctaccacagcctatcacacatctcaatacttatcaagctctaacatgatctgttcagtgactaattccaaagtatcatgcagtggcgggagaaagactaccttat

SEQ ID NO: 51428 - DNA, 387 bp, Triticum aestivum
  Clone ID: PAT_TA_51428
acacggaaaggaggggaaaaatggttggaacaaaacccgtcctaaaaaaatcggaccggccaaaaacacaggtgggaaacgggccaacaaacaaaaggttccataaaaaaaacccaaagttcccgacaaaggaaacccacttcaaaaaaaaccggagttcctgaacccaagctaagctaataacggaaacaaccggccaggggaggcctaaacaaacgtaattcaaacaagcatcctagcaaggacccaaaaacaggtaaaaaaaagggcccaaaaaccagaagccccttaatttccccccccataaacaaaaaaatcccatgttccaagggggaaaagttttttaaaaaaacttttttgggcttttggcgctttaccaacccaaaa

SEQ ID NO: 51429 - DNA, 523 bp, Triticum aestivum
  Clone ID: PAT_TA_51429
atattctatactttataaatagaaaccgtagcaacataactttgctagttatcataaactaccacttccagacctgacaatatattttatcataaatcacttacagaactggctgtaaaacaccagaacacaacaatgtcattaagtttaacaacatgacatgacatgcatcaacagttttggttcatcgatggcagaggcatcagtatcacatgttctacgagatatttaatggcacacaaatgcatttccgtattcaggacttgcagatgggaatgactgcattttgcataacagataagtcttggttgtcacagaagatgcaggccactctccgtcagttattaccattctgcacagctgcatttgcacgcggatcatcctcaccaatctctccatcctcgtctatgataccttcctcatcatcatctctgcctttgctgcagcgcactggagatgcaggctcaggtttcccagaaggttcaacaaatttggcacctgcctctggctgaccgttggggct

SEQ ID NO: 51430 - DNA, 390 bp, Triticum aestivum
  Clone ID: PAT_TA_51430
atgtcattgcaaatgtttttttgttaatccctcattttatttctttgattttttttttttctctttacacaaagtaaccaccgtgcctttaaacctgtcaggggaaaagggctcacaccggtcaaaccctcaaaattaaaacaaagaaacgaagccttgtgcaacaaccccacgggtccgctccccccctgctgacctcgaaaagccccaaccccctataagcccccagttggggcaaaaagcacccccccctacaaactcaatggaaggcccctttggttaccccttgcaaatgccaactttttaaccccctctccctggtgctccctccttaaaaaccccagggcgccagtggcaggtttttggcgactcctgacttcacccccccct

SEQ ID NO: 51431 - DNA, 455 bp, Triticum aestivum
  Clone ID: PAT_TA_51431
ggcccaaaatacaggatcattctggaaaaagggaacaggtatgtttggtcctgacagcacactgggaaggccaatgaaaaacatacaacagaacctttctcaggtacaactggtactcggggaggagcttatttctcagcacgacacacacatgacgcatttaaactacaggttcgaacaccaacaaaaaggaccagtacaggacgggccgcaacaaaaattcattggtttcaaaaactctaccacaggaagtccctgggggccgggacaaatcccggcaaaactgaggcccccccggggaagggaaaaaccaggtaaatctgcccttccttggggcccaacctgcccgggaaggtcctggtcgtcgttgaaacacaaaccggagggtcattcatccgggcatatgtatcacgaggaccacccaaacaagcaccacaattaggactagcgggggg

SEQ ID NO: 51432 - DNA, 420 bp, Triticum aestivum
  Clone ID: PAT_TA_51432
caacaaatgtttaatcaactccgtcttatagtcatagcatataggagggtaaactccatatatctccaacaagaagctactacatttttctccaagacagcataacaacaaggtttaatcaactccatacatttgagattgacactgctgatgccttatgatcatagcataggaggagataatctgaagattaaacatatcaccaaactaggctactagtagctagtacttcttgagactgataaatggcacacggtctccatgtccatgtccactggaggaacacaagaagagcaagaaggagcatattatgggggcggctactcgaacttcttgatgagtgagaggacgcagagcatcttgacgacgcggacggcgatgacaaacctgccgacggagacgagggaggggacaagcgcc

SEQ ID NO: 51433 - DNA, 539 bp, Triticum aestivum
  unsure (1)..(539): unsure at all n locations
  Clone ID: PAT_TA_51433
gaatgttcaaattgtctccataagataatttatatgtntgaacaaattgcaatgaattggaaaggtgtagggtttagaagacttcaaacagataactccgcatcaggttggacctaaatagtcaattaggacctgcaacgaccaagagaccttctcatgaatttttgctttggggagacgaagctacttataaacagctaaatactgcatcaaaacagtgaggggataggataagcctgcttggctgggagagatcagttagtcaacaacaccagttgcagatagcaaactatattatctctcatccatgtcaatatctgcaaggacacgtagttaccaagggcagagaaagccataggaagttcaatattcaacgcaaatcaggaaagattgaagccaacagaagaaaccgccagtaacatggtgaaacaaaacagggcaccttccggaaagtccccatataagccaaatagctggagaatccatatcagagatgttgtaagtgcaaacaaagaaactaaatagaggaggatcgatta

SEQ ID NO: 51434 - DNA, 434 bp, Triticum aestivum
  Clone ID: PAT_TA_51434
ggggggaaaacaaaataaaaaccccccctttcaaaaaacccccccaaaccaaaagcgggggaaggaaatttcccccgcttatcaaaacaccctcttatcccccattacatgtagccggatagggggggcattagccaaacatcaaggcccttggaaagccttggatcccttaaaaccccccaagtttgaaacaaacccccccaaacaggatttatttgccaggaccccaaaggacttgcccatttcaatttggcccccccccaaagggccccaagtaattgccccctgacaaacaaaaaactacttttttgacttacccccaacaaaacattttgcaaaaagcttatcaaaaaaaaagtttgcaaacccaaaacttgctgcaaaaacccccctggctgctttccccttggcccgcgggtccccgctataaaaac

SEQ ID NO: 51435 - DNA, 426 bp, Triticum aestivum
  Clone ID: PAT_TA_51435
gggagaacgatcaaggacatttcttgccttttatcaaatccgcgtacgtccatacgctctcgcggtacccccaaataccccacagactgagctgaacatgcaacagttcatcttgtttggctgggctttacactacacaaaagcgcgcggccagtccctcatccatgcatgaccccagcttatgacccctgttccaaaataacatcctcaagcgcagatcctgagagaactgatccaaccggaggctcaactttcggtcactctggttatattccaagggcttcttatccaaaacagcctgggaaccttttggctggcgctggcccttacgaacggcctttggcggccatatcctggcacttggattagctcctcctgccaagctagcctctgccgagggcctctggtgctccgactccttgggga

SEQ ID NO: 51436 - DNA, 450 bp, Triticum aestivum
  Clone ID: PAT_TA_51436
agttatacaaatttattattatttcaacatgtacaaacatattttacactacaaagtaacgacccccacaaataagaggggcttcccataaataaaaacaaaggacgggtgctaaccaaccaccactaaaagagagcaggaaaagctttacaaaaaaaaagggcaccaggcgagaagggccagattttgtgggcaattaaaacaaccaggaaccaaaagctaaggtaaacatagccatcattaattaacacctaattgcaaagagatggggtgaaatcaatacataataccttaacatgcctgaagaatacaaaagaaaactttctccctaacaacaagagtcctaccatagcataatggactaaatgatcttgatgactttatcaaacgaatagagggattgatgctgcttgaagctaatgacttgaactggagaggaaagataacctg

SEQ ID NO: 51437 - DNA, 584 bp, Triticum aestivum
  Clone ID: PAT_TA_51437
ctcacccctgcccgcctcccctctcctccgtccgtcctcgcccccatccagatcgtctctgcgatcacgacacccggagcagggcagaggccattggccgccgcgaaacagaagcagtgcgctctgcagctcctctatcccccacatcgatcataactagaacagtccccatttccagtttggaaccgcctctctcctcctcgagctgcggatgaagcggcagatcaagaggccgacccgcagccaagaatcgccagagccaggggagaagctggcgttcgctgagaaggagaacctgctggcggcgtacatggagcacgacgagcccgagctggcggaggccgacgaggaggaggaggaggaggagcgcgccatgtcgtgcgggctgggcggcaagaagcggcggctggccctggagcaggtgcgcgcgctggagcgcagcttcgagacggacaacaagctggacccggagcgcaaggcccgcatcgcccgcgacctcggcctgcacccgcgccaggtcgccgtctggttccagaaccgccgcgcccgctggaagaccaagcagctcgagcgcgacttcaacg

SEQ ID NO: 51438 - DNA, 599 bp, Triticum aestivum
  unsure (1)..(599): unsure at all n locations
  Clone ID: PAT_TA_51438
tccgcgcaaggcacaagcagctaagcaatctcagnntggtcttcaaaacacacacacacacactgacacacatcgatcgaggtagttagagatggccggaggagatgacctgaagctgctcggcgcatggccaagcccatttgttaccagggtgaagctggcgctcgccctgaaggcctgagctacgaggacgtggaggaggacctgtacaagaagagtgagcttctcctcaagtccaacccggtgcacaagaagatacccgtgctcatccacaacggagccccggtctgcgagtccatgatcattctccagtacatcgacgaagtgttcgccagcaccggcccgtcccttcttccagcggacccctacgagcgcgccattgctcgcttctgggtggcttacgttgacgacaaggtttaaattatcttcaattacttgaactactagtcttcgttcctttatttttagatatccagcgagcatctttgaccattatttttctctgtgtttcagctggtagccccatggaggcagtggttgaggggcaagacagaggaggagaaatccgagggaaagaagcaggcgttcgccgcggtggg

SEQ ID NO: 51439 - DNA, 588 bp, Triticum aestivum
  Clone ID: PAT_TA_51439
tggctctattcagtatcttcaccttgccaatttggacttacatcccacatttcaacttggtttgagaaccctgaaaagctgcatctgtataatgtgcatattacgggggatgagttagggtgccttctatcccattcctttgctttggcacacttgagacttcaatattgtcatgacatcattcgcctggagataccttgtctgctgcagcggctcaggttcctggaggtgcttgaatgtagccttgaggtgttagagatcaatgctccaaatatctccagattccgcttaatggattttaatgtgcaactctcgtttggaaagtcacggaagatgaagaatctgatgttgaacaatagctgtggcatcagttatgctattgacaaccttccttcctgtgcgccaaaagttgagactcttaccatacattctagttatgagataattaatgcaccagtggcatctagcaaatttcgccacctcaagatcttgattatttatctattgggactccattctcatcgggactatgattatttatccttagtttctctttttgatgcttctcctttgttggagaagtttgtc

SEQ ID NO: 51440 - DNA, 417 bp, Triticum aestivum
  Clone ID: PAT_TA_51440
ggggaagaagaggggcccttaaaatgggcaaacccacaaacttaggggaaacaatcaccttggggtcccgaggcccgggggggtcacaaaaaaacaaaaatcccaacgggggggaaaaaaggaacgggaaaaacccctagggggtcctaaaatagctaaaaaacaagggagcactagccccttccttccaaccttttttaaggcaatctaacaagccccggcaagggatcttggtgttttaagggtaaaaaacaccgcccaaaatgaagcaagggagcgggcaaaaaaaacccggggcgggaggggcagggccccaaaggggacccagcaaaatatgggccaaaacttccaagctgcaaatgggaggttggaaaaacccttttggaccttgctttttacttgcccgaagggcccccc

SEQ ID NO: 51441 - DNA, 432 bp, Triticum aestivum
  Clone ID: PAT_TA_51441
aattctatgccacatcatctaaattgcctagttggcatacatgatactagttatgatactctcattacgaccagtcttattggaacaaaccctgtgcaactgtttcaaacgtgttctgagccatcatgaaagaggattgaacgaagcacagcacacactagcttatactcttactacaagcaaactaaacgacgatcccgtagtcagcggtgaactcaagcagaggctgcaaacccctcgtcaccggcggtggcgggaatgctctgtccgttgggcgcgaagcacctgttgcggcggatctcaaccacgtttcctccgggttggtactgactcagcttcaccaaggagtcacggaactggctgtagaaccaccatttgttctcggggaggcctttgaccgcccagtcggtgcccccgtctatgatgagcact

SEQ ID NO: 51442 - DNA, 304 bp, Triticum aestivum
  Clone ID: PAT_TA_51442
gggaaacaataaattatagaaaatcggggccattgaaacgaaattgctaaatggcgggggacgggttttggatattaactaggaaaactagggggaaaaaaacacatccatgggaaaaatatgaaaatgggcccacggggattggttaaatttttccactcctaaacatttggatggcaccccattagatagggggaaaagaaaaataacttttaaaaggggggtaaaaaaccatgccggggggaaccatgggaactgggaaaaatgaaacaaagggttggggcccggaactggtttgttgggg

SEQ ID NO: 51443 - DNA, 504 bp, Triticum aestivum
  Clone ID: PAT_TA_51443
ctgggaacaggaccatgcattaaaagctcaattccaaacaataacatgatcactccatttcatcatgatataatggagagctaggctgacaatatccactcacatatttagatgaatgatggtgaaccattcactttacaaacttacaaaggatccagaccgagcagtactatagtgctagagtaaatttgttaaaagtcactttttgttggccaaatgtcgggaaattgcattttttttaaaacagcactgagctaaattaaatttttccaatcagtgctagaaagctgcacctctgaaatctacggagggatccgcatctaggctccatgcaagtagtctggggccaggtcaacaaaaattctactggggttagtttcgctatggatttaggcccaattttttttatggcgtgaaaaataagcaacccccttgctcagcttctcccataagctgagcttatgtactaattatcgcataactagcatataagcccccaacgaa

SEQ ID NO: 51444 - DNA, 330 bp, Triticum aestivum
  Clone ID: PAT_TA_51444
ttttttttttttttttttttttttttgtttttttttttttttttttttttttttttctttcgggataaacagatcaacccgtccttggaaacaatattgaagggatcctcttacatgagaaagcccaagggggaaaaattggggacttctttctttctgaacgaaaaattcaagccgccgctacacatgagatgtgctaaaacaaatcccacgacccgtggataacgctgcggggaaaatttcggccaatggtaacagcaaggtgcggttcccgagacccctttctggttggcctcaaaagggacagcaggggggatgattagttctggc

SEQ ID NO: 51445 - DNA, 390 bp, Triticum aestivum
  Clone ID: PAT_TA_51445
gggaaacccgaaagcttcccccgcagggggggggaaagagataatataccatcaggcaggcatgattcattcaaagattcaggtttctgcagcttgaaagggccatgattggggggatctacataacataagagggggggctgaaattgaggaccctgggggtttcaaggagcaaaaagcggggggaaaagagaagttcatagagatgacaaatgggcggaaccaaaagcagggggcaagcattcacaaaatcaattgcagacgggtactccttaaatggggggtgcagccttcttcttgggggacttggaagcgggggccgtctttttgggggacttggaagcggcggcccacttcttggggaacttttttggggggccgggggccttt

SEQ ID NO: 51446 - DNA, 560 bp, Triticum aestivum
  unsure (1)..(560): unsure at all n locations
  Clone ID: PAT_TA_51446
tcgcgatctagnactaggtttttgtttttcatatgttgtcatgaattttcaaaaaatttcatgatttccagaaaatcacaaatcaaagttgttctgaatttttaaaatgtgtttttttactttggtaattttgtcattaatttgaaaaaattcatagtagatttatttaatgatcattctagtttcaaccaaaatgttgtagatcaattgaattgagcatgctattttttcttaataagaatatatttcatggacaaattagatctaagagaatttatttttctgtgcacaagtagcaattaattttggttgaaagtcatagtttatttcaattaaaagtgtaatttcccgcccacaactgtccctgaaaaaccgctggcccagaaaggaaataggtgaaataggaaaatacaggcccaaaagaaacaatatggaaagggaatagagcctaggggtggtattgggccagcgctgggccaaagtcacgaacaggtagagcgctctcacagccagaatcgatcgagaaagggaataggactgcgctccggttcgctgaattg

SEQ ID NO: 51447 - DNA, 427 bp, Triticum aestivum
  Clone ID: PAT_TA_51447
gcggtcataaatgctcttagttataaggcgtctctatttcaaaccacccataagatgtgacatgcgtcgcacttgtccaaattactactcccttcgttcaaaattacttgccgtggttttagtttaggagcacacaacatccgcctcgtcgaagaactttactgtagcctctctgccgttgctacatgtacaaggtccccattggcatgcatgagcagcggtggttgcgtcagagcggcttcctgtgcgcggaggaggccatgagcacggccatggcgacgacgaacatgaagagcatgctccccagcagcgtgtaggtcctcctcgacgacctccggtactccccgaacagcaacacgccccagagcgtgctcaccagcggaaggacctgcacggaagtccggcgacgaatacccggaacgactgc

SEQ ID NO: 51448 - DNA, 531 bp, Triticum aestivum
  Clone ID: PAT_TA_51448
atcgacaaccaagtcaacattgagtacctatgaataaatcaatctcacttaattacatgtggtcatttagcaaaatgcttaggacaaatagatgttagaacgcaccaaggcacatccatgctactcttctacttcagctcatcttcccagcaagtatagttttttctccaaacgatagactcagctggtttcacttgtgtagagccattcattaagaatcccctggaaagcagcaggggtaaaggtgcagaactaccaaattaatctcgcaatgctgcatctctcttgccatcttcttatttacagtctgtgtgctcttaagatccaaagtaatcaagcaaagtagcttcaagcaaagaatcccctgtaaagttttccatcttatttacgacgacgacacgcaagttgtccacgcccagaggctgccgccggtcgagaagccgaaccagaggccgcagtgatccttacatataatgatgctatcttagttcttaaagttcctgaagttatgcatctgggtatatctggaaa

SEQ ID NO: 51449 - DNA, 546 bp, Triticum aestivum
  Clone ID: PAT_TA_51449
agaagattgaaacaaataaatttgccagaatttcttcatcacggcaggtgcaagtaaaaatcataaactccacaaaaatgactggtgaatccaaacaaagaactaaaaggtaaccatttaacaactaaacttcacaaggtgattcagatctgaatttcacaaagcataacaccggctgcaaggccctagtaagtttaacttgactgtggagttaactttcccttcaatgtatgttctcacagccaagattgatttatatgcatcccttatatatgcagtttccagtggagggcatttcctgtccaatatatcaccagaacaccggtagctaataggagtggtgtccaatgtaaggcactcaagtgatgttgcattctcaagaatatgacgtgctagctcaaccatgcttttttgggggcagaaaccactgatcttcacatttttgaggttgtgatggcggtgttctgacatttgtctcagagatgagagatctccctcaaaccagtcatacttggactgcacaggtgatacaaacaagacaaactt

SEQ ID NO: 51450 - DNA, 451 bp, Triticum aestivum
  Clone ID: PAT_TA_51450
ggggtaaaaacacaaaatatctcatatgccgatgggatttcaattcaatacaaacatatctaggccatcataatttagcccaacaaacagttcatactgggccccaagggacgaggcccttattggtcagcccaacccatgaaactaggaaaacaatgctcctgcccccccctgggagcttggcccaacgaacccacggcccccattttgatcaactggcggagtagggccataaactggaccattacagggggcatatgtgggaagcccagtagggtccccgtcgggggagtcccccaatgcccgaaaccctgggatgaatggactggcataaacaacccaatcaacatggatgaaaattgaatggactacaggccccttttaaaaaccctcttttgggggggggggggaaatttaatcgggggattccggacaaaaacaaaacattggc

SEQ ID NO: 51451 - DNA, 178 bp, Triticum aestivum
  Clone ID: PAT_TA_51451
ggggggcagaaacatccatcatcattgttcatgggaatagaaaaaaaccttgtaatggccagtctgaagggctagaaaaaaacacggccctgggggttggcttgccccaatagttccttattataatcccagtaccccaattccaaatgatttatttgaaaaacttgttttaaatcgg

SEQ ID NO: 51452 - DNA, 575 bp, Triticum aestivum
  Clone ID: PAT_TA_51452
cccagcgtccgcatcaagcctcagactgaccgctgggtcttccctgagaccaacactggcatcattgttcttgctgagggtcgtctgatgaaccttggctgtgccactggccaccccagctttgtcatgtcctgctcattcaccaaccaggtatgatcaatgtgtagtcaactgttaactagtattgagttcacaactgatagtacaaccatgagttagcatccaattttgtgctttgctgcaggtcattgctcagctggagttgtggaaggagaaggccaccggcaagtacgagaagaaggtgtacgtgctccccaagcacctcgacgagaaggtcgccgccctccacctgggcaagctgggtgccaggcttaccaagctcaccaaggcccagtctgagtacattagcatcccagtcgatggtccctacaagccggcggcataccggtactagtgtgtctgtccagcacgactagcggctggcctgagcctgagaggcgcacggcgacctatgaactatcctgttttcctttgcattatctatctagatttaggcatgttgtctattaggtgga

SEQ ID NO: 51453 - DNA, 584 bp, Triticum aestivum
  unsure (1)..(584): unsure at all n locations
  Clone ID: PAT_TA_51453
gntttgggtttatcgacagaaanaaataattcttggtactgtatcacatttaactgggacaggagtaaaagtatattattttgatgggagttgtacttttgctggtgaagagtccttggaaaagcttgaatccatgtcatagcaagctgtttacaagaactaggagcaagagttatatcattttatacttttcatacttgcatactgtagaataattacatttgtagattgaatccatgaagttgatactagtttaatgacagattctgtagccatgttctctgctgaagctaatgtaatacactaaatcgtctgtaattatttctccagaaagtgcgtacagagaattgattttatcatctgtggtggacctgctgatgtgttttattaccttgattaatgctattaacatcggttactgatgattgtaacagttgtagcgattcaatctttgactttgatgtcatctcacgcttaatcaaagttctcaaggaatcatctccaagcctgcaagaaaaatgtgctactctcctggagcatttagcagcttgtgagcaacatggcactgcaatgactgctgcccg

SEQ ID NO: 51454 - DNA, 563 bp, Triticum aestivum
  Clone ID: PAT_TA_51454
agtagtatcttttctcaagcgtagctccatcggtgcatgcttcactagtgtgtgtgtgcgtactagcctagagagcccgagcgtaccatcactttgctctttcaccagtcatctatcagtatactcgagtgctagcgagtagttctgggctaacaatgaaggggctcatgtagcgcgtcatggcggtgtagatggctcacaggtcgaccgtgggcggtgggtgttggtagagtttggtgtgcttgcggcggcgcgacgactgttggtgtgtttgcacgatggctgttagagcatgccccggcgtctccgagagcgtgaggaataggaagcgggtggttgcgccattatgtagggcagcctcctgctgtagcgcaaggaactaactcgccgaactccggcgggatcggggcagagagcagctccgtgtagatggccagcgtatcgaggttctcgagtcgcccggagggggccaaagatacaggtctccgtgaggccgagcatggtgagattggagcaattgccgatctcctactcgtgggttcggccactccggtggaggatgc

SEQ ID NO: 51455 - DNA, 597 bp, Triticum aestivum
  unsure (1)..(597): unsure at all n locations
  Clone ID: PAT_TA_51455
ngacatttcatatttgtgtcacgtatcttccattttagttggaaactaataaccaaggggagtattttttacaattgcaggacaacctacaaatattgaccaataaattatccatcatatgtatctttcatcccaccacccccgcgtcatcctctccctcatgccgatttgttgcccgaccgtgcagacaacatagcaatgaccatttatcgggttgttgttgcctttgggttgctcgctgtatcgactgtcttgtgattccccacctgcttgccctgcatattttctatttgatgaaatgtatactagctaactccatgttcttctatcattttattttactttgcaggttctactgtttgtgacgtgcttcttgttgatcatatgctgctttggcacgtcaagggccaatgctggtgttaggaccactgcgatcacaaacaaagccaagtagctgctgctccgctctctactgaagaagcatttgtaggttattctatgcataagactgcgcttttatgtgtcatttccttcaagctgtcattgcaacagaagatgaagtgtatcttcgtgatcagtagatcactgcgtgatgcc

SEQ ID NO: 51456 - DNA, 602 bp, Triticum aestivum
  unsure (1)..(602): unsure at all n locations
  Clone ID: PAT_TA_51456
cccagcgtccggtttgaggatgatcctgctacctctggcgtattacacaagcatctgctaagaactatgggtactccaatagtcgacaagattttatctagtctggatagggacaacaaattgaagaatggaatggagtatgaagacagtgaagaacagcatgctcagctgagcactactgaccgcacttttctggcaaaggatcttcctgggcaattgtcatcgaaggctcaagctttagttgaagcactggagggaaagcggtttgactcatttatggacgccttaagagatacagcagaggaaagtggcttgttatttaagaagcttgataaaagacttgagcgatcaatgctgcattcctaccgcaaggatttgatagcacaagtttcttcagagactgatccagtttccttcctcccaaaagtcgttgctctactttttctccaggcacacaacaagggtcttcaggcacctggaagagctgttggtgctgtcatcacactactgaaggacaagttaccagcttcaaccttcaaggttttaactgaatatcacgccactaccgtngaaagttctcgcactacaagctgctgccacgg

SEQ ID NO: 51457 - DNA, 552 bp, Triticum aestivum
  Clone ID: PAT_TA_51457
catgtccaggacttccatcccttcactgagaaacttatgggtttgcagggaggttacagatggagcggatgctgtcaacaatcgaacctatcttctcatgggatgctgcagtcccagcaaacttcaaatgtttttgcgcctcagcccggtcgaagtagaaagtccccgggactaacttctccttgggttgcaaacccaaccagaccactgtgtcagccccttcttcgttcgatctcaggtttcctgatagcttctctgatagtaccggcaagctcttcgagactccaggtgtatcagcccatcctggatgcatggagtagaaaccgacacccttgttgctgtatttctcagcccaccattcagtgagagcaacctgaactctcttgttacgagcatattgttttgtcccgtcaaattcgctttcgctgtattgcaaattcgtgttcagtggctcagtgtacatccctcctgatgcaactgtaatgacacgagcatcagatgctgctttttccaacagtggcatcactagctctgttaaagtgtatgttgctg

SEQ ID NO: 51458 - DNA, 449 bp, Triticum aestivum
  Clone ID: PAT_TA_51458
gcaatagcacatcagagttgtgaattatagtcgagtagtagaattaacagacagacagacatctgctactacatactacatactagatagttagataagatatagatagagatggaccaaataaaacctcaactcagttggattcaacaagatgagggcgcttgtgggcatcagcttcctcatcacttgcagagtaatcatcatcactggcggcgtaatctttacctccaagattaagattgatcagagccttctcgtcttcatcaggcacgtaccggatgtagccattgcctatgaggcgcacctcttcctcaggggtagcaattcggcaactgcgttcaattgggtccatatccttccatccacgcacagggtgtcgaatggggccttcattggcctcgtcctcgtcgacctcgtagtagccgtagttgttcagtccatcgatgacc

SEQ ID NO: 51459 - DNA, 280 bp, Triticum aestivum
  unsure (1)..(280): unsure at all n locations
  Clone ID: PAT_TA_51459
aattcaagctaaccatcatacttcgatgaaaagcatataggtgtagatagtaatctgacattcaaaaatttcatagcacctaagcnggcaaagaatataggagactaaatgtaatctttacttgtggtttaaaaaaaattatcagggtgttatcgcccatgacacatttgattgttggaaatctcacagccggtttgtgatttttgggtgttggacttcttaggcacgtcctgggctccgggtgtctgactcatggcggtggagatgccgccttgttggt

SEQ ID NO: 51460 - DNA, 317 bp, Triticum aestivum
  Clone ID: PAT_TA_51460
ataacagtggctgctcaattttgcgcccattttggtgtgttaacacaaacactacatgcttggaggaaaactccaaggggtatcactccacttaaaaataaaacgctcttgaagcatttcggcccccgaaataatgatgatagcatgtctcctgtaataccagagaaaacctgactttacaccgatctgggacaatcattaattatttggccgatggttatacatgccttctctgttatttatgaatatcctctggggtgatcaaagatattccactttccttaagaatgcttttcccttggattacattggtgcct

SEQ ID NO: 51461 - DNA, 540 bp, Triticum aestivum
  Clone ID: PAT_TA_51461
cagaagaaaatgaatcatcatctgctcaactagcctgggaatagtatggtatatggttatctccatgcctatatcaccaacactccgatcaaccaagccccttgattctagcttaatgaggcatgctgtgacccaatcctttgactgtaggggaacactggactggagcattcttcttaacagagcaacatttctcacactatttatgctgcgagcaaaaatatcgaagttcaataacttagtgagtaacctcacagttgcaccgacggcctggctgacttcaaccataatagtaggaggctcatcaagattctcgggattgcatgttgtcccatgaataacccccatttctagaacagcttcaattactgactcagatcgggcagcagtcattgcagtgccctgttgctcacaagctgctaaatgctccaggagagtagcacatttttcttgcgggcttggagatgattccttgggaactttgattaggccggagatgacatcaaagtgcaaagattgaatcgctacaactgttacatt

SEQ ID NO: 51462 - DNA, 305 bp, Triticum aestivum
  unsure (1)..(305): unsure at all n locations
  Clone ID: PAT_TA_51462
tttttntctttttttttttttttttttttttttttttttttttcgacctatacttttcaacttcctaacttcttttccagagggaacagaaaccagtctgcagcaccatggaaaatataagttttgcatcagggacagaaaccatagtttcactgggatacaggaagacaaagtacagccccattcgcatggtttacagatcaaatgaaatcacgtgcacgcaggcaggcggcatgtgtcggaatcagcgaagcaagaaccggactgcggaaacagcgtcgcccttgtgctctcggagtgtcctc

SEQ ID NO: 51463 - DNA, 563 bp, Triticum aestivum
  Clone ID: PAT_TA_51463
ggaaaatggtttctccattaagacttaattgttacttggacaatggtgattagtgcaaacagttgtacaaatccggtgaactgtgtaatgttacacctttagtttgtctaccttaataaagctagagtattacaactgcaacaccatcaaccatgcaaccagcataatagggcactgttcccatgcgctgactaagctcacttcaaagcttcttatcagattgttctccagtgcttttcaagtcatctgggttaagtcttggtctttttgtgctacagccatcattctccagagacttcaacttgttttttatcgcagatatctttgcagcacgatcagtttgtgctaatttgcttcccgaaccacctgccagtttcttgtctttcagtgctctttgtgaattaccggaatctaggaaacacttctcgctcgctaggtgaaccaccacaggacgtccacagaccaacttgccattcatcttctcctttgccaactgagcttcctgcatgctcactctttggtagtgtactgaacaaagcataaccacgaggctcgcctcgctt

SEQ ID NO: 51464 - DNA, 288 bp, Triticum aestivum
  Clone ID: PAT_TA_51464
aatcaggcaaaggataagaattatattgaatataggaacaactaccatccacacgtcattacaaacagccatgtatcatagtgtacatacacaacggtctgaatggagactaaacagactcagtaaagaaacaactactagctaacaaccccaaagataacacaacctatccatgaagtacatctagaagctgcaggctggagacaccaacctagcatgtaggatctggtgccgggaagcaaaattgacgggacccacagaagcggatgcatcaccaccaacaacaga

SEQ ID NO: 51465 - DNA, 542 bp, Triticum aestivum
  Clone ID: PAT_TA_51465
gttcaaaatatcttttgaaatcatttaaaatactatagcttaatcaattaaccatgcattgctgaaataaccattccccaaagtctttcactctaatatttttcattcttctccgttgttcgtctgcatccatcaccaaccatctaaaataacgtttcacgacgcacacaaaagaacaccggcctaacgctgatggtactgccaccacctcctacttgtagctaagatctacctggcgctaatgatcaattaaatatagtgatccatggaaaccaagggagacggtcaatgcttggtcgcagagaagagagcaatatgcatctcaatacgtccactcgtgcgggagattgaccttgcaggcctggaatgcgcagcggtggcgttgacatagtgctcgcacttctggctggcctgcatcgcattgctccgtctgaccagtgcgtcatgatcaagaaggaaggccccgggatagcaaggactgaaggacgggcaccgaggtcctcgacattgagattcagatcctgcatgacggacgacgcgcg

SEQ ID NO: 51466 - DNA, 578 bp, Triticum aestivum
  Clone ID: PAT_TA_51466
gacgtcctgcacgctactaactggatccttagacggcgcctttttttttttttttgaacgaaaacgatcactctcatctcatcagatgccaatcatgttataggcaaagaaagttcaactctgagcaacacataacatgtctaaacacggggcacagtgcgcactggcggagttttagttacaacacaggttcccagcgaacaagcaatagcagcatctttcagtaacacagaaccctttcttgtgtagtacaaattgtagttcagcaatggggcacatcactcccttcttcggcttttgtgatggtggtggtggcggtgccgatgcttggctttcttcttggcttttctctcctttctctcttttttctccgacgatctcctcccctttttattttccttcttcctgtgtgggtctggctcacaagagctggatggcttatcatccaatgtttccttatgccaacaatcatcgggagacttggatctcagaaacagagggctcttcggaccttgcactcggcgttcccatttttcttccaaacgtatattcgggctaggttctttgtctcgacaatg

SEQ ID NO: 51467 - DNA, 570 bp, Triticum aestivum
  Clone ID: PAT_TA_51467
agaaaacaaccttgcatcactttattaaatcatagctagaatatagcagctgacaaactaaagaaagtactcttgcactagagagacatggatcacagacgtaagcatgacccttgccatgttattgctggaaaacaaatgtggaacaaacacactttcccttaaaatgaactcgcatgagattgccataaactaaagcaaagcagcattaaatccagttcaaaccactatgggtccgtggtaaacgccaatggcatcaagagcattcccggtcctggcaaagaatcccacaacacatgtgttttctggcacggcggcgctgaaacggttgcccttctcatgcccaaacggtccatactttttgatgtttgtcgtgataacaagtgacgatatgacattgtcaattgtccctgatatttccgtcacatattctttaggtccgaactcgatggtttgactgttccctttgtcaggaccccaggggccttcgttgcgcctctttccaagtttgtcaatataagtaaatgcaagagagacaatccagctgctctcgctgctgagtgtcacact

SEQ ID NO: 51468 - DNA, 583 bp, Triticum aestivum
  unsure (1)..(583): unsure at all n locations
  Clone ID: PAT_TA_51468
catgaacaaattactcagggaaatcaatagtgtgcaacaacaggtagaaaattatgccaaaacgcatgcctgnatataatatcgttcgtggcctgacacatagtgtcgtgtttgtagcagcaaagcgccgacaaaaacatcgcgccggtggtcgcacactgggtgtgtcttaagacacgtactgtctgttctacgcagcacacgaccttgaaatcacaggtcttatctttttcctggtcgccgattcttggccncaaacatctccaagcttaaaacgcntttaacatctaatctaaatgttcctgatcggtctctgtcccctggcggtacggccgaccgcctgcccgagattggccggggcggcccccggctcatctccccggccaataatggggttaacccccttgggtttcccttctggtgtttgggattgctcccttcggcctttgctccctttgtgggtggggccccttttggcgtgcctggttgtttggggtcgtttgttgccctttttttggagtggctgtggccttttttttttttttttnttggggccggttccggttcttttttttttttttgg

SEQ ID NO: 51469 - DNA, 256 bp, Triticum aestivum
  unsure (1)..(256): unsure at all n locations
  Clone ID: PAT_TA_51469
gcccnnnaactcttagcatagcnncatttttgacatgttcaccgggtcntttcgcctttttgttccctgcatacttttccggnnggccatctgtttggccnctgtttttttgtcctngatcggttcttttgtctccggggtggcgttccctctctctggtccgctttcttggtgtccttggcgtctcgcccggcctgcccctttttcggcgtctggtcctcnctccttgctttctctcgctttttttgggcctgtt

SEQ ID NO: 51470 - DNA, 498 bp, Triticum aestivum
  Clone ID: PAT_TA_51470
agataaaaaaccatgatttgtccatcatctcctcttagaatagaaaaccactactctgagtttcccgcgaacaaaatttctattactgtattacaatagcactacgttttccccatagctgctgacaatcagaacagagatggtctgtttatttgacacaagattaagccttcagattcataatgtaaactgcatgcagatgttgggcaatctggggccggttgagacagctgcttcattctttcagtgatgatggctgtccagaagaaagcctatccgacctcgccttgttagctcgctccacataatcttgatgggagtcatgctttgcccctcgggtcatgaggtaccagggcacccccaaaatggcggcgaagatggcgatgcctgcgacgacgtgcttcttctcttcgctgtacaggtagtgggctatccgggcgcggaacccccccccgctggaactggtgccctcgccttccattaccggcgacggcggcg

SEQ ID NO: 51471 - DNA, 459 bp, Triticum aestivum
  Clone ID: PAT_TA_51471
gcgtttggttggcttctcctccccactcatcctcggttcccggtccggtcccgttccgttcgttagggtttagtagtagcggggtaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccatgaacggccaggacctggacggccgcaacatcaccgtcaacgaggcgcagtcccgtcgctccggcggaggaggcggcggctgcttcagcagcggcggtggcggctacgggggccatctccgtgagggcggaggcggaagcggctactggggtacaggcggttgc

SEQ ID NO: 51472 - DNA, 582 bp, Triticum aestivum
  unsure (1)..(582): unsure at all n locations
  Clone ID: PAT_TA_51472
gcgttcgtcaaatggttcttaaaaanaatcctcccgcttggttcgcttatggccaattcactgctattctgacgatcctgtattatgccccattgtggttcagagattacttctacaggctggtcatgaaaagtaatctctggaagatagctcttgcgtgaaccagagagattgccccctcgtgtcccattttcatttcatgagtactacttggtctctcggactctgactacagatatatttcacaatacatgagtacacacacttccagtccatatccatttgtaacgatcagtccaagtgtaaagtcctcccggttattatgtaataatggttttagtaatgtaatattattccgaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanagggggggcccctttttaaaaaaaccaaattttagtccccggggttggaaaaaaaaaaattttttttttggggccccaaaattaaattc

SEQ ID NO: 51473 - DNA, 584 bp, Triticum aestivum
  unsure (1)..(584): unsure at all n locations
  Clone ID: PAT_TA_51473
cggncgcgtgggtcagnaatgatcaggcaatcaatgtcatccgtaagaaatatgaattagaaaggtagaaacattagtgcnntgaaaaagagaaggcagaaaaactcataagggaaatggagcacaaatgcaacgaaaagaattagagaacaagcgagaatctgagaggtgtttgatgcgtcttaaggaggaacatgccgcagtggtggcaagaattcaacaggataacgagcttaaggaatcaactcttcgggcttatcacaaagaagaattgcagcgcattcgttctcagggtgagagtgaattgagggaggtcagtcataagttgaaccaggtgttttgaatgcgtcaggttttttttaactaactaaatctgtacaaaaatgtagaggctgtcgtcgctcagacaagagcatgaagctcaaataaaaacagtgaacattcggcatgaagaagattgtcagaaacttcaggatgaactggagcttcagaagtcaaaggaggagaagcaaagagcattattacagttacagtggaaagtgatgggcgaaagtcagcaagttgatcaggaagttaattctaaa

SEQ ID NO: 51474 - DNA, 586 bp, Triticum aestivum
  unsure (1)..(586): unsure at all n locations
  Clone ID: PAT_TA_51474
ccccgcgtccgactagttctagnacggggcggccgctcgcgatctagaacgtgcgctgctactctctggtgagagtttggagaactacggtgctgtagagaacatacttgttgagatgggaacttacttccaagttcaggatgattatctagactgttatggtgatcctgaatttattggcaaggttagtgcattactgcatgtgcccgtttaaaaatgaatggacattgttctattgttgatatgttctatttagctcttgcaatttcatcaatgttgagtcttaccatagattggcaccgacattgaagattacaagtgctcctggctagttgtccaagctcttgagcgtgctgatgagagccaaaagagcattctatttgaaaactatggaaagaaagatccagcatgcgtggcaaaagtgaaggatctctacaaagaacttaaccttgaggcggtatttcatgagtacgagagcgagagctacaagaagctgattgctgatatcgaagcccagccgagcgacgctgttcagaaggttctgaagtccttcttgcacaagatctacaagaggcagaagtagggt

SEQ ID NO: 51475 - DNA, 520 bp, Triticum aestivum
  unsure (1)..(520): unsure at all n locations
  Clone ID: PAT_TA_51475
gctttctctntatgttccatnaattcactgcttattttggccagnacagattaaactaggtcttgatttcaaggttcagttaaggcagttggtgcaggtttgtttgctgtaatactaactgtgctatttagacagagacatttgctctttctcattcctcgacattttcctttgctacaaagatttttcattctaggttgtggaaaacgcatgtagtgttccttctacaagtcgtcatgagctgggacatagaagaagagagccgacgagaagtcgcaaagcggttcgctccggtgtcgctgccaatggcgctgcacaaagtgcagattgcaggctagatgcgtacaagtccgtccctacttccatgagtcaattagatagtatatttggttatgaaagttatcttttgtgtatacagttttgccattattttgtaaaacctttgagttcttgataatgtaattttcttactaatcacacttttaattgatttgtgccgaggctaatagccaagttatgc

SEQ ID NO: 51476 - DNA, 470 bp, Triticum aestivum
  unsure (1)..(470): unsure at all n locations
  Clone ID: PAT_TA_51476
ggnaggaagccgcggccaaggccatgagggtcaaccaacggtcgtgatgggtggtgcatcaaggccatcgtcgttccctacgatactgcaatctcgtgaccgtggcagcgatggcggctacgaggagaacgcggagggaagcagggattccggcggcgataccagcagcatgggagatccggagttggacggcccgggttcaggctcgaggcatgggacacgagctggcggcagcagcaagtcgtcaaggcaagtcatggagcggagagagcgggacggtagacgtgaaggtaaatgggagcggaagcaatgaaggcaagccactccacccatggtggccaccactctattcagtagtcatttggtcagttatgcaatgcatctactctccagtagtcatggtggtcagtggtcactactctactctactctactcattagtcctttggtcaattatgcaatgcatctct

SEQ ID NO: 51477 - DNA, 133 bp, Triticum aestivum
  Clone ID: PAT_TA_51477
ggtgcacatgaggggccatggaagacgagtacaagactcccgcagctcttgccaaacccatgaaagattatggatcaaatactacaccagatacaaggaacattgtgcccatatgcatctttgaaagcggaac

SEQ ID NO: 51478 - DNA, 402 bp, Triticum aestivum
  Clone ID: PAT_TA_51478
aggaaaaaaaatatttaagagggcggatcaacagaacaacaatgtataaaacctgtgctataaaaagtgaacgaaaaataaaagccagccaatcacttgagcaacaaccgtgaggtgtggaacagtaccgcagttctgtgatcaggcaaaatgtcacaatctgtacatctctaagtaaacatatttctataattaattaatggtgacaaaaaaattaagttacagagttacaagtcatagaggaccttgtgttcaacggaagagccgagttcagtttgttgtgggcttgaactggtggtggttgaaattgaaggctgggtgtttgttcctcttggaaggggcgttggggtgcccttttttgcggcttctggggggtggggaccattccctggtttcttcttt

SEQ ID NO: 51479 - DNA, 444 bp, Triticum aestivum
  Clone ID: PAT_TA_51479
cgaaattcaagaagtatatttcaattcaacacctcatgttagtacaaagagaagtttacagagttttgttacaaagaaattaactgaagaaaaattgtatcggttgcagaattggtagcaactttacattaccagcaccagagctaacactgtcagaatagctcatcaattgacatggtgttgtcttccgtctgattcatctgctactcaaatgtctcatgcataatttactcaagatgccatttgtaaacctgcagaatgtaagccattggacgaaagaagaacccatgctgccctttctgaatgaagtttaacacctcccaaaatgttcttttgctaatagagcaatcctgatgtccaatttggcacctgcaaatttaggtataacatacaccgccagcaatccagattctggataactacttcgaaaacttgaagaactgt

SEQ ID NO: 51480 - DNA, 251 bp, Triticum aestivum
  Clone ID: PAT_TA_51480
ggggaaaacatgcatatatcagctttagcagaaagaaaagcagcagagttttctgccggctcagtgggcattttttgacccatctaatctgttcacaatcggcacccatttcccatgttaatcacttcagattcacagcaacgcctgtagtttaaattgctcgtaacggatatatgcattgctgttgtgtgaataaatgccagcggtgatcgtgggatgcccagctttccttgatcttctccatcctcttg

SEQ ID NO: 51481 - DNA, 293 bp, Triticum aestivum
  Clone ID: PAT_TA_51481
cactcttattcacaatattgtttgtttctctggggtggctcacctgatgttttttacagaaacgggtggcccatgcaaaggagggctggtcttaacatgaatttggggccagcctctcctaacacatggtttaatgataagctgtctgtgcttaatgtgtgcatataaaggtggggtgcgggttgcaacactcctcataccatcctgcggtggagctgaccatggagtttttgtgaggggatgggtttgacaggggcaggtccgtgggggatgaacactgctgaagactttga

SEQ ID NO: 51482 - DNA, 356 bp, Triticum aestivum
  Clone ID: PAT_TA_51482
agcgaaaccgatactcaacttccacaatctgtatatcaccagatatcttaacgacgactagcgcgtaacaagaataacgtcagcataaattcataaccaatatagcaggcatcagctagaagtatactgtatgcaggggaacatcatcgcgataaatcataaggtaggtaggtaattttccataactcaaaattttgatctaagcttctatctttctctccctctctcaatagctgcctcgatcatcagcgacttcagggactcactcctggtaacaaaccagctgggtcttgacttcgaagcctcgtctccgccatccagaaagtcagcagcaagcgagccccagggtcttcaaa

SEQ ID NO: 51483 - DNA, 355 bp, Triticum aestivum
  unsure (1)..(355): unsure at all n locations
  Clone ID: PAT_TA_51483
ggcgcgccttgggggttaagattaaaatccaaatgccagcacggcccataatccagatgacccagttttttactcaggcggcgtacccaaaactcaaagggacaggcccgttgggcggggtgccgggcttgaacaaaaacgcccgttgcgtttctacactggggggggcaagaacgcttttcactcatgggcctccttgtngtttttggggggaccgggggagttggtgagggcgttggggctttnggggggggtgggctttctgtggtgtttgggcagttttttggggttgtgccttttgggatttttgggaggcgcctggggggtttgggcccgggggggggtcggggggggt

SEQ ID NO: 51484 - DNA, 393 bp, Triticum aestivum
  unsure (1)..(393): unsure at all n locations
  Clone ID: PAT_TA_51484
gaaagttgacatatgatattactttattacaattggggggggactaaccttttttttgaagcaaatttaatagtagcaggcaggggtccacgcgtgggatccattacggtcccggaatctagctcgccgacaagcagttgtccaaacggttcttccccacagaccggacaccctgcacgcttttgtaaggtttatcaactagcaagggcgatgataaattttgaagcnagtaacgtatacgacttgcttttgagcactattcaatggatggattgtggatcatgcatgcccgcacggacgtacgtttagtagatgcctggttgcaggggacgatggatcttgtgggttttctttttttggcgggggctttgggaggccggggggggacggttt

SEQ ID NO: 51485 - DNA, 560 bp, Triticum aestivum
  unsure (1)..(560): unsure at all n locations
  Clone ID: PAT_TA_51485
ttgtgttttttttttttttttttttttttttttttttttttttttttttttgttttttttttttttggnnccaaaccgggttnncngaagaccccccggggttagtcctggggtttttttggttcccnnnnnaagatctcaaagcgcgggaggggggatttctttccttttggcgggtccgggcnttccnttccttttttggaagaggtaaacaaaaattgggtggcgtgggggtgcttngggggcggggggtgggggggcggggggncaatttttnaggtggttaggggggggggcgtgggtgttctttggcctggccgtccgggggggggggggccagtggggggggggggccccttttgtaagattggggggggggggggggggttgaggggcccgggggggggggctgggggggggcctgggggggaggggttggcggggggggggggggcggggggggggggtgcggagggggggggtggagggggggngaggggggggggggccccngggggggggggggggngggggggggggggnggntggggggggggcgg

SEQ ID NO: 51486 - DNA, 159 bp, Triticum aestivum
  Clone ID: PAT_TA_51486
gttatatccttggccggttttttggtttttttttttgggagacggggtcctttaaaaaatcaagcccttcattgttagaatcagaagggcttatggggagatttcaagcaatacacccgggaatttttcccattttttggccttgcctgggcggacccg

SEQ ID NO: 51487 - DNA, 364 bp, Triticum aestivum
  Clone ID: PAT_TA_51487
gcctacctgggcttttggccccggcccaaatcaattaaaaggggggttgggggggaaaattcccttttccgggacccaaggggtttccccattttgggggaacctggttcccccaaagataactttctttccccattttcctttttaattggctcatggaagtgggggcgggcttgtcccccttttgcctggattctgccctttgggcggggcccttgggggggcccccggggcggcccggtttgggccttctcgggggctctttttttttgtgtccccgctcttggcgccttggtgggggggccctcgctgcgttttccccagccctgagggaaaaatttttgggggctggggaaaagggggg

SEQ ID NO: 51488 - DNA, 320 bp, Triticum aestivum
  Clone ID: PAT_TA_51488
agaatctggatagttttaggccacaaccagaaaatgctacacagtctcaggtcagcctaagagtcgagcccagtacacaaagaggtcatcagtaagccagcatgggtgaacaggcagcgccatggtacaaaaaaacacccaggaaaacgctgtggttgctagatcttagacagggagccctatgcccttcaaaacaccggagctatctgatgagaaactatagcttattgtccttcaaggaggacccatcacgtatgtcccacttatccaggagcaacgaaacgcctgccaagatgcttcaacccctgaagtgaatgtta

SEQ ID NO: 51489 - DNA, 493 bp, Triticum aestivum
  Clone ID: PAT_TA_51489
gacatcaaaatctagcaagtaatttccgtaggtcagtgtacatgctgaacagaagcagacaactagagtcacacaaaattcgcttcatattctgtccacatcctttcatccaacaaagaaagtcaagttagatttcccccggcgtcctttcattcaaggctagtttgaaaacctcattttcccaagaaaaattagctcattttcacttgagaaaatagagaaacatagagttcccaaactagccctcaaggtccttaagaccagtgaagagaaggggcttcgatgcaccaaatatgctcattggttgccgacaacacggccaccatatgctctacctcgcctctgctgctgctgaacacgtcgctgctggttgaaatcacgtccagaggcaggatttgcctgctgctgtggtgcggtcctcatgcgttgcgccttcatccgtgcaaagagtgcatccatcgtccttggtgctgcatggttctgcgactccttg

SEQ ID NO: 51490 - DNA, 198 bp, Triticum aestivum
  Clone ID: PAT_TA_51490
agctgaaagtgcattcttattagaaacaggggagccacaatgcacatgcacgggttaaatccaggttgctctccacgtccccaccaccccgaccaacacgagctggtcgaagcaaactggtgtagctcccttttcgtccaccccctctgtgcacctccgagcctccaattctatgagcgagaaagagccggagactgt

SEQ ID NO: 51491 - DNA, 432 bp, Triticum aestivum
  unsure (1)..(432): unsure at all n locations
  Clone ID: PAT_TA_51491
cccccccaaaagagccccttcattcattggcgccgggctcctaagggcgcaaacctcactgcccttttcccccaaccccaacgggggggggggggtgctccgtttaccctttttttggaaaccgggttttgggccntngctggcctggcttttaagttctttgaagttgcacgtccccactcctgcccgtgccagggttttgccccgtttttggtttctcctttcttcttcggccatggtttcccccccctccttgttacccctcggggggggatcctctttttttccctttctggcccggggcctctttacccttctaaggggggtttttatccttgggcgggcccttggggattttgggcgggggcggggggtttttttaggggggtttcttggtcggggtgtgccggggcctttttttccgttgccttt

SEQ ID NO: 51492 - DNA, 165 bp, Triticum aestivum
  unsure (1)..(165): unsure at all n locations
  Clone ID: PAT_TA_51492
aggagagcattgcataattgaccaaaggactaatgagtagagtngagtngagtagtgaccactggccaccatgactactggggngtcgatgcattgcctaactgcccaaatgactactgnatatagtggtggccaccgtgggtggggtggcttgccttccttggt

SEQ ID NO: 51493 - DNA, 433 bp, Triticum aestivum
  Clone ID: PAT_TA_51493
aaaaaaaaaggggtcccccccgctttataaaaaaagccccatggccaacacaggggagaaaaaaaaaaacgccctccaccaccaaattaaagggacgcccccagggggaaaaaaaaaggggccgggccccgaacaaataaccccaacgacgaaaaaaccccctaaggaaaagccgatacccccccggaaaaggaacaatcaaccggggggggaggagccggaccccaccaaaggggggaccccaaaaagaccccctaaaaaaggaaatgaccttaaaaagccgcaatcgttggacccaaaaaaaaagttttcacccggagggacgggtaggaggggggagccccacaaaaaaccctggggggggggaaaaaacatccggggacccccccttcgtgggccaatcccgggactggaaaagggggaaaccccgggg

SEQ ID NO: 51494 - DNA, 463 bp, Triticum aestivum
  unsure (1)..(463): unsure at all n locations
  Clone ID: PAT_TA_51494
catacaactacttattactcttacaaaatcttggctaacaaagattgttcaaagcaacaaaggcatgaacctgaacaccaacagataggataggaacaccacactgtagatataggagttcggacatctctacgcattgccgcgaatttaggagagtagatccatagcacccactaattttcgcaaaaggtgttgtctcatatgctgaacatgtgatgctgcngtgaatctcattgatcagctgagggcaattccgcaaaacagggagtttaaggcngacccttcattccttcagtgcngataacatgtcctttcagattatctatgtcctacgacantgtcctgttcttctcgtcagtntgaaagatcatgttgcgatccggttgaactgcaaacatcgcttatgaatctccctcttcgcggtgtttccttccgaacagctccaaaacctttattttgtgtt

SEQ ID NO: 51495 - DNA, 486 bp, Triticum aestivum
  Clone ID: PAT_TA_51495
gtacatattactttttttagagttaagatgttcggatcgcatttgatcaaccgatccggccgtcaaattggcaggatatattactcctgattaaaaggctgcaagctgtaaggacacccatcacttaacacattattatgcggcagaaccgccatcagataacacatggcatgcgacgagggcacttctactggtcccccggtgacccgcacggaagcgaacttaaagatcctgtggtaaaagctccttgaatcaccgatgggtggggcgggtaaataaaggaacaccaatttgatttatgtcactgcctctgggggtctttcatctagggttaacctccaccttgtggatgacacctacggactttcagtggatgtgaataatacccatgttatgaatgttacccttattattgctctgtttcactttgggcgaccggacgctcattcacatagtgtttgtgaccgcattggtctctgcgacatt

SEQ ID NO: 51496 - DNA, 518 bp, Triticum aestivum
  Clone ID: PAT_TA_51496
actccaaaaaaaataatgctattagctgtcaaaatgatcaacatatgttccaatggatctcctgtgtgacctatctacatgatacgtgcattgtcgctggtcaccgtcagtttccgcacacctagctgctttcgttttctacgaattcattcttcaacaccacctcgttgtcatcttttttctcctccacctgcacactttcagtcttgatctcatcgccatctttcttctcttctgcctgcttactttcagtcttggtctttctgctcctccgccggcttactttcagtcttcatctcagtggcatctttcttctttaacttcagaagctcgacaagatcatggagggcaacatcagcgtcgtcgtcgctcctcatcaggacctcggcgacctctgcaggcgtcaccgtcacctcctggatcagcgccttgatctctggataggtggcatggtagtcgatggaatggtagttattggcaacaatccggaaagcttccgtggtgcaataccccatgtg

SEQ ID NO: 51497 - DNA, 547 bp, Triticum aestivum
  Clone ID: PAT_TA_51497
gtaaagggggtaaaacgagcaaggactcttccagtctccaacccatcccaattccctccccccgtggaaatagacttcttcccctctctcgatctcgcaggcctccctcccccgatgtccagcagccgcggcgacgctctccttgactcggcgccgctgctcggcgccggcgccggcggcgggggccagcgccggggcaacgcgctccgccggccgtcgctgcgcggcgccgcgcgcctgctgcgccgcagcgggcggcgggcgatgcgggagccgccgatgctcgtgcgggaggcggcggccgagcacctcgaggagcggcaggcggactgggcctactcccgccccgtcgtggcgctcgatctcctctggaacatctccttcatcaccgtcgccgccgtcgggctcgtgctcagccgcaacgagaaatcccccatgccgctccggacctgggtcgccggctacgccctgccatgcctccaacacatggtctgcgtgctctgtaagaaccgcatgcgccgaaaccaacgcggtggggccccagcac

SEQ ID NO: 51498 - DNA, 576 bp, Triticum aestivum
  Clone ID: PAT_TA_51498
cgccggcggcggcaggcgcggtcgtgacggccgtcacagggatgccgccagctacctctacaccatcctcgacaagatcagccgcccgctgacgctagtcctggacctatccggccccatcgtctggcccacctgcgacggcggcgcctaccacgacacgctcgagtgcaacaacatggactgcatgcgcgcgcaccggttccatccgcccaactgtcagcataccggctacggtatgccggacgcccacaacccctaccgctgcaagtgcaccgggcacccgaacaaccacgtgtacagcgacaccgcgtgaggggacatgacgcgcgacacgctctgcgtcaacgccaccgacggaaggaacccgtgggggccggtgtcggtcaccgccgtgacgacctgcgcgctggactccctgctagcggggctgccagtgggggccgccggcgtggccgggctcgcgcgctccgtcctgcgcttccccgttcaggtctcgcgcacgcagggcgtcactaactcggtcgcgctctgcctcccaatctgccatagaaacggcctcggcatcttcggcggcgg

SEQ ID NO: 51499 - DNA, 569 bp, Triticum aestivum
  unsure (1)..(569): unsure at all n locations
  Clone ID: PAT_TA_51499
cggccgcgtgggcctngatcgccgccgccgccgccgcagccaagccgagcagccatggagggatccgccgtcccggcgccgctccgcacgcgcgtgtgcatcatcggcagcggcccggccgcgcacacggcggccatatacgcggcccgcgcggagctcaagcccgtgctcttcgagggctggatggccaacgacatcgccgcggggggccagctcaccaccaccaccgacgtcgagaacttcccgggcttccccaccggcatcatgggcatcgacctcatggacaactgccgcgcccagtccgcccgcttcggcaccaacatcctctccgagaccgtcaccgaggtcgacttctccgcccgccccttccgcgtcacctccgactccaccaccgtcctcgccgacaccgtcgtcgtcgccacgggcgccgtcgcgcgccgcctccacttccccgggtccgacacctactggaaccgcggcatctctgcctgcgccgtctgcgacggtgccgcgcccatcttccggaacaagcccatcgccgtcatcggtggcggagattccgccatgga

SEQ ID NO: 51500 - DNA, 455 bp, Triticum aestivum
  Clone ID: PAT_TA_51500
acacatagctggctggtggtctgtagagggacggatcgactctatccaaaggagcattataacgcgagagagccgtacatgcgcagcctactagggggcctaggtgctggactagtggctgggacgggggccacgtgctgcagctttggcgcaggctcaagacaccaggggacccggaactggagcgctctgcaccagaaaccactgcaactacctatgccaccagacgcctaaacatcatcaactcctgactcctgagaccaaccggtttacaacaaggacaagtccatcaacggtggcggatacgtggaggtatacttacatcaagagttaaggacacggctctcctgacacaggtttcggaccgtctgggactgctatggcataacccatctgtatgaagaatacaggaaaggctgcattgacttgtgcttaggaggaccattccttactgt

SEQ ID NO: 51501 - DNA, 460 bp, Triticum aestivum
  Clone ID: PAT_TA_51501
atagcaccagcaagcaaaccaccccacaggctccagcttcagacacatacagaggtcttcagtttccgcggagatgggtgacgccaagtcgtcgtggccggagctgctgggggcgccgtccgaggtggcgaagcagaagatcctcagtgaccgcccggacgtgcgcgtgttcatcgtgcccgtcggcaacaacgtcaccggcgacttcaacgacaagcgcgtccgcgtcttcgtcaacacccgcggcgacctcgccagggtccccaacatcggctaggacgatcacgctccatcatgcatgtaatataggctagtgtgctcggcatgcatgcatcgtcatggactcatggttcatgctgccgggtgtgttagccatgattatcatgtactgtacgcgtacgcacctatatattcatcattatgttgtatcttcattgcaataaagctcactgattgtggc

SEQ ID NO: 51502 - DNA, 501 bp, Triticum aestivum
  Clone ID: PAT_TA_51502
aggaaaaaactttgatttacatgcgaacagacacatcacaaccagcttttgttccttcttccttcagtggaaccaacagagcttccacctctctctacataatttaatcatgagacaacaattgcattgaactgcgttgaattcccacaaaattcagggctaccacagacatcccgcagcgaatcaatcaccggtcagtcaccggcgtcttcacaaatggggttattgcctcctgctgctgctgctggaaggagaagtggccatctttccctcgacgtactgagcgaatttcacccttgggccaggaattttgcagtgagagttgagctcagccagcatctgctgccgacgctccttggccacctcctctacccacaacgccctctcgcaagcttccatctgctcctgttggccagaagatttctccgccagactcctaagacttgccacctcctccagtaagttcactattatatcggctgcctcttgcatctgcttcct

SEQ ID NO: 51503 - DNA, 349 bp, Triticum aestivum
  unsure (1)..(349): unsure at all n locations
  Clone ID: PAT_TA_51503
aaactcaaaacaaggttcttttttgtgcacaagaagggcaaactactacaagaaaaagcgggggaacaagcatgagtgtaaaatctttctggatttatacgtattatcgaccagccgggctcgcttggttgcttatcggaaggaaatctcaactaattacctttttttttattacaaaggattgggcaatggtgggagaaccccaacccgagccnanccnggtgaaaaaaaatgaaagggaaagaaaccttttttacttgggcataattgatttttcacaaaactcccccccggtcgacggtaaaacctttggcattgcccggccgcccggggcgcgaacacttcacaa

SEQ ID NO: 51504 - DNA, 264 bp, Triticum aestivum
  Clone ID: PAT_TA_51504
gggcaccttaacaaacgggggttttttaaaggttaaaaaagggcctatacaagggccatacctttgggcggggcagggggacaacccttggcggccccaaagcaggggggtttaaaaaacggggcaaaaccccccccttagcccaattaagagggctcatggggggggggggactttaaacatttccaacataggggccctctggggggggggaggaccggtcccccaaacccccccgttgggggggcgccttcctgggggggg

SEQ ID NO: 51505 - DNA, 531 bp, Triticum aestivum
  Clone ID: PAT_TA_51505
caagtcagattatgctacatacaacagggctctcggatcaagatcttggagctcacataaccacaaactagggttgcaggcacacataaaattgtgatgacattaactagaggtaggatgaaacgaaatacatcggagttgctgataacggcacaatcaagatttaagatgttggaacagctcaggcagatgggcattcgtgagcttggtccgtttagttatctcgcgttgcttcttcttaggcttagccttgggtttcacgccatggatctgggctgctgctcgtcgtttggtggtgtcggtcatcggcttcatgccgttcttctggagctccttttcgatatcaaccatatcacgcggtaactcaatcccacggaagagctccttcaggtcatcatcaaccttgatcttcacttttggatcgttagggtaaacaatgtcctcctgtgaatccatgtttgacaacagccaaacttcacctgctgccttcagagcctgcaaatcttccaacacacttggggtatgcatcct

SEQ ID NO: 51506 - DNA, 554 bp, Triticum aestivum
  unsure (1)..(554): unsure at all n locations
  Clone ID: PAT_TA_51506
ttttnntttttctttttttnntttttttttttttttttttttttttttttttttttttttttttttttttttttttttttttttttttttttttttttttttttgggaaaaggggccccgggccccccttcattggaagggggaaagagagagggcctggttgcgggcgatcctacaacagggctcgacccaaattttatggggcctggaaaaaccgggaacaagacccaaacctccgtcaaagggtccagggcgccccttataaaaatcaaagcctccctacggggggcttgatctcagggggcgacagctgctttcggggctttgtctgggagtatgttggcgggggggatgaactggggggggatctcacgggccactccgggcattggggcggcccccccggttttgggggcaaactttttcctcaggtttttttggagcccaaactcggggaagctcttggaattctcaggggcctgaacacgagccaagttggtgtagttggctgcccattgggcgaaaaaagggaactccccctctggcagcttcct

SEQ ID NO: 51507 - DNA, 550 bp, Triticum aestivum
  Clone ID: PAT_TA_51507
aaaagtccaatgaaacttatgtttttctcaatataatggaaagcaacaacacataagttatatgtttgaggatgggtaaactatttttagaaatggacatgtatgtgagcttgttaaatcagcatataggtaattaggcatacatgcttgtaggccgtattcttggcagatgaagattcctttttatcagaagaaaaatgaaaaaagcatcaactatcctacttgtgttcctgattgtttggtctcgttgagtgaaacaaatctcagggacatttctacatagcactgaatcttgatagatacagacatgcacagcaacaaactttaatttggttcttgtcttcctcttgccatcctgctgatcaactaccttttggttcttccatgctagttggatagtaattcgtgaaaacagagtaaccagtgataatcaaatccattactgcatcaaggtactttttcacatgatcatgccataaaggcattccagatttgtagaagaaaggtaggaaactccttgggctctttgaataagtgattatgtattacc

SEQ ID NO: 51508 - DNA, 552 bp, Triticum aestivum
  unsure (1)..(552): unsure at all n locations
  Clone ID: PAT_TA_51508
aagtgccaccatccaggcctgaatcatcatttaacctcaacatccaccaccccaaatgagacccacagcaaaaggaaaaatgaatcgctcgctncataatngaatagaacgggtggcccaaaaaagaatgactagtggtcctcaggnttgccgggaagcgccttgcacttgcaccgccgcagtgatcgggatcgagacggggacctcttcgggggcgtgggagggcgcttgggctgtggtgttgctcaccggggggaggggcgtgtccgccccgttggggacagtcaacaccggctctggggcccttgctgggtggcgtgctggtttttcctgggttaccccccctccggcccgcgcgctgggggggctgctgtgttttgggggttttgttccccctgtttcttgggcgggtttaatttgttttttttgtgnccccccccggggttgttgggggtgggttgcctgcgctccgggccttcttttgtcctcctttttgggccggggggggttgtttttttttttgggggtgttgtggggggtgggggttttttg

SEQ ID NO: 51509 - DNA, 277 bp, Triticum aestivum
  Clone ID: PAT_TA_51509
gggaccagcaactggtaggggttttattagtactatatataaacactggagtccaaccatgggttttaccggggaagcaacgaacttttaaacaaaaaatctgggaatccatcaatcacttaaaaagtaggttttataaaaaaagagggggccattcgcaacttcgagttgtaaccggggcccccgggaccccccggtccgccgaagtgtctaaattcaaggggaataaccccgggggggcgcccacctttaaccggaaaaaaaaaccccgggcccc

SEQ ID NO: 51510 - DNA, 302 bp, Triticum aestivum
  Clone ID: PAT_TA_51510
attgttgtcaataaatttttttgtttacagggacagacgataaatgccattttcaaaatattggaatttgttatttttatgagccaaaaatttattggtgtcattttttgaagggcaatgcacaatgcctttgcattaatggcggatcgtgtttagggatcatcaccttctggggggcttgggctggacactaatatttatgggggggttttatagcaccacctctgggtagacctggtggattgaaaacacctcccacttaagggagaaggaccccacatcgggatccacgcctaattaaa

SEQ ID NO: 51511 - DNA, 491 bp, Triticum aestivum
  Clone ID: PAT_TA_51511
gaacttgcaacaccaggttaggcgggcatcgtaaaattgaaatggccgcacgagagccccctgccagtcagctgcccggtgaacccgagcgtctgcttctcctcgtcgaacattagcaggttctgctgcatctgaaaccctccgagcaccacggccggcgcggcaacgccgccataccaggacttgtccccggccttcatctcgacgaaagcgaagcacgccgtggcgcggttcacctgcgccatggagttgatgccgaacaccgtccagttcctgccgccttccagcatcagctcgaccgttggcacaaagtagccgaaccgcgtcggcgaaagcctggacgagttgtagcacagctcgaacggcgccgcagccggtgaggggaccctcgcatcggtagtaatcgcaccctggcgttccatggcctggtcgaacgcgttgatgagcgggcggtacacgtcgtggcggagctccgcgtacgggatcgtcgt

SEQ ID NO: 51512 - DNA, 411 bp, Triticum aestivum
  Clone ID: PAT_TA_51512
ggcaccagggaaaacatctcatacatgacattggcctatccaaatgaacggaataagctgggggtaaaacaagacacgacacgggggggggcccctcaggggtacacgggatacacacacgggggccgataaaaagacagacagggaaaaagacaaacaggggaaacgaccacacccttctgggtactggcaacccaacaagggcacagtctggggcgaaccacccaggggcccctgtttgttggatcaagggacgggacacggacccctttattttccacctaaggtggggaaactgggactgggtttttttcgccggggcaaaaaatggttgccgggcaccacccggggcggcggtgttccccccccgggcctccccgcggtccctgaaaacaacggcgggggcccccc

SEQ ID NO: 51513 - DNA, 415 bp, Triticum aestivum
  Clone ID: PAT_TA_51513
gaggatggttcaacaaataataagcatgttttcatgtgactcttgggagataaaaatgttcatggaaacaagttatgctgtgtgttgggtgcgtacaaaagatgtggcattccttacaaatacccaatgtgtcacactactatgcggtacaactgcacgcttcatgatccattcaacggcaaagctgctctctcccaaaagaaaagaaaatgaaagaagaaaaaagctgctacacacaagagtaaacaaatttttttgccccttattggttctttgctcttaaacgaacgaagctaggctatatgtcgaagggagtaacggagcagtacgcattattttttctgagcgtagtggtgacaagtctgctagctagcgggtgtaggcgacaatcgctggtatcgggtgagggcatccc

SEQ ID NO: 51514 - DNA, 508 bp, Triticum aestivum
  unsure (1)..(508): unsure at all n locations
  Clone ID: PAT_TA_51514
gtaaaggttggtcggctttcatataaaaggcctttggccttttcgtgcaaaaactacatcactgatagtcaatttcacgacttgactatatgtatatagttctgtacaccgtacgatcctaatccttacaccatcaccggcatttccaatcaataaacagctatgatcctagcgtcctacaacatcatgtcagttggggtacctacagcacaacactcatcacaaggcaaccagtggtgtcgttgctctgctgtcgaagccagggaggttgtcgtcgaagagcgagcccatcccgaatgtcttgtcgatccccagatcactcgagatcctatcgcagagctttttgtacactgcagtgtcnccatgggtacttcctaagctccacaccatgcagagaggggccaagcgcaaaaacctcggcgcagactaagaatggtgtggggttgttcggtccattgcaattgcccgtttttttgagcttgctatgtgctctctggacatggaaccc

SEQ ID NO: 51515 - DNA, 382 bp, Triticum aestivum
  unsure (1)..(382): unsure at all n locations
  Clone ID: PAT_TA_51515
gcacancgccccttaattccatgataagacgaacaagatatgtgcctcntccaattgaaaccaggttgtatttccgttgctgctcccccntgacttcaccgcttcttgtttgttaacccgtccttcttccctacggcgggggtgtgctttttatnctttgcncntttttcanccacgcgtgtctgtctggctttccnttccncttgnnttttttgcttatttcgtgggagggntgacccctgtcccgccggnccctttcttggccttcgtgaccttgncggncttctttttttttatctgtccgtctccgtcctcttccggcttggggttcattttttccaccttctggttctgcttttttttccctttgtttttctttttc

SEQ ID NO: 51516 - DNA, 424 bp, Triticum aestivum
  Clone ID: PAT_TA_51516
acactggacagttgcagcattattgatgtgcatgattacaagtaataaattttgcctacaacccttcctggcaaataggcatgcattaaagatgaaagacctggaaccggaaacccaacaggtgaaattgaggaacaccacctccgagaagtatttgcgggatgggccgtcgcacaagaccagatataaacttgtttcaggcaaatacctattgaaacaactgcagtttacacttgaattatttcgccttactgcctttacaagatatggcgctattcatgataaaactacacaaactttcacagattgtcaggtcttaacatacgcattaattattccttgggcactttcaaggtgattgaaaaaagtcacgaatgaaatacgggttcacaagtcaccatggaaatacatgtatgtcaaaaga

SEQ ID NO: 51517 - DNA, 303 bp, Triticum aestivum
  Clone ID: PAT_TA_51517
gacatagcaaatgtgcatactaggaaccacagcagcgaccacctacggtacacaacagtgatgccacgcaacagattcggcggctcctgaacatacagtaggactcgtgctcccccgtacctgcttaatgaggccacaacattttccggcgccggcggtccatccctaacactccgtggaaaacaaatatcgctcactggcaaaagctggtcgtgtttgattgccgagcttgaagcctattaatctcgccccacatttgtgtgaaggggtttgtggcttcaagcgtgggtttcgtctccccaa

SEQ ID NO: 51518 - DNA, 477 bp, Triticum aestivum
  Clone ID: PAT_TA_51518
cctctgaatttcttcgttctatattttgacaacacaaaatgtactagatttgaaatcctaaaaatacatatcccagtgaataatggccaaccgcattgaagcaaattcgacagtaaccactttacgaacgggaaaaaataattaccatgatcactcatgggcagaaaaactagtgttgcgttcgcggcacagaaatgtagaaccactccggcctaactcttcaactccgccatgcgggctttgtttaggcagataagccatgtgccagtcacctccaccagatagtttcaaaatgtcttcctccttgcggatgtttggattgtcatcatcaaactcgatccattttccgtcatcttgctttacccagccaacatattgggcagagactgcacttctttccttgtgtgtcgagacagcaaccaaatcatatacgccaggtaattgtttctttggtggagaagactcaactttgtcaat

SEQ ID NO: 51519 - DNA, 581 bp, Triticum aestivum
  unsure (1)..(581): unsure at all n locations
  Clone ID: PAT_TA_51519
cggncgcgtgggcggccgcgtgggcattcctccacctgccaccgcaacgggtcctcctcatgccgcgctgaggggttcgcccacccgccgtctcgacggatggaggagcccatccggcgcccggcgagcctggcggcaaccggcaagaggttcatcagcatggctacagcaagggaacaggttgtcacgatcccagttaggaggaataaccccccaaaactttcaaagacacatacctgctgatgcagcctttacatcacttgccatggaatccctgaaatggagtgtcagctttgtgctgtaattctggtggaccgcgtagaagtcttggacggccagtgaaatgctggttcgtgccacttttcccaccagcgagcccagattgaggatcactccgacatggaactcgtctgctttgccggtggtgttctgagctacgccgggatcgacaaggagcaagagcaagaggaagaggattgctcggggtgttctctccattccgtggggcaccgcaagttttagattctttggtgctgagatgcactgcattgcaccctcttatgtaggattccgcttgttga

SEQ ID NO: 51520 - DNA, 177 bp, Triticum aestivum
  Clone ID: PAT_TA_51520
tccgggaacgtgcccctggcgataggagaagctaaaggttttgatccgtgagaagtggacaggattgtaaaactgaactgttggagcgatcaattctgttaagttgcgttttcggttttggggtttgttttgagtttgccacagcagctcgtccatggacgtgtccgtccgttgtta

SEQ ID NO: 51521 - DNA, 490 bp, Triticum aestivum
  Clone ID: PAT_TA_51521
cggggccggggtatcccgggctcggacccacgcgtcgcgcggaaagcttccttgcccagctagggattttgctgctctccgcacgccgcgctgccgcgcagccgtggtcaccgcccgatggcgctgtcgcgaaccagcaacagccgtcggattacccccagctgtcaagcctgggcatgcgacgagcgatcggccggcagctggcaagaaccactgtttgcagaacgaggcacctcactgggagagttgcggagaagaaatctgcacgcccactagttggtgtgtgaagttcagcccattgtgatttcaccacgtaactgcggtaaagacccgtgttctactgcctgggacagctggtgggcagagagaagcttggtggaccttagggtagggatactatactccatggagcagtgctgctgataatgcactgtttgaatgtcacttgcaagggctgcacagtacaagcagtgattcgctacgtgggcac

SEQ ID NO: 51522 - DNA, 345 bp, Triticum aestivum
  Clone ID: PAT_TA_51522
tgatcttatgttggctgcttctttggttaccccatagctatggctttcatggtaaggcatggcacaggaattgtgtgctgttaccatggacaagcaaaatgatgctggaaaagaatcgcaaccttgccttgtgatggcttgcaacaacaggtaaagtgcaggagaagctatggactgttttcaccattactgcgagatgctactatagctattgatatcctgagcattatatcacgtagctctggtgttatatgggcaacggtttctctgttgcttgtcaaaagtatggatatggaatgctcctctgtatcatttcttttcctttgcaaaagcaaaaatgcacag

SEQ ID NO: 51523 - DNA, 489 bp, Triticum aestivum
  Clone ID: PAT_TA_51523
aactgaaacaagttggatttccagcaacatatgcaaaccactttgttccacgattcagtccgaactacagagcaaatggagggctaaacaggccggggttccataaagcttcggggatatctgcaggggaggggggcgagaaaaaccctacccgccaaagccgaaaagggggcggccctggcgcttgagcgcgaaaacaacgtccatggggggaacggtcttgcggggggcgtgctcggtgtaggggacggcgtcgcggataacgttctcaaggaaaatcttgagcaccccgggggtctcctcgaaaatgagccccgagatgcgcttaacgccgcccctcctcgccaggcgccgaatcgccggtttggggatgccctgaatgttgccgcgcagaaccttcctgtgccgtttggcgccgcccttgccgagccccttgcctcccttgccgcgcccggcaatggctgacgatccctccttggttcgagctgc

SEQ ID NO: 51524 - DNA, 443 bp, Triticum aestivum
  Clone ID: PAT_TA_51524
agtaccagccgccaatgtacatacaactcatgcaacagagaaaacatccacatccatccagctgctgtgaatttaaaggctaacaacaacatgtataacggacgaatagaagcaatcagatttgatcgcccgccgccttgctgtgctggaacttgacgacgacgcaggtgatgttgtcgccgctcccacggccgaacgcggtctccgtcagcttcctggccgccgcctcggggtcctcctccatcttcacgagcgagacggcgtcctcatttggaaccacatgccacagcccatcactagccaaaatcagaaactccatttcatcatctatttcttgatcctgaatctctggttccgcgacaacaaattgcttcaacaagcggttgccaaacgcccgagacattgcaagtacaccaccaacccttcaagttgcaggcccacat

SEQ ID NO: 51525 - DNA, 557 bp, Triticum aestivum
  Clone ID: PAT_TA_51525
agatcaaaacttcactttttctttctataagtttctgtacatttctactgtatatacatatggcaaaattgtatgaagaccggctaatcctcaaaaggtggatgccaatcacagggtgtagagtgacttggagtatctatgagctaagaatgtccaagagagaaactctgatctggattaatttcctgaacagatgtcccgccccattctcgagatctccaatactacactctaactcctgcaattgctcctcctggcagacaactgccttcttcttgtgaaatgccttggagacaagagactgttttggcattctgatttcctttgacaagagatggactgtggactccaacagagacacagaaacctctctagctttggtcaatagcatgaccaccttgcaagccgcagaaacaacattagccttcttcgcgctcttcttgaaatgtttcttggccgtcttcaccaaacgaacataagactggatcttggcttgagcagttgcatcatctccttttcttagagctacctgtagctcttggatgatggccttcatc

SEQ ID NO: 51526 - DNA, 283 bp, Triticum aestivum
  Clone ID: PAT_TA_51526
aaaacgggaaccaacattttcatttccattggtggggggaacaagaagggcccctcagattagggataccacatcccccccccatgggggggacatgggtttaacacgacgcacattttgaaacactacgggttttccacccgtgaactcagcccaacaggggtttaccttttttacaccgggcatggacatggattggaaaaaaaacctattccctttttccaccgattcggggggcgaactggattttctttggcataatggggacccccctggcgtggat

SEQ ID NO: 51527 - DNA, 354 bp, Triticum aestivum
  Clone ID: PAT_TA_51527
agtctagggactaaagtttatttaggggactaaagtttagtccctaacatgtttggttctaggggctaaaaatagtaaaaatatactaaatggctcataagaagactaaaatggcctttaatattcttctgctattagtacaattgaactaaataaggggtagctatgacgcaattgccgtaccctgtagctgtagctccgctccgcctatagtcggggttgcaagacgtcacggctgattcgatcaagagaaccgcccatgaagcgacgggcgcgcagctggtggtgcctactcgcgttccctcttttttttcctgtcggccgaagaggccggggaaacactctttttttttc

SEQ ID NO: 51528 - DNA, 353 bp, Triticum aestivum
  Clone ID: PAT_TA_51528
gggacgaaaaaaacagcccaaacatgcaggtggcagcaacatcaaattaaatcggggcaaattcaaccccacaaggggggatccaactaatacatgggagagggggtgcccgttttttttggtacacatgaaaggattcactgaatggttcttgggtgggtgggaaacaaaataacagtttatgggccattgacaggtcgggtctaaaacataagtaaagcgcgctcgctaatgggtggtaggggctgaacaaactcctctggcgggagggaccggaaaaaacgggttttttttctcacaacaccgacctcgatctcgggagccttgaaatctttctggaaaaaaaattggaa

SEQ ID NO: 51529 - DNA, 577 bp, Triticum aestivum
  Clone ID: PAT_TA_51529
gaaacagaagcaagttttattgtctcaaagacgaacaaatgtaacatacacaacaacaaaatcacctacacgctacagatcacttgatgacttgaataccatttattcagtaacaaacaaacgatttattttcttccgaaacggatggagaggtgcccagggcagagtctccctacttgaacctagccttgacggcgtcgatgtcttcgttatcaaccctgaaggccttggccagcacgtcagttggcactggtggtgtggcagccaagagcgtggtggcgatggcctgggtgccctgaagctggctgttgaagccggcgataacggaggcggggcagtctcccctgttctgctggaagtgcacgagcccacgcgggaagacgaacacctctccgacggtgacggtcttagtgaagagcttgttggccgtggtgatgaatccaacctcaagggttccctcggtgacgaagatgatctcggtggcgcgcgggtgggtgtgcggcgggttctgcccgcccaccgcgtagtcgatgcgcgccatggacacgccgagcgtgttcaccccggggaaatgact

SEQ ID NO: 51530 - DNA, 344 bp, Triticum aestivum
  unsure (1)..(344): unsure at all n locations
  Clone ID: PAT_TA_51530
gcgcangccantccaaacatcatgtcnnnatcaaaacagatgtctcaagtcctttaggttgntgcttttncaatttcaagttcancattccngggaaaataacatgtttttaaattctaaaaagggtctttttttcacttttggggaatcaagcccacagtcttggctcttcctcttnngatcaantgcnnnntgcnnagggcctngtttcaattcncctggntnnatnanncggnttnnctgcnnnnngaagagtttcttatgctcacgacagcgcccaaactgggttggcttctcctttctcctgtgttcctacttcctcactttagttgctgatctgcttt

SEQ ID NO: 51531 - DNA, 552 bp, Triticum aestivum
  unsure (1)..(552): unsure at all n locations
  Clone ID: PAT_TA_51531
tgttttgacaagcgtgtgatcgagagttcgagaaggaagccgccgngatgaacaagaggtctttcaagtccgcctgggtgcttgacaagctgaaggccgagcgtgagaggggtatcaccattgatattgccctgtggaagttcgagaccactctgtactactgcaccgtcattgatgctcctggtcaccgtgacttcatcaagaacatgattactggtacctcccaggctgactgtgctgtgctcatcattgactccaccactggtggttttgtggctggtttctccaaggttggccagacccgtgagcatgccctccttgctttcactcttggagtgaagcagatgatctgctgctgtttcccgatggccgcctcctctcccaagttctcataggcccgttccgaggaatttgtccaggaagtctcttcgttcctggtggatgggcgggctccaccctgtcaaggtttccctttgtttccttctttgggtttgggggtggctccctgttttgtgaggccccccaccttggttggtcaagggcccctccctt

SEQ ID NO: 51532 - DNA, 612 bp, Triticum aestivum
  unsure (1)..(612): unsure at all n locations
  Clone ID: PAT_TA_51532
gctctggtctaattggtggtgccccctggntaagagtaccatatcccttccagtggggtgctccaacttttgatgctggcgaagcttttgccatgatggctgcatcatttgttgctctggtggagtctactggttccttcattgctgtttcaagatttgcaagtgccacacctctcccaccctctgtacttagccgtggtgttggctggcaggtatgtgctaactttgcatccgccacatgccaggcttgactagatcaatctccaactttgaactcacttgatgcgtatgcaactcttcttgctacagggtgttggtatccttctggatgggctatttggaactggaaatggatcttctgtatcgattgaaaatgctgggttgctagccttgacacgtgttggtagccgaagagtagtgcaaatatcagctggttttatgatattcttctctatccttggaaaatttggagctgtctttgcatcaatacctgcacccatctttgcagccctctactgcgtcttctttgcatacgttggttctgctgggcttggcttccttcagttctgcaatctcaatagcttcaggacaaagttcatccttgggttctct

SEQ ID NO: 51533 - DNA, 600 bp, Triticum aestivum
  unsure (1)..(600): unsure at all n locations
  Clone ID: PAT_TA_51533
cctcccaggcgagnagcttccagnagctagggtttcccgtgccgggatggccgtcgccgacgcggtgctgccctcgccgccgccgccgccgcagcccccgccggcgcggaccgtcgtcgtgcgcttcgcccttgcctggatgctggcgctcgggctcgtcctctgcgtcgcggcgaaggccctcgcctgcctgggcttcgccactgcgtgggtcgcctccgcggcctcggctgcgaaggtcgtggcgcgccgcgcctggggcgagggctccgctcccttcctcttcctccaggcgctcacgtacggggctctcaaggtctgcgtctacaacttccttgtgttgctcgcgcttgtcgtcctgcagctgtgcgcccagcgcgtggcctacgtgattgcacctgtatctggctccacttcgggattcaagaagagcgccttaggagcaaccaggccggtgtccgttgcacgcttctttaggcttctgcggcccatggtgcttggatttgtcgcatacgtggcctttatcctgctagtggttgctggttttctggtagcaatgatgtcgccacatgtggagggatcgatgtctcagggggaagt

SEQ ID NO: 51534 - DNA, 576 bp, Triticum aestivum
  unsure (1)..(576): unsure at all n locations
  Clone ID: PAT_TA_51534
acgggacggacaaacgaaccaaccaanatacctactccatttaatagtaggtatagatatgctataaaagccaaaatcttaccaaatgggtgggagagtgtacctaggaggatcagattgctgctcgtttcccttgcgccggcccgaacaagtttgtcgacctgctagtgcatccagctttgctagactgctgactcatctagcgaggccgttccatcacatacatctgggctatatagcaccctgctgctggccgtcggcacgcagtgtgccgagttcgtcaacccgctggtggatgccgtgtacatgtcaatgcagttatccagcgcctagatactttatctttgtgggtgacgtccacgacgacgaccgacgaccagatgtgttggctaggccgtgatcacgtagaccatgacaaaaagataatgtcttccctgtacctgacaccgtcatgccggagtacatgagcggttgctggccgtcggcatggatacttcatctttgtgggtgacgtcaacgacgacgacgacgaccagatgtgttggctaggntcgtgatcacgtacacctagtcttc

SEQ ID NO: 51535 - DNA, 450 bp, Triticum aestivum
  Clone ID: PAT_TA_51535
caggggaccctcgggtgggcttcatcaccaccgccaacaagctcttcactaggttcgtcaccgtcggagaggtgttcgtcttcccgcgtggcctcgtgcacttccagcagaacaggggacatggccccgcctccgtcatcgccgccttcaacagccagctccagggcacacaagccatcgccaccacactcttcgctgccacaccaccagtgccaaccgacgtgctggccaaggccttccgggttgataacgaagacatcgacgccgtcaaggccaggttcaagtagggagcctctgccgtcggcaactctccatccgtttcggaagaaaagaatcatctgttcagtgtgttcgttactgaataaattgatgtagcatgccgtgtagttgatttgttcacgtgtatgttacgtttgtttgtctttgaaataataaaacgtgtttttgttc

SEQ ID NO: 51536 - DNA, 592 bp, Triticum aestivum
  Clone ID: PAT_TA_51536
cgttcacgggggcaagctatgtcaggggaaacccggggagagaactatctactcttccaagatagggctccggacgaccacggccgaagagtactccttggcaacactgacaaatagcagcaagcacattgctgacaatggagatggaatcggaaacctaagcgctgagtcggtaaagtggaagatcaagtaggaagcagctgtttttgaaccaccattctaacggtgaacaggagagaagaggataaagaaacagagcaatccagagatcctcccataggatactgcaacgagctcaagtacaacggcacagaaaagcgacctggtttcgcagacgacgcaagggcagtagcacctggtggcggcgatgatcccgcaccgaccaagatcacgtccgagtggaagttcaagaagttcaaaccggcgttgtcgtcgcactgatcctacgacagcaagatgttgtgttcctccagttctgcggctgaaacctctgcttccgtgaaggctgattattgaggtgaggttgctacctcattaacttacatatatatatagttgccaaatgcatgtcctagctatatatatgctcgtt

SEQ ID NO: 51537 - DNA, 615 bp, Triticum aestivum
  Clone ID: PAT_TA_51537
tccagctccaaaccctcatcccccccatcggagctcccctgcccccaaccccccacccccacccagccatggcggaccgcggcggcgagcgtggtgtcggccgcctcgtcaaggagggccgcttcaccaagatggaggagatctacctacactcgctccccgtcaaggagcaccagatcgtggagacgctctgcccggggctcaaggacgaggtgatgaagatcaccccggtgcagaagcagacccgcgccgggcagcgcacccgcttcaaggccttcgtcgtcgtcggcgacagcaacggccacgtcggcctcggcgtcaagtgcgccaaggaggtggccacggccatccgcggcgccatcatcctcgccaagctctcgatcgtgcccgtcaggaggggctactgggggaacaagatcggcctgccccacaccgtgccctgcaaggtcaccggcaagtgcggctccgtcaccgtgcgcatggtgcccgcccccaggggttccggaatcgtcgccgcccgcgtccccaagaagtgctgcagttcgccgggatcgatgatgtcttcacttcctcgcgtggatccaccaagacccttggcacttcgtcaaggctacc

SEQ ID NO: 51538 - DNA, 587 bp, Triticum aestivum
  Clone ID: PAT_TA_51538
cactctagccgccgcctcctgcccctgccgtcaagaccctcgcgccgcagcgacgacgatggccgtcaccaacggcgccaccgtcgtcgacgaccccgttcaggagcagtccaagtcggctgcgccgctgctgctcaaggggaagcgcctgtcggccaacgccgtgctgacgacgggcggctccgcgctggctggcggctacgacctctgcagcgcggaggaggccgtggtgccggtgcgcggcaaggatctcgttgccaccgacctcagggtggacgacctggagggcacctacgcgcgcatcgagccgcgcatggggctggtgtgtaagcactcgatcgatgtgggcgcggacgaggtggacgccgactaccgtcgcccctgggcgtcgacctcttaatccactctgacgccgattttgacgataagcccggtgaccgcgtcgcgcaaatgggggtacagaggatcgccacttctgtacgtctgcgacgtggacaatctcaactccaccgttaggggcgagggcggattacattccaccggcgtatgatggccggcctcgactgaaggcgaggcaggcgtatcta

SEQ ID NO: 51539 - DNA, 628 bp, Triticum aestivum
  Clone ID: PAT_TA_51539
ctctctcctcctttctctcctcctcctgccaccgatcccgaaccaggaggaacccggcgcgaggagggcaaaggaagagaagaggagaccaccgagcccagcgcgcgcacacgacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaatgctgctgaaatcactgacaagcttggcctgcattccctgcgccagcgacactggtacatccagagcacatgtgcta

SEQ ID NO: 51540 - DNA, 594 bp, Triticum aestivum
  Clone ID: PAT_TA_51540
ctctctcttcttcttcttcttcttcttctctccgcactacttccttcgtctacggaacgatctcgcttctgagcaggcacggctgtctcgagtcgatcgagctcatccactgcattgttcgctccatccggctgatccgatgggcaagaaagtgccctcacctccatcttctccaggtcctccagcctcgctagcgactcctccacgccggccgtgataccctggccgtggccatcctgccgggacccgcagaccgactccttccgtgccgccgaggagccctgcgccacggctgctggtggcagcaggtgcggccctgtcgccgcgaggcaccgcaagctggtgggtggccccgccgagatgtacaagacggtcaactcggtctacatcgaccccgacgacggcgagtcattctcttgcctcagcaccgaggaggaggaggaaacggttgtagtggaggacgacggcttcttgacgcccactgcgtccgaggagtggtcggaggctgtgatccgcagcctcagccggacgacctcgtccaccggccgcttcttcttcgaccaggggccagcgaccaactccaacctgtctgcg

SEQ ID NO: 51541 - DNA, 589 bp, Triticum aestivum
  unsure (1)..(589): unsure at all n locations
  Clone ID: PAT_TA_51541
gntatttttctggccactgctgcactcttctcacatgacccaaagtagctagtgttctaggtgcttctcaaaaggggtataccctcctcccctatcagcttccaccttacctcgccaatgcttccagtgctctgatcaggaagaaaccaactattgatctatcgcagctagccccgcgggctgttctatcaatcgcccgtcccataatggcttctgggaacgactggttggggttctcgctctccggccaagagaacccacagccgcatcaggatagctcgccgcccgccgacatcgacatcgctggcgccagtggcttctatggcctacccacgcagccagctcccgacgctcaactcggtgtgccaggtcatcatcagccttcatacgggatcacggaggccttcaataggggagctcatgaaatccacgattggaacatgaggggtgatctggactacaacggcggtgcgtccgagctctcgatgctcgtcgggtcgagcgcagttggcggcaagagggcggccatggaggccgagaccgagcccaagcttgaggacttcctcgttggcaactcgttcgtctccga

SEQ ID NO: 51542 - DNA, 606 bp, Triticum aestivum
  unsure (1)..(606): unsure at all n locations
  Clone ID: PAT_TA_51542
gctagcttagcgcgtcgatctagtagtacagagggagtgatcagtacgtaggagatggacatggagatcccggtgatcgacctccagggctcaccggcgacgcctcccagcggtcgcaaaccatggcgcggctccacgaagcctgcaaggactggggcttcttctgggtggacagccacggcgtcgacgccgcgctgatggaggaggtgaagcgcttcgtgtacgcccactacgacgagcatctcaaggatagattctacgcttccgacctcgccaaggacctgcagctgccggcggaggaatccaaaaccgtctccggtgaggtagactgggagaccgcctacttcatccggcaccgtcccgccaacaacgtcgccgacttcccggagatcccgccggccacacgggagatgctcgacgcgtacatcggccagatggtgtcgctcgcggagctgctcgccgagtgcatgagcctgaacctcggcctggacggcggcctcgtcagggacaccttcacgccgccgttcgtcgggaccaaggtcgccatgtacccggcctgcccgcggccggacctcgtgtggggcctncgcgcccacaccgacgccg

SEQ ID NO: 51543 - DNA, 525 bp, Triticum aestivum
  Clone ID: PAT_TA_51543
gtcttctcgcctcgccgtgctcgtcgcactctgtcgcctgatagttgccgctcaggatgttcgtggggatcggccgcgtgggcttggtgaactaccgtgtggactactgatctctcctctgcttctgtgcccgttgtctccagaggcggacacttgtgggtgcttctgatctgagtcaggtcgcgcatgatgaactttaagcgtatttcgctgaccgacttcaagattgacttgatgcgtatacctaacaagggctctttgatcaatgccatggctggaagcatatgtgaactccaaatggtagaacagctcatggggtatgatgcttgtcgtccaaacaagaagagcatacttgaatgactttgtcaggttcaaagtcatgttgtctaatattatcaggtgtggtgctatcaggcaagaccttgccaagctcaaaaaggaggttgctggttaaaatatcctagtggctggcatgtagagttttttggtccaagtcttatctgctctatgttcctaagttcttaa

SEQ ID NO: 51544 - DNA, 620 bp, Triticum aestivum
  unsure (1)..(620): unsure at all n locations
  Clone ID: PAT_TA_51544
cngagggcacggcgggtcgcgcgtggcggaggcgtgccggctgcggatgcacctggtgctcgcggaggaggtgcggcttcgtcgtctgcggcccgggggcgaagggcagcgtcaggccgaggacgacgaggacggtgcgcggtggaaggaggccatgacggcctgcttcgcccgggtggacggcgaggtcggcgtcgacgacgggaccgacaccggcgagcagacggtgggctccaccgccgtcgtggccgtcgtgggcccgcgccgcatcgtcgtcgcgaactgcggcgactcccgcgccgtgctctctcgcggcggcgtccccgtgccgctctcctccgaccacaaggagactattacctgaagccatatgtgatagcggaaccagaagtcaccgtcatggaccggacggacaaagacgagttcctcatactggcaagcgacggcctgtgggatgtggtgtccaatgatatcgcctgcaagatcgcgagaaattgcctaagtgggcgtgcggcctccaagtaccccgagtccgtctccgggagcacggcggccgacgccgcggcgctgctggtggagctcgccatggcacgcggcagcaaggacaacatcagcgtcgt

SEQ ID NO: 51545 - DNA, 623 bp, Triticum aestivum
  unsure (1)..(623): unsure at all n locations
  Clone ID: PAT_TA_51545
gaccaccaaggctatgtctgctagtgacaagagcgtccagagacctgccgtacctcagcgttggattgctagagaaatttgatgattgtatagcttgcacgcaggaacagaaggtgccttagtcaccgatagaatatcatatagcgctgtgtacacgatnatgctcgcaacggcaagcagtcaccgggagcagtgtatcatcgcacatggcgcgccatgcaggaactgcttggnatggatagaggcacacagcgcgatataagtggtataagctgtatcgcgcaaacttatgtagcacctgctcgaacataaatatcatcctgcagcgcatgtggctgtgatgacataagctgggtttcgctcatcttaatgatggccaaagactaggtaatagttaataagtatgtctcaaaagaaacccacaatactgaatggaataccataaaatatgcgaggtgtacatcggataatacagcgtgagacacactacaaacatctataactgtgatattgagactggcaccatttataagattgataaggacattatgaaagatgaaatacaagcggctatcaataagaacatcctggacgacaaagacatgttgaacgaataataccat

SEQ ID NO: 51546 - DNA, 586 bp, Triticum aestivum
  unsure (1)..(586): unsure at all n locations
  Clone ID: PAT_TA_51546
cataanaaaccaaaagcgcgttaaggacacggccagtgttgattgttctggtgacaacagcagtgagcagcagacatcaacgtcagcaactgtgccgccaaaactgcaggatctacatctcgtaagcggaaacatgcccatgccagtgcaagttctgaaaatggcacccaagtattcaaagacagccagcaggttgttggagcaagcagtgctggtgctggtgatcataacatggacgccaggaatggaaagagtcaaacttctgcaaatcaagcaaattcaagaaacaacgtagatgcaaagaggggagccgcctcccaacaagtcgttattcgcacagaggacttgagggcagaagttaccgttccgtgctgggatgatgttgccgtgccaaacagtgagactagtgaatacaaaagttcggggaagaagagcattggatatgtgctggatgagtgggatgaggagtacgaccgtggaaaggcaaagaaggtcaggaaagcaaaggaagacgacaacgacgatggcatgaaccccttccaggcggaggccaactatgtgtcagcgcggaagacgaaacagaatt

SEQ ID NO: 51547 - DNA, 591 bp, Triticum aestivum
  unsure (1)..(591): unsure at all n locations
  Clone ID: PAT_TA_51547
cccacgccgtccgctttcgtctcgnacgcgcgcgnacagnanacaggnggaagaaagcccaaaaccctagtcctcgtcgccggcggcgagatggccgtcaacgaggaaacatccgtctacgtcggcggcctgccctacgacgccgacgaggatatgctccgcagctactttgggccctgcggcaccatcgtctccgtcaaggtgataaatgatcagagaatcaggggcaagtgttatgggtttgttacttacactcaacatagggctgctcagcgtgctatcttggagatggatggcaagcaaataggtaatcgtgctgtgagagtaaatgaagtgcgtacaagaggcaacacccgtgattttgggcgtgatggcttccgacgagatcctgtaagagatggaagggatgtatactgggaccgaagggatagggagaggagttatgatcgccaccgggatagagatccctaccatgacagggatagtgatagacctcgtgaccatgataaagacgacaaggaacagccaccaaggaaaaggttcagccgtccaaagggtcgtgagagcagagatatatcaagttccagtgat

SEQ ID NO: 51548 - DNA, 583 bp, Triticum aestivum
  Clone ID: PAT_TA_51548
cccagcgtccgggctgatgtactggggatgaatcaaaagaggaatgtcttgaacagaaactgaaagaagcgtcagatactatcacagagaaggattcaagattatccgagctccagtcacttatcaacagtgcacatacaccaacgctgcagacggagcccgtcaacattgatgagttggagaccgagcttgaaagccaccttcaggacaaaatcgaagccgagattcagtgtctggtcatggtgaaagcgaggcaaaactggcaagcccgggccgaggaccagatcgcgttggaggagcacaggctctccgccggagatgacacgacgatgttgctcaagctacaagacacggagaagaagattgtgatgctgaaagagcaggtggacagactagaggcccacgagaaggagctgtcggtgacgacggaggtcctgaggatgcaaagcaagaccttcaagatcggcctcttcggtctcctccagctgatcatgctgttcctttccctcaagatgttcttcgcccaggactctgcccgcttcggcgatctcgtgccgacatgatggctgactagttagcgctt

SEQ ID NO: 51549 - DNA, 594 bp, Triticum aestivum
  Clone ID: PAT_TA_51549
acactccagctgtctgcagtggatctactagccaagcactcgcaaaggcagtaggctacactgacataaagaagagatctttgctttcatctatggagaaccatactacactacaccttcaaactggccgaccgttgtacacaccatcgtttgttattagtacattgaaaaggttcatgccagaagatagactctcaagtctacatggtataaccctgaccactgatgggacaagcgctgtatttgatgttccttcagcagaggttcaagactacattcaaggcgcggagaacgcggccggggtgacaatcgatgaagtgaagcaactgccagccttgcaagagagggagcagtcaaggggtaactccggcgggtcgaggtttggtggccgtggaggcggtggaaggaggttcggtggtggcggaggtggacggtttggtggtggcggaagaggcaggggaggcggcggaggcaggtttaacaggaggtgaagacctagaagagtataatctatttttgacgggagtttgagagatgaaagaaggcacagggaatcgtcaaagttttgactgcgccgtgtatcgggtttttttg

SEQ ID NO: 51550 - DNA, 605 bp, Triticum aestivum
  Clone ID: PAT_TA_51550
ccccgcgttcggcggctagcttgggattgccgcataccttgctaagtgcgggattcggtatgaggtgattctgacaggacgaaacagctatggcgagtggttcagggaatccaccagctgatccttcagtaacgagtgactgtggggagaagttccctccgacagtcggtctaaaccatgatgagccgtcaattacggatgttttgtggttctacgacaacatgatgggctgttcgcacgggaagctgccgaaataaggcgtctatcttgcaccaggaccttaaggatgagcttgggcctataggcgagattacagtggatggctgcaggggcatccatcaaatgttaactgcgaaagagttgatgatatataccatggatggctagcaagatggagagagattttggatccctgctttgtggaagaactttgcaaaccagatgatgaaggtgactgggattacatctgttagatgatggagtccaagctaatgggaaacaagattgagtggctgaagaactgcacttcatgggattgctggtccttgtgcatcctggaccccgagaaggagatcttcacggtcttggacccaactgagacacac

SEQ ID NO: 51551 - DNA, 496 bp, Triticum aestivum
  Clone ID: PAT_TA_51551
ttccgctccagcaacgggctagccttcgtgcatcgctcctccctcttagtggcatggccaatggagatgatcacgactgtgtccgtgtacgagaggctcgtcaaggagagctgcccaagatggagtacgactactactcctgcagagcaatagatcagaggactctcaacgagaccagggaggtcttatccagaatcctgatgcaaccacacgtactgatcgatgtgtactatatcaacatggacccaaacatcttgggcttcgaccttttcatgcctatcatgatcgctaccacggccatgcagaaaatggttgaccctataggaaagcttgctactgaccaatcaccagtatgtgctgggaccataatgacatttgaattatgggctacttctagcgacgtaagggttaactcatatcgacccacgatacttttatttcagctctatggttacaaggacaggcatatagttgggcaactcaagaaaagggctga

SEQ ID NO: 51552 - DNA, 511 bp, Triticum aestivum
  Clone ID: PAT_TA_51552
cccagcgtccgtacaaggcaagtagccactttcagctccacaacaagtagtacgtgagctccacttctagtacgtgtgtgtgtgtgagttcatctgttcgtgagtgagagtgagagcagcttgtgtgcagccgctggctagctaggcttcctctgttagagtacaagtgagagctagctgcttgtagttcgggccaacatatctagcctagtgactagcactatggtctttctatttcgtataactgcaatttcatttatgttgttataagtttgttgctgtcagcatgagttaacttggtatgcagtaggcactgatctcattcttagactgatacacccgcagcgcgcgttcaggcatcatttggttgttagactgtttagctatgcagagtgaaataccagttcagttgtgctagcaaagaggaggcctccagattttttttttctttgcctagatttaagtattacaaatcatttgctgtaattccttcattggaaaatcattgctt

SEQ ID NO: 51553 - DNA, 574 bp, Triticum aestivum
  Clone ID: PAT_TA_51553
agccacctgattcagttactgtagcctgtagtatgtaggataaatcttgtctttgttgctgaatgaaattgtccgtttcaaaaaaaaattgcccctgcgctaatgatgcttaaaagcagagttccgaaaagttgggtaaaaacgtgatatcgagcagagcggtcgcatgatgccatgcactgcgaggacatagattcagcgcacagcttttaacctcatggatttgactggatttgatttgtttgctgttgcttttactcctccgagctaacatccgcagagagcattgacccgagtgtcgcttcttcgtctgcattttggctctcgctaggtgcatattaattgatctgagtatgttttttcttttcctttcttttgacattaatgtagtgtcaggaaacgtcctaagacggagggagtagtagttaactgcagtagagcagcaggggtaacattaacaagacagtaacactagtaactcatcagcggatggatggatggttgttgaaatggtgtgtgtgtgtgtgtgtgtatgcagcacgcggtggggtacgttgccggcgacgagtactac

SEQ ID NO: 51554 - DNA, 472 bp, Triticum aestivum
  Clone ID: PAT_TA_51554
aaaaaaacatttcgacatgctaattactggggacaaaaaaaccccttatgaaaacaaccctttaccgaaaaaaggcacacttgattcaccatcatccataaacccacaaaaagcaagcagtacacaacatatccggggccattggaggcactacttttaaagcgggaattttatttaggcgaaaaccacccccctaggggaatactaggcagccccggggagcccaaccttgggcggaaactcccccttgaaagccccaacaaccctggccttgacgtctccttccttaaaaaacaagaagggtggcatggcccccaccctaaattgctcaaaaatgggcttaaattcaaaaacggccaccttgaagaaaacaacagctgggaactttttggggaaatcaaaaaaaattggagccatgatgcgggatggcccccaccactgagcagggaaatcaatcaccaacagctttttg

SEQ ID NO: 51555 - DNA, 596 bp, Triticum aestivum
  Clone ID: PAT_TA_51555
tccataccgcatatgtagacccaagtccagagtccttgggaagggagagcttgttgtggatctaaagaagattcaaagaagatatgcaagatcagatctctgtatagacatacttgcagccataccacttccacaggttactgtttggttaatcatgcctgggattaaacgctcagattataatatccaaaatactacatatgctgttattattttggttcagtatgtcttaagaatgtatctcattgtacctttaagcaatcaaatcatcaaagctgccggagtagttgcaaagtcagcctggggaggagcagcatacaatcttctgctctacatgcttgcaagccatattactggggcaatatactatcttctctccattgaacggcagattacatgttggaatcagcagtgccttgctgagtctagcaatatgtcttgtaacattgggtttataagttgtgagaatactggtttgaacagttatcgtgagtggcaaagtaaaacgcagatatttaacaactgtgatgccactgctgatcctccaaaatttaattacggaatgttctcgagtgcattgactaagcgtgctgtct

SEQ ID NO: 51556 - DNA, 590 bp, Triticum aestivum
  Clone ID: PAT_TA_51556
cccacgctggcgcgcccccggactccctatttccttctggacgtaccttccctaaccgtctctctctattgggcagctgcctatgggatctgtactagagaaaaggagaacctatgcggggatgcggtgtgacgactagcgccggtgagctggctggacaggcgccgggcccatgggcgcgggtggggagctgcgcacacattcatcagcggcgagcacatccaaagccagcatgccgagatgcgaatgcgtatgccacaagctgtgccaacttcaaaggtcaaaaacccctttctggggcgatccgagagaggcattgctgattgagaccggaaagggggaggatatgatgacctaagggcatggaacaacaatgcttaaagcgtactggaggctgagtctgttgtctatgcaatggcatgagcttggtaaaggaagctcatggcagctacttcattattgggaggcctttactttctgctttttcacgtactatacatagacatacattctgctctgacagaaaaatggcgtgtgcatttacccaaacaaactgagactgcatttgcttcagtcatcactgaattact

SEQ ID NO: 51557 - DNA, 603 bp, Triticum aestivum
  Clone ID: PAT_TA_51557
acttcgtgatccaggcggggacggacgcgtcgctggtgccgacggagatgtccacgatcaacgccacggtgaggctcacgttccgcaacacggggagcttcttcggcgtgcacgtcacggcgcagcccgtcacgctctactactcccagctcctcatggcctccggcgacatgaagtacttctaccagcctcggaagagccagcgcaaggtggcggtgacggtggtgggcaacaaggtgccgctgtacggcggcggcgcggggctgagcagcacgccggggcccaagggcgtgcccccgccgccggtgccgctgcagctgacgctgaggatcagggcgcgggcgctggtgctgggcaagctggtcaagcccaggttctacaacaacgtgcagtgcaccgtccggctggacacgaccaagctgggcaaagccatatccctcaagaaatcctgcacccacgtctagccaccttgacccgacccgacaccgccatctttctttcttcttcctctcgttgcttgctgcatatgttatgttatgtaatgtgatgtaatgcgtggattactagtaccatttggacgggagaaagcggcgtgtccgttgt

SEQ ID NO: 51558 - DNA, 581 bp, Triticum aestivum
  unsure (1)..(581): unsure at all n locations
  Clone ID: PAT_TA_51558
tggntctcggtcggccttccanacctcctcctccttctccagacctggccgccgccattgcaccaaagaaaagctggtagcctccacaacctcgccacacacggccattttcccctctgcatcccgcaaccgccgtgttagctgccgttgcaacctcttcatccactaccatctgccgccgtgacgatagcatcgtctcgcaggcgtggacggccctgaaggcggatctggtgcaagcgacgccgttgctgtttctgcggatggtgcccatcttgctgcaaggagcaagctggttcctcgtgggcgtgctgaggctggatggactggcgcaacgactccgggcgtgctcgaggtcctgcttcagcctccacctaacgatgcgcctggtcgagtttcgccgcatcgcacaggcaggatctcactctcgatccactgcgtggagttgtgccgcgaaggccaggggcagcgcgtctccgccgatccattgatgggcccatcccgctgggctgctgcgccgtactaggcccgttaccgttgcttcatcgccggcgccgcttccgtcgccttgtcgggttttccta

SEQ ID NO: 51559 - DNA, 523 bp, Triticum aestivum
  Clone ID: PAT_TA_51559
tctcgtctcgtgtcgtcgctctcgtgttgttcggggcagggagcgaataggcggagtagcgcaagctggaggtgagcttaaaggagatgctgatagacttcttgccgacggatggtggtggagtcgctggcggaggcgccggccttggtcaaggcgcccgggggcgccccggccaacgtccccatcggcgccccgcgcctcggcggcatggccgtcttgcgcctcaagctcggcgacgactagttcggccagatgctcgacaaaatgctccgccacaacggcgtcaacaccgtcggcgacaacttcgactcgggcgcgcgcaccgcgctcgacttcgtcacgctcaccgccctcggctagcgcaagctcatgttctaccgcaaccgcaaggccatcatgctcctcaccgccaacgagctcatggtcgacatcatcaacaaggctgaagtcttccactatagataaataagcttgatccactatccttgactaacagcgcatgtgcacgctatgaaggcagcca

SEQ ID NO: 51560 - DNA, 467 bp, Triticum aestivum
  unsure (1)..(467): unsure at all n locations
  Clone ID: PAT_TA_51560
caggtttttgatgaagaccgttgctcaggtggccactgggaagcaacctgtcggcaccatagcttacatgggcaacatacaacacttgatgcaatgcaaaagcgctgtaaatacagctgaagaccggctcaatcctgctgccataaaggaggtgtttgaagctagggccctgaggatggcggtgaactgtgcccagaacatcagcaaggcgccaagccaagaagaaggtttctccgagctgtcccccgacttgcttgaggctgctgtggctcacgtccagctgatcattgtgaccaagttcatcgagaagctgcaggaggacatccctggccccggggtgaaggagcagctgcagaacctgtgcagcatctacgcgctccacctgctccacaagcacctnggcgacttcctgtcgacggggtgcgtcacagccagggcaggcgcgctggccaacgagctgctcggga

SEQ ID NO: 51561 - DNA, 507 bp, Triticum aestivum
  Clone ID: PAT_TA_51561
gcgtacgtacttcccccgcttcgatcccaccaccaccgaagcaggataccagatccaacttgggttcattgccatttaattacggtgaccttcctcccgagttactcactcaccacccgcagcggatacgatcggatctcccggcggacatgggggcgtgcagtaggaggaggcggcgacaaggaacgtggaccggatcaaggacccctggagcccctaagaaggacgacgcgctggaatgggtaggaggccagcacggagcgcgcaactgagcacgctcatggagcgaagaaacatgtcccagacggccccggtatgtgctggcggccccgctggcgcaaccaagtatactcgcatgtggagcaccggccattgacctgcgatgaggacgacaccatggctcacgacccacaccatgttgaggagcacgagacacaccatcaccagactgatgtccggccgtacctacaacaccatcaaaagccactggtaactccacgctaaagc

SEQ ID NO: 51562 - DNA, 556 bp, Triticum aestivum
  unsure (1)..(556): unsure at all n locations
  Clone ID: PAT_TA_51562
cgggcttggcaccgnaggcgacggccgacgccgccttccctcacacagcggacacagacggacgcgtctcccctggtttctaccgaacgaaggagcagaccccatgtcgcagatggacaaggaaaagggaagtagaggaggaggaggaggagaaggagagaagcttggtgtccattatgaagactaagccgcttgtcccaggaagtggaagggcaagggcaagggttgtgtcgctgccaaggaagcgggccaaggattacggcaatgtcccgctcgccgagttgttattaagggcaatggagcatgataagcaagcggagaaggattatgaagaggaggaagagaatggggaggacgaggatgagcaaggtactctgtttgaggaggaagattctcattttgatgtcaaagcgctaagtgttatgctatgcaaaattgcattgtttggctctcaacgttcaatatttttgctgtataaagttcaaaggaggagctgtccaaaattcaaaagcaatgatgcccaattctttcttaanaaaaaaaaaanaaaanaaaa

SEQ ID NO: 51563 - DNA, 626 bp, Triticum aestivum
  Clone ID: PAT_TA_51563
gatccgacgaccggttggatcggaccagatggactgtggagaatagcagttggtgctgagctgaaaagctacactgctgcacttttgtacaagagtgaagactttcttagttggacaagagttgatcacccactgtattcacagaacttatccaatattgtggagtgcaatatgtgggagtgccttgatttctttgcggtattgccaggcaataacactggactggacatgtccgcagcaatcttaagaggaaccaagcatgccctcaaaatgagcgtgggttactttgataagtacttgattggggtgtatgatctcaaacgtgatgcctttgtgccagatactatcgtagatgactgtcggctgtggttgaagatcgattacggcaatttctatgcttcgaagtcattcttcgactcgaaaaaggcaggaggatcatatggggttggtctaaggaagcagattgtcgttcagacgatgttgcaaaaggttgggcaggaatccatacaatccccaggacgatttggctagacagcaatggcaagcagttgctgcaatggccagttgatgagattgagtcccttcgaacaaatgaaatcaaccatcaaggacttgagctcaacaag

SEQ ID NO: 51564 - DNA, 625 bp, Triticum aestivum
  unsure (1)..(625): unsure at all n locations
  Clone ID: PAT_TA_51564
cggacgcgtgggcgccgaggtgaatgtcgtgtcctccgcgcctcccgcggaggaggaggaggaggaggccgggaatctggacaggttcctcgcctccaccacgccctccgtgcccgtccggaacacgcccgagacaagcctgaggatgcggaggagtggagatgccatggattcatctccttacttctgccttgatgatctctgggagtctttcagggagtggagtgcttatggggctggtgttcccctggtgttaaatggcggtgactccgtgatacaatattatgtgccatatctctctgctatccagctgtatgctgatccatctagacctgttgcatggtaccccatatatagaatcccaacaggaccgacgctgaaggacctggacgcgtgcttcttgacattccattgcctggcaacaccttccaaggatagccatcccaccacaccagcatgccccggcttcgagggaatcggccactgcaccaccgcaacgggcaggctttccctgcccgccttcgggctggcgtcctacaagctccgcagctccttgtgggcgtccaacggcgccccggagcangagagcgtcacgtcgctgatgcaggaggcggacaactggctc

SEQ ID NO: 51565 - DNA, 586 bp, Triticum aestivum
  unsure (1)..(586): unsure at all n locations
  Clone ID: PAT_TA_51565
gnctagttcttaggacgcaagcggccgccctgccgaccgacactagtatagctatgtatctaattgctgtgtagggtacggggctctgcgcgcaagaccagagcaatgtccttggcgtgtgctcccgtcttgtgagctgaggttgctgttgtagagatgaactggacagaattaggattggaatggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggacgcgcttcttaaaaaaaaaaatctaacttaccgggccggggaaggaaaaatttttttttttgggtacccaaaataaaattaatggcccggggtttaaaaacaaaaggaggggaaaaacaaagccttgcccaaactaaattgattggcagaaaatccccttttccttaggggggttaataaaaaaaaggccggccccgatcgcctttccaaaaaaaaacgaaccctaattggaaaggggaacgccccctcccctggaccataaaataaggggggggggggggt

SEQ ID NO: 51566 - DNA, 557 bp, Triticum aestivum
  Clone ID: PAT_TA_51566
atctagactatcttgctgcggaggtctttgcgagcggcatggcccagcttgtatggcatttggtgttggagtgtgaaatgacggggctgttggagcatgcatggaaggattactctatatgactgaagaattgctcttgagtatctccatttctccaggaaaggtgtgcccctgttggcagtttcgattgcttgaagtggcagcaaaagccgtgtgacttctctgcgtgttcttcatccatctttttttctgtctcgtcaaggaaagctgcttgccagcatgtggttatttttgtaaaatctctgcaaatttttgatggctccgttggactgcttgatgtgctggaatcacacaattgaactgactgtagctctagtcatttagtaacgtccctgtgaactttgatggctccattagtcttgaatagcagctaattttgcctacctacttggtgcttggtctgggtgtagtgtaacatagcaacgctgttaacacttggagctggtttgagtacgagtaactttttactccctccgtcccataatatacggaggtgc

SEQ ID NO: 51567 - DNA, 608 bp, Triticum aestivum
  Clone ID: PAT_TA_51567
tccagcgtacggtccgccggcggcaccatggcagagcggacctaccctggagccgagcctagcaaaccatcaccagcagtggttactgcccgacagcgcaaccatgctaaagcctgatctacgttaacgcggtcttgatacgcgagcaacaggactttgggtcacgccaggtggggcaaaatctctgctgaacctgaaactggggcttgccgttgaaacacgacgacgggcccaggagcgccatacgttcacgcaacatcttgggcctgcaggttcgagaccactatgtcagctcgccgatgttgccatcttatacggcaccgagctggggcgcgaattctgggccatcgccggcgcaagcacacttggcgctagtgcacaaacaccggcgggctgggaactaactcatatgctgcgcacgccgccttcaccctgggactgcatgaggacgagtgcacctcctatgccgccgtaacacacgtcgcattttgagatgcagcatacgccaccggcaccgggggcgtactaaggcaggcaggtgatttacttatagggactgctatcgtatcacatgtgatggtattgctaagcttgacagtttttgtttt

SEQ ID NO: 51568 - DNA, 201 bp, Triticum aestivum
  Clone ID: PAT_TA_51568
gcttgcgcatcagacaagatctttgtgatcttgtccagtctgttgctctgtaaaacccttgtatacgtgtatcttgtgtagtaccttcatttgctctagccctgtactgtaacctcggtgtgatatcctgctgttgtggcttgaagctgtgacatatcatgagaaactgatttgccttgtaactgacgattcttgactgac

SEQ ID NO: 51569 - DNA, 477 bp, Triticum aestivum
  unsure (1)..(477): unsure at all n locations
  Clone ID: PAT_TA_51569
cccgggtcgcccagcgtttcggcccgccggccgccgcgccgcggcgcgccaaaccctanaaccccccccgaaaaggcgagcctcgccgcgacggcttctcggcggcgcgcctcttctcgcagggcgtgtcctacacctatgacgacgtgatcttcctcccgggcttcatcgacttccccgccgacgccgtcgacctctccacccgcctctcccgccgcgtgccgctctccgtcccctgcgtcgcctcccccatggacaccgtctccgaggccgccatggccgccgcgatggcctccctcggcggcgtcgccgtcgtccactccaacaccgagccccgcgcccaggcctccatcgtccgcgccgccaagtcccgccggctcccctttgtctcctccctccccattttttgcccggccttcgccccgacgctcaacgacttcgcgggccccgactacgcccctgtcaccgggcaagggg

SEQ ID NO: 51570 - DNA, 601 bp, Triticum aestivum
  unsure (1)..(601): unsure at all n locations
  Clone ID: PAT_TA_51570
ttcaattatgagttagtgtntcaaatgattgaaatatacaacgaacaaatccatgatctcttgggaagcaatggttcagagaagaatctagggattttgaattccagccttcccaagggcttgctgttcctgatgcaacattgcatcccgtcaactcaacgaccgatgttattgagttaatgagaacaggacttgggaaccgatctgtgggtgctacagcactgaacgagcgaagcagcagatctcacagtgttgtcactgtacacgttcaaggtgtagatttgaaaactggagctactttgcgcggggccctccatcttgttgatcttgctggaagtgaaagggtggaccgttctgctgttacaggcgatagactcaaagaagcacaacatatcaataaatctctgtctgctcttggagatgttatattttctttatcacagaagacttctcatgtaccataccggaacagcaaacttacacaagtcctgcagagttctttgggtggccatgcaaagaccctcatgtttgtgcagatcaatccagatgtgtcatcttatgcagagagtttaagtactttgaggtttgctgaaagggtttc

SEQ ID NO: 51571 - DNA, 540 bp, Triticum aestivum
  unsure (1)..(540): unsure at all n locations
  Clone ID: PAT_TA_51571
attaagggttcaagnatgccgagnctagtatagtactaactgtngaaaccagatctttttttcatgcatgcgactgtgagacttttctgagttgtagatggtcgcggatgaatataccttgttgggttcagactctagtttagatggaagaggcttgagctgggatgagtgagagattgctatttcatctgctggagatagattgagagagaggggtgctgattagtgtagtctgtgattgagagaatgcttgctgctgctatttatgcttactgattgattatacagtgattatgctgctatttgtacttgttgatgttattgttgccatccgatgcatattgttgtgatccatagcttactgccttgcctgcaagtgtcatgctggcgaccgggttcggagcgctcggatcgaaggtggtcgagcactggtacgagctctacaagatggacaagcagggggccaacctctggtacggttcatctactggtggggaggaaaaggtctcaggtccatgacatctccctgaaccactactc

SEQ ID NO: 51572 - DNA, 593 bp, Triticum aestivum
  unsure (1)..(593): unsure at all n locations
  Clone ID: PAT_TA_51572
cacacanccgctgcgccacctccgtcctccggtcctcccttcccccctgcagccccagctcacgaggaagccgcgggaggagcagctcaaccaggcgtcgccggccggagaaggaggagaggcgcggatgccagccagggaggcggatcggctcgcctccgcctctgcatccaccttgctgctcatggcagcatgtgtgcggaagcggggacaggcgaccacgagcagatgtcatcggcggacgcacggtgcgcgaagtccggtaagatgggcgcggcctccccgcaggcgtttcaagatgccgtgcccgacggctcggaatgcgcgtgcctggcatataggaggtatgcctcagagcaagctggcggcaacgtgcaccgcgaggccccagagcagcccaaccagtacatagcccctccgtactggaggaaccctgccgccgacgcagccagcgacggcgacgcgtatgagagctcggccttggtggcccgcgagccgtacgggaggatcacgtccgcgctcgagggcagcaacaagcgcagcacgaggaggtgcgcctggtctgcaacgacgcaaggtgtacgtgtctgcat

SEQ ID NO: 51573 - DNA, 368 bp, Triticum aestivum
  unsure (1)..(368): unsure at all n locations
  Clone ID: PAT_TA_51573
ccatgccgggnatatgcaagggtgcagtaagtctcgtccctcaacattctcnccgtcggtgagaaggcggagtattcgcctttcacccgcgtccgtccaaggtgtctggntgcagtctgtttcgtttctttcacccagtgttcctccacgtgctgggggggggtgggcgggtctttcggtctccggcgttttgtagaagattgcgtgctgcgtgactatcaggggtgagaaggcgatgcagctgctggtgagtggcctgctggtgatggagctctagctgctctggaggaacttcatcgccaccgttctgtttttgcttttgttctcttgttgctccttgatctcggcttggttgtgctccctctacc

SEQ ID NO: 51574 - DNA, 459 bp, Triticum aestivum
  unsure (1)..(459): unsure at all n locations
  Clone ID: PAT_TA_51574
cggncgcgtgggcgacccagcgtccggttataaaagctttaattgacctgcaagctcttgagccaacaggagacctctcgccggtaagaaggtccggacaatttttcttggacaatctgctgtgccagtgaccgcatcaacaggcatactctagctgcaattgcagaggacttgtttgcaattgcgctagatcaacacttaccgttttccttgcacatttacgttcgtgataagggcactctcaactcttgtaaggcattgcgtacatactgcaatcctgatttttcctttgtcaacagtggtgcaccatatgcacaggaactgttagccttgaatacgagactaagagctggacctgaattagtgcaggagataaaaaagtaagcaaatgatgatcctaattctacgatttcaacgccttacataagccaacgggtcgaagattatgactgggtaact

SEQ ID NO: 51575 - DNA, 501 bp, Triticum aestivum
  Clone ID: PAT_TA_51575
ggacacatacacaactaatcacatcaaattaagaaatatgtttgtctgaacattcaccagcgatatggaaaatatagccaagtttctatccgttttcccgagtcacgatttcaacaggggacgttttaaaaccataacgcaacgacgggtcgagaacagttcccaaatttcatgacaggacggggaccctggtacaaaatgcaaatccccactaaaacttattcagctcttggacacttccgaatgactgactgactgactggtataaaacgacggggctagacaaactccgccttggggtaaatccgtacggggacggccaagcccagtatcgggagggggaccaaaaactggaggatcttgatgacaaactcgggggtcttgtcctggttgaagggcggctgcttgggcggcgtgtacttgaccttggggggtatcggggtcgcgtcgatctcaccaacatagtactcatccataatcgcccgggcggtcgtgctgtgc

SEQ ID NO: 51576 - DNA, 467 bp, Triticum aestivum
  Clone ID: PAT_TA_51576
agcaaacgggaaacatcacttttattggtacagcccttacgatggccaaaagttttcaaccctggccctgggggaaagggggggggggtccaaccctcctagcgggggggggggatcggtggccccacccacacgggcgagcggggggggtggtctcaagccctatcaggggacccggtgccaaccttgggtggaacacgcggggaaccgggaccccgggcctcgatcaaagatggggctagaacgatttcttctcggccgacaccagcccgggggtccctccctccacttggggggggccgggccccacctttaatctaaaagtccccgctcggaaaagatcatgagctggccgccaagggggtgccccaagatcttggaatccttgcttaacagcttgcattggttacgggaaaaaccccagaacagaacctttgggaggtaccggtccaacaacttcctgggga

SEQ ID NO: 51577 - DNA, 440 bp, Triticum aestivum
  Clone ID: PAT_TA_51577
aaaaaaagggggcccggccatgggggcaactatttaatttaaaaaaaaaaaaagggggggggggaagccacataggggacagggggccccctcggggggaaaggcagagttcccggggggattcgagggcattccccacccggggggcacgggggggacccccaaagccaaggggaggagcagggggggggcccctgtttatttaaactttggagagggggcaaagggggtttatctggggccatttggctacccattttttggggaaaaagggggggcaaggaacctctcggaaataaaaatgggtcgagtatttgggtaggcaaatcccgcaaatagcattttaaaaaaaaacaatccgctccttgggtgttccaaaaaaaacaactccgccgccgacttaaaacccctgggcggtacgggactttttggttttgaac

SEQ ID NO: 51578 - DNA, 475 bp, Triticum aestivum
  Clone ID: PAT_TA_51578
ccaccatatccggaaacattggggccctcacaaattacaagaggcggggttcggaacatctaactacagagcacaggggtttcataaaacccccacgagaggtcaacacattcagggaagacacaagagcgggctttctaaggagggggggaactgggggactgccttggggccctcggagacggggtgcttggcgagctcgccggggaggacaaggcggacggaggtctggatctcccgggacgggagggggggctttttgttgtacctggccagcttgggggactcgccggggagcttctcaaaaatgtcgttgatgaaggagttcatgatggacatggccttggaggaaatgccgatgtcggggggcacctgcttaagcaccttgaagatgtaaatcttgtacgtctccacgcttttcttggacttttttttgccctttttttggccgccctccttggacgccgggggcctt

SEQ ID NO: 51579 - DNA, 521 bp, Triticum aestivum
  Clone ID: PAT_TA_51579
cagcaaaaaaactgatcagcagcagcagcagtcctacaggagatgagggtcaagggttcagtgtttacccaaactaacaccaggttgttcaaaacaatcatcaagcaatgcatacaacagctgagttaaaagccatcatagtacagaccacacacaaactagagctagagcttgcggatcaaatggaccgtcatcgggaggctctcgctgctcctgtctgccagttcaacgaggcaaatgtctcctaccttcatcccggccagaaagacaaggtccttccaaaatgagctaatatgcctcacatccttatgtttctgggccaccatcctgctaaaccacttcatgttgctaccctccagcccaagtatgacatgtgtttgttcaagcgggaaacgacacgccgaagcatattccaggctgaagctcaaacgttttgggctccaaacatcacgttcattcatcaccttcacaaacacagggaattcaaatccaattgcctggactttctcctctactttctc

SEQ ID NO: 51580 - DNA, 534 bp, Triticum aestivum
  Clone ID: PAT_TA_51580
aaccaggcattacccctttccattactgcgacataacgggaatacaaccattgtccagaaaataaggcgggaaagaggaaagcgggttcaagcatcgccggaaaacccaccatgagcactcgtcatcgagattactcactggggggcgaaaacccgacgacactatataatccaagccctaaccagatcaaacaccgtctacaaccagaccaaaacaaacgataggctccaaccagagcaacaggcccgaaccaacctcacgcaggaggcaactattccagcaaagtaaaagacaagatcacgatcaccccctcctcaacgagctccttcttcttgataagccgtcgcgcagatcctcatcagacgagaagtattctctttcagcttttcccctccagttctcagtgtcatcgcgtcctcttgcttcatcagacctgcttcttaaggttaatcaaggcagagtctgtggtagaccttgatccccagcagctcttttgcggccagagtttggtcaacccaggacaccaagtccgt

SEQ ID NO: 51581 - DNA, 294 bp, Triticum aestivum
  Clone ID: PAT_TA_51581
acacctcagaactaattctgtaatatggacatcactttagtcacctttaagacatgacatggttgacactatcagcacatttgggatacaaaaatttacaccacattagcgaggactcaggcgtgaagtcggaaccgatggcattctcaagtgggatacatttatacttcctcgcttccgctgctgctgccgcccttccggatactgaacttgcacagggggcatgttgcattgatgtgcagccacttgtcaatgcaggcacagtggaaatggtggccacaagggagttcccgt

SEQ ID NO: 51582 - DNA, 434 bp, Triticum aestivum
  Clone ID: PAT_TA_51582
aaaaaccaaacccatccacggggggccgttaaattccaggcacataacttcactcgcacaggggagggggataattattcacgactcatttactagcaaaaatgggggacaggcctatctaaaagtttcctggggacataaaacggcccagcggtggaccaagatgagaccccaaacaaagggcccccaaaaagctgatgggggaaaccgaatcaacctacccctcgggaagggcaaaaaccccggggaggggcttgccttccagcagctccaagctcgcccccccgccgggcgaaagggggctaattttgggggccagcccagcctttttaacagggggaacagaggcccctcccccggtgtgggggggcacacccttccaagttggcccacccaactggttcgcgattgcttaagggcctgggggaaacttt

SEQ ID NO: 51583 - DNA, 484 bp, Triticum aestivum
  Clone ID: PAT_TA_51583
caccctcttgtttaataaaaataatgaaggggcatcaaacattgaatatcagttgaacaatagttccaaactccataatagcaatagctatcatctatggcatttgttttataaccatcaaacatgcctaaaacatcatttctattgaaatccacatgacaagtactaatggtaagttgcaccatcacatagattaaagaaatagttcaacactaaagcatcgaccatttgcatggtggtaggagcaagtggcaatgtgtcaagcctctaagttgcggtagatatcttgaagccttgagtgctccatggtcagcaatacatcgtcatacgcacattttcgctacaaccgatgcatgcacctcaaacaacatgctggtgttttaccggaattttaatatgagtagcaaaaagggggaaaaccataatcctttttcgggcaaaaagaaaaacaaaccgcttggtgtcggggggcttggcgcctgca

SEQ ID NO: 51584 - DNA, 494 bp, Triticum aestivum
  Clone ID: PAT_TA_51584
gaataaacctgctattttcccacagaagagaagcctgaattttacatgccctagcatctagcctgcacagcacattttcatgttcaaacgctcagtttttgatctagtagcggagccacaacgcacatcatatcccactctcttgggtagctccatccttcctcgcacgccatttactcaagtccacgacacatcgaacccacaaacttctgcgtgatctctacagcggtggagattgtgcggaagtttcctggttagatgcgtagaaattccatgaacagcccttcacgtcaccgtggaattgtagcctcagaagtccagaggtggcgtttccttgtgcaacaagtcatgggcaatgaagtcccaaggaagagatactgacatcaaacaacacttgagcggaagaagcttatcatccaaccgtttgttggcagatgcagcctcgaaggcctgctctgccaactttgatgcagcagaagccgccttacaaacaa

SEQ ID NO: 51585 - DNA, 555 bp, Triticum aestivum
  Clone ID: PAT_TA_51585
gaggattgaggccatgggatccctttgtggttgcaacttatacatgagctcagtttagatccctttgctagaaaaaagatgctgcatacaacaatgatcttatctagattaatggttctctgattattcttttgattctgagtcatcaatgtgtttttattgtaggttcttgtacggaacataccaccaaaccccgatgaatcagttagcaagcctgtggaacatttcttccttgtcaatcatcctgatcatcatttgaaacatcaggtaatcactaaattttggaacatctcccatttgaagaatcatcacttcatcaggagtgtaaactgatactatttccaactacaaagtgttggtgcctactgctcccttgtcccttgctaccggctggggatgctcggcgggcagtccctgctctcattttcctccagcctctggtaaccctcctcctcacctgccttgcacgttcgaggaagtcgtcatcatggtggtggtggtcgaggaagtcgtaggtgctggtggcatcatcacggagcaggcaccatcttctcc

SEQ ID NO: 51586 - DNA, 483 bp, Triticum aestivum
  Clone ID: PAT_TA_51586
ataggtatttttttttttttttctttttttttgtctttttttttgaacagtccaaatccaacaaaccgtgccttaaacctgaggaaacagactgggggtgagccacaacacgataattaagcaccattgccagggcgaggtcccacctgagggggggaaaaaaagaagataccacagacgatttaccagaacagaggccactaaaacaagaagcaaactctatgtagagtagcgtgaaccctgccaaccttgaagcatgcggtgtacttccataggtgataccagcgtatgagaggggtggcttccgcgctccaactcaagcaagtgcaggcgagcatttgcttgggggggacagggaccctgggccaaagggcctgcgcgaagagctttgactcaagatcccagatcttgatggaaaactgagtttgcgtccagacccaacagctgttgggcctgaaggaaaacgaggggttaattgatccc

SEQ ID NO: 51587 - DNA, 551 bp, Triticum aestivum
  Clone ID: PAT_TA_51587
actcaaatgacaatctacttatgcccaaaagcatgttaccgtcttaccaaaaagaaaagaaaaaattgcatcccactctgaattcgtgatacttgtcttacttattcctagtcgttccactaattcgtgatacttgcagacatatacagaagtatcagttgcgcaacacaaatcacaagagtacaccagctttgagacaaagagggagtagcccgaatagaaatgtggagctttatttgctgcagcatccaatcagagtacgcgacttgggctccataaccaaaggcgcatctcggtttaggcatctaggacttgacggccggcgtcgtagctgttaatagtacctgagcctgccatatctatttgctcgtctcagaacatgcggtgcggattaactcttatcatctccagtattggacggttggggttcgcctcggccatgctcttgaaagcatcctccgtagcctctacttctgccgccgtcgagccaacgcagaataagctgacagtgaggcgagcaaggctggagaggcgttggatgccaaagtcga

SEQ ID NO: 51588 - DNA, 477 bp, Triticum aestivum
  Clone ID: PAT_TA_51588
atgaactactatgtttttcgataaagaatggactagtattcatacagaaagaatagcgtgtctacttacaaactctggaatgaacactttacaaatggaatctaccggaattctccctgacccattacaaaattgaactgttcatggttgcctgcttcatgcttcaggagaggatggacatgaagacggtggaccaggtggtgagcgccacagcagcgacgaggtacgtccacaggaagatcaccgagcactcctcctgcccgacgtcgaacagctgcgccattgtcccgatgttcatggcgggcggcagcgcgaactgcaacatcagcacgtaccggtagagagggtcgtggggaaggaacccgaccccgtgcgccgcacggacgacggcgatcccgataaccggcatagccacgtagcggataaacacgatcgccacgatcaccgcgcgcttcagcaccgacttccgcagccctt

SEQ ID NO: 51589 - DNA, 444 bp, Triticum aestivum
  unsure (1)..(444): unsure at all n locations
  Clone ID: PAT_TA_51589
gaataatccgacctttctgctaaaaaaagtttcctgcttggcccggtttttacaggtttcaacagggtacaaccttttcaggaaaaagggggcccccccctaacccacattttttattcccccttgaatgaaaaagccgtccccatttaatttctttccaaaagggccaaccctttgtcttggtttttggcccgttgcccaaaatgaaccccggcgtccacatcatcccctcgaatttcccgagtttcttcccccttccctttgttccccccaataatgccaaaaaaatcccccccccgctgaaagacccctttgccactttttggttcccttgcctccccttggcccccccnctttttctgagggccccccccacggctttttccctggcccccctctgaagtcccttacctttcccagcacctccttccccccccaagaacc

SEQ ID NO: 51590 - DNA, 284 bp, Triticum aestivum
  Clone ID: PAT_TA_51590
tcgcaagcaaactggaactcgctcgctgggggagtagcattgaatttcaaccgtcgtgcccgtacctctcacagcgagatcggttgcgactcgttccatagtataggggacatgttcctcgagcaaactgttcagtggcttacacgagttattcgattgggatgcgcggacatcgctgccgtgggggaggggcgtagccgcctagaactagtttagcctgcgggccgggtcttctggcgagcctccgcggacttgggcgtcgtgttgccggccgacgggccatg

SEQ ID NO: 51591 - DNA, 288 bp, Triticum aestivum
  unsure (1)..(288): unsure at all n locations
  Clone ID: PAT_TA_51591
ggaccctgctgctgcacgacacttgctgcacactgggtgagaagaatccccgccgtttctttgagggtgcggctcttctccgtcgcatgaaccgctttggtctccttgctgcgggcccggataagcttgattacgtccttgccctgtctgctgagaacttccttgccnggcgccttccgactcttgtcttctacgctggcgtggctaaatccatccaccatgcccgtgtcttgatcaggcaccgccgcatccgggttggcgggctgttcctctctgccccgtcgttca

SEQ ID NO: 51592 - DNA, 585 bp, Triticum aestivum
  unsure (1)..(585): unsure at all n locations
  Clone ID: PAT_TA_51592
ttgtaagaaagatggccaaggcattcactgcagttccaagcattttgcccgtgaagatattaaatgtgcaatctgttgctctatcaaaatattcacagttgcagaaactgccaacaagacctgacggaatgtttatgcatttgaggcacatgacttgtagaataattgtccattcaagaccgcaggaagccaattacgacattgaagttcttcaactggcctattgtttggatgctgcaccccaactggagacattgcanttgaatgtgattgtcgttttatttattaagaaatattaatatgcggaccttgnagaaagaactttactttgattagtttgaaaaattgattgcaagcttccaatgcagatgttctatgtgtcatccagtggtgtgtccagtgctgaggtggtgggtctgcgccggcctgatcatctcaagacagtcttcatgagcgggtttcgctgttccaaggctcagattaagctggcgtgctgtttcttgggaaatgcttctgttcttgcgaacctggcttttgaaccaaagatcacaggcccaggcaatttgggtgataatactgacctgc

SEQ ID NO: 51593 - DNA, 162 bp, Triticum aestivum
  Clone ID: PAT_TA_51593
tcgcgtgtacgttgtggtaacgccacccgcaccatccaggggtcagtatgtgatccggtgtctgcacgagtaccggctagacgacagtgctctcgtggttggcccgtcgcgctgtctgcgggtaagccaagtccagcttgccgtgttcctcctcctgtcctc

SEQ ID NO: 51594 - DNA, 383 bp, Triticum aestivum
  unsure (1)..(383): unsure at all n locations
  Clone ID: PAT_TA_51594
gcgttcgaccgagcgcgagcaccgcaccgccgccgccgccgagcatggcgaacgttcccaagaccaacaaaacctactgcacaaacaggtgtgcaagcaagcacacgcttcacaagggcactcaatacatgatgggttaggacagcctgtctgtccatggaaagcgtctttgttacatgcagcgggcgggatgcggtgctcagaccaaccccgctttgcacatgatggcngaaaccaccaagatgatcgtcctgaagctgctttgcccgaccttgatgcactactcccagcgccccctcnatcggcgcangccttttgagatcggtgggtgacaagaagggcaggggtaccttctcttcttctggcattgctttcgctctatc

SEQ ID NO: 51595 - DNA, 478 bp, Triticum aestivum
  unsure (1)..(478): unsure at all n locations
  Clone ID: PAT_TA_51595
tccgcccggtcggcggcgcgnagcacagggggaggagcaggcggcggcggtgcccgccgacgagagccggcgacctagcccgagctcgncgcctggcttggggtttgnngnaagctctgaagaggctcaatgccccgtctcactggttgcttgacaagcttggtggagcttttgcccgggggggctctctggtcctcacanggcccgggagtgccttcctctggtcctcgtcctgnggaacagactggactctgctctcacctaccgtgntgtgctgtctatccttatgccgcgtcgtttcctggttgctggtttggtccgctctgtctcgacctcccctgctggtttcttggccctcctttcccttcccccgcctggtgcgctctcccggcttctgtgtggctcctggggctcgcttccgccttccctctgtctgggctgtggttgctcactccccgctctgcctggtccggtctgt

SEQ ID NO: 51596 - DNA, 291 bp, Triticum aestivum
  unsure (1)..(291): unsure at all n locations
  Clone ID: PAT_TA_51596
gccagcaggggggggcccactgctagaaactgttacattctgcaggcggacgagaggacgctcctgagtttgctaagaagcttgcctcagttgctgacctttatgtgcatgatgctttcggcgctgcccatcgggctcatgcttcagccgngggtgtggcgcggggttttgatgccttctgttgctggcttcctcttgccgaaggaacttgactctcttgtcggcgctgctgccaacccacagacgccgttcgctgccctcgttggtggctccggggcctcctcttagctt

SEQ ID NO: 51597 - DNA, 439 bp, Triticum aestivum
  Clone ID: PAT_TA_51597
tcggccacgacgtacggcccttcaagtttctctgcggcggtcaccatcttccgtggcctgagggcatcgccgccacctgaggcaagaagcgtggatagctgtagcttacgactgcaacagcgttggggagcaggagctccgctgggggggcttgctaatgtaccatagttttgccgagtaacgagagaggttgttggctctggcgggtagcccaagcccgtgttccactggttacagggcgatagtgtgcaaagccgccctctgctcaatgaatgcatgctcttcaacctgcttgcatggcggtcggaagaggattccctgacagatggctcgtggctgtgcgagtgattggctggctctgttccgtgtgaggactctgatctgactaagtctgctgttgtctactgtgccagcaggtgcgccagactgttgatcctcc

SEQ ID NO: 51598 - DNA, 486 bp, Triticum aestivum
  unsure (1)..(486): unsure at all n locations
  Clone ID: PAT_TA_51598
ctagttctagnacgcgcgtgtccgggctgttggacgagtccgcagatccatccctccctccctctggaatccttctctgttttttttctttttcttttcctttgtttagtgagagagagatngtgagtgngagagagagagagcccagtggattatgggcgatattggtagttggggggggggtatcgaagtggtatatgcagatgaagaaacatgaatttcnnnnnngnnnnnntnnnnntangtttgttggttggttgttgttggtgggggggggggtgtggttttggttgtttttgttttttttggttgttttttttttgttgttattttttttttttaaagggggggccgcttttgggggtccctgttttcctcccgggggctgggcccgttttttttttttttttggggcccccttttttccttcccgggcccccgttttccccccggggggggggggaaacccggggggtcccccctttt

SEQ ID NO: 51599 - DNA, 238 bp, Triticum aestivum
  unsure (1)..(238): unsure at all n locations
  Clone ID: PAT_TA_51599
acaaaacatctncaaagaacacctctaaagtttcaactcataaggcattgcgagagcacccctggtgcctatgcttcccgcgttttgtttggaatggggtgaatgtatgtaacaatagaaagatcattggaaattgggttattgaagtgatgcctgaaaccttgttaagttcttttttgntatttatttgtacccggctcttccaattgatatttgtattcaaccatgtcgtgaaaca

SEQ ID NO: 51600 - DNA, 349 bp, Triticum aestivum
  unsure (1)..(349): unsure at all n locations
  Clone ID: PAT_TA_51600
cacagccgaagaccacgcctgcctgcggctcagcagatcatnacgaggagttccatggccgcgctgatcgccgtcctgctcgtggcggcgctcctgtgcgcgccggtcgtcgttgagcttgcgctggtgtagcactccgttcaagaagctggttgagctcatgcaggtcgttggtggggagtggggctgcaagcgtcttacaacctatttatgctcgctgagcagatggggaaagtccgggagaggctagattattctttgcgtgagctcattcccataatagatttgacgagagggctctcaccggcggccattcttctacatactatcatactttatcttatatact

SEQ ID NO: 51601 - DNA, 333 bp, Triticum aestivum
  Clone ID: PAT_TA_51601
tcgccgccccgaatggaggaagggtacgcgaccgtcgatctatgtgcgtctaggcatggagggcaccctcctctcgcgctccttcttcgtctggagcgctagcatcccagacagcgtagatccactacccctacgtccgccccacgccggccgccggtggctcgcatagatctgttggtggggggcctgccgcacgcgacagagcatgctgccatgttgttttggtgcagccagaccgccgccccttccctcacgctccgggtagaggctcgttctttttggtggtgacttctcgtttctttccggtggtggctctcttgttggcgtgttatg

SEQ ID NO: 51602 - DNA, 487 bp, Triticum aestivum
  Clone ID: PAT_TA_51602
cccacacatacgtcccgcgtccaataggccgggagaacgagaccagcacgactacgggcgcgaccgagcacaggtatccaggctgacgaaggcgtcttcgattgatggccggcacgggcacagcgcgggcctcgacactaactcctgtggagtggtgcccgtctgcgacagggcggacgagctcatgatctctagttcctctcacaagcactttgcatttgatgagtgctacttgagccggagagagcttggatagcaataccgatggcctgagtaggcgatgctgataccgatcacggcaagatggtacaagtgagactctatacttgagtttgacctattaccatgaacgaagggatgctggttatggctaacggcctgtgcatactcactgatcagatggacgtcttaagtatgcagcttttaagaatgagcttgattaccacaagatcgtctacatatcttgacgaagctgacaggaacgact

SEQ ID NO: 51603 - DNA, 242 bp, Triticum aestivum
  Clone ID: PAT_TA_51603
acacagctgtttgtctgccctgggcgcactcagtacgttgacatggtctgcttctgatagaatactggcgcctcaccccgcatgctagatcggctacgtgccagccgtgttcccacagggtgaccagggcggtcgaagctagggccggctgctggtgctctacttgatcacggtgtgtctgtgcacgaccccagactggccacacgacaaggacgcttccttgatcgaccctcgcgcggtgg

SEQ ID NO: 51604 - DNA, 484 bp, Triticum aestivum
  Clone ID: PAT_TA_51604
acatcaacattcacattacgttctggcgtgaagatatcgggcatgtattaggattcatgttcaattcacaacaggctctttattggcgcccacaacaattcatagcagcccatcatcagcggttccatacaggtgagaacaagaactctagccgacttcacattggagaggcaaccggagcttgacaggcatacgggggacacaactgctgaagccaaaaaaaggccttgagaggaacaccgacggttgctgcgccttgctatgagtagccatggcgtaacacatcaccactttatcgcaacagccggccatcagaacttgctactggtgccacagctagctaattgcacagggcgggattcactgcttacaggatcaaccttacccatgccaccggaactctagggtgaagagcactgttactcaatgttaacagacaactacggtgaagagcactgctacttaatcttgacagacgagtaaa

SEQ ID NO: 51605 - DNA, 521 bp, Triticum aestivum
  Clone ID: PAT_TA_51605
gggcagaatctcttggttcaaccaaaacacaaccacaccaatttcacgattaccattacaaagcaaatcccacaattatcagaaagttttcaagacactcaacatctggcaggtactgacaccaacattggagagtcgactggcaaccatagataagagcaaaaatactgaagacagcatagattttagcatacagggcgattagcacttgacctctttcagcccatgtgcaaagtacaggaaagttggatcagcagctccctccttgtagtaggggaacaccacgccgccatcattatgcatgctctcgccaacaaagaactgaagggccttgagcttgctaagaagatactttgggggggactcaacattcttcttgaaagcatctagggcatccccttcaagcttggcaaaaaggttcttgatgtagcgcttcatgtgagagataaactgcttcttgtcaaaagcaggttgctcctgaagacggaaggtgtcaacaatgtcaaccaccttcacgggct

SEQ ID NO: 51606 - DNA, 505 bp, Triticum aestivum
  Clone ID: PAT_TA_51606
gactaacgcgtacctgcttactcagactataacgtcaaaatggcgcgagataccccacgaagttttgggcccttaaattaagtacccatcaggccaccatttgattgatgtaaaggtgatagctgctacctacctcattcctcttccttattaccaccggtgatctgcgccaccgcctcgccttgttgtggttgcctcctcttcaccctgcctgtagggcctgcgccgtgtggtcttgtcttggaaaagaacttgtgcgttctggatttttccctacccataaacgacggaacgttgaagatctgccttccttccctgatgtggggttccctgctctggacacgctccttgtggttggtttcttacatgccttgcttagacacacgagtcctttggccccttgcaaggaagcctttatctgtgaagccttgggcgtactcatcacttatcctgggcctaacctgcgtacctatcaaatgtcatgcgacggacaagaccccctccc

SEQ ID NO: 51607 - DNA, 454 bp, Triticum aestivum
  Clone ID: PAT_TA_51607
ccaaaaaagtcctggttttttatttaacacaaaggggaacaaagtttacggggggtccaatttaatttttaatggtttttaaaaacaaggttccttttgggaatacccccagttaaaataaccgggggcaaaactccttaatagaaaaccataactccctccaggatcaggatacaggttggggtaaaacagttgccggggtttacaaaacctggggcaagatagctttccaaaaaaattttttcctaatattccaaaggggaggacggccctccttggggagggggctaaaaaaatccttttttttggggggccgaaaaagcttcctttgggggagggggggcccctgaaactttgttcactttaccaaagcgctggggggtaagttgggcccattaaaaaccccggggaaaatttttgggcgggtcatttttatcacccaattttttggggc

SEQ ID NO: 51608 - DNA, 533 bp, Triticum aestivum
  Clone ID: PAT_TA_51608
acaaaaatagtggaatatcacttggaagagttgataataatgaagcttctccgtccttacagcaatacagttatcaagagatatactacctccgtcccatattaatcttgtaggtcaacagaaatgaaacatttctggcagtagttaatttgcttggttgcaatatggattccagacatgaagaggaacggatttttcattccagtcagatgaactcaacaccataatcaattcatgaggtcagttacaccatgacaagctcagtcgaaaccaaacttgggttttcctgttgcagagcgtacatcttgtcgaacattccttccttccgataagcttccaacaagatggagtatgtgatggcatctggttcacactgcatatgcttcatgtgcctgaagaccctctccatttccatcagatcctccgctttcgcacatgccgcaagaacagagttgtgaaaagatgtatttgccggtacatcgagcctctcagcaagctttaccatgcctaccaccttgtggaaaagggctgca

SEQ ID NO: 51609 - DNA, 530 bp, Triticum aestivum
  Clone ID: PAT_TA_51609
agtgccaagtctactgccatatactgtaagatataaccccaaagtttgccaggaccatttctcaatctggtgaaagctaaacatccaatgacatattcgatagacctaagagtaacacgcacccataccaagtgaaagctaaacatgcagtgacatattcgataggcctaggagtaacatgcatctgtcccaagtgatatgcgacatgttaaaagtcatcttaagagctgtccatctggttatccgtcgaagctggggtgactgcgccattgttgatccctgcggcgggaccgactccgactcccattgaaccgtcggctccgaaagtgaagttactgggaacattgtttgggccggcccgctcgaaaatgatggcacaggagtctggttgaacgcaggcacttggatgtcacctgatggttgtgggaaaccaaatccaagtgaaggaaatgactcggttagaaccgtggtctgagctggcgagccagcgctgggtccaaagagcttctgttcatactcaacaagctgac

SEQ ID NO: 51610 - DNA, 489 bp, Triticum aestivum
  Clone ID: PAT_TA_51610
accaataaaggttcatctgattattaataagttaacattactgacaaggtcttggaatgaactgacgttggcatgccttatctgcaattttgactgttccatttcatttcggcacgtcggcaagtgcatactgaattataacagcgactctagctaccgggcacttttgagggagctaaaccaagtcatcatgtttgatacaggtataacagctctattggctcaaaagattatttgtgcctgcccaagaatagtaagccggacactagtttcagttcatcagggcataacattcctttacaaaaatttatgtaaactgttatctaacaccatagattcaaggaccaagggtgaaggactatttttccgcttgtcaattaaagaacaggagtctgcatttgaattctttccattgatgtctgaatatatcaagaaattaggaggaccaatgtgcagtataaaaaggaacatgtggacatgaccaagaag

SEQ ID NO: 51611 - DNA, 511 bp, Triticum aestivum
  Clone ID: PAT_TA_51611
aacagggcacagcagcctaatggactggtatatatattactcattatataatccatatccattcgacatataccacataacaagcacgaacgaccagaaccgacacaaactgtataggttggttcagaaaaaaccatggtttcacaacccgatgctctcgacccacacacacacacgaaaaaattgagcgtttcactcctcggcagcatttggaaatgaaaaaagcaaagcctagttatcacttcacaactagagccgtctctccttcattcagtcccaccagatgcttgatgattccagtgaactcctgcaccgatcagtactcggcgttgtcatccagctccgcgagggccaccctgctgccttcatcggtggtgatggccaggttcttcccttccttggcagcaataaaaccctcctttaaagcactcttaagcttccttaggctcatgttagcaagggcgacattttgctttgcacactcttctctcttatcctcagtgatgatgac

SEQ ID NO: 51612 - DNA, 502 bp, Triticum aestivum
  Clone ID: PAT_TA_51612
aagcgagggagaaatgatcacattgttccgtctgtcaacacactgtgtcttggcacagagtaacaccaattacagaagagtgctgctttgcacacggcttgttccagtcggttggtggcatatcctgcacttcaggccctcgctacctaacactagtgtgcaacacagccactacattaacaatcgggcttgaatcgggcactgggtgttggctgcgaagtacgtgcgccttccgaacatgattatgataacaaagtgacgctcgtcttacaaaaaaaagcttttttatcagtttgagacaacttctccccatagtacgctcattgtggcaacactcatgataccacctacagctaatggtctattcctagtaccagtagcctggccaggtgtttcacagtgaccaaaccacaaacttagtctgaactagacccacagccggaacagcgactgccaatcacttggacagaaccgcgccctcctccagggaatccttctccgc

SEQ ID NO: 51613 - DNA, 297 bp, Triticum aestivum
  unsure (1)..(297): unsure at all n locations
  Clone ID: PAT_TA_51613
agaaacaaaggattaaaccaagcaagnatcatgaaccatgatcaagaacaagaagtaaaactaggagacaatgatgaagattagagagagcccctcgcttcacttcacttcagtccccctgtttaattaatccctgttgccctgtcggaagtacaaaaataatgatgtggggattcgtgagcttgtcccctcccatggctacgggcaccctaccgttgttgttgctgctgttgggactgtggcggctgcggctgcctcctgtggtgcttgttgttgtgcatccagaccttgaagacc

SEQ ID NO: 51614 - DNA, 505 bp, Triticum aestivum
  Clone ID: PAT_TA_51614
aacacagaaattgcacgctattgtgccacacttattaatagtaatttacatgctaactgaaagctgccgacagacgcaatgaaaccaaagaccaaaccgtgaacactaaaacaaagagacacacgatgaataagagaccatctactcgtccatcctcatgacgcaacgcaggccctcccccttgagcatgaggtcgaacgccgtgttgatctgcgagaagggcacgctgtgggtgatgaacttctccacgtccagctccttcctcatgtacatctccacgacttccgggaggtcggtccgcggcttgtagttgccgaagaaggtgcccttcagggtcctctcgttgagcaagttcatcgggcttgtcttgaacaccgcctccttgtgcgggacgcccaccagcaccgtcacgccccacccatcatggacacattcgaaggcggcgatcatggcgtcgatgtggccagtgcactcaactgcgcggtcgactccaccattggtcatc

SEQ ID NO: 51615 - DNA, 346 bp, Triticum aestivum
  unsure (1)..(346): unsure at all n locations
  Clone ID: PAT_TA_51615
ggttggtttctttttaaaagttgcttgatacatataattttcatttttatgtgggatgtgtttgaactcatgatgagtattatcttttcagggtcagtcgttgtggccaacgagctttttttttttcttgttngagctgcngatggggggggggggggaggcctcacacgcctgtgtgnttntgcnnttgcgcggggggggggtttagacatcgtctctggtgtgtctggcttntccgtggccttgtctgccgtgtcacgtgggcctccctgcgtcttgttttttttggtgccgtttggtgtggtctgttccgggcccgggttctggtgggtgttcctgcgcgtgg

SEQ ID NO: 51616 - DNA, 475 bp, Triticum aestivum
  Clone ID: PAT_TA_51616
gggtaatcaaagaaccggcttcgcccccccttcatcatcaactcataaacgcctcaaaaaaacaattcgctggggggaacgcgcctcaaacactggtctgattctggattctacaatttccccccgggtgaccccaaacatttgcaatcccccaaatcaatttggcccccatcttattaccgcctgcgttggccaacctcaagtaatcatcacccctgggggcaagccgggggccggcgacccgccccttgtccgattccctacccccaggcccaggggttgtcgacccccacgaggtcgtccccgtccacgttgccgttgcggaacccgaggtacccggccgcgagcccgagccctacggggatgaaccccccccccttgaaggacatgacggggagcctgaggagggcccccttccccgggttgacccccaagagcgcccccggggcccccccggccgggccgggcccccccc

SEQ ID NO: 51617 - DNA, 458 bp, Triticum aestivum
  Clone ID: PAT_TA_51617
gaatccaatgccagcgcacacatcacttcaaagcctatgtttccgtgttcttcattcggaacaccacaggtatgcaacaccgcctttaaacatgacagactatctattcatttacaacataggcgctccgcaccaccttgcatgcacattattatggccattattgctctagggttacagcttaccgacgcttggttctgattaacgaatgactggctcgtcatcagcatgcttttaaaatgtggaggcccgcttattcctccgataaagctgctttccaccgccgccatgcttctcacactgtgcaccaaacacgctcccataatcttgcatatcatgcgatctcacctcatgcagctgccaaaaccactccttatccctatcccaccggaagataccttcatccagcctaattcgatggcctgcaacccatcgtctgctttggcagggctggaact

SEQ ID NO: 51618 - DNA, 471 bp, Triticum aestivum
  unsure (1)..(471): unsure at all n locations
  Clone ID: PAT_TA_51618
aagcgaataagtacatccattgtgtttctggaatttggggaatagaatacatggtccagtttacaggggatgcgaccctggnttgtggaggtgcctggtacccttttcttcaccaccacaatcctgtctatccagggggggggggtctagtatagcctaggtattgcagaacgaggtttgggggggggggctacaccgntgttctacagcatgttgcaagattcctcatctgagttttaccacgactgggttgtcgggggaaggtaaagtaagcttatcacgaggaatgcttttgactcgagttgctctnctgcccgggctgaacctgcngcaagttctgcccctcttgctcggcctcttcctttggctcggtcttgggccccttgggcttcggggtcngttgctgggngcgaacaccccccgacttgcttttcngagcccaattgtccccgccnggggacgcatgcttgt

SEQ ID NO: 51619 - DNA, 402 bp, Triticum aestivum
  Clone ID: PAT_TA_51619
gatcatcatgcaatataactggcaggttcgtacagacacacacatagtttttcccaacaggacacaacagctttgtgcttcaaaaagggcctagtggtggtcacctaactagggcgcacataccagagcgctctttgtagcaccaagctgattcctgttggcttggggatcgaacccagccgaataccaaaaagcaaaagccgataagaagcccggatagcccgtgttgatgaccacagcggcacggaccggatttttgggacccgagattacgcactccagggcgctgggacatacttaactgttccggtttgccgatgcacctatcggaggggacatttgggtgccgcctgaagcctccgggcttgggctggcaggccctggaaaactaggccgtggtcg

SEQ ID NO: 51620 - DNA, 580 bp, Triticum aestivum
  Clone ID: PAT_TA_51620
cccaactttcgacgacaacggggcgcagaataacatgtccttcgaccgattttgctacatatgcaaagcgcgccggtattgtactgtgcgaggcggcgactgttgctaaagggcgggcacctgcccataggattacacctgggcgctccctcatggacctgccccgacggtctgacccccaggctgtgacggcccatgtacatctgcagatcaattctccacactgagaacgaaggtgctagtttcagtgcgtaaggcaccctacaaactcccagcaaagtgcatgcttgaaagctgccatgtataaaccaagggttgaagatgacgcctccgctctcacgaagaacgtgatagcgatggaggaaagtcaggagaaagctgcctgaggacttggcacgagtgacgaatgcactgagtgctatgcataagatgatggtaactggtgggttaccaacttgaaatgggggaaccagccatgccacctagttctccgcacgtaacgaattgaatcgagctttgatgatgatttgcagctggcaattgtttactcagggctatgtcacccttccccgcataatga

SEQ ID NO: 51621 - DNA, 569 bp, Triticum aestivum
  unsure (1)..(569): unsure at all n locations
  Clone ID: PAT_TA_51621
cgcactgccgccgaccccgtctgcctgcggccagcagccatggcaaggggtcccatggccgcggtgctcgccgtcctggccgtggcggcgctccggcgcgcgccggacgccgcggagctcccgctgggggagcacccggccaagaacgacgggacggtgaccctgctccaggtcggggactggggccgtcgcgtcgcctacgcccgatccaggcacgcagggcagatggcgaaggtgatggtgaggctgctcatgtgcttgagcttctcgcccgactaccgctgtgccgtgaatgggctcaccggtgttcgtgtccggcgggacgggaggccttggcccctttcttctccgtccatagctttcncttctgcggggttccttgtggtcgcgatctctgacttccggggcgtgttctctttctctgcttgagccgttnctgcgcaagctcgatccgtattccgcccccctgttcttggtttctttggctggtccctcctcttgtttgtcgttcttcttgcgcttcgctccctcaccccctcccgctctgcccttcctcctcgtgcactatc

SEQ ID NO: 51622 - DNA, 456 bp, Triticum aestivum
  unsure (1)..(456): unsure at all n locations
  Clone ID: PAT_TA_51622
cggctctnccgccccccgcgcgcgagcgcgctgcctggccgcgcgcctggggngagacctgcgggtgcttcggcgtcngacagccgtcccccgtcaaggtctgccgtggtgtgcctgtcccttttttctggctctctgctgttggcttgggggagggggggtgtcgtcgtgttctctcactgtgttncccttgtctcgtgggggctggcgaatgtgtcctgtgaggctcttgtggctgcccgttttgcttgctttttgtgcctggccctgcctgctggtttgggtgccttcctccttcgggtccgggttcccccgtttcttgtgctccgtttctcttgttgctttcgtgtgccggggctggttggctcccgtctgtgttttggggtgcttttggggctgccccccggtgtctgtgcccgttttgcccttggggctgtccttctttctgtgcggtgg

SEQ ID NO: 51623 - DNA, 214 bp, Triticum aestivum
  unsure (1)..(214): unsure at all n locations
  Clone ID: PAT_TA_51623
ctcgtgcgcgtttggttttcttgctgcaccggtgtggcgggcggctttgggccctccctttgtttcccttgtcccttttccgctggagggtggcgccgnccagttgtttggtggctgtcgcacagctcggtgtgcgtggctcgccggggtccgctggctccgcttccctctgtgtgcgggggcttccgccgggttccctgcccgtgcttttgct

SEQ ID NO: 51624 - DNA, 496 bp, Triticum aestivum
  Clone ID: PAT_TA_51624
ctccggtctctccgtttaaacagaggtgttatgagagaaaggagccactgatagagagctgaagatagagggcggctggagtgaggacaacaaatgtatccagctacttacactggtgtttacttggcactcggttgcaagtatagtcctaattttcaactgcctctctaactccaggcgggtgtggctctttcctgctggtctactgcctcacccttgttttttctgggcttccccttgtgattggcgagggctttctgtggttgtctgaccacgctgtacttgctccgtccggttcggctgttgcaggctcgtttcctctgctggctccccgccctggtctgtgcgtggtgaagggtggaggcggtacctgtttccggtgtgccattgtcttctgctggacttcggtgcgctccccctggatgctggttgccattgcgacctatgcttttggagaactggcggtgcctctctttttcctggctttcgttctttg

SEQ ID NO: 51625 - DNA, 297 bp, Triticum aestivum
  Clone ID: PAT_TA_51625
ctgggttatgctccatatatacatttgggctagtcccacgtttttgtgtatggattggaatgggggtgggattactttgaaaggaagatcagagaagaaggggtttcacaaattctgggatttgctaaattgggtacggacgaaccaaaatttgtgacgatgatgaaatgaattggtagtagtatgctgacgcatttgaaatgtgggaccaattggctcttatccgctttctgatttcctttcttgctttgatctagtgtggcatcggtcaggcacacgccctggggcgccagtgcg

SEQ ID NO: 51626 - DNA, 364 bp, Triticum aestivum
  unsure (1)..(364): unsure at all n locations
  Clone ID: PAT_TA_51626
gcgttttgtgccgagagggcgaacggctcagtctttaatcctaagcggttggtggcccngaagttcacttctcaaaacatgttgctcctctagtgtgcncttggggttcgccngctnatcatgcttgtcgtgcgttttgccggtcgacctcctgcagtccctcgggggtgggtgagttgctttgctgctcactctttttttcttctcgccgtcgtttgcagtgctctctgtttgtatcttgtgctgtgaacatttttgttcttttgacgtccattttgttgtttttgaggtacgctcctgagattgccttgtctgactggctggtctttttgtnttgtctttgcccttgtgttgttcggttggg

SEQ ID NO: 51627 - DNA, 171 bp, Triticum aestivum
  Clone ID: PAT_TA_51627
caaattcgagtatcaccataggggctagcagcagtagcaaatatcttggttgttgacctttcatcaatgattccttccttgaacccgagccacttcttcaactcatcagtagtcatttcgacagtcatcgtctgggattttccatcatttttagttgtccccattgcacta

SEQ ID NO: 51628 - DNA, 592 bp, Triticum aestivum
  unsure (1)..(592): unsure at all n locations
  Clone ID: PAT_TA_51628
tggtccgncctgcagtacccggtcccggnatttccccgggttgcgacccacccgtcccgtcactccatgccctagcccctcaggagctcacgccggggacccaggaacgcacccacgctcaatgcacgggccgcctcccataccctaagcccctccctatcaccgcactacccccacaaggcgtggcagcgccagggcccctcacatcctgcggccgtaccgtatgagcgcgcagcgggtcctttctgcgccctgtatgccctacctacaatgatgttcacactcgcgttacatgcgacggtcactgaatagcggcagacacgtaggtaacgccatnaagccgcaggaaggtccaaggcacgcagctatcgtggaggtagcagaaccatggaaaagaacttcgtccaatgctaaacagggaagccttccttcggcagcgacgacgcacgatacctcaaccactcctatggatgcaacatgatctggcgttgaggctatacgcaaaatgtaggatgagactgatcttcgatggggtcaagaacaaaatactggacccacatggactgcccagtctgcggacactacttatggc

SEQ ID NO: 51629 - DNA, 561 bp, Triticum aestivum
  Clone ID: PAT_TA_51629
tttgtttttttgttcttctttcttttatgtttgttttctttcttgtttctttttttttattttttttttttgtttttttttttttttttttttaaacaggacaaaagttcccattcaggggtcccaggccctccggggaaaacaacataaatccccccggggaggggggaaagggggctcatcaaaagggggcctacaacataatgggggggggccgggggaatttagggcctccgcggcgtttagctttagcggaagcccgggactcggccgcctttttccttgggtggggcagggccacttggctcttcttccgttcaggggaaagcgtcgtgggttccaaaggggcccttttcttccgggaaaccacggacttgggaatggcgccagcatcctcctcagcttggtccataggggccgggggcttattgttttcctggggaacagggggggggctttcagcctttttttttggcaaattcaggaagggggccccctgggttcccatcttgcgccccggggggggttccttgtttgggggctccaacgcctttttctttt

SEQ ID NO: 51630 - DNA, 541 bp, Triticum aestivum
  Clone ID: PAT_TA_51630
cactgaatcatctcgatcaaggccttcatcagtgcctggtcatctcattggtacttcatagacggtctaggaaaaaagctgtgacggcgatgcgatgctcgtgaccccgaatcgcttcttgatttagcgaaaggggtcacgaccgacgaatcatttaaaagttacgctgaatcaatcagcgccatatcaggactgatgctggtgttgtgcaactgttttctcccatggagtggagagatgcggactagagaccacatcatgttcagggccagctcagcagatcatgaaggcggtaacattggctttcctgatgggaggaggctccccatcttgttcctgtctgatggaattgtcacccaagcattccatcggaggcgtcatttgagggtgatgtcgaatatgacgccttcgagatctgtgatggttgttcttgtcccgtccacttcctcgacaagcattccacgtttttcagcttccttcagtaccagtgcgtccatgactttggttcgtgatacataagccagtataaatctacatttat

SEQ ID NO: 51631 - DNA, 471 bp, Triticum aestivum
  Clone ID: PAT_TA_51631
atccacgtccactgatgatgcacgcagaagcaactacgcatccactgatgactcgacagacggattcttttgcagctcctggccccttgatgaggcccataactcatgctagaaccacacttgacattggtgtggagcatcccatactctaagagccaactgctcctgccatgagatcttcctattcccagctcgcgccgccgaaggggtccaagcatcccagaacgccggcgttttctagtcactacgaccgcggacaacatcgccctgtaacatgtacttggtcaccttgtctgcccttgctgtttcctgcggcccctgagtttcttcggtctcctcacagggaactcttttcacaagcctcttcgaggccgctaaccggggacgcccgttgaaccggttgctgcctttgctgctgggcgggctgctgacctttggttgctctcccaacagcctgaacggaccggtggc

SEQ ID NO: 51632 - DNA, 554 bp, Triticum aestivum
  Clone ID: PAT_TA_51632
ggtttttttttttttttttttttttttttttttttttttttttttttttttttttttttttttttttttttttttttttttttttttttttttttttttttttttttttttttttttttttttttttttttggcccaatttgggggcccggggggggggcatttttctttgccccccaccattgtttttttgggggggcggggggggcctttttggaaacgggccgaccccccccccctccaaaggggggttttttcccccccttccattttttgggccccaaaaggccgggttccttaagcctgggtttggcccccccccttttatgtccttaccccgaaggggggggccccatttttccctggcccccggcttttggttcggggggtttttttttcccacccttttttccttttggaccccccccccctttggggggtttttctttcccttggccccccaaagggggggcccccccccttttttgggcggggtgctgtccccaaagcggcccctggccaccccggttccggtcccccttggttggggccttt

SEQ ID NO: 51633 - DNA, 413 bp, Triticum aestivum
  Clone ID: PAT_TA_51633
gatgcacagcagtaacgcttcttgatatattaagaattttcgacagcgaaacatgacagcgtcaagatgtcttgctctgttcgttgttacaatcatgcatagatgataggtgtaggaactaatcccagtgttacattgagtgtaaaaatacatcaatccatgcagggccagctcctgtgtgcatctttgagaccttctcggatagtccatcgacggctccttctgtttcctcagagatcgcgtcgtcatactctggctgtttattcgggttgacaacgacgcacttggaagcgctaatgctcgcgctcttgaggtaggtccgcgagctcaagctggtggggctcaaaccattctggccaacaccgggtgcatcctgtgacttttgagggctcactgcaccatgggcatcaggc

SEQ ID NO: 51634 - DNA, 505 bp, Triticum aestivum
  Clone ID: PAT_TA_51634
aaataacaggcaaatctttgttcaaccaaacacaaccacaccatttacgattaccattacaaacaaacccacattatcagaaagttcaagacactcaacattgcagttactgacaccaacattggagagcgctgacaaccatgatagagcaaaatctgaaacgctagatttagcatcaggcgattagcacttgccttttagcccatgtgcaaagtcaggaaagttggtcagcagctccctcttgtagtaggcgaacaccacgccgcctcatatgcatgctctgccaacaaagaactgaagtccttgagcttgctaagaagatctttgggcggactcaacattcttcttgaaagcatctagtcatccccttcaagcttggcagagaggttcttgatgtagcgcttcatgtgagagataaactgcttcttgtcaaaagcaggttgctcctgaagacggaaggtgtcaacaatgtcaaccaccttcacgggctggtcatcaaacaccc

SEQ ID NO: 51635 - DNA, 472 bp, Triticum aestivum
  Clone ID: PAT_TA_51635
gctatagccacatttccttttccgtttcttcgtgctttgtgtcgtcctttttttatgcttacacaacatattccctcaaggtagaaccgtgttggatctggtgttttttttttttgcgcgtgtgccatgcctgacgattgggcgggggctctgattgccgatgccgccgtgttgcacggctgatggggggttgacgcacgtatgtctttgttgggcggctttggtcttccgcaactcgtttttttacagtggccgtgccgcttaacatttcttccccctttttttggcctttttgccttgcctttttgggtggccctggaggttttttgggttcagttcgcggtgttcctccctctttctctgggggtgcttccccccttttttgttttgctggcccccgccgcgcgctttttgctcttgggctcttcccttctcagctttgttgtctttcctctcccccggtttctcttgc

SEQ ID NO: 51636 - DNA, 562 bp, Triticum aestivum
  Clone ID: PAT_TA_51636
cggcaccgccctttttctttttttttttttttttttttttttttttttggatgaatggtcccaagacagattatttccacaattccttgctggttcggtcgcaatgtaatatcagcacaccagacctttcatacagtttacagcaaagacaaaccaccctatcagaagtaaacagaatgccgatatccctattaggaaagaccatccggccataaaaacaccaatgcacgtcacagttacgaaaggggcgaatgaccgaacgatagacattttgtccacccattcgccgtgaagccaaacaagagctgccacattcaaaacattccactccgcagaaccaccgtgggcaagccggttcaggcagtttgccacgaatgattagcagttgcaggtgaacaggttgtagtatttgtgctggaaatgtctcgtgcccatttgcagggcgccatcccatgatgttgctgttccaacttctgtgtgcttgtttgaccactcgcatacatgtgccgccagattagcaggaaagcagcacttctttctgtccagctggaggtatctagcg

SEQ ID NO: 51637 - DNA, 346 bp, Triticum aestivum
  Clone ID: PAT_TA_51637
gggggaggggggggggttttttgcaaagggcaaacccagggggattcccgggtgatggggatccctgggggccctggctgccgggttggccacatggcccccctcgttaatggggtttttacccccccctttacccccgccgggcgggggggaggagcgctcgccatttcccggtgccccccccgccgccctttggggttttggcgccccgggggaatgaccttttttttttcccccccggttttttgctcctcctcctccccccgggggggggggggttcggggtgggaggaggggaggccccggttggttgtgatcctcggcccggacccgtgggcggccccgg

SEQ ID NO: 51638 - DNA, 555 bp, Triticum aestivum
  Clone ID: PAT_TA_51638
cggccgctccgcggatctaggaactagttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgtgtggccccccttttttttttttttttttttttttttttgggggaaattttaaaagcttttgtggtttttttcagtttcccgggggaaactttggggggggggggggccccctttgaatttttttacccaatcgaaagggccctttttttttttgaatcctgcctttttgaaacggggggggggggagaaaaaaccccccccaaaaaaaaatttattttcttttccggtcgacccccgttgctcccccttttttgtgaaaaggaattgggaggcctgggccacgggtttttcaaccccccgggggggcttgcccttgggggcggggcttgccctgcccttgggggccccaaactccttttgggaaaaggccccgttcccgtgaatatcccccttggggggcttccccgggg

SEQ ID NO: 51639 - DNA, 533 bp, Triticum aestivum
  Clone ID: PAT_TA_51639
gaagtctatcaatgatacttgtcattcttgaatctttggacaagggaggagaggggcatgcatctcacaacaacgagcgaaaaaagaagaagaggaaacaagatggtcatattgtgacgaggaggaccaagtggggagaaaaatgctcacgcgccgaagaaacacacatccatccagcccgggaaaaaaaggatcgatcgcatccagggagggggtggaggcctcacgacacggcggcgaccttctcggcggtcttggccagcgactggaggttgcacttgacgatggtgtcgatgaacacgcgggtgtcctcggtcgtgttgcccgcgggcacgtccacgacgtacgactccacgacgacggtggcgctggacggcgcggccggggatgggtgcacggtggtgacggagaggtagttcttgagccggtgctccccgccgacgacgcggaagctgagcacgtggctctcgtcgtccaggatctcgagccgctcgcggctggacgccgcggggaggcccgacacgacgtgcacc

SEQ ID NO: 51640 - DNA, 545 bp, Triticum aestivum
  Clone ID: PAT_TA_51640
tggctgccggaatttggaacccgaagacacaccagccagttcaacaggtgctcgctgagatgacaaatggtggagttgaccgcagtgttgagtgcacgggcaacgtcaatgctatgatacaagcatttgaatgtgttcatgatgtatgacttgctaagacattaatcatccactcaagcatgatcattttgcattgcctcttttctctagatgaaaacttgaattctgtgatctatatacagggctggggtgttgctgtgctggtgggtgtgccgcacaaggacgccgaattcaagacccacccgatgaacttcctgaacgagaggactctcaagggcaccttcttcggaaacttcaagccgcgcactgacctgcccaatgtcgtggagatgtacatgagaaaggtaaacaggaatcgctaattgctgcagcttggtctatgctttgcaccttgttgagatatgttgaatgctggacacttttatctagtccttgaaaacttgaacctcatgctcgaacaacttgcgattgtggtcaggagctgg

SEQ ID NO: 51641 - DNA, 522 bp, Triticum aestivum
  Clone ID: PAT_TA_51641
cattgctgtggttgttggtacaatcacagatgacatgcggatccaagaggtcccagcaatgaaggttactgctctgaggttcacagagacagcgagggcaaggattatcaatgctggtggggagtgcctcacttttgaccagcttgctctccgtgctccaactggggagaacacgatcctgttgaggggacccaagaatgcgcgtgaggcggtgaggcacttcggcaaggcgcctggtgtgccgcacagccacaccaagccctatgtgcgctccaagggtaggaagtttgagaaggctcgtggtaggaggaacagccgtggcttcaaggtttaagtcgccctttcttgttagtcgctgtttgtgtggagcggctgttgttctgtttgagcaattgatagtaattagtaaagtactttgtactgagagtagcaaaatctatcgccccagtgttcgaatgatattttgcaagattcttattgctgtcaaaaaaaaaaaaaaaaaaaaaaaaaaaaaaaaaaaaa

SEQ ID NO: 51642 - DNA, 583 bp, Triticum aestivum
  unsure (1)..(583): unsure at all n locations
  Clone ID: PAT_TA_51642
gttgaccaggacggcgcacacaccgcatctcccctggcttcttttcaacaaanacggcggcttctctgcgcacaacagcccaccatcgcccgcatcttgtgctgcgggtgccccggcgacagctggctggagaccagggagctacgagcatggggatacagcgctacgacccactacagccggcggttggcggagctgcatacaacgatgccgcccaactgggagctgcaaccggcggtttggctggagctgcatgcctgcatccagcggcgctgctcgacgacgagctgcaaccgttcagtttggaggtgcatccagggcgaggagggatgcatccaatggcgaacgccgacgacaagaagcaaccgtgaaataagaagctggaatcagcctcaccctttcaacggcagacctgcatccatggacgccggactgtgaccggcatttttggggagctgcaaggtgggctatttgctgatatgtttttttctggaactcgagttttttttttgctggaactgatgtaaattttgcttcaaacgatcatcgcatttctaattgctgagtttgttttttgctggaa

SEQ ID NO: 51643 - DNA, 331 bp, Triticum aestivum
  unsure (1)..(331): unsure at all n locations
  Clone ID: PAT_TA_51643
tttcggcgcgagcccaccagtgaaggcatgcggcggtggccgcagctccactcttccatgcncttagtgctnctcgggcnggggacgagatccacttcgnctccctgttcattgttngtcccctctcctgctngttccacccctgctgcttttttttggtggnctncggcngctgctgtgtggggggggcactgctctatagttttgatcttttctgctttttcgggtttcactttttggcgccaaagtgcggttcgcctagggcttcgttgcggtgcgcttggcgtcttgcccctgtttccgttctgccggtgttgcgttgtctttttgt

SEQ ID NO: 51644 - DNA, 357 bp, Triticum aestivum
  unsure (1)..(357): unsure at all n locations
  Clone ID: PAT_TA_51644
tcgactcataccaacaaacctctcctctgcgggctccaaccgaaccgtagttgtcttgctgcggaggaaactgcggctgcggccccgcctgcnngtgcggcaacggctgcggcggctgcncctgtccccggaggccgtggccgccggcgcncccctcctcgtctccgccgccggcgcccacttgtcttgctccggcggcatggtgatggcggccgcgtccggcggctgcggctgctcccagtgcatgtgcggctcctgctgcggctgctcctgctgccgctgctgtgtcgttggtgctcggtcgtgcgtgctccgcgcgtgcggcctgcgtgctgtcgctctcctgctcccgtgccc

SEQ ID NO: 51645 - DNA, 615 bp, Triticum aestivum
  unsure (1)..(615): unsure at all n locations
  Clone ID: PAT_TA_51645
gtgcacttactcgttggaacacctgggcgtattttggatcttacaaanaaggtgtttgcattttgaacgactgttcaatgcttattatggatgaggcagacaagcttctctctcctgagtttcaaccttccatagaacagttgattcgctacctccctgctagtcgacagattttgatgttttcagcgacattccctgtgactgttaaggagtttaaggacaaatatctgcctaaaccttatgtgattaaccttatggacgaacttacactgaagggaattacacagttctatgcttttgtggaagaaagacagaaagttcactgtctcaacactctcttttccaagcttcaaatcaaccagtcaataatattttgtaactctgtaaatcgtgttgaactattggcgaaaaagatcacagagcttggctattcttgcttctatattcatgcaaagatgctacaggaccaccgtaatagagttttccatgatttccgtaatggagcatgcaggaaccttgtttgcactgatctttttacaaggggaatagatattcaagctgtgaatgttgttatcaattttgatttccccaagaactctgaaacatatctccaca

SEQ ID NO: 51646 - DNA, 266 bp, Triticum aestivum
  unsure (1)..(266): unsure at all n locations
  Clone ID: PAT_TA_51646
ccggccctggcggnagccggctgcgggatggggnagnncctcctcgngggaccggccctctcctacaagggagnnagcttcatcgtgccgtctnngctacgagnggtcggcatgcaacaagaacccgccaccgtgcgagtacccatcgcgcaacccttcctccaggtaggtttgggctgtatatcattgcaccaaagcgtgtggggggggggggcgcggcggtttcttgccaccgactaccaacacctgagntagaacccttggac

SEQ ID NO: 51647 - DNA, 457 bp, Triticum aestivum
  unsure (1)..(457): unsure at all n locations
  Clone ID: PAT_TA_51647
gcgttcgagngnagtcccaaatnattcacacggaggacatccacttgctcactaactgaacctgtacaactaacataggcagaatgtggtttgaacagcgttngaaatatacagaatgcatacaaaggtgaatggcagcgtgattttagagtctgacatgaatgtgagactcacgcacaaatttatgtagagcactttcaccttacaggtcatggcaactccatctccggtaatattaacagattctataatgagcagacgttcgctcagctcgtccctggagcgacccaaccacaacatgtggggtagttagttgcatacatgcatgtgatgatgcaagctaatttcaacttttttttaaaccaaaaaatgttttgtgtaccaaaccatatgcccaattcacagtgtgtttaagctgttggctttgtattgtcaagggcttcgtaactagattcca

SEQ ID NO: 51648 - DNA, 273 bp, Triticum aestivum
  unsure (1)..(273): unsure at all n locations
  Clone ID: PAT_TA_51648
ggtccggnatcccggtcgaccaccgctgtcaaaaacacttaaaagaaaacaccaatacatctagaggcaaccaccagttcgcacccgttgggcatgtttaccatgcagggcccagcctgggtgagcctcccagggctgggttcagctcacctcttgtgagcagggagcggtagcgggggggggtgtttctggcctgatctgaggcgctggtcgctttgcttgccgtttctgcctgcttccacttgttcctggttccatttttttgttttgcct

SEQ ID NO: 51649 - DNA, 421 bp, Triticum aestivum
  unsure (1)..(421): unsure at all n locations
  Clone ID: PAT_TA_51649
tttgcccgcgcccgcgcagtatattcactcgccggcctctccttcctccgccctcagacgcgcgcgcacgcataggaggagcagaccagctagctagccgaccccggaatggcgccgcagcagggtcgcgtggcgccaagggcgacggtgccgtcgcggcggccctggngatgggtggggggggaagaggacgatcgtcgacgggggcgggggcggggtgggcctggtcgtgggcgtgctgcgccgtggcggccggcgtggcggcggtggggctggcgggggccggcgtgctggtgtggtgggcggtggcgttcctcccggcgcgggtgctgctctggttggtgcccgttggcctcgttctcctcggctcgccgctcgttgcctggctcttcctcttcgcctccggcgcttgccgtcgtct

SEQ ID NO: 51650 - DNA, 587 bp, Triticum aestivum
  Clone ID: PAT_TA_51650
tgcccagcgtccgcccagcgtccgcgggcgcgtggggtgttatactctcaagttgcctttcagtaaactaaaaacctttaggattttgtgttttcatatactattcttttgcacgggtttgtttgcctcaattggctgctcaaatgtatgattcactttcgcaaacgttgtcgtaaactaccacacatgttctttgtttctaacaattttgatctatggaatttactgcagaaacacttgacttcaaattcttgctcaagcccaaggacgcggagaccccgtgcatcactgaggaacggccgacgcggctcctcaccaggggcatgctccagggtgatgtgaggcttgcaaacttcaggcttaatggagatgatcagttgcttgagtataaatgaatcacccactcatggcgaccgaggtcgacttgtgatatgacaagcggatcacggtgtcacggaatgagcaattagagaagagtgttttcacctaaggcgggatctgtccctgggatgagctgggccgttgcataaaattcggcttcgaacagctatacagttcctttctgacgttccccgttggctcacgcc

SEQ ID NO: 51651 - DNA, 508 bp, Triticum aestivum
  unsure (1)..(508): unsure at all n locations
  Clone ID: PAT_TA_51651
cccnacgcgtccggnaagcacacaanaagctcatagccattcaaagcctctccatctccgaagctccaacccaacctcgaagagtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcgtatcgatctactactaccataccatgtaaccgcaacctgatcgagggcctttatgtacgcacctgacctgcatcagcagtcaggtgccatgccatgattgtaaacaggcccccctaaataaaacctcccttgattaactaa

SEQ ID NO: 51652 - DNA, 571 bp, Triticum aestivum
  unsure (1)..(571): unsure at all n locations
  Clone ID: PAT_TA_51652
cgcacccgctggtcctgcagccatcgggtctcgtctgtacgaccgcatcggctgacctgactgccgttaaaccgcagacggacccgcgccgtgagggccccgccaggcgatcgagaccgtcgaacagccttctagagccgtctctcgcgcgccaggcgatcgaggccgtcttgtttaggtttgggtggttatataaagctccgtacgcggatggccgcgcccctcttcctcccgctcccccaaaccctaccgccggcggcgccgccgcctccgtacgtgtgcttcgagcttcagacccgccgtgacctcctccctcctcgccgccgacccctcccgccggcggttgcctgtggccggggacatgacggttccgtgggggcggaggcgttactccatcgatctgccacggtgcagccgtcacccccctgatgagttcgttctgtgtgatggggaatacatcggtctctcggtgctgtgttgccgctggcgtccaccaggctcctgctgatgaatagagccatgtgtctcaagggtggttgctctgngcaacgccgtgattattttttcactc

SEQ ID NO: 51653 - DNA, 605 bp, Triticum aestivum
  unsure (1)..(605): unsure at all n locations
  Clone ID: PAT_TA_51653
ngaactctgcagtgtttctgtttctgaaacttaacttgcatctaaacagaggcaactctgcagtgtttctgtttctgaatttaacttgcatctaaacagaggcaactctgcagtgttcctgaatcacatttcaattatttcttgtgcgcgtccagctggctcagagcaccatctagcagagccttcttctcactgttgctgatcacttcccttgaatgtttaagctcagtggtggctgcagtcagctcattcttcaggttcctgatcttcaacgtacccctggccctctcagggtccctgatcttctccttgatcagatgcaggtcctagtggtcagactgaactcctgatggtgctagagcgctggagaattgttgtggtaacgatggagcggacggttcttgaactgcctcccagaactagtagcattttctgcaaacaagtagccgtttagtccaaagtgtggaaataactgtggaagcaggaaacaagtcactccctgtgagtgttaataactgtccttcgttcgaattcggtgtttggaccagtagatttatctgttcttttacagcggtttcagaccaataatttctctggtttctgtt

SEQ ID NO: 51654 - DNA, 575 bp, Triticum aestivum
  unsure (1)..(575): unsure at all n locations
  Clone ID: PAT_TA_51654
ccctcccatcttttcccgtccaggntggtggtggcagcgccatggagcacggctgcacaacttcgatgccggggcaggtgggctcgggcgttgaacggctccacgggagcagcagcatgcggcgcatccagtcgggcttgggcagtgccccggcgccggacgcacgcgctggtttccggcaagctggacatggtgatggaagtgcaccctatgttagtagggtgagcatcgatgaagctagaaggagggaaaatgtcaaccccaacaatgaagataacattatgatggggaatggttcagctctaagagagacagcttggaaagggcttgtaagcaatgacatctattatatttggaaccatggcccgaagtttggtgggggatttgattgtcggtactgccccctaatcactagaggaggaggtgcaacccgctttagggagcaccttggaggtataccaggtgatgtgaaacagagtatcacagcatactttgacaaggaattgtcgagcaacaaagtatcaatgcaaccaaagatcagcactgctttgaatgttgagtcaaaagagtacttg

SEQ ID NO: 51655 - DNA, 602 bp, Triticum aestivum
  unsure (1)..(602): unsure at all n locations
  Clone ID: PAT_TA_51655
cggncgcgtgggcggcgcgcgncataggaggcgaacagcagcggagccaagccaccgacgccaccatgggtatctcgcgtgactccatgcacaagcgccgggccaccggtgggaagcagaaggcgtggaggaagaagcgaaagtatgagctcggccgccagccagccaacactaagctttcgagcaacaagacagtgaggagggtccgtgttcgtggaggtaacgtgaagtggagggctctccgtctggacactggtaacttctcatggggtagtgaggcggtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacagaggaagcaaagaagagcaacaatgtccagaggaagcttgagaagcgccagcagggacgtacactggactctcacattgaggagcagttc

SEQ ID NO: 51656 - DNA, 566 bp, Triticum aestivum
  unsure (1)..(566): unsure at all n locations
  Clone ID: PAT_TA_51656
ggagatccacgaacagttgcagcgatggctaggtgcacgggcattntcctgagatctatgatgtatcagaatgatcaagggcggccgaagtcagatactacaagacataccaagctgtatttatccgcgctagagcttgttcgaatgggtgacgcaaatgtacaatcttacgaagcgaccatgttactgctgcaacaagctaaagccaagctggcaccaatttgtgcggaacgagatgggatgggtgttgcagatagggaagctgcagcactagctgatagaacggaagacggtgagttagatggagacgacgatgtcatctcttcaatcagcgccccgaaacggaatagagcaatgggaaggccaaccacaagccgcgacaagccgccttatgagaagcccgtgaaacgatctaggttctgtaagatttgtcgaaaggaaggtcataagagcaccacttgccctgactgtggcgaccttccaaaacctcccaggaaagctcccaagtgttcaaactgtggtgtgcttggtcacaggaggagcagctgtggcaaggaaatactgta

SEQ ID NO: 51657 - DNA, 597 bp, Triticum aestivum
  unsure (1)..(597): unsure at all n locations
  Clone ID: PAT_TA_51657
anaagtgtacccatcgactcacaaagcatanacgagtgcgaagaagagatggatccagccgagggccgaaggatactggtggccgtggacgagggcgacgagagcgtccacgcgctgcgatggtgcctcaccaacttcgccgcgcgcggcgacggcgagcttgccccaccggacaccatcctcctgctctacgtccggcccacgccgcccacctactccgtgctcgacgcctccggctatatgtttgccaatgaggcgaccgccgcgatcgacgggtacagccgggcggtggcggacgcggtggtggacaaggcgcagaagctctgcgcgctccacagcaaagagaacggcaaggtgaaggtggatgtgaaggtggcggttggggacgcccggagcgtcatctgcgacatggtggacaagctcggagccgacctgctggtgatggggagccatggctatggctttctcaagagggctctcctcgggagtgtcagcgattactgcgtcaggaacgccaactgccccgttctcatcgtcaagtcgaaataacagggcgaactgttcttgggagcgatgtgctatttggcatttacatct

SEQ ID NO: 51658 - DNA, 592 bp, Triticum aestivum
  Clone ID: PAT_TA_51658
cccagcgtccggccgccgatcgagcccctctcggccttcgcgccgctgctgctgcaggcaaccgccgccgccgtcgccgggagctaaacccctcgcctgacgccatggggcgtatgcacagcgcgcggagaagggatactctccgtcatgcggcgtctgcgcggacaaggaggactcccccagagctgggtcaagaccgccgccgctgatgtcgacgagttgatcacgaggctgcaaagaagggtcagatgcacctcgcagatcggcgttctgctccgtgaccaacacggtatccccctccacaagagcgttaccgcgaaagcaagatcctccgcatcctcaatgctcatggtcctggctgcacgcgaaatcccagaggatctgtactttgtgattaacaaggctgagcccattacgcaagcatattcgagaggaacaggaaggacaaggactccaaattcaggctcattcttggtgaaagcaagatccaccgtcttgcccactactacaagcgcaccaagaagctcccacccacctggaagtactagtctaccactgccatcactctggtggcttacgaggctctacatct

SEQ ID NO: 51659 - DNA, 533 bp, Triticum aestivum
  Clone ID: PAT_TA_51659
aacgagtgaaaaacctccttttctcaacttctgactgcacttctgtgtgcaacagatgactaaaacccgtcttgcgcttctgctaggttgatagattacaaaaatgacgacgaccaaaactgagatcaaactgactagagtacatcaatccaccaatggctggaagcaatgtttaacaaaagagatacagaaaggcggttacttcagtagcatctctgcaatctgcacagcgttcagcgcggcgcctttacgtatctggtctccacatacaaataactccaaccctctgttatcatcttgtgacaagtcctgacgaattctaccaactgatacatcatctttatccgatacctccagtggtgtagggaagcggttggcagcacggtcgtcactaatggtaacaccaggagcagccctcaagatttctctggcagtgtcctcatcaagtggtttttcaaactgtagattcacgctttcggcatgcgcgcgcattgtaggaacccgtatacaagttgcagttactcttacatcct

SEQ ID NO: 51660 - DNA, 110 bp, Triticum aestivum
  Clone ID: PAT_TA_51660
tcttggcaccttaacggcgctcggattaactatctattctaatgcgagcgcgcctgggatcagcttcgtcgcgtctgcgacgtctgctctcttaggtccctaattcattc

SEQ ID NO: 51661 - DNA, 444 bp, Triticum aestivum
  Clone ID: PAT_TA_51661
agcagcagcagcattttttggggccaaaaaaaagctggggggggggacaaccccttggccgggccgtaattacagatttactggaacaaaaactccgtttttttgccaaggggggggaaaccccaaacgatgatttggttaaaaaacccccccccagggttttttacattggagcgatcggaagcccgttagggggcctatttttccatgcgggttatgcaggggatgccccccccctttcccatgagggcaaaccccttgtttttctcccaaaacggccccctgggggggaaaaacttttccacctccagtttctgaccaaaattgaaagttgttcgaccatgagggtaaagttttcaagggctaaaaaaaaggggccagctttcaaaatttttaaaaaaggggcaaagcttaaaccaagctggaaaaattaaggattcctgt

SEQ ID NO: 51662 - DNA, 532 bp, Triticum aestivum
  Clone ID: PAT_TA_51662
ccgacgtagtaactttgtaaagtaaaaatttaagataaacatgttgggcaatgataggcgccggtcgaccggcccaaattaggccggtcaccgcgcagccgtctgatttccccattaatagccgtcaattgacgctttcccttgagtcgccttcttccgtgcactgactgcgagagaaaaggggaaatcccaatgcacgctccccacgcgcatagcactgcccgccgcacgtcgtcgctcaccgaacctccgccggtcgccgcctcacttcgcagctcgaattcccctcctcatcttgtcgtcgttccagcaccacccttgcccggatgtagcactgcccaacgccggttccagcaactcgcagtgctgatcatagcacgacagcgccgcctctggcttgccgccgtcgttgacctgcaccatcatgttccagccaaaaaacatatctcacccgaaaaaaactcggatggtcagttgcagcaaaaccaaaaactggttccggcagaagaaaaaaaaactgcggttccagcaa

SEQ ID NO: 51663 - DNA, 452 bp, Triticum aestivum
  Clone ID: PAT_TA_51663
aaaaggaaaaacaagtaaaattcccatcccatcccattcaacaaaaaatagcaaacaacagggggaggcggaaataacataaacgaccacaacccccaaacccttaaatgggggggggggggccaaccccccaaacccgaaaagggggcccccctggccctggagggcgaaaacaacccccatggggggaacggtcttgcgggggccgtccccggggaaggaaacggcgtcccgaataactttctcaaaaaaaatcttaaccaccccgggggtctcctcgaaaataacccccaaaatgcccttaacccccccacaaccccccaaacaacggatccccggtttgggaatcccctgaatgttgccccggaggaccttccgggggccctgggccccccccttgccaaaacccttgcctcccttgccgggccccgaaattttcgtttttttttttt

SEQ ID NO: 51664 - DNA, 421 bp, Triticum aestivum
  Clone ID: PAT_TA_51664
gcacgactaactgcatcactttcatctttccgtagattaaaaaaatctgtagaacggacaaatccccatctgaactccaagtctccaaacgggtcgaactaaactacaatgcatcatcggcagaactgaaacaggggcatgacgccatgcgcaccgcaacgaagccctaggcgaactgcattttggggccaaaaagggaaatctgaaaaagccgaaaagatcataaacttcgacagggcatcagacaccctgcatcttccgtagtccaccctccaggagcagcagggggggaactagcaggagagggggtcaacaatgaacagggagtcgaagtggatctcgtcccctgcccgtgtagtcctaagtgcctggaaaattggagctgggggcagcggcgatgcctcactggtggtgctcgccc

SEQ ID NO: 51665 - DNA, 422 bp, Triticum aestivum
  Clone ID: PAT_TA_51665
ggaccaaacccggggggggggggggggggttcaagccccggcccaaaattttggcccaaaaaaacgggttgaaacttaaagggcccaaaaatgggggtccccctttttaaacccaaaagggtaaagctttttggaaaaccttcatttttgggcctgggccttttttgggcccctttttgccggggttggggctgggcctccccccgggatttccgggccgggccctggggggggcccagttttcccttttggggggggtttaaaagctggggggaatcaggggcaaaggtgtttccggggggaaattggtttcccctcaaatttcccccaaaattacgggccgggggtttaaagggaaaacccggggggccccttggggggggccaccccacataaatgggggggccctcactggccctttt

SEQ ID NO: 51666 - DNA, 546 bp, Triticum aestivum
  Clone ID: PAT_TA_51666
ccaagacgaaacattgcattgaactctgatgaaagatgaacaatatgggcaggcgtttattcagaggcaacaacaaatgccgctggcaagaaccagcaagcactgggtaactcccaatttatgggcaagtagaggggccacaaggttaccatcactgtagttgccaatgatcaaatcaggcttggtctgcatttctctcatgagttcgtttgcaacatcctcggtgtatgtctccaggtacggccagacatcaaaacgcgagatccacttacggaggatcccattctcagttctaaatggaacacggagaatgtcagtgtgctcggttccaataaccttctcaaggcgctggccacatgtagttccaacagcatcaggcaacaacctggtgacaatgaggatcttaggagttatgtcaaggccttgttgcttaatcctcagaagcatctcattctccaaagcccggacttgatctaagatgtacacaacctggccaccggtatcagggtatcccaacacattggattgagcaaagtatccatgtgg

SEQ ID NO: 51667 - DNA, 555 bp, Triticum aestivum
  Clone ID: PAT_TA_51667
gcagctcaccaccgattatttgcaaacttaaccagttcactaccgttcagactccagacttcaagttcaatggccgacctgtcacccaataacccatctgaggcccacatccccaagttcgactcgggcaacaagcttgtgtgagcaccgacagatcacacgcccagaaccagcaacagggttaaaatgtcctgtgtgaaacagctaatgacacaataggatgaaaataagagaaaaagaaactaaaagcaggacagggcctaggaataggcacctagaatatacactactttgtgcctaatgtggcaggacatttgccctcatatagccataacagtgtcagcatgacaaggtgtaataaaataagttgggtgcctcatctaatgttatccaccaacatagaattgtctctgatgcaacaaacgagatcaacaccataaaacctgatgagctggtatttacaaaagttctcattattcgcggagaaatgaaagcatatgaaaacggtcagattattggcagtatatagcctggtctatctgaggaggaattgat

SEQ ID NO: 51668 - DNA, 465 bp, Triticum aestivum
  Clone ID: PAT_TA_51668
tttatttttatttttttttttattttttttattttttcttttttttctttttttttttttttttttttttttttttttttttttttttttttttttttttttttttttttttttgggggggggatttttaaggggggttttttttaaaagggacaggcaaatataaatttccaagggggaaaaaaaaacccaaaatttacaaagggaaaacgggcaaaattaggagggggcatggggcctggggggtgggtttatggaaaaaaggacgggggtcggacccccaggggtcactatgggggggggaaaaaaggggggggtcccatttccaaaatagggggtcaaaagctcaggaaaaaagcctttttaaaggggggaacgaactggggggaaatccgggggacccaggggggtttaaaaggggggggggggaaccccccccctttgaacaccggccccagaaggcct

SEQ ID NO: 51669 - DNA, 540 bp, Triticum aestivum
  Clone ID: PAT_TA_51669
accacgtatgcctcggagtagaataatctgcggggctacgaaaacccttttctttgtgcacaaaaattgcacgtacgtacctacttatccaactaatctgcgggcctatcttccagccaaatatacaaggcagagagatcggcactgaggtagcggcagctgttgcttacattccgatcatcttaaacgacaagaaacaccaacaacagagtagaagctatgctaacacggctgccgctgctagtgcgatgcgaccgagagaaacgcattgagatttacaagcaagatcaagaatccgggaccgaaagcaacgtggatgcctgcacgcggagctgcggcgccggcgggatcgtgtctcatcgctcggccggaggcgggtggtggtggtgggtagtggtcccgaggcggcggcatgcgccggaggcgaagagggagagccaggcgacgagcggcgtgccgaggaggacgaggccgacgggcaccatccatagctgctcccgcgccgggtggaacgccaccgtccaccacaccagcacgccg

SEQ ID NO: 51670 - DNA, 549 bp, Triticum aestivum
  Clone ID: PAT_TA_51670
gggataagaacatgtatactagtaatgattcagtacaaaacgcacacacaactataaatgatagtaatgcttctgtacatagatccttttatccacaaccaagccaacgctgggtatctatgaaaaatattgtcatttacatgtggtactcttctacttgagcttatcttctcagcatgtatagtgtttttctccaaacgatagcctggtttcgcttgtgcaaggctttcagtaagcatcccagtaaaggtgcagagatgcaaataaaccacggcatgatgcatccatacttaaatcaagtatattttaattcagtttctcggtcaatccttcatacctcctcatttgtagttatctcctcatttgtagttatccgaggcaaagaacagagaataatcattcgcacaaagcacttcacaacatgaacaatctcagcatacaactcccaattggaaaaatcttattcccgcctttggtgaaatcactcttctctaattgctcattccgggacaccgtgagtcgcttgtcatatcacaagtcgatcttgaa

SEQ ID NO: 51671 - DNA, 465 bp, Triticum aestivum
  Clone ID: PAT_TA_51671
caccagttgtaactaacattaacagaaagcgggcggcagcaaacgcggttcacacacacaaggctcacatccaacaccacgtcctggagtggcttccaacatagggggggggataaactttggggtaaaagacgggtccaggggctcgcttgggcgacctcctcgatcttggggccggcgccgccggcagccgggggcgcatggtcctcgtccttgccccccgccatgtcagctccggccccctggtccttcttggcgattatggggttgcggaggccctccagctccttctttttgtcgtcaaactcatctgcctcaccaagctggttgccgtccaccccctggatggcctggccatgggcgccctcgtttttcttcttgtcccccgcttcttgcttgggggctatcttgtcgcccttgtttgtgttgcccttgttgttggcctccttcccccgggctttcttt

SEQ ID NO: 51672 - DNA, 438 bp, Triticum aestivum
  Clone ID: PAT_TA_51672
aggaaaaaaagggggggtttatttaggggggcctggttacaaacagggggggggacccggctgggggggcagggcaggggcgtacaaaaaggcccccgatcagggggggggtacaggggagggggggaggaaaacgaacccaacgaggatgcccccccgggccggggcctgcctgaccgaggaggggtctagcagctgcggcaggagcacccccagggggggccccccttgcactgggggcagccccaacccccgtttttgggcgcctttttcttcccgccgggactcgccttgggggggggggggggggaaacaaggggggggggccccggggccccaacctggggggacatgttgcagccccccaaaccgttgccccccttgcggggggggccccagcccgagtttcctcccgggcaagaaatcttaaaggggggg

SEQ ID NO: 51673 - DNA, 462 bp, Triticum aestivum
  Clone ID: PAT_TA_51673
ttttcttttttcttttttttttcttttttttttctttttttctttttttcttttgttttttttttctttggcccccaaacagcaaaattattcagcatcggtggccctggggccaacacacgacatggggggcatttattcagcacacacggggggggctcacacacccccccccccccccccccccccccccccgcgcacgggcgtgtcacggccccacaggtcacttggctttgggggggccccaagcgggcccggggggccggacctcgggccttttggcgggggcggccggcccgccgcccttggccggggccgccgggcggaaccgctcccgggcgcgggggtcgccccgggttttccggcccgggccctgcggggggccccgcttgccctctggggggggggtttgggggctggggggggtgcgtgggctgggtgggggcgggggggggctggggg

SEQ ID NO: 51674 - DNA, 417 bp, Triticum aestivum
  unsure (1)..(417): unsure at all n locations
  Clone ID: PAT_TA_51674
ggggggaaaaacagtttctgctttttcggggtctggtcccatatttttttggcgggggttccgaaacaagggggcggtggggggtgcttttacaaaaccgccaagggtataacgggtccctcggttggctggggactgcctcagttcaacttctcgagtagctcggtggtcttggccccacggttgcccgggtcgcccccctccttgaaggggttttttttcatttgcagccccctttttggacacttgggcttgaagggcctgagaaagctcgccgtttttttgaagtgcggccccacaggggagatttcatgccccacgttttccaaacatttgacgcccggtttcccaagtgccttttcggtttgatccttgctggtnagggggaaaggctccttgtcnatatattccctcccc

SEQ ID NO: 51675 - DNA, 468 bp, Triticum aestivum
  Clone ID: PAT_TA_51675
aaaagaatcgggatagctttagatcacaaccaaaacaggcaaaacattctcagttcaacctaggactcgaacaggtaacagaaaaggggggtcagtatgtctgcaaacatgacaggggcgcaacatctaaaaaaatccaacggggaacatgcagcagctcttcggcctaagcgggggcacccttgcccttcttcttcgggagcttcctcatggaaaactccagctccttgccctccaggagggacccatcagctctgccacactgtccagggcgagacgaaatgcaggccagcagccttccaccactgaactgctcctcaatgggcgagcccaggggacgtccctgcgggcgcttttaaagcttcctctggacactggggctcttctttgcttcctctggggcagcagcagcaaccccagccttttggccctcagcagcttccttcttgggagctgcagaagctttct

SEQ ID NO: 51676 - DNA, 448 bp, Triticum aestivum
  unsure (1)..(448): unsure at all n locations
  Clone ID: PAT_TA_51676
ggaaataagcgggcaccccttaaaatggtgggggccaacagaaagcacaaagtttaggagttatgggggaatttcaacaagcccaggccacatgttttggaattcacccaagtttgggtgatgagattccagggggacaaataagttttattgcatggtctagtaaaagaacttggactttcgccgttttctagtatccccagtaatcattacgggtctcatcatcaaactttttcttgggttcagggggcttcgcgaagtactcggctgctggcattgggctggtctttttcttcatctctttcaattcagcaatctccttctttatcctctctggttccttcagagatgtcttttctggttcctgtctttcggttnacagggccttaaactttggcttggcctccggggtggacggggggccttactttgggatccgaatgccttg

SEQ ID NO: 51677 - DNA, 534 bp, Triticum aestivum
  Clone ID: PAT_TA_51677
acaaagccgatgtactgcaaatatataaaacaggcgtcaggctgacagcaaagtaacaggctaacagctagctgtacacatggcgacatatattctacattctcttgacagattcaaaggctagtcttcccctcaaggccggggtctgttcactgtttctactccctgaagtgttgcttacaaggagtggatgatgcatgctccagagaggtaaaggagtacacatggaaccagcaaccctcccctacttgtatgttttcttcacctctgggagcttttccagcgcggtcacgacctgatccatgtccggcctgcaccgggcgtccattgacaggcattgcatcgcaagcgccgctgccttctgcgccgccgggagcgaatattgcgaccccaatcgtgggtccaggacatggatgaccctcctcttgctgttgatgtaaggtcttgcccactccaccaggttatgctgtccaggcgggcggttcttgtccagagcacgttgcccggtcagcaactttagaagaacaacaccat

SEQ ID NO: 51678 - DNA, 459 bp, Triticum aestivum
  Clone ID: PAT_TA_51678
gggctatggattcacacatggattatatttccgggtaatacaattctagcaggaataaaaaacatttatcatgaaataggggaataaaaaaaaactttattattgcccctagggcatatttccttcacttggcactcttcccataaaacttggtgggcgggtctcccccgataggtgggagtcgggccccccgcacggacttgagggaccccgagcgcctcggggttgcgggggggcccaccataaagcaccgggcctcctgcacgggctcgacaggcgccaccaggggggggggggcgggcccttccaaaaaggggcgggcctcccgcacgaactcgagggaccccgagcacccaacatggccgaccaaaaagctttgggcctcctgcacagcctcgatggtcgccagagtcacgggcgaggccttgccgccccatgaccggcttttaatggcccccc

SEQ ID NO: 51679 - DNA, 527 bp, Triticum aestivum
  Clone ID: PAT_TA_51679
aataaagtgtaatattatattattgaaatatatagaacatatttagcaatacatccatcaagacttggatataatctattcgcgcccaaactttctccatatatgctcaatcaaatcatttttaagagccttatgcgttggacgatcacgaactctaacatctctttcaagtacctcggcaaattctggtatgtcaccatgggtatgtcaccatgagtaattgtccaaaacttagcaggccttcaggtgcagaggtatacatctgcctccatgtagggttggctgaggaggattccatgagaggcgggtacaggtgtggccgaggatcttgtcggggcgccagggtagaagagaagctgtggagagcggcttgctgtggcgccgggggagtgctgcggcggcggcgaggtggccgatggccggacttgcgcggcgtccttacgggcaccggacttggccatgaatctggtggctttgcgccgcctgccagagccgccaccggccggcaagacggagtgcggggcgcc

SEQ ID NO: 51680 - DNA, 411 bp, Triticum aestivum
  unsure (1)..(411): unsure at all n locations
  Clone ID: PAT_TA_51680
gcccttgtgttgtggttttttttttttagcagtaacaggggcgtatatacaagtcgcgggcgtcttggagagaattgcttgacacttccccttagctcctctngcnggttncacatgaagaatcttttttttttgangaaaatagaaggcttaagggggggggggccttccgtcccatnntntaagagcatttttgccgtgggggggggtgtgaatgccaaatagcacatcgctcccaagatcagttcgccctgttntttcgncttggcgntgagaacggggcngttggcgttcctgncgcngtnntcgttgncactcccggggggagcccttttgngaaagcgcttgccctggctccccgttcccngcgggtcggctccgggcttggcccccttgtgcggcggtggcgct

SEQ ID NO: 51681 - DNA, 580 bp, Triticum aestivum
  Clone ID: PAT_TA_51681
caatctcatactcgatggcgttatatgctcttgcattgttctatgcggcatgcagagatctactccggccatataatcctgtcccaaagtttattataatcaaatcagttgtgtttctcacatactggcagggtgtcctggtgttccttgctgccaatctcgattatcaagaatgctgaaaggctgctgatctccagaactatgtattgtgcgttgagatgctcatagcagccattgggcacctgtttgcgtttccctacaaggagtatgcaggtgcaaatgctcgcccttcgggtggtttcagggaaagccttcttcatgctttaaaattcaatgatttctaccacgacactgtccaccagtttgctcctacctacaacgaatatgtgctgtacaaccacaatgagggagagagtgcaccaacaaagtttccttcagggagcgccgtgccaagtgtccgggatgtggagttggctggcatcatcgtgatgccgccctcaaataatagtccagtgacctcaagcatgtcatccaaccacgtagaccaggacgaatcgatgaccactccgatcaggaacaa

SEQ ID NO: 51682 - DNA, 294 bp, Triticum aestivum
  unsure (1)..(294): unsure at all n locations
  Clone ID: PAT_TA_51682
ggggatcctctcacagccgccgccaaanacatttccccaatgctgcgacaactgcaactcctggtcggggtaccaattctgtgaggacgtcggccccaggtgccgccgcggctgcgccaactgccaggtggtgcagatgagccccgtgaagacgttccggtgtggagatggacgccccgtctatgacgggcacgacacgcccacgccctgcccgccgccgtgcaaaaagcactgatcgctccagctccctcagacactgatgagatcgatgttgcggccaaaacataaaataaa

SEQ ID NO: 51683 - DNA, 570 bp, Triticum aestivum
  Clone ID: PAT_TA_51683
ggccaacatattttatcaaactgctcagctggagacaaacagtaaaaggctcaacgataacgcctggcccctcctgtggtctatagagcctggggctggcctgtacaggcgctagcacacaggccctctacatgatacccggacgtgaccccggaggacagatgtacagaatgccatcaataggaacgcagtgatcgtcgcctaacctggacacgagggggatactgatgatgatccaatggtggcaacaaagcagacacttcggacaataatacatacgatggcaatacaccataagaaggaaagaaactaaaggagctcaagaccgtgactcctgatcaaaccatcaacacaaactgggcaatagctcataataagctgaccatcgcttctgcttcaccaataactccccctataaccaaaccatagactaaaaccacctacgtccgtacattaatgctatcaggaccagattgccaaagatgaacattgtctcacactccatccaacaaatagtctaacttgcgatgaacaactttacaacatacaactttgagcagcactaactta

SEQ ID NO: 51684 - DNA, 302 bp, Triticum aestivum
  unsure (1)..(302): unsure at all n locations
  Clone ID: PAT_TA_51684
tgtcgtcctcggtgcggttcgcngacaccaggtgcatctccgtggtgtcatcgggctggtccctcagcacggcctggatcacctggtacaccggcgtgatccccgtcccgccggccaccatggcgagccggcgcgcgaaccggcgctcgccgcccaccgtgaacgcgccgcggccggcgtactcgatgtggcccacggggcccttgatgtcgacgggtgcaccgagcggcagcgagtcgaggtactgcgacatgagcccgccggcggggaacttggggtcctcgtccttgaagtatatcttg

SEQ ID NO: 51685 - DNA, 574 bp, Triticum aestivum
  unsure (1)..(574): unsure at all n locations
  Clone ID: PAT_TA_51685
gtgaaaaaaagcgccanacanaaanagaaaacatgtgcggcggcgccatcctagcggagctgatcccgccgtcggcgggccgtgcctcgaagcaggtggccgcgggccgggcctcgccaaagaaggccggcaagagcaaggggcagaagtacggcagcgtcgccgatgtcgacgacttcgaggccgccttcgagaacttcgatgacgacctagacctgcaggcggaggaggacggcgacgaccatgtcgttttcgcatccaggcctgcgttctccccggcctacgatggtggccgccgcgcggtgccggcggcgagcaagaagaagagcgtccgccccctccacggcatccggcagcggccgtggggcaagtgggcggcggagatccgcgacccgcacaagggcacccgcgcctggctcggcaccttcgacacggccgatgatgccgcccgggcctacgacgtcgccgcccgtcgcctccgtggcagcaaggccaaggtcaacttccccgacgcggccagggccggggcgcgcccgcgccgcgccagccgtagaaccgcgcagaaaccgccatg

SEQ ID NO: 51686 - DNA, 517 bp, Triticum aestivum
  Clone ID: PAT_TA_51686
accgtgccaagccaccggggggaaattattattattattagccttcgatgcaattatcttacagtagataaaaaacataatatggtcctgcatgcacaaagcattgtcaaatttgttcctcggttcaatactctagtggtgcatccagattttgatgtctcctttcaaatttctccgtcgaagagctcttcgtaggttttgtaaatgctttgagggtgcacaaaagaatcccccctgatttgcttaacctgttttatttcagaaagcttggtgcacagttcttctggaatagaccagtcaaacagatcaatgttctccttcaacctcgactcattagcactcttgggaagtacactctgacactgttgaagaccccatcgcaaagctatctgtgccggagttcttcccaggctctcggctactgatgttaccaccgggttactcgatacgtctttcatcctgcccaagggcgcgtacgccgatagatgaaccccattggagtggcaaaacgctctca

SEQ ID NO: 51687 - DNA, 449 bp, Triticum aestivum
  unsure (1)..(449): unsure at all n locations
  Clone ID: PAT_TA_51687
tcgcgatctagaactagtcggacgcgtgggctcggcngaaggactgtctcgccgccgccgccggccgacgaggaggaggccaagagttcttccacatcgtgctggagcggaacatgcagctgcacccgcggcacttcggccctcacctccgcgacaagctcgtcgccaagctcatgaaggacgtcgagggcacctgcagcgggcggcacggcttcgtcgtggcgatcacgggggtggaggacatcggcaaggggctcatccgggagggcacgggcttcgtcacgttccccgtcaagtaccagtgcgtcgtcttccgccccttcaaaggcgagatcctcgaggccgtcgtcaccatggtcaacaagatggggttcttcgcagaggctgggcctgtgcagatctttgtgtcaaaccatttgattcctgacgatatggagttccaatctggt

SEQ ID NO: 51688 - DNA, 468 bp, Triticum aestivum
  Clone ID: PAT_TA_51688
aaaaccaggccagcaacataaaaaataccagagaaaatccaggggtacaggacaaagacaaacaaaaaaataaagggggggaaaaaaaaaaacggaaatccggctggcttctccaaaaaaaaaaagcggaattttttcttaaactaattgggtggggcactccctaaaaaggagaagaaggctgaaatccttggagcaggggcagactctaaaaagaaaaaaaaggcccatcgaacctaactatttaaaaaccgttttaagggggaggacatttgacaaaagcaaaaaaaatacccacagcatatgtacaagggggggccaccttggaaaaaataattttgcgccactgagggcccttgggccaaggcttgatttgaaagaaaaaagccttgagaagtcccctgtccagccagggggaagggggctccgccaaagccttggcaataaaattgaaaaactcctcctttt

SEQ ID NO: 51689 - DNA, 436 bp, Triticum aestivum
  Clone ID: PAT_TA_51689
ggggaaaaaaagggttttttaaaaggtggaaacagtttttccccaaaaggcccctttttgggggggaccccaaaaaccccctaaagcaaaaagtttattaaaaaagaaaaaaccggggcgggtgttttaaagaaaccaaacgaaaaacgggcgggaaaaaaaaattccaaagggggaaaagggcccgaaaattttgtttttatttgaaaaaaaccggccccttttaaaaaaaaatctcctcccccccccatgggaggggggggggaaatttgccttttttgaccaaagggggggtggacacactttcggcccaaaaacaagggaaaaaggccctggggaacccggaaaaaaaaaaaaccttttttttaacggaaaaactttgggaaaagaggaccccccccaaggggggacccccgccccaaaaagttgttgaaac

SEQ ID NO: 51690 - DNA, 464 bp, Triticum aestivum
  Clone ID: PAT_TA_51690
gactaaacccccccactcaaatggggacagaccggtcccggacaaagaggaaagacacaattacccccatacccaaaacaaaagggaagggcgaaacacccgccaatcgctaccgaaaaacaaaggccgcaggacccggggaggggttgctaacaaaacccacggcaagaacctcggggggggagcacaacaagcccacggggaccaggtccgggaggacccgcatgcccacaggcgggtccacttctacccggatgggagagatcctcgaagccaccggaccaacgtgggggggcgacatgccggaggggccaggcaaattaacaggggggggacttgggacgatgccacccaaaagaaaattcgggaaaccaggcacggccccacgggggagaaacaggacaggtgccctgtatgcaaaatcggagggggacacaacatattgggagaagggaggaacaaac

SEQ ID NO: 51691 - DNA, 448 bp, Triticum aestivum
  Clone ID: PAT_TA_51691
ggggggggaaaccggccctttaattatttcctttcagcccggggggaaaaaaatgggcctcaggggttttggccaaaattttccattttacaagggaaacaaattgggttggggggaaacaccaaaatttttttagcccttaaaaaaccgccgggccgggaaaaaattcctgaactttttcctttacaaaaaaaaacctagggccccgagcaggggccaaaatgttccccccgcaatggaagccagccaccaaaccgaccccccctgggatcgaaggaaccggttaaggggttttttaaggggggcaagggcatctgggattttattgggggaaagcttttttcggtgcttttgggaccctacaaggccttgggcaggccctacattatccccggggggggtgggatttttcaccgggctgggacttttatccggaaaaaaacggggg

SEQ ID NO: 51692 - DNA, 422 bp, Triticum aestivum
  Clone ID: PAT_TA_51692
gggttgccaaatatatttttcgttcgtaaatggccggtgtattttgcagagagcttatgtggggtacaacaaagggttgtgcacagagccttcaaaaacacacaatcgcgtccatggcccctgtaacctgtacgggatgccggggctaatagggataggatttctggctggggactataccctacttgcttatatcttgaccagtactaccctgggccgcaagcttgctgaactgacaccatggtagcaggaaagccgccgattcaaaaagtggcatgtggaatgccctccggcatatattcccccggcatttgctgttcgcgcgcataacccagcctgtatccaaagagcacccaaacttaggagggtgaaagtggtacaagctgctgaccaaagcgccctaacaacgcgggaaaaacacc

SEQ ID NO: 51693 - DNA, 554 bp, Triticum aestivum
  Clone ID: PAT_TA_51693
caaaagactaaataaatgatactcaaatacaataaaattagggcatctccaaagtggatcagcaaacagctatgttcgtggacatccatcaagcttccgtcgttcaaggcaatttaccaaaaaaacaggacacttgtcataataaaaacaaaaaaccaaaaaaaaacagaacaccgatcaatgtggcggccaacgcaaagccgtgggagccaccgacttgtgacttctttgcgtcgtcatcgtgttgcttctgtgcccccgagcctcaatctccttaaacaatcactcccgccgcaccaagataagtcggctgttgcatgtgacaaagatggttcagggatggaggcggcgctgagagcaaatccatcgcatccctttgcagatgcagggggaaactgattgacctcccaactcgtcgcttgccaactaaaagggacttgttgatttgttctacaagtatctcgaacaaacttgcatagaggcttttagcaagaatgaagttcaaatccatcccatgcaaatatcaaaaagataaaaatctgacagatgataaa

SEQ ID NO: 51694 - DNA, 452 bp, Triticum aestivum
  Clone ID: PAT_TA_51694
ggctgatacatggcgggtcgctattcattttgggcttgcttgggcccgctcgatacaaaaaagccccgtaacttccaacctgttcgttgtatttgggcctgggttgactattctaacattggcggggttgcttttaaccaggcgggggccggaaaagttaccaggggggaggggaccctggacgggggcgaaacatggcaggtgtgccagctggaccacccggagcggccgaccaaatacggcaaggactggggctggggcttctgggctgtcaacctcaaggggctcgacctgctgggccccaaggaaatcgccgtccccgcctgggacgaggccctcaacacccagcccgagcgccttatttggaacctcatgggcatgaagaacaactgctggttccgggtcaagaacaacgtgtgccccccgcacaagggcgaaaacggcctcgtttt

SEQ ID NO: 51695 - DNA, 313 bp, Triticum aestivum
  Clone ID: PAT_TA_51695
aaaaaaaaaaccaacggggggtccatgggatccaaacacaccggcttgccctaactacacagaccaaacccaaggggggaacaaaaacacacgcccttggacagaaggaacagggggggaagaaaccagacggggcagggaaaacagcccccgaatccggaaagggggcgcccctggcgcttgggcgcgtaaacaacgtccatgggggggacggttttggggggggcgtgctcggggtaggggacggggtcccggatgaccttctcaagggaaaatattgagcaccccgggggtctcctcgtaaatgagcccc

SEQ ID NO: 51696 - DNA, 587 bp, Triticum aestivum
  unsure (1)..(587): unsure at all n locations
  Clone ID: PAT_TA_51696
ccgggtcgaccacctccgttgtggtaaatgatgccgatgttttgtttatcatggnaaaaccanagattagcctatttgagctcagtgatagagttactcaatgagatcataaatagaagcatgattcaaccaatagacatcaatttgatgaaggcatngaaaaatcttattgtgttatgatatgatgattgatccaatatgtttttgccaagtgaagaaaaacactaacatggcactgagtgaaagcgatctatacaaaggcaagatttgaatattatccacccgaaagagaatgtcagatatgaccaccatcagaagaagcaacaatgccacaagtgagctctcttgtatatccatgtgctattgtcgattcagtgtcgcatatgttgagcgtttatggtgagcacttccattcttgccaattgagatggtgaggctcaggaacacttcatttgccatggtgttttgattcgtcttctgcagcaacatgaaactctcattgtaattgtacccacttatgcctgaatactgctattacttcagttagattcaagaagcaccaagtttctgcagcgctcctgcatttt

SEQ ID NO: 51697 - DNA, 581 bp, Triticum aestivum
  unsure (1)..(581): unsure at all n locations
  Clone ID: PAT_TA_51697
tgnaanactactatttcctccgttcaaactgaaattcgcccacgacttcaagattctgaagcaattaggtcaagggtctgagggggaagtctccaaatgctcatcgaactttagtgacttcaaagtgcggtaaaagaagttgtgccctcaaattttctgattgatgcaagtacaactaaaaagcattctgagcccagcgaggttacactgatggtaaaactgaaccacggtaatattgtgaagatgttcctgtcttggaacgaaactgggagtaacttcatgggccttccatcagatgcaacattcatatgcatgatgttgtctgcgaggacactgtcgtactatcttgatcaaagatcaataattgagttggacacagtcaacaatttatttctgcaaatcatgatgggcctggagcacatccacaagcagaatgtggttcatcatgatttgaacctggaaatatcttgaaagatgacgatttgtctttgaagattgctgactatggaatagctgctattaaagatttgccaaactccaaacttgatcctgataatattgggagttttccgtacgctgcg

SEQ ID NO: 51698 - DNA, 588 bp, Triticum aestivum
  unsure (1)..(588): unsure at all n locations
  Clone ID: PAT_TA_51698
cggncgcgtggggtggttctactgtgtatgtggtgttcaatgttgccaatttgcttttcttcaatagatgtgtaggaactaaagttttgacttcagaattgccagctttactttttgttggcatttatagttctaatgtttatggaatatcataacatctcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgtttttgaaaaaaccaaattttacttccccgggcttgcaaattaaaattttttttttggggcccccaaaataaaattaccgggccgggttttaaaaccgtgggaatgggaaaaaccttgggttccccaaattaaatcccttggaaaaaaatccccttttccccagtggggtaaaaaccaaaaagcccccccccaatcccctttccaaaaatttgcccaccctaaatggaaaagggacccccccctttacgggcccttaaaccccggggggtggggggtttccccccaggg

SEQ ID NO: 51699 - DNA, 575 bp, Triticum aestivum
  Clone ID: PAT_TA_51699
gctggatcctccagactgcggggaagaagaggcatgggatctggatcaggagccgtgctggtgcttgtggcagcatgtctagcgattgccccgccctgcgctctggcttcttctcgcaattattacccttttcaggtttggtctggacattgcgcaaccaaaattgcttaactccacaaatggttcatttactccaagctcacatgttgattttgacccttcaaaatcaaagtgactctcgtggcatcccaggttttctctctcgcatggagtgtgaccacttagtatctatggcacatagtaagatagggtcatctttacttgttaatgatggtgctacaaatatttcccagaacaatattgatgcaggcctcctacttcgcctggctgatagcaatctgaaggatactcaagccaaggaagggacaccttccgattgtgctggttacgcagtgaaacctgtcaaaggcaacgcgattctgctgttcaattcaaggcctgacggaatcgccgacaaggacagccagtatgaggcctgttctgtccttgaaggggagaaatggctcgccataaaa

SEQ ID NO: 51700 - DNA, 573 bp, Triticum aestivum
  unsure (1)..(573): unsure at all n locations
  Clone ID: PAT_TA_51700
cggncgcgtgggaacccaggcagcaggnattgcaaattccggattctgatattgtaattgaaggcaactgtgctagagtggtctgccagaaacacaaggagaagtcccatgccnatactgaacccaggttctgagcttgcattgtgtgactgcagctggtcaaggaagggaaacctttgcaaacatgcaatgaagtcggcaaaggtttgccgtgacaggggattggcaccgccatctttggcgctgcttcgctactaccaggcactggcaaatgttgttcattgcccacccagtgactctgtgatatgcgaccatgcaatcgcggtggcagtttctgtgagaacacagttagatgcgttgctttccgccaccaacggcagttctccagatacctcacttttcaagggtccacaatcaaccagtgacaatgaacccagagaacttgatgttcgggaagccaacattgaaaatggcagtgaagttcccgctgacgaggatagcgatgaggacagtcctgcttgcaagaaaagaaagcctagaggaccatctgatgaagacgaaatcgctacagcg

SEQ ID NO: 51701 - DNA, 482 bp, Triticum aestivum
  Clone ID: PAT_TA_51701
aaaagggaaggctttttagacatttcaaagggcccccaacatataggagggggggagacatattttaaaagggagattcattcattttacccgggagggagccattggggggaatctctaaaaagacttattttggggaacggggggagaaaatgcttcgtttcatcggacactaacggacatttccttgcagggtgggcggccccaaatttggtcaaaaacccttgccatggctggagttgccaccccgggcatggggaaaccccggctgctttctagactaaaaacagagacgaatcatttcctttccaaaaaccctgcgggataagaaccccccccgcccggaaatacttggcatcaaaatgaacaaaaggggaggtatctaaacccattttagttctaaatacaacccttttatccatttggaggacaactattttcggacgggggggggccctgacaaaacatccaatattggggga

SEQ ID NO: 51702 - DNA, 367 bp, Triticum aestivum
  Clone ID: PAT_TA_51702
acaaaggggggcaaggcccatgggcttaaaaaaaggggagaaatgctaacttttgaagaacccaaaaaaaaaaaaaacaaaacaactccaaaattggcgcccagactaaactaaataacttgccgggggtggggaaaactgaaatggcaaaaaagggggggttttaaatatgggggagaggcaaaaaggcccgcaaaaggggcccaaaaaatagtttcaaaaaaaaaaggttctaaaaaatttagaacttggggcctcagccctgggggaacactcttcaacacctttttgggggaccatcgggagcgctctttttgagccttagggagaagccccgctgggccgatatttactaaaagggggaatt

SEQ ID NO: 51703 - DNA, 520 bp, Triticum aestivum
  Clone ID: PAT_TA_51703
tttttttttttttttttttttttttttttttttttttttttttcttttttttttttttttttatggtaatttttgtttttattttttattcttttttttgaaaacaaaggggcaaccctttgggagacgggggggggaaaaaacaaacccagcctctagggaaaaaaggaaggggccgcaaaaaaaaaagggggaaggggccacccaaagtgcaaaaggaaaaaacgggagacgggtttttgtccaaaaaccccggtaaaaaaaccccaatcgaatgcccaaaagaaataacagccaccctgaaaagggggggaataaatccccgggggaggcccggcccaagggggagagcccaaacgaaaccccccaaaaaaaaaacgggtttttaaccggggcacaacccctaaaaccggaaaaaaaaaacttggtgagggggttccccacacccaaaaaggggcacaaaccggccctgaaaaacgggggaaccggttgaaaagccaccaatcaaaagtttggcacg

SEQ ID NO: 51704 - DNA, 540 bp, Triticum aestivum
  Clone ID: PAT_TA_51704
ttttttttttttgttttttttttttttttttttttaccacaccaatttcaaggataccattgcaaagtgaatccacaattctctgaaagtgtccgaagagcttaacagctggttgttactgtacaccaacattggcttaggtgcctgacaactctgcatagtagcctgagcaagaatactgacgaaccccaaagaattttgcctactgtgcccttagcaattgacctcttttagcccatgtgaaaagtccacgaaagttggatcagcaggtgcatagcttgtagctacgccgaacaccaagcctggcattatgatgcttgctcttgccaacaaaaaattgaggggccttgatcttgctaagaaaatacttggcgggagactcaacattgtttttgaaaacatctaagatatacgctttaagcttggctgcgaggttatttatggataccttcatggaaaagataaactggttcttgtgaaaatcatgttgatcctgaatacggacggtgtcaacattgtcaatcaccttaagggcctggg

SEQ ID NO: 51705 - DNA, 522 bp, Triticum aestivum
  Clone ID: PAT_TA_51705
atcgccgaatctatgttacattactaatactattacagctcttagaaataataagtccaaaattacacaagcattcgtgtggtagcatcagtagagcaacatatagtaatcggtaggctcctcagaggccgaggagctggcagttctcccagagcgtcttggcagaacgacggagctgcgcagcctcggcctcggtgaggtccatctcggcgacgccgaggacgccggcgcggccgagccgggccggcaggctgaggaacacctcgtggccgtcggagatgccgtggaagcccgcggcgagcacggagaccgggtgcacccggcgctggtcgcggagcagggacgccgcgaggctggcgacggagtagccgatggcccaggatgtgtagcccttgaggccgatcacctcgtaggcgccccccaccacggcccgccggatgccctccagcgccgcctcgtcgaagctccggtggctgtcgcgcagcgacttgagcgccggcatgccgcccacgctgatgctcg

SEQ ID NO: 51706 - DNA, 518 bp, Triticum aestivum
  Clone ID: PAT_TA_51706
aaaaccttaaacttcatttaataaacataacaaccatacatatacaggttgtgccacaaaaggagcacatatatgtttctaggtgtgcgtcacaacaaaaatataagtggtgcctcaaggagagaagtatatatgtttctaggtgtgccacccaaccaaaaaagcatatagtggctgcttatgtgccaaaacaaccaccaagatgagcagaacctgccaatgtcaccaggttcaacaaacaaggcacattacataatcactccaccaacttaattgtaggtcttgcaaacattcagcagcttgtaggtcatccaagccttcagaagtttgtagatcatgcaaatcctcaaaagcttgtagatcatgcaaatcctcagaagcttgtagatcacccatacctccatcaaccagtgtatctttggtaaacaaagtgtactctctgtctccattcaaacttctcctccgagcatgttgtagcctttgctcagctgctagtgactacttgtcctaacactgct

SEQ ID NO: 51707 - DNA, 280 bp, Triticum aestivum
  Clone ID: PAT_TA_51707
aaaaagaataaccaaaaaaaaatattattaaaaacaacctttccctcttatccgggcaaaagggggggatccccaggccgcaaccccatcacgggaaagaccaccactaggccgggggggctagcccccccactaaacgggacgaaacaaacaggcccgacccgccggaattaaaaggggggggttccatctctaaagctgggcccccaagaccgcccccagggcaaggacggctcaaggggcggggaaggggaggaacaaaacgacgggggccacggcc

SEQ ID NO: 51708 - DNA, 555 bp, Triticum aestivum
  Clone ID: PAT_TA_51708
tcgcgatctagaactagttttttttttttttttttttttttttttatcacccaatagtgttctattatacaggatatgtaacaagatgtgacatagtaacacgcagtatatattacagtgaactgtacgtgctgccaccacaccacaccatagctaacagtggcggccagtaccacacaagaacagaaaagaaaaaaaaaacagaataacttcacactgaagattccccttgaagagggcaactataccaatcgcgctgatcatttgtatgcgtatgagcaacccgctgttcattatttgtgctttgatgaaaccacatatttccaggagtttggttcccatagtttaggccctgtcagaagtagtaaaaataaccttcacatgtaatgttgttgctggctcctccgcaactgcagctcagctgcgagctgagagcacttccttcttgtttcctctagttcatgctccagctcgccaatcgtctgcttcaactgtgtatctcgttgccgaagatcttcacgccttgtgaacagaaccaaattttcttcactcaac

SEQ ID NO: 51709 - DNA, 489 bp, Triticum aestivum
  Clone ID: PAT_TA_51709
aaaagcttatctgtgcaccctagacccgataatagcatttaaaactactgaggaagccttgaatcacagacacacggcaggcgatcctactgcaaaacagtagccgaaccaacggcggcacaacaatgaggtctcaggcggactcgatattggacggagcacgtccggaaacggacacaataaccgggctcgcatcgcaaaatacgccagaggggattaaacttacaccctaccagtcgacagaaattacacccatattcaaaaggttccgtcacgaggagagggaaaacagaaccaatgttccaacaaaacttttgtggaagcacaaacggagctttgtctggacctaaagatattgccgaattcaagaaccccgacaacccgtcctttggaaaaacctaacacctttgatggaagcctggcgtattcccatggagtgatgcaaggaccaccatgagggtcacccgttgctgtgacaaacccaaccca

SEQ ID NO: 51710 - DNA, 562 bp, Triticum aestivum
  Clone ID: PAT_TA_51710
gcgctgggcctgcgcgagccggcgttccactggtgcgtgcgcgacgcggtcaccgtggggttccgctccccggttggcccaatcgagcgcccgtccactgccaggagatccccgtcccagacgccgtcgccgaccccgtcgccgccgccgccgtttcagcccaccgctggccgccatctgccgtccttcctccatccaggcctgacgccgctctgctactagccgcccgcccgtccgtccgttaattagtagaagaaggtgtagaaaagcaaaaggggaattgggccatggttgcgtgcggggtttgtgcactgcaggaggaggagcagaggacaagcgaaggcgacgactccagagaagagaagagaagagaagagaggaggctgcctgcccgcctgcgcggtgcccggctggacacgttccggctggaagatttctttctgtttatgttccgtgttttgctggggtggttgggctgtgctgtgctagtgctgtgtgacagctggtgtggtgcgcgtgtccgtccgggctgttggacgagtccgcagatccatccctccct

SEQ ID NO: 51711 - DNA, 531 bp, Triticum aestivum
  Clone ID: PAT_TA_51711
agggcacgctcatctctgcaattttctattgcaggggacacgccaaaaccacgtttcagtatttgattgatatgatatcgcagcaacttggcactggagggtacatctcgaagtgcatagtattaaaacagggatagtctacctttactccccgggccaagtgctcaatctaattcaagtgttaagggggtgaatttattcgaaatcctaatggcccatctctcgctctcgctcgaaacaaaccatcatcacccgtctccgagcagcagcgacttgacgatgacgtcgggcatcccgtcggcgaccgggaacaggtggccggccgtcgggagctcgtggtagatcacccaggggagcctcttgctgatgtaccgggacagggcaacaggcacgaacaggtcttcgactccgtgccacaggtgcaccttcacatcgtcgccaacgccggcgaacgggttgcccggctgcagcgggctccatccccacttcccgaacccgacgatcatagtcccggtgcagggaactcgtgct

SEQ ID NO: 51712 - DNA, 593 bp, Triticum aestivum
  Clone ID: PAT_TA_51712
tccggatcttcctttcctaattgcagcgaagtttcgaagaaggctacagcgacagatgcatatactgtaggttagaccgttgttcacggcgtgcacaagttggatacaatcatacaaaacacctctgtttgagcgaaagtcacccatttgtttgtttgtttgttgtatttcgaggagagcatataagaaactcatatgttgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgtttttaaaggatcaaattttacttccccgtgcttgcaacgtaatggtttttttttggggcccccaaaattaaattaattggccgtgttttaaaaacgtggggattggaaaaaccttgggtttcccaaatttaatccctttgaaaaaaatccccttttcgccagttgggttattaccaaaaaggcccccacgaatcccctttccaaaaatttccccaccttaaatggaaaatggaaccccccttttaccggccatttaaagccgggggggg

SEQ ID NO: 51713 - DNA, 575 bp, Triticum aestivum
  Clone ID: PAT_TA_51713
ctccacacacactagccctcttccgcccggggatggcggcatcctccccggcggccacggccacgacgacccctcctctcgccgggccggcgatccaccgcggccccgccgccgcccgcctcctctcggggtcgctctcccgccgctcgcccccggcatccaccgcccaggctgtctcctcctccgccgctcccaagcccaggggcttgctcctgccatgccgggcagcggagggggcggcgccggcgcgggcggaggcgccactgaaggtgatgatctccggggcgcccgcgtcgggaaaggggacgcagtgccgcatgattgtcgagaagtacggtttggttcatatatcaactggggatcttctacgggctgaagtatcttctggcacagatataggcaagaaagcaaaagaatatatggacaatggcatgcttgtcccggatcaagttgtgacagatatggttgtatcacgactatcacagcctgacgtgcgagaaagagggtggcttcttgatggttacccaaggagttatgctcaagcacaaagtcttgaaagtatgaaaataagacca

SEQ ID NO: 51714 - DNA, 569 bp, Triticum aestivum
  unsure (1)..(569): unsure at all n locations
  Clone ID: PAT_TA_51714
gnagaagcgtggacgccgtcgtcttgctcgcggtggtgccggtggtgggcggttgcatccacccgtcagccaagccaagcatggcgccggaccacggctccaaggtcgacatctccttcgccggccgcttcaccgccagcgccatcgccgcctgcttcgccgagatcaccacgatccccctcgacacggccaaggtcaggctgcagctgcagaagaaggccatcgccggggatctcgctgggcccaagtaccgtggcctgctcggcaccgccgccaccatcgccaaggaggaaggcgccgccgcgctctggaagggcatcgtccctggcctccaccgccagtgcatctacggcggtctccgcattggtctctatgagcccgtgcccttgcaatcgctgtggccaaccccactgaccttgtcaaagtcaggcttcagtctgaagggaagctggcacctggtgtgccgcgccgttatactggggcaatggatgcttatgccaagattgttaggcaggtcagttgttgcttctgctcttgttttgcaagctaactgtggattgttacatttc

SEQ ID NO: 51715 - DNA, 565 bp, Triticum aestivum
  Clone ID: PAT_TA_51715
cccagcgccgcaaacttccagcttctgaacccaccgaccaatcgtacagtacattcatttgagagtgatggggagctacggcggagacgatggcggcgtggagctgaccgagctgacgctggcgccgccgggcgagagggcgcggagggcgaggcgggcgaggaagagcgtcgaggcggcggcgttcgtgaaggtgagcatggacgggacgccgtacctgcgcaaggtggacgtggcggcctacggcgactacctcgagctcctccaggagctcaacgccatgttctactgctgctccatcggcctgatggacgggtacggccagtgggagcacgccgtggtgtacgaggacggcgacggcgactggatgctcgtcggcgacgtgccctgggagatgttcgtgtgttcgtgcaggcggatgagagtgatgcgagcgtgcgaggcgagagggctgagcgccaacgcgtgacagaccaatttggtgccgcagatcttgggtacgtgtagatatgatctgaacctcttgcatgtcgctccagtgggtgtgacagcgatgaggaaccaa

SEQ ID NO: 51716 - DNA, 455 bp, Triticum aestivum
  Clone ID: PAT_TA_51716
cgccggcgctctccggggcgccgggctccggcactccctctttcggagggccggggcggcctttggagcgcacgagagggggcgagcagccccagcaccacctgttgccccggcggtagcccctaccccggttcttggtgagcccatggacttgcacgactgctgtggggggggtgctgaagaacccggtgctctgatggccttgtgaaggggctccgtgaggctgccaagtgcgttgggaagcatgctgctgagctctgtgtgctgcctgtcgattgtgaccagcctgatgacgtgtggctcgttggggcactatgcgctgggcacacggttgaccggcttactgcgccgcgtgcgttcactctgggggagcgggccggcctttgcgcgcattggctctgggggcgaggcaaggacagctgggccctgctcttgcgttgctgccaagggctccc

SEQ ID NO: 51717 - DNA, 205 bp, Triticum aestivum
  Clone ID: PAT_TA_51717
aaacaacaaaggggttttttattggcccccccggaaaccaacaaacaaacaaacaaggggggggctttcgccaaaacagggggggttgggaggaagggacccaactggggccccccgggaacaacgggcaaacccacagtatatgcattgggggggggaccctttttaaaaacttcggtgaaatttaggaaaaggaaaacccgga

SEQ ID NO: 51718 - DNA, 532 bp, Triticum aestivum
  Clone ID: PAT_TA_51718
gataacaaatctagttcaacattaatcctgcatcccagcaaatataataacataggaatcacccaactagttcacattctgattccagcatggatatactaaatagttttaccctgagcccaagccactgagacctacatgtaaccatacacatggcgataggtaacaatatatatagatactaaatatgataagatgcaatgatcattacctacacaactaagttgtcatgataatatctttgactgctttcagctcggccggcaggaagctagcagccagctccctgagaatagatgggcagctattcttcaaatactcgtaaccatcactcgccatcatcgcctccaaattggaaggcgaagtgaggaactcaaaacaggcatccttgattctatgtaagccgtgatgctcggctagagccaaactagtcgccacgacgttagagtcaatgaggttgcacaacttctcttcgcatatcagcttgagcctctcaatgttgtacctgtccgccgcaacaagtagatgacca

SEQ ID NO: 51719 - DNA, 482 bp, Triticum aestivum
  Clone ID: PAT_TA_51719
ggaagatctataaccatcaatataattggaagatccccaagttggggggggggcagcagagcttttaaaatccccgaatggaaactatcctctacattcatggtattattggaactccaaacaagtttcaagctgccaaaatgacatttctgatgcagcttcgattctaaggattgatccttttttgggacattctcaacatttgggatgcttaaactgccacgaatcttgggcatgtccctcaattggcccaattcatatccctttttttttggcacaaaaaattcccgaaaattttgaagcaaagttagattgccaatgttaggaatttgaggcagggctttgtatgaaaggcatgtcctaccatcatgcagttcaatatgtctcaaccgccttaaattggaaaaattatttggcaaactctcaactttgtcatttaacaaaagtaaccgaaaaaatgagtttatagaaaaacgactaat

SEQ ID NO: 51720 - DNA, 450 bp, Triticum aestivum
  Clone ID: PAT_TA_51720
ggaacactacaagggcccaaaagggcccagccctttattgtttttgacaaaaagacatttttgcttacaacaggggccctaaagaagctgaaaataaaaacaaatccctgctttttataaaagagggccccaaacataaaactgaaaacccgatcgggtccaccctgggccgcaggggatacaataattgccgacccctgggacaaaccacttggtccggggaaacctttgtagcaagccacaaactccaatttggcacaaaactgccttccttttggcattgggggtgggaggaacaagtttggccccccttcgaccaaaggaatcgatggattgttggaggaaaccggggtcgaaactccttcaaatccaccttgaataagcttaggatccccatcaccagtttccaacgagataggggaagccctttcccaaatgcggggataacac

SEQ ID NO: 51721 - DNA, 549 bp, Triticum aestivum
  Clone ID: PAT_TA_51721
aaacaactgtcttttttttaggtttagatccaggggtcaaacatcattatgtaaacggagaatcactattccaacgttagttccacttctactctggttgcgacagatcaacactcttctgtattcatgaggcaacttattacgatcactcccttagcatgcaacgcatggggtgaactaatatgtgtgtacataaccgaagaacgctccgctgacaccgatggcactgctgtattttcttacggagcctgcttgactggggccctctgaaatacatgtatactctgtgattaacctaaatgctaccaattgtatacagagaaaacaggggaaatccaccaaagcaaggtgtcccaactaatgcttgatcacagaaggtttaggttgcatccagtctaccccttaatgactttcaacgaaatacgatccacggaccaatggttgttattattcaaaagccaatgttgagcatgcaacagggcaaaaacctcccaaaacttaatgcgctgtcagtctctcattgcacagtggcagcatgcctataccaca

SEQ ID NO: 51722 - DNA, 469 bp, Triticum aestivum
  Clone ID: PAT_TA_51722
gggaacaaaattagcccctttggtggtgggaaacacacatgcgctggacaccatgtcaccattcgcctccaccgcacgcagaagcggggggggggactcctaggcctacgggatcgatgctaccacctggggaacccctttttgccgggggcggccacggggggggcgccctcaaacttggggggggcccaagggatggtgatgcccccggggggctggaagccgaaccccttcttggcctcccgcagaaattccccgaacatggggggggtgaaggacaccacgggcaccacgtaccgcaggggtttcccgggcccgccgccgccgacgtacaccggcacctggcccttggggggcttaaccgccttgagcgtttggtgcccgcggtccccccggccgaggctgaggagccgcgccagggacttgccccaccggaggaccggtgccagctttttggcctccctgccct

SEQ ID NO: 51723 - DNA, 468 bp, Triticum aestivum
  Clone ID: PAT_TA_51723
tcgtgatctagtaactagtgccaccaccaggcttccactcctcgcccgactgtgcacatgtcgacagcctaggggcctcctcggcgcctgcggacacctaggcggccgccacgcgccggcgcaggcgcctactcgactaccaacagcgggctatgcggccgtgccctccagacctttgccaggcggtagcccagtacgcctgcacaagctctaaggcgcccgactgcgggatcgaggagctgaagctggatcgggcgggaggccaggaacgacatcctgaaagaaatgctcaacgggctggagatcgccctggacaaggggaaggtcgacttgactgacaacgttggactgggagaaagctccgagcccaaggaggtctgtgcgggcgctgacctaagagaaaggaggccaatgggcccttcttgaacaccgggaatacgttaatacctcttggagctacattttgat

SEQ ID NO: 51724 - DNA, 450 bp, Triticum aestivum
  Clone ID: PAT_TA_51724
gggggagggaagacccattgaaccctcattccaatctgaaacccggctgaaaaaggctttgttttccaaaaaggcccctggttcaggccgcatttgtcacacatgcgggggggccaggtacatgcctttgattcaaatcttcattcttggggaaacaaaaagaagggggattaaatatttcattatttcttaaattttcgggaatcaggaatttactttacccaaaaaaacaggacgggctgagctgacacggttgaacccgggcaacaacgggttgggtccccgggtaaaaaaaggataacacttggtaaaactggcacattaaggaccccctttgcccgaggatttggggcaatgcccccatttttaaccctcttttagtcttggcctcaaaaaaaataaaacagttttaggtggctgcaaattaaaccggcaagggatgggggatgc

SEQ ID NO: 51725 - DNA, 518 bp, Triticum aestivum
  Clone ID: PAT_TA_51725
agtccaaaattccaattaaatcgataccacgaagaaaacccaatagttaagagggggtttgggtacaagcaagccttggtaagaaactaattaacaaagtacatgacaggtcagtttggactggtccaaatttggtgatagcgcaaaataaggaacttactcgagcacattcattaatagggcagcgcaaaataataaggaactgacttgagcacattcattcatagggcagcaaagggaaactaattcgtttttgcatccataattgcatcactttggaccacattactggcaccggcgttaaccttgagactcttattttggcgggcacatttagccttctcctgggaacttcttttggaactgaacacttgtgggaccttaaccaacatttttttagacttccgagggttccgcaagactggtttatagtggccttggcaatctcatcactggaatcgactagattactagttagaggtcccttttcgacagaactgaacatactttcaggggat

SEQ ID NO: 51726 - DNA, 476 bp, Triticum aestivum
  Clone ID: PAT_TA_51726
ataactgcaggcaaacgccccgttgatgtaagacagggggggtaccactgctcacctggccaaatgtgtttcaacagggatcgctagcgtcccaaccaaaaggtgtaaacacacacaaggcctgaaaaaggtgcggcattgtgatgaacgtttttgatcactgcaactacaacagttaaggtgcaaaccaaaaaggcttcttaccttggggaacgggcctgtctttgaaccatgatgggacttcttacaggacttcatcagtgatgggatcaaccgcaaaatctggggaaggatgcctaggtcaacatgaagaaatcatacttccaacaaattaacagcgctttctaaagcctctgatactaagctttcactttctgtgaccacaattacctccaaatgcatgaacccatatataactccttataaccctttgaagctaaaacgcaggtttaatggaaccatggagcacatggcca

SEQ ID NO: 51727 - DNA, 516 bp, Triticum aestivum
  Clone ID: PAT_TA_51727
acaagtcagtatgtagacgtcttgagatttcacaaattgataatgaggacaacacacggtcatacacttaccagcgaatctatacaatgtggccccacactaggcacagatgggtggctaactggtgctcttatcatttgcttggtgccgaattacgatgcaaacgggccgtaccgggccttgttggatgaacattaaccattgctcagtggtttaacggagatgatgattacaacttctgatggggcggaccttgtatcttcacaagccatctgcattaattgtctgaacattgaccaacctaaattgtagcactcatgccttggggcactacttatgaatattgcaataggctgagcgattgtcacacatgtctacaagaacttctggcttaaggctgatgaaaaagtgggattgctctccaaataacaataaaatctgcttgcacataactgttcttaatatcaacaaacttgccagaagttaacatattccgtgcgtacaatgcattcagga

SEQ ID NO: 51728 - DNA, 546 bp, Triticum aestivum
  Clone ID: PAT_TA_51728
gggacaaagtaattttctattgtcatctgaacacaaataagttagtgcaataatcatgcaaaaacctgatggttggggcaacacatacgaacaaggcgacctataattagagaaacaaagtggcttggtataatgttacacttctctgtatgcaccgaagcatcaggtcttgccaaaaagctttaaaatggttggtgtctcgcatctttcagtcttcttggaacgtcccttgcatatacccattggtcagagttcataaaatcgttatagtgaataatgctataaaactatagagataaaactgaaagcaagaactgggcttatcacatcctttactggcatgcatgatcatgaattttggaatcagtaacctaacaattaagtggaatacttataaaaaaaggcaatgggttaatctcaaacaatatacttgcaggaagcttgcagaatgaactgcttgagcttaaagacatattttacaactacaaattgtagttggcaaaacattaaaacatggatagattcttaccaacaacccgctgaatg

SEQ ID NO: 51729 - DNA, 489 bp, Triticum aestivum
  Clone ID: PAT_TA_51729
gactcttagcggggactggttgccatactcattacatttcctctagctcttacggctgcttaaacagctcggctttcctgttcttccaacaactgctttatacctagagcctcaccctgctggccatacgctgtcgtgccgacactcaacatcccatgactcataagatcgtggttcctggtcttaataaatgcccgcttctaaatgttgtctgcgttcttcaatgcggtcaagtccccatcctttctctgcaacattcacctgataattgacagcagctccctcaattatctggatcccagagctccaaaaaccgcattgcatatctatctattggccgaatgtgattctcaaaaccagaactcccttgccctgctgcatctcgctgcaccagccatttgcttaacatcagcgagcttctacatttctccgacacctgcagacaatgtaagagccttttcttcacttatttggctcacacgtaaacca

SEQ ID NO: 51730 - DNA, 411 bp, Triticum aestivum
  Clone ID: PAT_TA_51730
ggccagtgcagccattgttgtctcagcccttccgtagtgtcatctgggtacttgccttacatgctgtaaattggcttatggtagtgaatgtgcgtgtctgtctggttgttctgttgttttctgcatcgtatggaggcctgtcgctgatggttaggttccatgccttgtcttcctgataggttattgcctccactaatgtcgctgtagtgctttccctagtcatagggatggggttgatggggttgcaatattctcagttcaaaatatgtgaactagtatgttatttgttgtttgtcatgtcagttggatctgtattatgttgggacataaaatggtaaagaaaccctataaatctgccatctatctttaattgttggatctataaaaaaaaataaaaaaaaacatactgac

SEQ ID NO: 51731 - DNA, 569 bp, Triticum aestivum
  Clone ID: PAT_TA_51731
gtggtagtagattggggcgccgcctacctcgcgccgctgctccagttcctcaccgacgcctgcgtcgtgctcttcctcatccagagcgccgaccgcctcatccagtgcctcggcagcttctacatcaccgtgaagcgcatcaagcccaggctcaagtccccggcgctgccggacgccgaggaccccgacgccggctactaccccatggtgctcgtgcagataccaatgtgcaacgagaaagaggtgtatcagcaatcaattgcggccgtctgcaacctcgattggccgaggtccaacttcttggttcaggttttagatgactccgacgacccgacgacgcagtcgctcatcagggaggaggtcgcgaagtggcagcagaccggggcccggattctgtaccggcaccgcgtgctcagggacgggtacaaggccgggaacctcaagtcggccatggcctgcagctacgtcaaggattacgaatttgttgccatctttgacgctgacttccaaccaaaccccgactttttaaagcgcactgggccacatttctaggacaatgatgaattggg

SEQ ID NO: 51732 - DNA, 414 bp, Triticum aestivum
  Clone ID: PAT_TA_51732
aacaaaattatgggattttacttttatgaggacccatgcttggatccaaaattcttgggggttgggaacccccctcaatttgacccctaaattccgatgttttggagaaaggtgcaaatcaagcataccttaacattttttttggccttttcgtcgggattagttggccggccgagggatttcatcaccatgagtccccatccacatcgaaaatcaagaacaaaacctaatttactcactaataatgaacgaacaacgggagctaggctgctagtataatttaaatagggacacgtttcatcaataattcacggggcaagcattatcatgcgcgtaaactcgttgaaacaaacaaagccgtcgccgtcggggtcaacccccccgatcatgcggggggagtcctaaacggaacac

SEQ ID NO: 51733 - DNA, 457 bp, Triticum aestivum
  Clone ID: PAT_TA_51733
gttattgtgagttttatatttgtttactaaacttttagtgtttgttcagttattacaggtaaataccttttttactacgggtatttgtacattataagttggacacagccaaggttttgggggggaggccgaaaaagctgaaataacggcagagggggagggagggaaggcccgctggctcaaacacaacaaaccctgtgagaagaggaagggacaaaggaaaaaggtacaaaagcggagacagggacaaaaaaagctggagggggggtttaagcactaaaacaggggggggtggcactccaggggtaagaaagaaagggggcgcgcccccctgataaaaaaacaggggcatgggcccagggaacaaagccttaatgggcagagtttgcgaggggaccgcacgggcaaaattccatactgcgcccgcgagccacaaagagattcaaaaggacgcacc

SEQ ID NO: 51734 - DNA, 442 bp, Triticum aestivum
  Clone ID: PAT_TA_51734
gaaaaaaaaggggaaggtttttttccaatggggagggggtttttataaattaaaaaaagggcccccaccctttttccggggggggggaaccccaaaacaaaggaacccaaccccccccaaaaattttttggggaagggaactaaaaagccccccccaatttaaaaatattgggccaaaaccccaaaggggggggcttggggggaaatttaaaaatttttttggggaaaaaccctaaacttcctttttttttggcccaaattttaaaaaaccccggccataaaaaaccgccttgaaagtttctttggaaaaaaacccccctttgtttttgcaaagggggaaaaaaaattcccattttaaaaaaggccccccccgcccaggaaaattttaaggaccccgggtggtttaaaaaatcccccaaagctttttgcccgtaggggaaaa

SEQ ID NO: 51735 - DNA, 293 bp, Triticum aestivum
  Clone ID: PAT_TA_51735
gggggggggggcttttccttaagggcgggggtttttcagggggggctcttttttggagggaagaaacggggtgggggggggggggggggccgcccaggtgggaccttgccgtcggggggggggaaccatttgggccggagaaattggcagggggggattaccgggtgggcataggcttggggggggcagggggactggcttcctttggggacggaaggggggggggatattgggggggggcatttgggttggagaaaaggggccctttgaagaccgggggccattgggggggg

SEQ ID NO: 51736 - DNA, 534 bp, Triticum aestivum
  Clone ID: PAT_TA_51736
gagtgataagctcataaatatccccttacaacaacgggatggataatacagatactgcctcagagaaaatgagacgtaactggtgttctttttattgccacaaaagacctgcgagaagagttcagcagagacactacctatgcggtggaagactgaaacatactagaaagaatagccgaatcggcttctggagttcaccagtgccctgtttaaatccggttactgatgaaagaaagagccacaggaacatttgaacaaaacattacaggcgggtctgttcagacctagctccatctcctcttatcctcttcttcatccactggggtataccactctggccgcccctttgagctgctgtaccggtagttcaggaagagctcttcgtcacatacggacctcgtactcactagcacaagcgtcctcagaaccggtgactctggacttgaaccagaaggagccaaacctcttcattgtaaccggctcttcaccaccaaatgcaatgttcgggatgtatgctctcatgtccttctctga

SEQ ID NO: 51737 - DNA, 309 bp, Triticum aestivum
  Clone ID: PAT_TA_51737
gaggcctaaataatcatgtttcaatatcaacttaaacataagagggggcaatgtttttttgcccgaacgaaaaactggggaacggttattgaatccaccggccaatgggggacacatttttcaagccgaatagtgggggatctaaatctatcatttaggcgaccccctcaatcttgggccctgggcccctgttgccccctgggggactgggcggagcattcttattcatgccaccagggattttagggccgggaccctgggacattttggggaagatgggggtgcaaaagccccccaactttttcattt

SEQ ID NO: 51738 - DNA, 532 bp, Triticum aestivum
  unsure (1)..(532): unsure at all n locations
  Clone ID: PAT_TA_51738
gagtataagctacaattctatagacactgtattccaggagtacaaatattctggtgcaagttcattttgactttctaatactacagatctgttaaagagcatcgaaacggaaaaggagctgaaaaaatgagctgctaatatcaccaacggaaaatcacatacacccaccagaaaggcaacaccattggtgcttcttcccatgcaagctacttggaaaatttccttgaggtaggcctcaaacaactagctgcagcacaaagtgacaaatgggcagttcttatgcaagaacctccttcagcttggccttctggtcgtccgtcagggttttcgggaacaacacctcgaacgtcacatacagatcgcctttcttgttgctttggtgcaatggcatgccctctcctttgaatttccttacctccttcggcttagtgacaccctaacaatttgtgatggagcagagtagattagatgcagatgagcctagtggcctacaggatgcaaaaagaatcatttnagggctcctttgattcaa

SEQ ID NO: 51739 - DNA, 552 bp, Triticum aestivum
  unsure (1)..(552): unsure at all n locations
  Clone ID: PAT_TA_51739
aacatanaaataaatacattgtaaaaacccaagggaaaaacattgtacgatacgngagtacatgcttgngatgatgtngaattttataggtgtactaacgtactacaaatgcgctagaggtccctgtgaaatagttgatggacccaatcagcggcttagaggcaccaaaatgtctcaatctgtaaacaccggatgtggcatcttcaggaactgtccactccagcgttgcaaaactcattggactcaccggcaatggccttgaccacctgaagcgcagcgaccaatcgtcgtcatcatagacaggaacccaatcgcttccgccatccagcttctcaacgagcgcgaaagtgccgtcggtgaggagatcattccttgggcaggccgagtagaatgtagcgttcacaacgctgcccttcctgaaggttgagttcgcagggacgtctgacctgacatctccaaacttgacgccgggaggtgtctcgtcgactatgacacctgggagcagaccaatttgccggtttagtagatcaggaggctgcagatttgttggaa

SEQ ID NO: 51740 - DNA, 444 bp, Triticum aestivum
  Clone ID: PAT_TA_51740
aaaacattgcaaactccccaacgatgaaggctgcgggcccaaaaagggcagggccagactcgcaccagcaaggggggaacatagcaaaaacagtacgccgttccaacaatgaatggggaaccggggccataattttcccgacaccgggcaggggaaactttaaagcctaggttccgtcaaaacaaaaactggcaagcttagcaataacaacaaacgggatgcgagaacagtcccaaaaagtaaaataccgggctggccaagcacccccccggagccgggggcgtatgctgaatttaaaaatggggcgggcgtagcggggacataggaggggaaaacggcctaatggaaccccaaggtgggaggcgcgggcccaacatatgagggggggcccaacccggggggggttggggccaaccccaagagcttgcgccggggggggcccaa

SEQ ID NO: 51741 - DNA, 459 bp, Triticum aestivum
  Clone ID: PAT_TA_51741
ggacagcaaaaggctattggtaacgggtagccaaaaacaggttttggcaacttatctttttggccaaaaaacatactaagctgaataaacgaacatcaccccaataaacaaacccacaagggactaggctggatgaaaacatcaaagtattcccccccactggctggatgcaagttctttgggaatactaggagaaaaaaacattgacgacgaacagttttccatttaaacgacaattttaccaggggcatggccattgatactggtttgccaccccttgcctggattgttaaaagggaacttggagtcaatcaccggtttaagcttgccttccttgagcaacccaaccaaaaaccccaggtcccccttgttgggcaaaaggaacaggggcaccaggcgctttttggaaaagtcaccctgggcaacgcaaatgtgaggatggcccacaaggtggggggg

SEQ ID NO: 51742 - DNA, 605 bp, Triticum aestivum
  Clone ID: PAT_TA_51742
tattacctacttagtacagccatggcccccaccgtgatggcctcgtcggccacctgcgacgatactttccaggggctcaagtccaccgccggcctgcccgtaagccgccgctccaacggagctagcctctgcagcgataataacggtggagaggatcaggtgcatgcatgtgtggcccatcgaggcattaaaaagttcgagaccctgtcctacactgccaccgttcaccacggacgccctgctcaagcatgtcaactacctgatccggtccaagtggatgccttgcctctagtttagcaaggatgggtttattttcactgagcacaacgcatacactgggtactacaatagacggaactggacaatgcggaaactgcctatgtttaggtgcaccgacgccacacatgtgatcaacgaggtggaggatgtcaataaggagtaccctgacgcgtatgtgcatatgatcgcgattcgacaacatgcaccatgtacagtgcgtcaatcttaatagacttcaatccaccggggctacgaggagtccggccaagcctaaacaggtcactcacctacggccacatataaagggccattgctgttatgacaac

SEQ ID NO: 51743 - DNA, 596 bp, Triticum aestivum
  unsure (1)..(596): unsure at all n locations
  Clone ID: PAT_TA_51743
caggcttcgtttcctccggcgacggcgngacgagcgagagagtcctcggcgcggccgacaaccggctgcgggatcgcgcgattcagccggcgccaaggccgcagaactagcggcaccgcaccgcgccgcacgccatggcaggtaataacccaccaccaaagccatgggaacgtgttggcacttcatctggtccagcgcctttcaaacccccatctggaggcagcacaagtgacgttgttgaggcctctgggacagcaaaacctggggaagttgtttctgctgcacagagcaatgctgctttcaacgtgaacaatccagttgcagggcctgtgcccccgcgtccctggcagcagcaaggatacggaaatacttatgggggttatggtgccagtacctataattcatatggtggatttggtggggcttatagtaacggcgggctatatggaaataataacatgtattcagggtatggaggtggttacggcagttcgtacgggggctctggaatgtatggtgggtcaatgtataataacgggatgggaaacccatacggtggtatgggcatggctccttacaatcagggcctaattcat

SEQ ID NO: 51744 - DNA, 547 bp, Triticum aestivum
  Clone ID: PAT_TA_51744
cccagcgtccgcccagcgtccgcccagcgtccgcccagcgtccgcccagcgtccgcccacgcgtccgcccacgcgtccgtaaaaaaaaaaaaaaaaaaaaaaaaaaaaaaaaaaaaaaaaaaaaaaaaaaaaaaaaaaaaaaaaaaaaaaaaaaaaaggggggcgcgtttttttaaaataaaaaatttttttactccgtgtttgctaaggaattaatatttttttttttgttgaccaaattttttttatttggtggccgttttttaacatcgtgaattgttaaaaaaattgttgttattaaattttttaatttttttgaaaataatctttttttcaaatggtgtattattaaaaaagagggcaccattgttcttttttaaaattttttaaccttgtttgttgaatattgcgcccctttttttggggctttattagcgggggttttggtgtttattcccagcatgattattattttttttagcgccttattaccccttctttttgcttttttcttttttttttttgcaacatttttcgtttttttttt

SEQ ID NO: 51745 - DNA, 574 bp, Triticum aestivum
  Clone ID: PAT_TA_51745
gctcgccttcacaaaatgcctcgccacaaaggccatgaggatcattacgcacatgaacatcaatgtacctcggaccatatgagagcaattttatttcaatgctatcgtcccagaacagggcgatgccagcacctttacccaccccatcatgggtgatacagtgcttcagacctagcctccctcttattctcttgacactctcctcgcactgccgcgtttcagataagaacacgacagaggggcggtaggtgtgcactaggcacacaagttcccgaactgtcccgggatggcccaaaccccagcagttccagcacaagatcgtcatttctttatattcttttcggtctcaacacctccaaaccaagttgtgtgtgaaaagctaaaaaacaacggtttgtcaaggctttcaattaccattttgtgggggttggtttctacattatttttgtcttggcgctgcacagtttagacatgatgttatatatattgccccattagatataaatcagcagaagtcacagttgcttgaaagtgttgttaagatctgaagtttcattgttattattttcttctt

SEQ ID NO: 51746 - DNA, 578 bp, Triticum aestivum
  Clone ID: PAT_TA_51746
ggcatactcctgttctccgatttacagtacctggcccccgccgggcatggcttcgtcggctaccaccgacgcacccttccagggctcaagtacacagccggtctgcccgtcagtcgccggtccagcggcagcctcggccgattaagcaatggcggaaggatcaggtgcatgcaggtgtgggcgattgacggtatcaagaagttcgagaccctgtcttacttgccacccctctccacacaggccctacctaaagcatgtagactacctgatccggtccaagggggtgccctgcctcgagttcactaaggatggattcgacttgcgcgagcacaacagctgtcccgggtactacgacggccgatactggacaatgtgtaagctgcctatgtctcgggtgcaccgacgccacgcaggtgctcaacgaggctggaggatgtcaagaaggagtaccctgatgcctatgtccgcgtcatcggcttcgacaacctgggccaggtgcagtgcgtcaacttcatcgctcttcaggccaccacgatgcgatgagtcccgcaaggtctaaactacaagatgaaacaatg

SEQ ID NO: 51747 - DNA, 571 bp, Triticum aestivum
  unsure (1)..(571): unsure at all n locations
  Clone ID: PAT_TA_51747
gtgggnaaaaagtgggatatattggaggctgtaggcaggaaatatgggagctgggtaggagtagctcaaaatctgtgaattcgtttcttctgtccctctcttgtgatcttctccgtctgtagcgctggagtgagctcgtgatgtctccattttaggacggaggagtgtgcaagtgtgcttcttcctcttcttcttattatcatttcttttctgtttgcaccccagatatttccttttgctgcaactgttgggctccaaatctgctgtggttcgtttcgtctttgaatccggagggagaaggggatctgccatttctgtgctcggctcaccaaattcttgctcgagcttgctctttctcttctctgtgagattttaccgtcccccattttcggtttcttggaggtaatttcttctgctgtaaaactctggtttgccgctagaaagatctcgtgtttgaccggcgatgggtttatgggttttcgcagcttcctaatccctagtcctaacctcgcttgagcgctcgtgagcttagttagccgtgtgaaaatcgcggcgttgagtcttctcgtgc

SEQ ID NO: 51748 - DNA, 514 bp, Triticum aestivum
  Clone ID: PAT_TA_51748
gtgattgaatgccctgagtgtctcctgccgcctagctcatacaaaggacccatgcatcactggggcgccggccatctgctgtgaggccacgcagaggacgggatgtagggattctagtaaggatgatcctgagatctctcaccggcctcaagcccgtaaggggcctaaaagtgaccgctcactgcacctggtactggatagacggtgatctgtataagaagttaagcagtaccaaggactcatgggtcagcagcgaattcttctttaacacacttgtgcctgcaatatcagcgcatctaaagagacggacatgcacgcgagtttgatatggcgatgtcatgtccgtatacacagtcgttcgtcttacgtgctcaccacactacgattacggtgaacgatagatttgcagcctgctgaattcaacaccaactaacgtgctgagtttcggcattgaagatcatagcaccaacagatgctcagctcgcttcatgatagatctatagaacagtgtagc

SEQ ID NO: 51749 - DNA, 540 bp, Triticum aestivum
  unsure (1)..(540): unsure at all n locations
  Clone ID: PAT_TA_51749
cccagcgtccgaaacaaagccatggcatgatcgatatggcgcacttgcaggaggtggcactactgatatatggcatgtgagggcggcgggctacccgtgccgccgcggatgatggggcatgcatgatcacatcgtcaaggagacttcgtacaggattcgacaccgacgggcgtctccatggtacactcacggcctaccacgaggcgtggtgtccatgncacattgaaggtgcgactagaaactggcttgacacgaatgactatcaagcaccctgcacacggcgtaggttccaccgagctgcaaggtaaaacttatgtctgtaagggcacgatgactaagcttacacgttacggagcacactaccatgtgtgtatatgttgtgatcatatatatgtatgtgttatgttgcacacagttatatagcgtatgcatgcgtacgtgttaggcggctatcatccccaatcgtacacgcgtgcagagcttatttaagctcttatcgtgaacaaaaatataacttcttgtgataaaaaaaataaacat

SEQ ID NO: 51750 - DNA, 374 bp, Triticum aestivum
  Clone ID: PAT_TA_51750
aatgcatgacttgctggcggttacatgatgcaacttgcacctactctgatactttccacatccacacggtttgagaaattagtccagactatggccagtttctgtaacccatggctacctcactgatacatgcaatacgtcctccatcatggatgaagctctcacctaggccaatgagataatcctgctcccagcgctcgacaatactatataccacctgcatgcaccctgaccggctgcctatgatttaagaagactcatctctctttaacgctagccaagctcctcatcatcgaagaagatgctactgctaggagcacctgtgggacgaatccaatgtctagtgttgtgcactcaatgtttttgatgatgac

SEQ ID NO: 51751 - DNA, 343 bp, Triticum aestivum
  Clone ID: PAT_TA_51751
ctcctgtatatattgccttttttttgggcggaaactagagttttacttgtgattatggctcttgtgcgatataatgttttccattcctgtaaaataattcactgatatgtatagacatttccggacttcggttttaattgttgggttgggggcttgggaaagcacgagcaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcaccttaaaagaaataaaattttaattgggtttaca

SEQ ID NO: 51752 - DNA, 604 bp, Triticum aestivum
  unsure (1)..(604): unsure at all n locations
  Clone ID: PAT_TA_51752
ccaactcccgccgccgacgccgncatgccgccgtccctcctactccctacatcctctagtctaaggctgcgccttccgcagccgcgccggtccacgcccctgctcgtttcattccccgcgcgccgcctccatgtggatctccgcctccgcctccgcctcgccgccgccggacccaacggcgtcaacggtgcggcctctcccggggacggcgggggcgccaacaacctgccccaaaaccggagggatattctcctggagtacgtaaaaggtgtccagccagagtttatggagcttttcgtgaaaagagccccaacacaggttgttgatgccatgcgccacacagtgacaaatatgattgggactctgccgcctcaattttttgctgtaactgtcacaacggttgctgaaaatctggcacagcttatgtacagcgttttgatgactggatacatgttcaggaatgcacagtatcgtctggaactgcaacagagcctggagcagattgctcttcctgaacccaaagaagaaaagggttcagaagattacgcacctggnaacccagaaaaaggtgagcggggaagtgatccggtggaacaaggtcaca

SEQ ID NO: 51753 - DNA, 560 bp, Triticum aestivum
  unsure (1)..(560): unsure at all n locations
  Clone ID: PAT_TA_51753
cggccgcgtgggcggncgcgtgggctgctctccagtacgcgccggccctttcttccccaacgttcgtccttgcaactgacttccccggcctgcatgcctcgcctcgcctcgcctcgcctcgcctcaaactcttgtcggtttggatcgatcgtttcaaggaggcttaatccatcaattatccccaccatgaaccgtgaaccggccggccgtttcatgtcgcaccgccgccgcgctctcatccacctgccggcgaacgccaacagatgcagccctgctggtcagatccgctggccgccaacaggcggtatttcttgccggcccgcgagaggctcctgtccttcctccggtcaggttcggtgcacagctagctagcaggcagcgatctcatctctgctccctacgttactactactctggatctggcacctgctctatctattgcatgtgaagaggcagcgaataaatcgcatgagtgtggacgcgactgcgtgaccatggatgggacatcacctccctcgcggtaccagtaggcaagcggataatctatcctctcatctccc

SEQ ID NO: 51754 - DNA, 559 bp, Triticum aestivum
  Clone ID: PAT_TA_51754
cgccatcttgacacgtgccggcgcaccatcagcgccctggtggaggtcgaacacggccgccccaggtcgcatacgggacgtacctacgaggaggcctccgacgaggcaccgacgtcttcaagcgctcgctctaggcgcctcctgcgtgttcatcggagcagccggtggagttcgcgctggcggagagaggcgaggccggcatgcaaaacgtactgtgcatgatgcgggaggagttcgagctcaccatggcgctcgcgcgggtgcaccaagctcagcgacatgacccgcaccacatcttaaccgagggcgaccgcctcgggcgccccctgccgaggatgtgatcaacacccaacggcatactaactcccccaccggcgatcatcgccgactctgacacacggccggtcatgctagccaagtatccactgcaactcacgcaataatcaccgacaactatatacctacgacatggtcatcgccaagaggatgctagccgtgtgtgtgcggtcgacgacggagaaccgtagtatataaatcatgcgtactgacaaccggcacg

SEQ ID NO: 51755 - DNA, 484 bp, Triticum aestivum
  Clone ID: PAT_TA_51755
gcgacacgactgcgagtcgagtaggttgattgcgcgaaactgttattgaaaaaaacgggctcgcatgggtctttttcactcaggaactgggactccatgccgggcgttataccgcgcgctacacgtgggattcatgtgacgaataggccagctctgtccccaatcttgcggaccattctggattacacttaggaggacgaactttaagacatcctggtgaaatgcacctggcgcacctaataatcaagtggctttagacgcctgcgtacaacgctcttcaacgaagcggcgcgtaactgtgcatcctcgaaggtaatgctaattactcccaacggtttgcaaaaggatgaccgaactacccgtagcttgtgaaatctgtgaggcgaccaaattcaaccacgagcccgaggatactattgcttaactagacaatactaaagatgaagaggtttaaatggcacttggacctaatctgcgtaacaag

SEQ ID NO: 51756 - DNA, 551 bp, Triticum aestivum
  Clone ID: PAT_TA_51756
agggtgaggcgacctacctgagggtccttcctagggtctatggtgcgcgctactgtgatacatgcactatgcgcgatacatggcgatcgcgatctgaagacccagccccatggaacgggctgcggagccttgcggccacaccgtggaaagtccgcatgctcggcccagggattactacgcatggtcgcttgacccgtacgcgtgctatcatccatcaccccgtgtgtacctgcccacaaagcaggttccgcaatgactctcggcacagccgtgtcactactgctgcccaagccgggctccggtttatgaccccggcaccggagcgtaggcatgcccgtcctaattacactgttgatggatataacaagcttgcatggctgcgacaggtgccatgaacacattgggctgggctgcagcgctgcaactttccaggggatgtacgatgtccatgctaacaatgcgagtgccggtttcttgatgcattttaagatggatctgaattagatggatgctcatgacttagccgagaaagaatctgatgtggataacac

SEQ ID NO: 51757 - DNA, 355 bp, Triticum aestivum
  Clone ID: PAT_TA_51757
ctagttctagatcgcgagcggcccctttttttttttttttttttttttttttttttttttttttttttttttttttttttttttttttttttttccaactttaaataaacgtctggtatttcaattggtttttaaccacgtttgtccctggggaaatttttggggcgttttttcttcctacctcccggtcgggtaagtaacgggggggtgggacattgtggggtttttggggctcccatgggccaagaacaccacgtccacctttactttccgccggccagaacaaattagcccgtccgctcagctgtcgtaggggcggcacttgtcggtcttgggggcttgtttttgatcggga

SEQ ID NO: 51758 - DNA, 479 bp, Triticum aestivum
  unsure (1)..(479): unsure at all n locations
  Clone ID: PAT_TA_51758
atccattacacctatttgagngggttccgttcctaacatgtttacttccattgcaggtaacgtatttggtttcaaagccctacgtgctctacgtttggtggatctccgaattccccctacttttcaaaaactttccaaggcccgcctcatggtctccaagtcgccagcaataagcggcacaagtatgaggcgcgctttcattgtgtatgtcctttttaaaccaaatttggtgagttgttccgtctaaaatattaaccagagcgagtcatgcaggtgggaccgcgaccgtgcttgttacctccccagcgatgctgaaaaccgcgtctcgcatcccctgtattcacctgcaagcaccggtctcgtgttgtcgcgcccaacactcttctgtgcaacaagcaaggccgagagcccgcatgatcggaggctcatgcctgctggtcctactactagcacccgtgatgcagacgaatggattagaa

SEQ ID NO: 51759 - DNA, 582 bp, Triticum aestivum
  unsure (1)..(582): unsure at all n locations
  Clone ID: PAT_TA_51759
cccagcgtccgggagccatgaagtcattgagagaggagagaagagaagagaagggagtggaagtgttaccaatgcggcacctactgctgggaatggtacccctgtcaggcctcagtcttctaatccatccaacaagaagctacaaaatacagttcgaatctgatgcttctgttggccccaatggcaaggcatcccccagggaaggcgagagtgacgtcagcaagcccggaagccgacttggccgtcgacggaaagctagtgccaaatcacagaatgggacagaagatgcttggtcttgataacccagaccttggtccattacttctttaacatgcaagacacttgattgccctctgataatccgggtacatgcgctgaaataatgctctccttgcgaccaaatcatttgagaaaattgccagtgggaaagccancttgaacttggtcatttagttgcatgttgtccgctgcgattcactgcaacatgggcaaagtaccgaaaaagctttcccttgtcctacaaccgattccttcagaattcctgttgacccgaggaaggtcagggaacacgcatcttggcca

SEQ ID NO: 51760 - DNA, 595 bp, Triticum aestivum
  Clone ID: PAT_TA_51760
tcgcgaccccaattcgattccaccgcctcgcgcccgatcgatccgcgctgggttgctcactttccccctcgataggtttctcctgttggggaatttttttgttgttgagtcgattttgtccgagggtttcccttcggatcggagcggatcgagttcggaggagatgcgaatcgaggagctccccggcgattcgggtggcgggggtggaggcggaggggcgggggagctgcagctgcgtcgggaagacggcggggccgatggttgtgagctgaagctgcgtggcgaggatggcgttgtcgccgcggcggcggaggaggagaagggagagggtgcgggtagggtgaagcgcgcggcggtgggcgtcggcgcacggatgctgttctacccgacgctggtgtacaacgtcgtgaggaaccaatgcgagtctcacttccactggtgggatcaggtcgacgagcatgtgctgctgggtgctgttccattcccgagcgatgttttgaggctgcagaagcttggagtttgtggtgtggtcacactaaacgaatcatatgagaggcttgtttccaagtcactgtacgaagctcatgggattgaa

SEQ ID NO: 51761 - DNA, 361 bp, Triticum aestivum
  Clone ID: PAT_TA_51761
agggccgggctggtgggcccgcacaagtgagggtgccagcccaacgagtgctcgaggaagtactgttattggggcaccgataacaaggtactgcagacaaaattggccgtcgggcccttccacgaggagtggaggtgggagcacacatcccgtgcaaagcgtgcaaaccgacacctgctttgactggatcaagtcccaggccgtctacatggtgcccagagtatgagctttatacacgacgccattttttctgggaggcgcccaagcgaacccctacttgtgcaaatggagtaccagcgacgactgccagatgtagatagccctcttcttcctccacttcacccacgagacctgtacacat

SEQ ID NO: 51762 - DNA, 568 bp, Triticum aestivum
  unsure (1)..(568): unsure at all n locations
  Clone ID: PAT_TA_51762
ttctcaacaagnnaagcggcacagcggnaccgtggccccgnncaaccnagggagggccgnncggcgcagggcgaggggcgacgggagnncagcgcgccggtagctttccagcacgnncccaccgcgcnnncgccgccgnncagcgggccccgacgaccttagnaggnagnaatcgtgnnacgacncatcgggagggagggaaccanttcgtcnngtcgcaaccgccccagtttcttcnngtagcttttcgtaccattgcttcgcngnnttactananngtcctttaacggnntaggcncnngggcgccccgtcggcncccgtgtctttcgcttgtgaacccgcccaacgtnncttcattcnncggccgnngcaggaaccnnnagtcgaagcttacgtcttgttgccnnngccgccgagggcattgcttagctctttgaagcctgcagnngttggattaaacttacttattaacagnacttagcttaggacattgtttcgcgccgatcttcaacacttttcgaaacttntgacaattataatatttcgccttcgttttacnncttaatt

SEQ ID NO: 51763 - DNA, 356 bp, Triticum aestivum
  Clone ID: PAT_TA_51763
ggccccaatggcaaggcatcccccgtaggaaggcgagagtgaggtaagcaagcccggaaaccgactagcccgtcgactgaaagctagtgccaaattacacaatgggacagaagatgctggtcttgataacccataccttggtccatttctaccttaagcatgcaagagacttgattgcctctgataatgcgcgacgagcgcttaaatatgctctccaagcgaccaaatcatttgagaaatgtgcaagatggaaagccaagattgaacttgatcatgagtttgcatgttagggctgcaatccactgcgacatgggaaaagctacgaacaagctgtaccttgtcctacaacgatccct

SEQ ID NO: 51764 - DNA, 596 bp, Triticum aestivum
  Clone ID: PAT_TA_51764
gttggtactgggaaatcctcatttatgttggtgtcgctgatcttatgcatgttcttcaaagcttcttctttttattgcctatatgtttatttgtactaattcagtaagtttaatttatctgtttgcataatatgtcctacatattgatagagtagtatttcgttacttgattaatggtcaaatatactatttccgtatctttacaataggtgcctcaaatgaaaatgtcttagtcttctacactgaatctaccatatgcagtttagttattttataagaattcatcaccaaaactactttgttgggtcagaatttcatagacgttcctcaatcctcatcatgagattaacttgtagaagaatctattcataaccttatgatgtgtgtgatgttgggttatgttgaaaggctttttttttgccttgcttccattttcttccatgtgcattgactaaacatatgtttgaaaatgtggcatggtcaaacatttttttgccttgcttccatcttcttccatgctgatcaatagcgctttttcttgggccttgctttgagagggccgctggtccgagccatttcggtcatttttccgtctg

SEQ ID NO: 51765 - DNA, 603 bp, Triticum aestivum
  unsure (1)..(603): unsure at all n locations
  Clone ID: PAT_TA_51765
ngaaaccgtatgtttgtccttgtttagccactcagggctgaatttggatacagatttgtgtgtgaatagtagatatattacattgtntaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccaaaaaaaaaaaaagggggcgcccccctttaaaaaacccaaaacatccccccccgccgggggaaaaccttaaatattttctttttttggggccccccaaaaaaaaaaaaccccggcccccgccttttaaaacccgtggcggagggaaaaaaccccggggtccccccaaaaaaaaagcccgcggaaaaaaaaacgcccttttgccccggggcggtaaaaaagaaaaaaggccccccccacaacccccttccaaaaaatgggcccccccgaaaagggaaaagggccccccccctttcgggcctaaaaaacccggggggggggggggttcccccccgggggccccctccctttagccaccccctaagccccccccttttgggttttcccccctttctt

SEQ ID NO: 51766 - DNA, 553 bp, Triticum aestivum
  Clone ID: PAT_TA_51766
gccaacatgcaagtatcgtccaagctacacatcgctagtcaccaatggccagacgactgagcctgcgtgcgctctgtttcgtgcgcgccttggcgtcaccagggccacgattggacatggcgcccgcaggggtaagacttaaaatcagctaaaatgtgcggaaagcaaggcttgatccaccagcgacggacaaggagaagctggtgacaccacgaggcgagggggaattggaggtgcctatcgacctgtacatgcttacaccataactaggaagaggggatctacctgccctactcctgccgggcaagttcatgctgctgctgcgcttgcaagttgacgatctgagagtataaccagttccaccatagctttctagactaccaccaaatagaggccggttgggtgctaacttgccacggctaccataagtgacacatcctgataaaaaccgacaaggaggatgagctcaccgtattagctgctatacctatgtgtctttgcaacgagatacagctcatatcatattatcttcttataatgcatgcattgacat

SEQ ID NO: 51767 - DNA, 218 bp, Triticum aestivum
  Clone ID: PAT_TA_51767
cccacgctgtccgcggtacgcgcgcggcgtgacgcgtggcgcggtacgcgtgggatctgcgttccgcatctttgttgggccgcgctacctcgccctgccccggcatcgtgtccattccccactgcccgtgaaagagtctggcccggtatagcggtcggcgggtcgctctccggtcctgctgtggacttctggccatgtagctgcggctgtggtggcag

SEQ ID NO: 51768 - DNA, 521 bp, Triticum aestivum
  Clone ID: PAT_TA_51768
gcctcaagtagccatgcactttggggacccatcctagagcggtcaagaaccttcaccctccctagttcgactctcgtcaccacaccatcgaacgaacgccaatggctaagctccaggacaaggcagggcctccctacaggtcagcagcgtctcatagttcactggggagcagctcaaggtatggccgaaccctggctgactacaacatccacaatgaatccacactgcacctggtgctaactactctatggtggcatgcaccatcttccacacagaccctgcaccgacgagaccataaccctggaagatgactcctatgacaccatccacatcatcaaggccaacatccagcacaaggaggacattcccccggaccagcagcgtataatatctgcttgcaagcagctcgaggatggccaaacacttgattcatacaacatccaaaatgaatccacactgcacctggtgctcatgctacatggcggcatgcatatcttcgtcaagaccctgaccggcaagac

SEQ ID NO: 51769 - DNA, 595 bp, Triticum aestivum
  Clone ID: PAT_TA_51769
gccacgagaactttgttggaactatacaaggcttcacaagttagtacttcagacgatgagttgattctggatattataggatactggtcaggtcacctactgaggcaacaactgaaatctagtgaggcacaaagaaccccactcctaagagaggtagaacatgttcttgatagccccttctacaccatgttggatcgtctggagcataagaggaacatcgaacaatttgacataatcgagcatcccatcctacaattgacttggcagacaaatcaagatcttctagctttgggtgtcatggatttcaatacaagtcaatctatttaccaacaagaatatcagcatctcgagagttgggtgagagagagcaggctgaaccggctacctttcgcaagacagaagttggcatatttctacctgtcagctgccagcaccatgttccctccggagctatctgatgctcgcatcctatgggccaagaatggcgcgctcacaacggttgttgatgacttctttgacgttgggggatcaaaagacgaattggagaacctcactgcattagtcgagatgtaacaatatttacgtcggttatttt

SEQ ID NO: 51770 - DNA, 598 bp, Triticum aestivum
  Clone ID: PAT_TA_51770
gcgttcgtacctcctctccgccgataatacaataccatggcccccgccgtgatggcttcgtcggctaccagcggcgcaccctttcagggctcaagtgcacgggcgggctgcccggcagccgccgctccagcggtagcctcggcagcgtcagcaatggcggaaggatcaggtgcatgcaggtgtggccgattgagggcatgagagaagtcatagaccctgtcttacttggcacccctctccacagaggccctcctgaagcacgtcgactacctgatccgctccaagtgggtgccctgcctcgagttcagcaaggttggcttcgtctttcgtgagcacaacagatcccccgagtactacgacggccgatactggacaatgtggaagctgcctatgctggggtgcaccgacgccacgcaggtgctcaacgaggtggaggaggtcaagacagagtaccctgacgcctatgtccgcgtcatcggcttcgacaaccctgcgccaggtgcagcgcgacaatttcatcgcattcaagccaccgggttggcgaggagtctggcaaggccctaaactacgagttggaagcaatggacctatgtattga

SEQ ID NO: 51771 - DNA, 599 bp, Triticum aestivum
  unsure (1)..(599): unsure at all n locations
  Clone ID: PAT_TA_51771
ngagctacctaagcagnagatggcctgaacttgaagtgcgttgttggatggccagataatcaagtatcagcctatgatcaacgaagcagccaaagcaatgctgaggaagatcctgcagcaggatacctccccacacagatttgaatccatgggcaattcagataatttgctcctggagaactgtatgccaagtgctcaaacttttgacagctcttcatcaacccggaattctgcagtcacccttgcagaggtcccaggcaactcaggcatgccatatatgcccacgagctctgggctttcagcaatttgttcatcgtcaactccccctgagatgcagtgtccagttctggacagcaactcatccacacaacttcccacacaacttcccaacatgagtgctgcatcttctattccaaaggctatgacaccaggtttaagtgatatcagcattccaggattcccagatctgcatgatctcataacggaggacgcaattaatattcctgtagagaactatgcaatgcctggtcctgagtgtatattccccctaccagatgaaggcagtgatgactctgttcccatggaccccatcgacactg

SEQ ID NO: 51772 - DNA, 564 bp, Triticum aestivum
  Clone ID: PAT_TA_51772
ttggtcgcgtgggcggacgcgtgggcggtcgcgtgggcggtcgcgtgggcggacgcgtgggcggacgcgtgggcggacgcgtgggcgcaggaagacagagcttgagagagcgcgcgcgagatggcatcctgcatgatcacctcggcgattgtggcgccgacgagcgtgccctacctctccagccggggttcctacttcgtcgtcgtctgcagcggtggcaagaagatcaaggtcgacaagccccttggacttggatgcgggttgacagtcgacatcaaccccaacggcaagaaggtggtcaagaagggcatgtaccagttcgttgacaagtacagcgccaacgtccacggctacagcccaatctacactccaatagaatggtctgaatctggtgaccgctacgccggctgaacgaccgggctatttatctgggccgtcaccctagcaggcctcctcggctgaggcatcctactcgtctacaacaccatcactatcagctgctaagagagcatctacgtgtaacacatggccggatctctgcttgcatgcacgtctatgtaatct

SEQ ID NO: 51773 - DNA, 277 bp, Triticum aestivum
  unsure (1)..(277): unsure at all n locations
  Clone ID: PAT_TA_51773
gaccaggcacaaggaggccgaagcggagtcggagaagaacgcgcccccggcccgcgcacgtacgaggaggcgacccggcgaggacacggagccaccgccacaagcgcacccaaggagaaccgcaagacaaggcaccaaaagccaccagaggagatcaggcaagggagcgcagaaggccatgggaaaccaacgatatncccgcataagaacggggaagacgcaacgaagcacatnagagcagcaaacggaaatccaggaagagagccccgagggagaa

SEQ ID NO: 51774 - DNA, 282 bp, Triticum aestivum
  Clone ID: PAT_TA_51774
cccacccagatggcctggtgggccacctccgtggctgcttttcacgggctcaagttcaccccgggcctggtggtcaggcgccgctccaacggcgctcgcctcgggagcgtcagcaacgctggaaggatcatgtgcgtgcgggggtcgcccatcgcgggcgtcaaggaattcctgaccctgtcttgccaggcaccgctcaacacggctgccctcttgcaagcaggcggtctacctggtcccgcccaagtgggtgcctcgccgtgagttcagtaaggtgggggc

SEQ ID NO: 51775 - DNA, 236 bp, Triticum aestivum
  unsure (1)..(236): unsure at all n locations
  Clone ID: PAT_TA_51775
tccggtgtgcgctctgggtgttgccgcggcgtcgcttcaccggggtcgggggcacgacggccgctgcgcgcgtgtggcncggtggcctcccacgccgcggcgtcttgcggcgtgcgccttctccgccgggctcctcgcaccgtccgtggggcctcgccggtgtccctggctgcgccgcgtgcctccccgtgctcaactatcccacatctctcggccgtgggcgtatggcggccgcg

SEQ ID NO: 51776 - DNA, 273 bp, Triticum aestivum
  Clone ID: PAT_TA_51776
acccagcagtggcgtccgcgctcaccaacgtgagcctgtctccttccgccccggccggggcgacgtcctggcgtggccgctcgtggccgccgcccgcgtgaccttcccgcctgttttctttttcggcggcgccctctcctgctgggggggcgggccggccccgccgccgggcttctccgtctgttgtttctctgctttcttgtggccttggtgtcgtgctcggtggacgccgcctgcgggtggtgcccggtggcttgggccctggtggtggtg

SEQ ID NO: 51777 - DNA, 373 bp, Triticum aestivum
  Clone ID: PAT_TA_51777
gggaccaaggccgtttcccgggctttaaattggaaaaaaaacgatctcgacttggtaaaagaaaaaccaaatttccctttggggcccccacctggggaaaactggggtaaccctaaaaaacccccttttttttggggaaaaaaaaacccacgaaaatattgttacatttggactaaaggagggggggtttccaattcgttttttgaccccccaacgtcaaaaaagtcatcaacaaccggggggagcgccccatttttggcccatagggtgggagcataaaaaacctccggggggaaaatggggctggcagctgacaagtaaaaatatgccaacttttgttttggaaaagggagccggttaaacctgttttttt

SEQ ID NO: 51778 - DNA, 457 bp, Triticum aestivum
  Clone ID: PAT_TA_51778
ataattaacagtaggacaatggcccgcttgtggtatataatgaatgtcacactggtgttgtttctgtgtagccggggctggaatttacatttgcatgctccacaacctatgttcgtacaaacacagatcataccggatgaaaaatatgctctggttggaaagcagggtcctggtcaaaagtgaagttcacaagagacaatcatacataagccatagcgtcagatcgccatgttaggccttaccatacttcttttaacccgggggtctctaatgctatgaaactgacgcactgggacctggcgcaggttgtcgaaaccggtcacgcggacataggacgtaggccaccttctttttgacgctaatccaccttgacgaggacctgaccaggcgtcaggggctcccgtagcataggctggttttcacatttgtggcacagttcggagcctcctgagtaccc

SEQ ID NO: 51779 - DNA, 274 bp, Triticum aestivum
  Clone ID: PAT_TA_51779
gggggcaaattaacgggtaaaaaaagattctagaaaatacaagtaatcatcatctcaaactggggggccagctcgatcgatcttgcccttgcagctgaatcatcatgcctgcctttttaatttctgctttgggaaccaacgtccctccctagtagtgttgattggaatgggtggattaatagctgtagtttttgacgaacatgccctccttggcctcggggggttccccgtcgctggggtactttccgagctgcccgagcgaattggccttggc

SEQ ID NO: 51780 - DNA, 535 bp, Triticum aestivum
  Clone ID: PAT_TA_51780
caaaatctgtccattgatttagttcctcaccttcaagacgtggtatctaggatctagagtataggtacacaaaattgtatttattacaggctgtagaatctgtatctattatatatacatttgcagaaagccatatagacaagatgtacaaattcatccaacgcatagagagaaaaaaaaaaggaaaagctagatggaaagaccattgaaatctttgaatcatttgcatactactccatgaatcatgcggttagtttcctgattttcgttgtcacatttgccagtctccattgcaaatcctcaatagacttttgtctctcccaaacgtagtatttcattgaccctcgtcgttgaacctcaactgatcttcgtaatgcctctctttttgtcaggagattacttggtgatgattttgttgggcgatgataattctttccacggtaaaattttatggcatggctatttgtgagcttctgtgttgctattagcattcctcctgtctaaacctcaagcagcattgaatgggtatgttatt

SEQ ID NO: 51781 - DNA, 434 bp, Triticum aestivum
  Clone ID: PAT_TA_51781
atggggaaaagagagattaaaccattcatgtcgtgctgatttcacacacgccgctgcgcttctagatcagattaatcaatctttcacccccgtacatacatgcacacatgcttgcacatcttcagcggatcatgtagaactggcgaatacacagcgtaatcccacagcatgtcagtcctgacaaaactgcagtgggcctgcatgtgaggaccctgggacgagtcagctcgataagggtgggtcgtctccttgcctgccggtggcttggatgtaatgaacctggatcactgcacctgagccctgttctaggatcccatcatgcttacatacgcctgagggttctgactctaggattcctgcacactccttatcacctttgtggcctccctgcacccgtacattggcagtttgctcattgaccagttgcggcccgt

SEQ ID NO: 51782 - DNA, 483 bp, Triticum aestivum
  unsure (1)..(483): unsure at all n locations
  Clone ID: PAT_TA_51782
cctctggctcctaagttgtttacaaacagccaggcagagttttgcctgctcatggttccatcacgcaacctaaacggcttaacctatcatgcatatcagcggatctatatcttgtttcaaactccaagcagattggcacctttgctgcaccctctctaaaatgtggaagcctgcgtctccacctccatgacaaccacggggtgcggccacgacgaccacgaccactactgacaactaggcgagttacggctgtaccaagacagatacaaacttanaggtaagcatagggcatggactgggcaccggcgtaacgagtgccccactcatactccgccccatataccaacccgaaaattacagaccgaagcctgcagggcctccagattgacctatctcaaattaattgagagctggtcactgtcatggttatagctggtaacactgtcaaatccggttgccttaacaaatccacacaccctccga

SEQ ID NO: 51783 - DNA, 211 bp, Triticum aestivum
  Clone ID: PAT_TA_51783
ccttcgggcccaaaacttgaatacattgttttggcaaattcccgggcccctttgatgggggttttttctccaatgcggaaattttcatccctgttgtccaccggaacaccatttgcaatcacttttggcggtgccaattttttttggtttgccctaaagccaaacaaaccggggacatttctacgttgggggaaaaaaccacaattttttt

SEQ ID NO: 51784 - DNA, 576 bp, Triticum aestivum
  Clone ID: PAT_TA_51784
agtatgaaatttctaattatttcgcaacagttgtagtatgatagtggcacaccggaccatacaaatacaagcgtgctacatgatcaagtctaaggcaaggcagatcaaccaggctatgagatggccctcggcaatgccagcatgcacagcaataatccttggttatatcctacggggacggacagttcggtccagatttatttcttatcagtatcagcgacaacaaggggcgacagcaaccgccgtttcaccaatcaatgcaccagctgcctggcccgaggtgggcaggcagatcacttggatttggctggggctggaagcaactggtaacaggcgatgagcgagctagcgaacccaaacgcacccgtgacgcgaggagtgaccttttttggtgccagttgcagcagccccacggcgacgactatgtcgaggctcgatttgatgagggcgagcagcctctcgttggacttcttcagcttcatccgatactgctcgttcttgtacagctcttggtgcttgaggtccttctctaacttcttcatcgatttggaaagccgctgaagctcggctagctcg

SEQ ID NO: 51785 - DNA, 575 bp, Triticum aestivum
  unsure (1)..(575): unsure at all n locations
  Clone ID: PAT_TA_51785
ttnntttttttttttttttntttttttcaaggatgaacctcccatattattatcaaaataatcattccgcacaaaaaggaaggaaaatggttgctgtgaaattacatatgcacacgaatcaatcaggagggccacacgttttcaatccgcgtcagttcaaggcttgatgcatgccagcaattagccgcagcccactaacgttgacagcaacagtttcgtcagtagcaccgcgagaacgggcgcgtgctcctcacaccaggttcgagccaccatcgccgggtcctgctggtatcggcacgtcctcgacgtgcaacggcttcttgtaaagctggagcagcagcgacgagcagacgacgctcaccgacgaggccgccatgcaggctccggcgagccagggaggtagccggatgcccgtgaaagggaacaggacgccagcggcgatcggcatgcccaggacgttgtagcccagggcccagacgtagttgagccggatcttggcgagggtcttccgcgagaggtcgatggcggtgatcacgtccaccaggctgctcttcatcaggacgatgtcggcagcc

SEQ ID NO: 51786 - DNA, 444 bp, Triticum aestivum
  Clone ID: PAT_TA_51786
gagggcgtggggggcgctcatcccgcccgcgccggcgccgcccttcttcttcttcttcttgccggcgaatcgacgttgatcgggtcgtccccctcctcatcccccgccggcgggggcggcggtggggcgggctcgtagtcgacgtcgtcgtcgggcgcgggggacttgccgcccttcttccccttcttgccgcccttcttgggcggtggcttctccgcggcggcggcgggcggcggcgcggcctcgtcgtcctgcggcagggagtactcgtcgtcgtcgatggcgacgttcttcttgcgccccatcggcgccaagcgcgtcgactagtctagggttcggggggcggaggtggagccggaatgcggcggcggatggggatcgattggtgggagcggcggggcacaggatggggaagaaaaccctacttgcgagttgtgcccggac

SEQ ID NO: 51787 - DNA, 429 bp, Triticum aestivum
  Clone ID: PAT_TA_51787
ggatgcaaagagacctccgatttgaccaagttggaagtcagatatttgattcctggatccatgcttagttcaaaccacttaccggatccacatatacatgggattaccccctaaagctactaatatagaaagagcaaaatccctcaattataatacacactagtcaagataataatactaggaaaattcgtcccatgcgtcaagcgtcaggacaggagaactaacctaaggggcaattaatcggaatatacactcagtacctttgctcgggaaacggtccgtcatggaacatgacgggctccatttttttcgcgtgtgatgtcgcaagtagacccattcaaactccggagagtcacacgcatgctataggcccatgcatttgacccacctgaacgcccgccctatcttgaaaggaagttcatagtcttt

SEQ ID NO: 51788 - DNA, 418 bp, Triticum aestivum
  unsure (1)..(418): unsure at all n locations
  Clone ID: PAT_TA_51788
tttttttgattatataaactacacataacatggtgtnctgntcacaattaaaaacatgggtagaaaacataaacataaaaaactntantggnanaagaaataanaaaaaggtaaaaaanaaaactacggnaccacaaacaagagcanaggacatggtggtaactactactacnncctagggacaaaaaaaaatanaaaaaaacgtaaactaatgaaaaaaaaanaaaaaataaaaaataaaaaaaaacannnaaaaaaaaaaaaaaaataaannnataataaaaaanaaaaaaaaaaaaaaaaaaaaataaaaaaaaaaaaaaaaaaaaaaaaaaaannnnanaaanannaaaaaagaaataaaataaaattggaaaaagaaagatagaaatagaatataaacaaaaaatatatcgat

SEQ ID NO: 51789 - DNA, 532 bp, Triticum aestivum
  Clone ID: PAT_TA_51789
cgtgaacacttttatttcatttaaatatcaattgaacaaaccatgcttatgtgggtattaagataacatgatcgtgtgtatcatgatggtaccggcctgtcgaagaaggtattgattattcctgggctaactctacgatgtcaagttaagacacttagagccagccgttgagatatggtgcttaagtggccatgccagtgaccatggagataccagaagaacggccaaaccgggcgaccttgcagtcggtggaaaagatgtcggaggtgacgtaggtagaggtgccgcccataattggcatgttggtgctgacactgagcttgttgacatagtcggtgcggtaggtttggccaagcacaccgtggacatcgtcggtgaggctgtggaacttgaagccgatgtcgaagtgcgcgaggctgtcatcctcggttacgccgtagttgtggatgcgggagtccttctctgtgatgggcaccacattggccaagatgtcgaacactcccttgagttggaccctgatgccgttagttgc

SEQ ID NO: 51790 - DNA, 528 bp, Triticum aestivum
  Clone ID: PAT_TA_51790
caccagatcagtgtctcatggaagcattttcttccagtagggtattacaatgggagcatgaacgaattgcaccatcatacaccaataatctagtgcaaacttgtaagggagtcgcgcggctattgtcgccacgcccataatgccccaacaaactcatggctattgacgattacaatctagtactggcagaaataagcatgtctacaaaacttttcatggctaatgacgattcggcgcatatactaatagaaacaagcaagtctgcaaagactctttttcacctgaaaacttgtatctgttgggatcactccaaccatcagcagaatgggtacagtagctccttgcaaaattcttccgacaccttctgttcttagcttcgcctcaacagaactgcgatggtgctttcctgtctgcctggtactccctccagaaactaagaacgagagctggcatcataacaaagcaagctgtcgcgtgcgaaccaaatatccccacatccatgatcaccgaaccaaccactttcccctg

SEQ ID NO: 51791 - DNA, 569 bp, Triticum aestivum
  Clone ID: PAT_TA_51791
agtcatgaacacatatatatccaacacatgttaccaatagtagcaagtttcattcgtacatatacatagtttcatcaatattacacagtttcatccataggtagcaagtttcacaaggtcaaaacaaaaactaaatgcaagcaatccatcaacccaagcttccgtgatcttaagcaaatctgtaaaatgggaaagaagaaagttagaagaagaagactagaagaagaagattattatgatgcaactaaaatgtgaagattattatgatgtaacttatatctgtaaaataggtcattttggagctaagtaaggttattatgtcattttggagctagctaagcatattaagtcatttaggagctaaaatatgttatttcttaagcatattatgtaattttagagctagttaagcataaaaaggaaacaacaaaaaacagtatacagtttgctgtggattgtgaaatgttttcttgtcaaattatcatttttgtagattgtgaattgtttacagtaactagcatgctagcatagcatggatttggactaaagagcattaaggtaatgaaact

SEQ ID NO: 51792 - DNA, 353 bp, Triticum aestivum
  Clone ID: PAT_TA_51792
aacacacccctccaacacaaagtttttttggcctcagagaagctaatcgaaggaacaaactttcacccactttcgcttttagctagaaaaagagcggggggttaaaactggggggcctggggaatccaggtttttaatcaaaaggaaatggccccggctgctgttttgggtttggggggcaccttttttttcacgagggcaaaaaaacctcccctggtggttgaaccaccaccgccgccagaaggagcctttttttttttttcaggggaaccgggggggttcttggggctttttgggcccccgcaaattcggtttgggccaagccccttaacttttccttgaaggggttcctg

SEQ ID NO: 51793 - DNA, 431 bp, Triticum aestivum
  Clone ID: PAT_TA_51793
gaactctggcaaattatgtcacaggttctatcattactgacatataaaaatggggagtacagagcaggaacgtttcggttcaaatgcccggcaactcatctgctataaggcaagcacatttgtttcgaaactcgcatgaagggggggagtctaccgggagagacggcctcctactcgctgtctgtctgtctgcccggcgagtcagatttgcttcctacaatatctcacgctcgcatatatcttgctgggcctcgcatctgacaactctctgtatctgtaggctaatgtggtagcagcctcacctgcctactcagccttcccggatgcgcaggtttcggccgttgaactgggggaacacaacatcttgctgtcgggggagctgtgcgccggcgacgccggtttgcgcttcttgagcttccacacggtcttta

SEQ ID NO: 51794 - DNA, 572 bp, Triticum aestivum
  Clone ID: PAT_TA_51794
cagcactcctccgatagctcccaataaattttgctcattctacaagttttttcaaattcggaatgcaaataacctaaaggtgttgtagccactcgtaacagtcaccatcaatctgggtcagatgttcataacaagcactgtcatggtcccacaaagaaaaacagtcaccatcaaccaatgtgaactaattttttttctctctattcttcgtcgccagcatgctcaagaagatagtttgcagcgagttgctcattcctgtcgcaggcaaagaatgcttcgatgacacgtgctctctcaaaccccatggcttccaacctcccaattgcctcttgctcttctggtgtcacactgatagcatgaggcatctcatcctggtcagcctggtctaaaaagtccccatcgccgccttcaaatgtctcatttagtaactgaaggaactcatcattgttctcctgaatcaacctcagaagttgaggattctgcttgctcaattcctggagcataggctgtaaaatttgtggatttgtatggaccatttcccgaagtgcttgaaactgttggttatttctaaa

SEQ ID NO: 51795 - DNA, 518 bp, Triticum aestivum
  Clone ID: PAT_TA_51795
agtggataagagaaatactcttttttctgctcatcatcgacatcgaaatcaccaggaaagggaaaggaaacaaactcgaacaagatcagcgaagacccagagtaggtgacacgtcatgggtaccagcttcgacgtacacgtacagacacagtacgatcaacgaagagaattaaacgcgacgacaagtccacgacacacggcgaagacccctagtagaacccctgcaccggccaccggcggtcggggtccggcagccacgaggagcgcttcttcttccgctgcttgtccttcctcccctcgccgtcgccgtcgccgtcgccgtcgaccctttccttatcgccgtcgatcccctccttgtctccgtcggagctcttggagtcgccgtccgacgagccgccgcagtacccgccggccaccacggcccccgccgaagacctgtgcatggaccgcacgtactggagcagccgccacgccgccggcttttgctgctgctgctgccgcggcgggggcgtcaggga

SEQ ID NO: 51796 - DNA, 315 bp, Triticum aestivum
  Clone ID: PAT_TA_51796
gggttaaaaaaaaaattttttacttagagggggcgccccaaaaaccacggggggtccacgaagggtaacccgaaaaaaaaaaccccgaccactcgtcccaaaaaaataacccccaaaacccagtttaagataacggtggaacccccataatacctaaaaaggggggttaaccgcctttgaaaaaaaaaaaaaaaccgtttagaaaaattccccgaacttggggccaacacccccggaagcaaccggggggtaattttccatgccgccccccatggggggaccaaaaccctgggacattttgggaaagaggggggg

SEQ ID NO: 51797 - DNA, 456 bp, Triticum aestivum
  Clone ID: PAT_TA_51797
agcaaaacggcatgctgaattgcttccaaagacaaaatctgcacgatcacatatatctagaaatggttgcgtgcaaattatgtcacgaaagcaagggcagcttatttctatttgattcacaccccaagttgtaagtagtgctaccacctcatcatatagaattgacttaaacatgtttgcctccggccatgcaggaaaacatttagcctttattggaagacccaacggtagggaaagccgactctatagtgaacgtggatcccccagcatagactatcaaccggtgcttgcaatccatgagtccatggaaataaaggcgtctcctgccgagtccaccaccgaaccccaaaaaacctgaagaggcaggcaagctattaccattctttagggccatgatggacagggtgattacaaccaccttcttggacttgcaatgggattcatgacctgcgttcg

SEQ ID NO: 51798 - DNA, 572 bp, Triticum aestivum
  Clone ID: PAT_TA_51798
gaacaatgacttggcatctgttctgaagacaccatgcttttaaataaatcttcatcgaaagatgataactgaagtttacacagacatcactaggggaatgcaaacgaatagcaaacatggataataaaaattacagaaacacacggacgcctggtaattgattgcctcgagttgcaaaatgttgcacctggcacagttcttcttaacatggttgctgctgtggctgcggctgcggctgcggctgctgctcgccttgccacgcccagactatgtccttgagcgctggcctcatctcctggttcaagaccttctggtactcgatagtatcaccgtttgtcttcttcaactccacgagatggaagtcaggggtgacctcaaatatctcagcatcaatggacatcacacctttccttccaggcttgaagctttccatcctcatcatgccaccatctttcttgacgagcttcagtcgcatgcactttgcgatgtcctcgatctttgacacgatcgtcgaagccgagttggtggatgtgaacttggactccctcttcttgccattgtcctcaaacata

SEQ ID NO: 51799 - DNA, 564 bp, Triticum aestivum
  Clone ID: PAT_TA_51799
gaatctggatagctttagatcacaaccaaaacaggcaaaacattctcagttcaacctaggactcgaaccgtttacagaaaatggtgttcagtatgtctgcaaacatgacatggacgcaacatctaagaaaatccaacgagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccactgaactgctcctcaatgtgcgagtccagtgtacgtccctgctggcgcttctcaagcttcctctggacattgttgctcttctttgcttcctctgtggcagcagcagcaacctcagcctcttgcccctcagcaggttccttcttggcagctgcagcagctttcttcttcctaccgatttcgactccataatgagtcaggtaccactgcttgaagggggcagcatcaacttgcacaatggcattcttgacaagggtctgagtcct

SEQ ID NO: 51800 - DNA, 432 bp, Triticum aestivum
  Clone ID: PAT_TA_51800
aaaagtgaaatctatggatgatctatgcattgataaagatcaacaaaggatctggacaagatccacacacacagctgctgcaaaagcaggcaggtaagcactcttacatgataaactgccaccactcactgagacatcatgcacaaactgaaacctaagctcgcggttgaactagctagctttgctgctatattcacaaggtaaacgatttgacatcatcttgattgtgttgtttgagctgctcatcatcagtcgtgaacggcgctggccgtcgaggctcaatcacctgtcggagatccgcgggccaccataccgaacgctgcacatcttcagatccctcggcatgtcgacctctttcagccacgcgaggcgccggccttcttgtgggatgctgggaggagtagggaacatccgcgtagtaggtgcaatctc

SEQ ID NO: 51801 - DNA, 456 bp, Triticum aestivum
  Clone ID: PAT_TA_51801
aaaaagaaaaacttcttagttgcttgattagcccggaatccaaaagccaaaatcacatgcatgcagattactagttcccgattgtcggtctaatctatgattagtggagtggctagtcttccccacgactggcctcgtcgtcgtcacgcggggcgcacgaagaagacgacgagcaagacgcacaagcttcattcccgccgtcgcattgtcccgttgctgatgtagcactaacaaccacaccatcgccaccagtactcgtgctcgtgctgctactagtagtactcgtgctgctcgtgctgctgctcgagctgctggtgctactactcgacgtcatcgtccctgtcgtcgtcgaggtgtttgccgtggcgctggcggtgaggcggacgagcaggtcgacgaaggcgctgacgatgagcgggtggtggtgcttggcgtttacccgtgggtaccatacca

SEQ ID NO: 51802 - DNA, 457 bp, Triticum aestivum
  Clone ID: PAT_TA_51802
gacctaacttttcgactgtcttgctagctaatgaatcccgctattactagcgtctgccctcttcaccatcatcacatgccattgaacggcgagctccagttgttggagtacccgttcgccctcgcaatgctcacagttggcgccgccgcgtatgggtcggcgccggtgctcgccatcgccatggcatcgtacccgagattgagcttcccctcttcgtccccgtagctgcatgtgcttccctggttggtggcagtgctgctgtgcccctgttcatccaccacggtgctagccggcatcaagaaggcgttgccactggtgccttgctggtacccgccgccgttgtagaccgtggagctcgacgatgcctggaaatagttgtgagcggcggtcccgaggtgcaactgctggaggtcctgcaggctttgcgtggggacgctggcgtcctgctcgggcttgc

SEQ ID NO: 51803 - DNA, 480 bp, Triticum aestivum
  Clone ID: PAT_TA_51803
aaaataaaacaaatttctgcacacaccaagaaccaactggacaccaaattcacaacatagatgttctgtaccaagaaccaactggacaccaaattcacaacatagatgttctgtaccatgtaccaagaaccaactggacaccaaattcacaacatagatgttctgttttggtgccgttgtggcatcgatgatctggtaatacatcattcaatgactaacaacaattcatggtcccttgtagatgaactccgtatcaaggtcgtgcaacacaatacgataactagctacatataccttttacatacaagaactctaaatttgtagcatgtgagatcaaaaggtcatggcaatacactcctctcttacagctgcaaagaggtcagagttcatgtatctctcgcccccgctggggaacatggtcacaatcatctttcccttgttctcttctctcaccgcaaccttcaagcaagccggcaagtt

SEQ ID NO: 51804 - DNA, 468 bp, Triticum aestivum
  Clone ID: PAT_TA_51804
gtgttttgtttttttttttttttttttttttttttttttttttttttttttttttttttttttttttttttttttttttttttttttttttttggacagggatcgggtccaaaaggacccaaagctttcattaaatcccaacagttataggggaagggggaaaccaggactcaaaggaaaataaaactacagcataatccctgaaacttacaagggggaccctatccagaaaatcaaaattacaatcaaggccaaaaataaactttaaaaaaaaaccaagcctgccaaaaacggggaaaaaaacacttgggaaaaccgggaaagcaccactccattttcgggaaaaaaacgaaaaaaaaaaatccatacccaaaccgaaaaaatgcccccctaaaaggataaaaaccgggagaaaaaaaaaaaccccgccaaaaacaaatgttttaaaggggccccctttcgccaaaa

SEQ ID NO: 51805 - DNA, 490 bp, Triticum aestivum
  Clone ID: PAT_TA_51805
attgttagatgcaccataaaattaactttcataccatataactttagtattatagatgttgatatttttttcctacaaagttggtcgaactaggtaatactccaatagcaacacagaaaattttacagatagtactactccaatgaaacccaacgagcacagctagtcaatcgtgccgaatccgtgaaccgaacagttccttgaaggcctgaaacctcgccgccttgtcggcaaacttggtgccctggtagtagtccaggtagtcgccgaacctgtacggcccggggtacagctgcgccgccggctgcctcgccgtggccgccggcgccacaacggcgtcagctccggggttgtagaacgtcgccacggacagccgccggccctcggcgacgggggcgacgcggtgcagcacgctcctgtaggcgccggccgttattacctccaactgggtccccgatgttgactaaagatcctgctgccctttggtggg

SEQ ID NO: 51806 - DNA, 266 bp, Triticum aestivum
  Clone ID: PAT_TA_51806
agcaaactagcttgggttttcaataacagccttgacataatatgaaatacctcgctgaaaacagttgttctaattctggctttaagaacactggatcatagagcctatccaacttggaacaaaaaactcacttgggggggcgtggggtattctaagccgccccctccttcttgtgcttggcacgctcttgcctggttcccccccccctcttactctttgccccctgtcctttttcctttcttagcccttctttgttgctttttttt

SEQ ID NO: 51807 - DNA, 454 bp, Triticum aestivum
  Clone ID: PAT_TA_51807
acaagaagattaaaacttgatctttgcaataagagggaaatattgaacacatggacaagctaagacaaacaggccagacaagtccactcctaaatgctgaaagcctatcactggcatggcgtccaaaccaggattaaacaccctggtaatccactcaagcttctttgttccgatgcccataactgtagccaattggtacatgagagtagcacctgcatcttttgacatggttccatagcgatgtttgctacacataacatcgatattacagtaactaggagcaaacaataactactatccaccagattctctgaactctgcctcctggtccatcatagccatccttatttattttgaatgaagtatctgaaatggtacaacaggtgctgactttagtctgaaaatgcaaggttcagaattaggcttcagttctataattgataatcgactcccc

SEQ ID NO: 51808 - DNA, 452 bp, Triticum aestivum
  Clone ID: PAT_TA_51808
acaaagcaaataccacaattatcagaaagttttcgagacacttaacatctgatagttactgacaccaacattggagagtcggctgacaaccatacatagagcagagcaaaaatactgacgaccccaaagattttagcatactgtgccattagcacttgacctctttcagcccatgtgcaaagtacaggaaagttggatcagcagctccctccttgtagtacgcgaacaccacgccgccatcatcatgcatgctctcgccaacaaagaactgaaggtccttgagcttgctaagaagatacttcgtggcagactcaacattcttcttgaaaacatctaggtcatccccttcaagcttggcagtgaggttcttgatgtagcgcttcatgtgagagataaactgcttcttgtcaaaagcaggttgctcctgaagacggaaggtgtcaacaatgtca

SEQ ID NO: 51809 - DNA, 472 bp, Triticum aestivum
  Clone ID: PAT_TA_51809
gggtggtttttttttttttttttttttgttttttagctttagatcgcacctgcgtttagaatcttcaatggggcccaaatggtgggggctccaaatggaattggttcttgcttttttcttcaaaacggctggtctctaactggggggggggggggcttaacgaagggcagcccgctctacttctctctgctgcctacatatgtttctgcgttggtggaaatgcgtatctactcctgcctcggccgaatggaactcccgtggcgggcaagccaaaaaatcctctgggtcgattctttcttgcccctcagcctcgggcttatccggttggcttgttcccggccgcctccgcttttttgttggcctttttgttggaatgcttttcttcggaattgcgcccggcctggaacgggaagtggggaggccgggggttttcccgtttttttccgggggggaggtgttgccttggggtaag

SEQ ID NO: 51810 - DNA, 358 bp, Triticum aestivum
  unsure (1)..(358): unsure at all n locations
  Clone ID: PAT_TA_51810
acaaaaaatctcacaattaaataccggccccgatcaaaagggctgtttatttcgagccctcttgtccgccaacaagggggaaaaaaggggcaacaaggggggaaaaaaaaaggaaccgcaaatggcatgtttcaaaaaatgggcgaaacaacaacactttttttttttttttacggagcccgggggcgttatttttttcggaaaaatctaacgactcggtctggggggcttgtcccaaggcttggatttggaggaattctggttcgttttccgcgctgacacaaagttggcccccccctggaaggggttcatgccatcgncgttggcggcttcctttggtttcctgaccttttttggc

SEQ ID NO: 51811 - DNA, 363 bp, Triticum aestivum
  Clone ID: PAT_TA_51811
ggggcgggcaaacccagatataccaaatatatttaggcccacacaaaatttacaggggggcccccgtagtttaaaacgggttacactttaacagggggggaaaagcttaactgggccgggggcagacctaacacgacgcaaataaatgggccgaatttacatacagacggactaaaacaagggctaactagtcagccataatgggggcacaaaaaccccaaaacgggcaaagtcctgggcaaaaaacattttgggggaaaggaacaccatgaccagctgggggaaacccaaaaggcccaacttgaagggcttggtttgaatcctaaagacccccggggtaaccaaaaggtcctttttgggggc

SEQ ID NO: 51812 - DNA, 431 bp, Triticum aestivum
  Clone ID: PAT_TA_51812
gaaggaaatgcttcgactacaacattggactagtacttaaggtttgacattacaaattcaaacccattgtccagtttacagcacccacatttggggtacaaattcataggcgacaaacctaaagtgaaaaaatacactcaggaccacactcatgacagaatcgaaaattaggaccaccctgcaactattacggttgattccctggggctacgatttcaaagcacgggaaactcttggaaggtcacgctggttccctttcatagtcacgacctcatatgcgagccgtatgtgatcaaacaatatctgtgcacacaaatgagggcacatattaatgaaacctatgtttatcacaagttactacaacattgattaaaatgtgatgcccgatacttatcctctgatgatagatcgcaaggatagcccattgaact

SEQ ID NO: 51813 - DNA, 309 bp, Triticum aestivum
  Clone ID: PAT_TA_51813
agaaatgctttcataatgacaacactaccaaacccgacagatagggcgtagaaaacaaaatcaggacgtgataaacagcattcctcgggcagtcttcacggcgacaactcctgcccccttctccaaactttatttctacgaaattattgcccgacacatcgattgaacaaacgggggaccaagaacgagcggtgtgtgaaatggaccagggagcgccactgcgcacaatgactgaatgcttaaggcttattcggcgcacctccccaactagaggcgtacacggggggacccgtccccccctgtgaccaa

SEQ ID NO: 51814 - DNA, 319 bp, Triticum aestivum
  Clone ID: PAT_TA_51814
ggggccccgaacattacattttttgtaaaaaggaaggaaaaaagggttggcatttttttccaaaattggggggggggggggggttcacaatacccagggggtcccccggaaaatttattttttttgttttcaagggccattcctttgggaaatggttttaaaaaacattggggttttgggaaaactgcagggcggggctgtaaaattttgcaaaaagaaaaaaaaaaaaatcccttcatggtcggggatcccaaaaagtgttccaaaaaaccccccaatgaaaaaaggggaggggttgttttttaaaaggggggttttt

SEQ ID NO: 51815 - DNA, 545 bp, Triticum aestivum
  Clone ID: PAT_TA_51815
gaaacgaagctacactacattgttgaggtcaggagacccatcttttacaacaagtagtgaacccaccctccctttggttggaaaataaactgtagaagaggagcaaagactagtggaacaacttccaggaagaaagaaagaaagaaagaaaaaaagaaagaaaaatgaatttgttgtggctacgactatccaagcaagcagctagctaggtgcacctgacgttcctccctggccctccgtagtagaagtagttcccccagacggcgttgacgccgccctggatgtcgtagcagttggggtggtcggcggtgacgtggaaggtggtgagcgggatgaggctgttgtcccagtccaccacctccaggttgcggaagtaggaggagcggccgaagccctccccggggaagtgcccgctccccatctgcgtggccgtgtgcgacccctcggcgcgcgtgtccaccacctcgccaccgaactgcaccatgctcgcgtgcgacgccaggtggctgaacaagaagctaggccagtaacccaccagctccccc

SEQ ID NO: 51816 - DNA, 458 bp, Triticum aestivum
  Clone ID: PAT_TA_51816
aaaccacattggccttactggggggggaaatccgtccaagcacaccaatttgtataactggggaatacatgagcggggggaacacgggcttgctaaagccatcgttccgatagaataacggttacaacccagggggtcaatttgggggttaacgagggaaaccagcagctttccacagataataatttcgcatagggctggtggcggggggggacctgaaccccctacgcaatatgcagcttatgtcacacatgaccatcctggagggggattccgaggggggttcctccatttagtatagccttgaaaaaaatgcttggtttgaggagatctagtacttttttggagggctggcggccctgggatcaacgctaaaaacaacagtctttccagtaatcaggggggccattttaaaaacatttggcacagttgtctcaaagggagggggggcatcataa

SEQ ID NO: 51817 - DNA, 423 bp, Triticum aestivum
  Clone ID: PAT_TA_51817
cagaactcaagttcatattgttacagtgacatacacaaagggatgtgtgttatacattagtagggtagtgtatggatgatctatggcactgaaaactccaacatttcttcttatgtactgtactagatttacaacaaaaacaggtattgggaacaacaatatgtgtcacgcatcggagagcgagatgatggcttcagtcgaaatggtcggcggagaagtcgggctcgtcgggcttttgcagcctgcggatcatggtgtcgtcggcacggaaccttctggacgcggaggcgaacttgtgcattttggcggcggtcctggaggtgccctcctgcttgggcttgtcggcggccgggtgctccttggaccaccacgagtaggactcccaccggctgaggcttttcgacagctttcttcgctggtgct

SEQ ID NO: 51818 - DNA, 381 bp, Triticum aestivum
  Clone ID: PAT_TA_51818
ggtgataagagcagcaatagtttattttcacaaactaggaaatataatgtacttcaaagtttcttgggtaaatgcagacaccattgttctctagtaattcaccgatgactgaagcaaatgcagccacaggttgcttgggtaaatgcagacaccatttttatgccataacagaatgtgtgtctatgtatagacgggaaaaaggagaaagtaaaggcctcccaataatgaaggacctgccatgagcttaactttaccaagctcataccattggatagacaacatactcagcctacagtacgctttaagcattggtgtttcatgcccttaggtaatcatatactgcccatttccagtatcaataaaaaatgcctctcccggatc

SEQ ID NO: 51819 - DNA, 526 bp, Triticum aestivum
  Clone ID: PAT_TA_51819
gtgttgttgggggttgtttttttttttttttttttttttttttttttttttttttttttttttttttttttttttttttttttttttttgggggaaggaaacgcggggtcattcattcatttcatcccggggcaggggacaaaatcattggggggggggggggaaggacaccccgttttttcccggccaaatgggcctaggaatccacgccttacatcacattacataacataacatatgccgcaggcaacggggggaaaaaaaaaaaaaaatgggggggtcgggtcgggtcaagggggctagacgggggggcaggatttcttgggggatatgggtttgcccaacttgggcgggtccagccggacggggcactgcacgttgttgtaaaacctgggcttgaccagtttgcccaagaccagggcccgggccctgatccttagagtaagctgcaggggcacccggggggggggcacccccttgggccccggggtgctggttaaccccccgccgccggcggtaaggggga

SEQ ID NO: 51820 - DNA, 416 bp, Triticum aestivum
  Clone ID: PAT_TA_51820
cactgaaacgggttcaggtccaactataacacatggggtacaaacataattcttgggatcaatctccccaaagcatgtgaaaatgatcctgtatatggctcgggaactaaaaaaatcacttgccaaagatgggggaaatgtacagtacaaccggcccgactgtcaaagggggggcgagggccatcaaatggttattagtacggtatatgctgaaatctgccgtcttcctgtcgggcttcactatcaccaacatatgaacagtacccgttccacatgcacacgcttaaaaatcaccaagcaagcgttccttggtccacactggtctcccccgataaatggtgtaggaaactggtgtgcagggcatggccagccttgtgggcaactacatgagcaattggaaaaccctggctgccatt

SEQ ID NO: 51821 - DNA, 395 bp, Triticum aestivum
  Clone ID: PAT_TA_51821
ccaggagcagaacatcaacattggacaggaaaattggggccctttcgtttacatgggcacaagctctagttgctgggctacaagtatgggagagggcaatcttgggcaagggcctttagctccggaagaacgtggcatgccccaacgttttagagggggggaaaaacaaagaaggaacgaattcaaacaacggtggctttatcagttaaaaacagggggagccttaaaaatcctgaagcaaagaatttttttttaatctccctgataaaaaaaaaggcaggggctcgccgttccactccttgaggcactccagaagcgcgtggatgggctaaccctggttaaaaaaaacaaaaaccttggccacctcctccccgggggaccgggttttttttccg

SEQ ID NO: 51822 - DNA, 479 bp, Triticum aestivum
  unsure (1)..(479): unsure at all n locations
  Clone ID: PAT_TA_51822
aacagcgtaaacaaagtgtcacttcaattggatttagtattttatatcctttattgtttcaacatagagccctggtacgcacagcatgcaacaaacgatgtggatcactagccggccctggtgaaattgaagttgctgcaggagaagcccatgcccgggaggttctgggtgaagctgagcgtcttcttgccgttgtccagcaccaccagcttgttctccatctggaaccctccgatcaccagcgccggcgtcgcgccccccgtgctgcctcccgaccggacgaacgcgaagcacgccgtgccgctgttcacctgcgccatggagttgccgcccaccaccgtccagttcgtcccgccctccagcatcacgtncacgttcggcaccaggtacccgaaccgcgtcggcgccagcttggacgagtcgtagcacagctcgaatgggttcaccgccgccaccttggcgctggatcccatggcgcg

SEQ ID NO: 51823 - DNA, 524 bp, Triticum aestivum
  Clone ID: PAT_TA_51823
gtccaaaactatcaatgaccctgtcctgtctcatgtacacgactgtagaaaaaatcttacaaaggcacaactctacaacacaccgtgaacagcccgtgctttccctatacgccacacagtgtgtgatcacagattaccatccgtcggcaagacattcagagaggttttacaggtgagcaaaagaaccagcttggaccctgaagagaagtcagtactgtgatgctacatcgtcagcgaatcaggaagcgaggtcggagcgccgcagatcttgccaccaacgtcggggaagcattcttggtcgggcagcgggacgatcttaccatcggactctaccttcactgggtatctgaggaggtgcccttgcaacgttttcatctcttctgatgcgaatctttcccagttttcttcggctatttggttcactaatcttacacattccagactagaaggttccttgaagtggtcatcaaccataccaagggtgttctgcccagagggagttcctatacccatatacctggccg

SEQ ID NO: 51824 - DNA, 516 bp, Triticum aestivum
  Clone ID: PAT_TA_51824
cctctcttccattcgtattgctggccgtggccgtatccttgcggccaccgaaaagaacctaaaatggtatcgaaatggaacctacatcgatcaataataatagtaataataataaatccccccaaaaaacaaaagagccaaaaggtggacgggtgatggtcgcggtgcctccgacgcgtcggcccggaagctgcggaggagggacggagcatttgctcttgctccaccacgccgcgggcacgcgcctacgaccgcgagtcaacgctctccgctgccgccccttcctcggaggcggaggcggtggccgaggccgcggcggcggccgatcgggcgctaggccggggcctgcggcggcccggggacgcggtggcgacgcggcggagcgcgccgccggccgtccagtatcggcggcaggcgcggcagaagtggcgcggttgccgcacgttgtagttgttgaagtagcagaacttggtctccctgctcccgcacctcgggcattggaaggggttcgccccc

SEQ ID NO: 51825 - DNA, 475 bp, Triticum aestivum
  Clone ID: PAT_TA_51825
ggggcccaaacccttgcaatagtccggggcaaaggagggggggacctcacagccaacaacattacggggggggtaaccaaaacacattttttggtcgctcttattccgggcagaaacccccgattactactaccgggtccggggcctgccattggctggacttactatagcccgagcagaccactggggactataaatagggggggcgccgagcccacctaaacggggggaaaaaaatgtcaagccgggctatgggccactggtcgtcgccggcaaaaaggggaaggggggctttttgacgtcctcaagcgggcggaaccacaccttttgggccaacacgggggggccccccttgggggcgctggccggcccaaggctggcggacaacttgggggcaaccgcgggggggcccaaaaccccgggggtggggggagggccccaaaacttggctggggtcccggggcccctcgaaaaa

SEQ ID NO: 51826 - DNA, 428 bp, Triticum aestivum
  Clone ID: PAT_TA_51826
gtcttgaatccacattattattatcggcatcatctccaaactaaatagattacatggttccatccgcgatagaaataaccaagatcagatattaagaaccacagaagttggatagtttgtaacctcaggctcagatcacctgaagcagccagcaacacaaggaatcagccagcaagcaaaaatcaattagtccattggctaaccaacctattattaatttcaatcatgggataattcaaccacaatagaaacatttcggtatcttgttattacctcctttctcctgtgtctgccttctgttttggcctggaactactgtctaagcaggccaccaccttcgctgcagccaatcattttatccaagcgggtcttgaaactaatattgacttcatactgagcccccaatacacgaagtcgttttaaccaaa

SEQ ID NO: 51827 - DNA, 311 bp, Triticum aestivum
  Clone ID: PAT_TA_51827
attccaaaacacaaccagtttgttttcagcacatgacaactgatcatataaatggtgttcacacaagtttgagctagacattctttaccacgagcaaacaatagggcctaaaaattgtcggggtatccatcacagtttctgaaaactggggtggcgaaaaagaccataggccgtgggaaggtcctttccctaggaccccctgggggtgtgggactgaggcttgttcttttacgggtctttcttttccgacaaggtcttttcaatgtggcattggttggacatgtaagggttgatgcttacattgtcacgga

SEQ ID NO: 51828 - DNA, 354 bp, Triticum aestivum
  Clone ID: PAT_TA_51828
gtcacaacaatatatgctcatttcataaaataaatgaaatatacacaaataaccacggaaatgcacatgtaccgtgagcaagaaaatcctaaaaactaaaaactacaagcatcctggagaatactaagctactctccagctcctcgagcgtcaccggtgctcgccatacgtcaaccggggttcattggcgttcctttgtggcaaaggatccggctgtaccggccgttgtcattgagggagacaccattttcgcaaccattttgccttgaaccatgctcctgaacgggaacttgtctttaacgatgaaaactccatggagcccgtattacctgcgtgtcgagaagccctggtggg

SEQ ID NO: 51829 - DNA, 412 bp, Triticum aestivum
  Clone ID: PAT_TA_51829
ggaaaacgatggcgggggggggcaacaaaccccagttccccaagggcggccgggcccccctagaatacaaagagagccccccccggtaacggggggcctttaatttccgaagggggggggggggccccaaagcgggcatttttatggggaaaacgttggagggccagggccggtcccaaaccattttatccaacaattttagcccctacagggggggggggggcttgggggggttgcccttctcccccaagcttgggggcgggggggcaaagccccccttgagggggccaacccccccgggccccaggtggtggccaaccttttcccagcggaggcccagtttttccagggcacgggatatgccccggggttcgggaacgttgccggggaggggcccagcaactgggccggg

SEQ ID NO: 51830 - DNA, 516 bp, Triticum aestivum
  Clone ID: PAT_TA_51830
catagcaaggtagatttttttaactaaaaaacccaacattgcagattaaagtgtcaaactgacaggattaaatgtcttgaaagacactaatataacttttaaaagatgaaaccatagccaacagataaactatcatgtgggtactagtgttcaagccatgatcttcgcagacctcatgtaaagactgtccacaaccttcccaacgtttgaaatagtttcgagtgtggcagggaagatggcctctgttttcatctcctcaaagataatgaggcaaccagcaccttgatctagagtaccagcaaatttcttgtcaaggatcatttgtgacagcttcttctccacatggtcaactggcaattcaatcatctgagcaacatgctcaatctccaccctcgagtagggctcaatcaacctgcagaggttctgctccagaagggtatcatacagagatgaaagatgcctgtggacaatagggtcctcctcaagctgggctttgtaatcacgaagggcggtttc

SEQ ID NO: 51831 - DNA, 281 bp, Triticum aestivum
  Clone ID: PAT_TA_51831
gggggaaccgccaccagcataaaactttattcttgttactacgaacacaacactacgacaggactttccttaaccaggctacattgagcacaaatgaacatgggggcgggggggcttgacatgcaagaacagggcatgcatgacactcttttaataagaaccccccatggggaaattgaaattgctgcatgtagtgcggatttccaggagcagcccactgaacgcgaacgttttctttaccagaacgaacattaacagggtggtcttcatttggggccccc

SEQ ID NO: 51832 - DNA, 381 bp, Triticum aestivum
  Clone ID: PAT_TA_51832
gaaaaaggaattccactgaacatgcaatcgaccttcgggggtacttcactccgggatgccatgcaaaaaaaaattaatccagacttgcaactggggaatttttgttgggcaaaaaaaacaaaacaggccgacgagctacaaatgtttttcttccattaacttgccgactgtgactaacagttgatgcctggcgggggaaaaaagattggcttttgaggggtcccgacagacctacatatattcgttcaacatcaacttcttgttggggatctactggatcttagccatcatcattatcctcttgggggcgaacaccccgtcatcgggcgaacgggggtcaaaccctgacatgtacattccgacctcaaacccaataatcta

SEQ ID NO: 51833 - DNA, 557 bp, Triticum aestivum
  Clone ID: PAT_TA_51833
agcaagcaattaaccaagagaccttttatggaggccgtggatggcatgagatccaggctcgaatttgccaggtgattcttcaaacatttcatgatacatcagcaattggtaaaattaacacatctttgacccttgcgccataccaccatacttgcgcggacaacaccgcatctgtattcgctcgagggatagcaaatctaagttgaattattctatcgacaactataccctgacacaaaaatcctgctgcatgacaagcctcattcaccagaaagaaacacagtgggataatgctctcataagccttctgatttggagttcacggtaactttaggtccggcccactgttggctagctcgagacttggcccatggatcaagtggaactcgctgaggtggcggtggcgttgcaggtttggcctctcggagttcgttctctctgtccacaaactcaatgtatgccattggtgcagcatcacctattcgtatcctagttcgcaaaagtctcgtatatccgcctgctcgatctttatagcggtgggccagctctgtgaatag

SEQ ID NO: 51834 - DNA, 458 bp, Triticum aestivum
  unsure (1)..(458): unsure at all n locations
  Clone ID: PAT_TA_51834
ggcataacggttcaggatagacaccgttaggtgagggtttttctagatttataaaatataccctgtaattttacaaagacccccttgatcaaaaatcaaaaaagcaatcggctcctagatttgtctcaccgttgactcatgtcgcctgggccgatggagctcgagctcgagccacccgagcagctcacctggagcatggccgccggcgcctctgctcacgcccacacgcggccggcgcggcttctcttgctcgttcccatccccgctgctgctcgcgcacggcgtcgcagcacgcgcccatgcaccccgtncccgctgctgctcgctcatggcgtcgtggcacgcgcccacacgcggccggggcgactgctgctgctcgttcccatcccgcctgctgcttgcggcccgagctggtgctttcgcccacgcacgggcagcgcggggctgcccgtgcgtga

SEQ ID NO: 51835 - DNA, 312 bp, Triticum aestivum
  Clone ID: PAT_TA_51835
ggggaacaactttaattatttcccataaaaaacttaatttttaaatcttacatatcgacccacataacttggagcagtttgcatacatgggccctactcactagctatgggttattctggggttttaccccccccccccccttaaccatggggcctcaatcaaagtttgcccatgcgggggggctccccaaccgggttcaccaaaattccgacaccggcgggccctaaatcccccgtcacccgtgtgcccacccggaaaacccccattttttttaagtgccggccggcctttatgaagggctttttgggccc

SEQ ID NO: 51836 - DNA, 369 bp, Triticum aestivum
  Clone ID: PAT_TA_51836
attagggccaaattgaccagaactgtttgggtaacacccgaaacaggaaacaatttgaggcccgttaaaggggacaaattgaaatcaggacacaaaagcccaccaaaagtgcacggataaaaaaacatttttatgtaaaaacacttgacgccctggccgtctaaaaaaaagcccctcaaaaggttcaccgcattacctaactttatcgcaaaagcaatctacaagctttcttgttttggcctcaaagtcaatattgtagaaccctgcccagcgggcgagaatcacaacacttgggacagtttccaaaggaacactgtgaataaagcccaacgcttaaaccggggtgaaaaaattaggctggaaagaaaa

SEQ ID NO: 51837 - DNA, 330 bp, Triticum aestivum
  Clone ID: PAT_TA_51837
agcgtgcgtactcgctgcctaagtctcgcacagcgatcgtacgcaggtgcatcctcatgatgtgctggtccagtcctggagctccttaccttggcgaatccagaaaggatgtggggtcgcgcgcgctgttcgatgcgcacacgcggatccaagacaggcccaattagttcacaaagaacagccttgactccatgatcgacgagagcaatctgtaccactgccacactaacaaccaagtgtactcatatctgacccaaagaactgaacccggaaaatccaagcgacacaataaaaaagctggaggtcgaagcctgactgaggtctacatac

SEQ ID NO: 51838 - DNA, 576 bp, Triticum aestivum
  Clone ID: PAT_TA_51838
accaacacaaccaccacggtcgatcggtgagggaactccctgcgatgcacaacccaataccgctctggttgacaagagcagtgactgccactgcaccgacaagacccaccgcttgtatgaaggcgacggttactgtgtctgcctgcccgacacccagaagagccagtttacagcgcatagagccaaggagaacgacggtaattgcatgtgcggagacagatgtacctgtactaactggacgtgatgtcttgaacagtccaccacgcttgcctgtctgcatttcatgcgcctatacccgaactagcataccctgtgaatcaaggtcgatctgtaccagagtctctacgaatggtgcgttatcagcaccgcaataacctgagagatgattgatgcatccataagacatgatcttggatcttccaatcgtgcccgtgctattcttctgtaaccagcgggtgtgcttaacgtactaatactatgtcgccgttagctccaacgtgttgtggcatgtgacttcattctttgtatgcttgttgcacggaatgaaatttgtctggtggctcagtaccgccccac

SEQ ID NO: 51839 - DNA, 584 bp, Triticum aestivum
  unsure (1)..(584): unsure at all n locations
  Clone ID: PAT_TA_51839
ggnacaatccaaagctgctgcccaactccagctccatccaaaactactcttgtcatcgccggtggtgggctggcgctccgtccccgtgtcggccgttgttgccgtaggagttgccgagcatcatcgagctgttgatgtgttggtgttgccaagcatatcggtgcagcgtggccggtgctgtggaggaagtagcgttgtgcccgtgaatctcgccggcggcggggatgcttccacgcaacacgcgtggtgctgcatcctctgcagatctccgcgagcgagggagttgcagcgcagcacggcgcaacgagcgtggcggagctgcagtgcaacatgtgatgttgtactcggtggcggacctcgccggcggcggagctgcagtgcagcgttcatggtgctgcgtccgtctcatcgccggcgcacggcggagctgcagtgcagcgcgtcgtgctgcgaccggtggacctcaccagcgacgggaagctgcagtgcagcggaccttatcggcgcggcggagctgcattgcgacacgttgtgctgcgaccggtggacctcaccggcggcgggagctacagtgcagcacatcg

SEQ ID NO: 51840 - DNA, 546 bp, Triticum aestivum
  unsure (1)..(546): unsure at all n locations
  Clone ID: PAT_TA_51840
ggaaatacacatattcttatcttaggaacaaacatnaaatataaatggtaaaggaaaacccaatacaatgtcagcagttgacaaaaccgccatggcactttcatatgtgtgcccgtggagagtgaactgtttaggccttgccggactccttgcaccccggtggcttgaaggcgatgaagctgacacactgcacctggcgcatgttggggaatcccatgatgcggacatacacgtaagggtacttcttattgtaccttcttcacctcgttgatcacctgcgtggcgtcggtgcacccgaacataagcaggttgcacattgttcagtacctgtcatcgtagtacccactggatgcgttgtgctcacggaagataaacccaaccttgctgaactcgaagcatggctcccacttggagcggatcaagtagtcgacctgcttgacgagggcctacgtgctgaccggcggcaggtaggacagggactcgacattcttattgccctcaatgggccacacctgcatgcacctgatccttccaccgttgctgaca

SEQ ID NO: 51841 - DNA, 548 bp, Triticum aestivum
  Clone ID: PAT_TA_51841
aaaccttaatggccaagtgctttaattcgaataatttgcagaaattacatgactggaacgcttgaacaggaactacatactgctggagtattcaaacacacggagaggcaccatggaaagcaggaacgtgacattattcaccctcaaattaaagacttggggaaaagctttcacggaaactgtggcacgcgtgtgagtttattcctagaccatgctcgttaatttatcctacaggtatgtgctactcgttgtacttggaacggcactttgaactccacgttgatgaggaccttgatcatgataatgtccgcggagttcatacctgaaagataagctccgaggacgtagccgttgtagtgctcgctggtgtactgcccggtgaagtagacccgcccgccaaccggcgcctgtagctggtcgtactcgtagcgaatgacgcctacaggccattttaattaagatcccttgaagaattggatggaccaccatcccagcacgtacatatccgctggcgtcggggcacgttctacttcgagcgaacatgttac

SEQ ID NO: 51842 - DNA, 524 bp, Triticum aestivum
  Clone ID: PAT_TA_51842
aggtaaatcatacacgattacataatcataactctataaataggggacaaagaagacgaaaagacagggaacccaagcggacacattcgcacagggcacaccaaggacacaacatagggggagagcaagcatatacacaacaggctggcacgcactcaccacaggtaggaattcagagcagaaggggagcgctccagagccatctaaatcaacccccagtgcacagggcgtggagggtcacggagaggaaggcggccctggccttggtctccgcggaaagggcaccacatcagggcaggtggagggggaaacagggactgtcacaaataggaataacgccttatcagcggtaagatcaatccggttaccgacgacatacacacaactgctgcaactgtaagatcaggaggcacgaggcactttttcttgtcaaagccaggaatataactcttcccacacttctaaaagatcacaggaattctgtgaaagcacttgtaccttaagcggaataacctcagcctggc

SEQ ID NO: 51843 - DNA, 632 bp, Triticum aestivum
  unsure (1)..(632): unsure at all n locations
  Clone ID: PAT_TA_51843
tcgcatgccgccctttttttttttttttacaaatatgctgtcccattctcattgcttgaagcttgacaacatgtctttcattactaaagnaagcaatgttgaagtcacttgcaattctatgttgtgcgaagttcatctcttcactcagttaaaaaagaatccgtctcttcacttgtgtttcctgatctactttcagcctactcaacaaaatgctcgtgcccgccgatcttcctatgcatctgcagacaatgatggtactccttatctgcgcatgctaagcagacaactccctgtatttgatggtcaatgtagtcccagtctcacacaacattgtcttttattttttctgtagagagtttgagtttgcctgccgaggagctgatccagaatgatgatccaactgaagacaagaacaaggaataagtataatgtgcatcgtgctttttatatggaaaaatcgcggttctgctgtcatgataccaaaactgtgccttgttaaataactagcaccggtacttatagcatgcctgaggttgagctctgcagttttagctgcggtatatctggcttcttccacattcagctatgcctgaaccagctaggaatgaacatttcatgatggtggtgtttgt

SEQ ID NO: 51844 - DNA, 581 bp, Triticum aestivum
  Clone ID: PAT_TA_51844
tcgcgatctagaactagcgaccagggcgccgtccggcaccacgcgcgcgcgcaggccgcgtccgggagcgcgagcagcgtggcgctcccgggcgcgcccgccgcacacaacaacctggcgctcccgggccccgacggcgcggtcggcggcgacccgttcgcggcctcgctgtccgtgccgccgccgtcctacgtgcagatggcggagatggagcggaagcaggagctgctggcgcaggagcagaggatgtgggcgcagtaccggcagggcgggatgcaggggcaggccggcctcaacgggctcgccgtcggcggcggcggaagcgcgttcgcgtcgagcacctcggtgccgatgcccatggcctaccacggagccggcgggtactactactagctccagtcctcgagctaagcggcctctgctcattcccccgtcgagcttttatatgtgaataatactctggactctgatggtgatttgctatgaaaaaaatgtaacgcgaactgatttgatcctgctcgatcgctgaggttaccatggcgattgagaatttgagattgattgtgaaaaatacttatacg

SEQ ID NO: 51845 - DNA, 257 bp, Triticum aestivum
  Clone ID: PAT_TA_51845
agggggacaaggcaaaaagtcaagttgcataaatgaaacttggggcaacagcccctacaaagttttttaaaaacacactgttaaaaacaggggcctcaaactacaaaaaaaaggaaggtttttagttgtaaaaaaaaactgacaaaagttccaaaggatcccggagaacccatttacaggggacccacactttttgggctccaaaaacttccaaactcctaaccccttccgttttttggaaaataactcttcacccc

SEQ ID NO: 51846 - DNA, 527 bp, Triticum aestivum
  Clone ID: PAT_TA_51846
agggggtggaaaacatagatagaggagatttcgagtagtgccatgaccatctcgtattaactttgctcctatagtcgccttcagaaatagattaattaaagttcttgggctatgtttaatctaacatcaatagaaaagataaaataaaataaactatacaaaaaaccgactgattttggtagaaaatccgtcgggttgacagccgtttgattaccccattgatggacgggggatcaagcccctcccagcgtttctgtccctcgcctttctcggcagcaacgtcgccttccagcagccactgcggcaaagctcaattcccgcgggtcatagccaccgtcgtcgccgtacgctgcactgcagctcccgtcgccggtgaggtccgctgcactacagctcccgccgccggtgaggcctgccggatgcagcacaatgcgttgcactgcagctctgccacaccagcgatgtgctgcactgtagctcccgccgccggtgaggtccaccggtcgcagcacaacgtgtcgcaatgc

SEQ ID NO: 51847 - DNA, 558 bp, Triticum aestivum
  Clone ID: PAT_TA_51847
atcatcatcctcgcaccaaactcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacctaattaactactcct

SEQ ID NO: 51848 - DNA, 534 bp, Triticum aestivum
  Clone ID: PAT_TA_51848
agtcaaaaaatgcctgtttactcaacacttgttgtgctgtatgttgctgacgggctaaatacgatgctatccaagcaaaaatccaaaattttacaatcgtgttttcgttacacttgtatctcaggtgtgcacaggaaaatgcccttgtagattaatacaggtggaaaatataaaccggtctcccaagcgcagcctacggcagctgcgcatatacatactttaaacgcactgaacctgtggtaatctgcatctgagtttatcttacacccatggactccccgcctagttctacattgtactccagtccgcaacagcatttaataggatcagaaactcccttcattttaatgattcgttcttcaagagactggaagtactcggcttctccagctccatcaccttgtagagctttgtattcttcctccaaggacttcttatccatctcctgcactgcagcagggaagctagcagttatgttgctctcctgctcaagggtctgcttacactgcaaagttaataattctttagttgaac

SEQ ID NO: 51849 - DNA, 567 bp, Triticum aestivum
  Clone ID: PAT_TA_51849
ccccgcgtccggcccgcgtgcgcccacgcgtccgccggcctgtcgcatggcgtgcgtctcccagtcccggtcggtaggcgcgccagcaggtttaccgtgagggcgtcctctgcggaggccgaggccgtcggccgccgtgcggtccttggcctcatggccagcgtagtcgtcgggagcgcgttcgctcaggtggtgcacgccggctccgtcgcggccatgaaggttggccccccgccgacgctctccggtggactccccggaacggacaactcggacgaggcatgggacttcgacctgcccctgaagaaccggatctacctgcagtcgctgccaccggcggaggcggtggtgcggtccaaggagtcggcccagtacatactcaacctgaagccggtcatggacaagaagcaatggccgtacgtgatgaacgacctccgactctaggcctgctacctgcgctacgatctgaagaccgttatatgcttcaagaccaccatagaggagaagaaggacctaaagtacctcaccggcaagctcttcgccaccctcgacgggcttgaccatgca

SEQ ID NO: 51850 - DNA, 611 bp, Triticum aestivum
  Clone ID: PAT_TA_51850
ctccgggcgcgtgggggaagggaaaggcccgggcagtggaaaagccgttgtcggtggcgcggaagcagcaggcggtgctggcgaacgtggaccaggtcaccggcgagaggatccccaagagcttcgtcttctcgcgcggcaagctcccctccacgctccgtcacctccagcaggacctccgcaagctcatgctcccctacaccgccctcaagctcaaggagaagaagaggaacaacctcaaggacttcgtcaacgttgccagtccattgggtgttacgcatttcttgatcctctcgaacccaaagagcttgcggcacttgcgcttcgccaagtcaccgcagggcccaacctacacttgtcagatttcagaatacgctcttgcggctgacatcgcaaactcccaaaagcggcctaggtgtcctgcagagatattcaaaaactcgcctctggtcgtgctcagtggtttcaatggcctgggcgagcctttcaagagttttgttaccttctttaggcatttggtccctgctattgatacagatactgttaagctatcaacctgtcaaagatattattgctacagtatgacaaagagacggaggctatcgatttcc

SEQ ID NO: 51851 - DNA, 583 bp, Triticum aestivum
  Clone ID: PAT_TA_51851
gcccggaattccgggccgcccccccgtccgatgggcctaggccgatccaagcacacgttccaggaggagcctcgggagccggggtcaccttacagggacggccccgcagcacgccaagccaatactcgactcggcagagggaaacgatgcccctcaacaacccacgacagcacaccgggctcggaggcaacatcccgcaggactcgctgcctgaaggcccgctctggaaccgttaagaccctgctcgccctgtgcgacactggggaggcccctgtgcccttgttctactgcgccgaggacgacatcgagaagatcttcgattgcatcacagcgtacagggtgagggaccgctactgacaagtcgagggcacttcttccttgatgggcctcattgaccataatgactccaaggataggcagcgtgccgtctgaaaggatgctgcgaaccataatagggagcagaccattaaccagattgctaacggcaatggacggtttattctgaaacagatggtgtcgctagtgctagccggcaacacacaggccagtatagctacgatcggtcgcttgtgtcggcatagcg

SEQ ID NO: 51852 - DNA, 557 bp, Triticum aestivum
  Clone ID: PAT_TA_51852
ccattggttaccattaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttg

SEQ ID NO: 51853 - DNA, 549 bp, Triticum aestivum
  Clone ID: PAT_TA_51853
gcagcagtgcagtacaaatagacaaatcgaatccaatcacgcaaacgctccctaagcatacttaaacaagagttagtaatccaaaaggctcctacgcattcttcaagttaccagtccaaaggctaactaaatatacacagctacattaacagtggcctacaatgtccaggagtagacgaacggcaacacacgcccacatatctttcctttcctgtgtaaacatcttgagctgctccttgtgcctcggtcggcctcagctggcgttggccgtctggtcgtgctcaatgaagtccatggcctgctccttggacaccacgttgatgaagctcaccctgttcttgtgtgtcacgccgtagatcttgtccgcgaccttcaggatctccggcctgaatgtggtggctatgaactgggtgtccgccaggtcggccagacgccggaccacgctcccgacagccgttctgtactgaggatccagagcagcatcaatctcatcaaacaggtagaacggagctgggtcacatcgttggatagcgaagatcagtgttaatg

SEQ ID NO: 51854 - DNA, 364 bp, Triticum aestivum
  Clone ID: PAT_TA_51854
atactaaaagcgttgcattcacactttcatatataccacttatatatcatcagtagttctggttaaataggagaaaccgggaggagagagaatttaagtacacggcagaaaaggaagagcatatatatctgcacgcacgcacgcacgcacgaatcttggcgcaatccatgtgccgcgccgtgcgcacgcacacacgggttgcaccgagatcctgaatacgggaatggcgcgggagcgacggtgccttagtacttgtaacccgcgacgtgcaagctctcggacgcggcggcgtccccgccggcggctgcgccgccgtacttgccgagcgcggacgcgtgggcggacgcgtgggcggacgcgtggg

SEQ ID NO: 51855 - DNA, 562 bp, Triticum aestivum
  unsure (1)..(562): unsure at all n locations
  Clone ID: PAT_TA_51855
gcgatctagaactagtagaaccgggagctgngagtgatccactgccggtgggccatgctgggcgcgctcggctgcgtcttccccgagctgctcgcccgcaacggcgtcaagttcggcgaggccgtgtggttcaaggccggctcccagatcttcagcgagggcggcctcgactacctcggcaaccccagcctggtccacgcgcagagcatcctcgccatctgggcctgccaggtcgtgctcatgggcgccgtcgaggggtaccgcgtcgccggcggcccgctcggcgagatcgtcgacccgctctaccccggcggcagcttcgaccccctgggccttgccgacgaccctgaggcgttcgcggagctcaaggtgaaggagatcaagaacggccgcctcgccatgttctccatgttcggcttcttcgtgcaggccatcgtcaccggcaagggccccctcgagaacctcgccgaccacctctccgaccccgtcaacaacaacgcctgggccttcgccaccaacttcgtgcccggcaagtaagctgctaggtgtttgtgtctggaaa

SEQ ID NO: 51856 - DNA, 486 bp, Triticum aestivum
  Clone ID: PAT_TA_51856
gttagaactatgattacaaaaggaaattcggtacagaaaagaaaacattacatgcactagaaacgtcacgctcaatgtggcactaaacaggagggagggacagattactctagggacttggagcgcatgtggggacactacagtgggctatagatccatcctgaaaacgactggccatgacttagcgctaaggagtttggtctacattcttagaagggaggtagcttaaatgacctagttctgtagatcaactgtagaccagaagcgtaacttggagggcaacttagacgggccacttgacctaattgcatgcccataacaactctcagcacatgctttgagaactgaacccagacgaatcttaaaatacaatgcggtgaaggccatgttcctcggctctcctaaacttttctagacagatgaaacttcttgtcgaccatcggggcagtttgacggtgaccttttgagtccttgacggcacttgat

SEQ ID NO: 51857 - DNA, 500 bp, Triticum aestivum
  unsure (1)..(500): unsure at all n locations
  Clone ID: PAT_TA_51857
gtatcaaaaactcttgcttgatattttacttgagtcatcattcaaaactgttactccatggagaaagaggcatggatacatatatactgcagaaggagctatatatggatagaattttatcaagtagtaatagcaacagtgattgatcccatactatgactttgcctaaagcttggaagaatggcaggctcgagttgcttggcgttaacagaagcttgggcaacgcaaggagggggcaccaccttactcaaaggaggaagggctccaccgacgttcgggttcccccaacaccgagtaccccttgcacttaccaagctaagttaatagcaactagcggtggcatcccttcaccctatcacttatatgcagatgctatatgaggcacgacgacggcattattaatctgaaccagcactgggtttatgtaaggctcatactaaaaaacataaaggccaacacggnaacatgaggattcctgccttaggagctccatccagtgc

SEQ ID NO: 51858 - DNA, 567 bp, Triticum aestivum
  Clone ID: PAT_TA_51858
tcgcgatctagaactagctccggccggcagccatggaggagtacctggcaaacatgaggaccctacgcagctacatgaacggtccgtcgcgcgaacccaccgccccttcccccgtccccgctcccgccgctctgactctccagccgcctcggctgtcgatggttgcgtcgctgggctgcagatctggaagaggaggcagcgaagcggtcagcagaggagcagaggcagcgcacggccatagatgctcacgacagcgacatcgccttagtgagggcgcaggcgaaacaggtgagcgacgaggccgagcaccttgccaaggcgagggcgcatgtctgtgtggagatggccgagaagcagggtaggatcgcctcactggaggtcgtgggtgccacgctgaagcagacgttagacctcctccagctggaaatcacaagtacatctgcaaaactcggccagaaaagattattttacacgaagacaatggaaactttgagtgtcaaactacaagagcatcagggatggcttgattcagataagaataagatggttgcaatagaaccatttgct

SEQ ID NO: 51859 - DNA, 473 bp, Triticum aestivum
  Clone ID: PAT_TA_51859
ctgggtcatgctccaggacaataattcaaaatccaatatccaacttaaaacgcagcagctagggcttatatgcaccctcctaaaggcaaaactgaggtaaatacaaaatatgtatcatgttacacggttaaaaaaccattcggattcgaccaaaataaggattatcacttaaagaactttatccctttttttttcaaaagcgacttctttactatgctttctcaaggatcaaaactcataatgttggcgaaatacaccagttgcttaaaatttttagcaatcatcataggctggtgttaaaaaccactcgagctcatttaggctacttttcgtaacccgtgtggtcctcctccgtcccataaaccaactccataatatcctaaaaaacttctatatcttcttccttttggccctccttaaaatttttttttccaacaaattgggggtaaaagaagtcgcccgagcataaccca

SEQ ID NO: 51860 - DNA, 511 bp, Triticum aestivum
  Clone ID: PAT_TA_51860
caatcatcaaaatacatcagaaccaaacccagtttaatttttaaaggcttttttaacaaaggggagcattgggcggttcacttgcatttacaccaaaacaagttcaaacggggcagttcgccggcttaaaaaaggctttgtaccatgtctacacattatcggggataaaattattcacgtccatttgggcaccaccgcaaacagggtaaacatgctgaacaaaaaaagctaccaaagactatccaaaagggactgaattgaattccttccatgcctcctggaaaaactcaaaaaccttttctgctatatacttttgaggcatggcagctcctcgctgttgcaacttatctggatgaaaacataacaatgccttttgataagcttttttaaccgctgctccttcaattatgttaaccaatggaactggtttccatccactctcaggccaaaaaacatattgcagtgtaaaaagcaatgaccgaatatttccttcttttccctttgaccactc

SEQ ID NO: 51861 - DNA, 492 bp, Triticum aestivum
  Clone ID: PAT_TA_51861
cttgttctgcgtggggctaaggatggacattgcatcgagcggaggaggtggtctgagcgtcggggacgttttccttcttgacgacccactttttgatcggtgctctgtatcgtacacaccggacctacggcacaatgctgagcgatccaagtgcttacaggacgcgggagacttggttcatggccatcacaggttctgcttcggccgatactgcgtgtgcccggcacgaggggaacagcacacgagtgcaccgccggaggctcggtgcgctccagtgctgccggcgggtacgtagctatgaactacgcgccaaccttggggctcacggagccggacgtgaacatggtggccttcgagagggtgccctactggagaccttctggaacattgtgagacccgtagacggcggcgaggacgcgctcattggcggcttgctaagcgtccaggttcggccggccgtccgccaggaagtacggactacactaaggggac

SEQ ID NO: 51862 - DNA, 357 bp, Triticum aestivum
  unsure (1)..(357): unsure at all n locations
  Clone ID: PAT_TA_51862
tctgcgacgtctcgctcttcttggtgtctcctatattcattcctggccgtcgctttacatggaaagttgatttcaacatttgggcgggcccatgttctanctgttggccagtgaacacaattgccctttccggtggaaattgcacttctggatccccctgaagatgatgctccacactttctggtccctaacaagaggccccctgaacatggtgaacacacacgcttttttggttactcatttcttgtgcatgttgctctaaactgtcagaggttggccagggtaacctttacttttgttgcaacccctctccttcttcttccacgtatggcagtcatggcccaggtcctgcttgtc

SEQ ID NO: 51863 - DNA, 149 bp, Triticum aestivum
  Clone ID: PAT_TA_51863
cgggtaccctgattaccgagattgggcacaagaaatggaacccaggcgggcgacattacaaggactggtactggtacaaaaaccccttggtattcgccttcaaataggggtaaagacggggtttttacggggtaactcccgacttgcac

SEQ ID NO: 51864 - DNA, 476 bp, Triticum aestivum
  Clone ID: PAT_TA_51864
gaatagacgcgcttagtgtagagtacagggcatgtttttacaagggctagtgcatacatgtttgcgaaaagaacattttttactagattaatggggttcctacatggtgcaccctagagtatttaccataaaaatacagggcacgcacgacaagtagatttatgcgacgaacagttctgtctgccctgtgatgaagagggtcaagaactcctccccgtacacagtctgctttttgatcaggatgatatagatcctgtggaggatgaggatgctgttgatgaaaatctgcagtgccactccagtatggcggcttcacgagtttcctgacctagacgcttacaatgtcttccttggaacatggcactaatccttatggctcaacatttgttggtctaataaaggttttccacctacataaacctaatcgcaaattgcccaatattcttactgaacctaaatttttaaacatttttatg

SEQ ID NO: 51865 - DNA, 132 bp, Triticum aestivum
  unsure (1)..(132): unsure at all n locations
  Clone ID: PAT_TA_51865
cggncgcgtgggcggncgcgtgggtgagagggtatcgcaaagatcctttgttgattaatgcaggtctgatcacataggagagctgctgggacttggtgatttgtaaaatatgaaccaatggtgacttaatgc

SEQ ID NO: 51866 - DNA, 275 bp, Triticum aestivum
  Clone ID: PAT_TA_51866
ccgggtcgcatggggcagcggcggcggcacagcgccgtggagctggcggccggggcggacgggctcgcgttgtgcgcgaccgtggcggggtacctctacagccctgaagcgaccgcgtgcggtctgcccccgggccccggcggatcactgggcgcggaggagggcgacagctacctcgtgggggcgggcctcgtcggctggtcgctgaccaccaagtacgcaccgtgtagggcctaccggccgggccctacggcctgctcggccccgacgagggc

SEQ ID NO: 51867 - DNA, 605 bp, Triticum aestivum
  unsure (1)..(605): unsure at all n locations
  Clone ID: PAT_TA_51867
ggttgggcaattgcactagtttgaggcacctttctctttctaanaaccatatcactggacacttcccatctaagatcagtctgctcggtaatttgactggactcgaccttggctacaataacctagatggcgtgatcacagaggaacaccttgttactctaaagaacataaaccatctggacttatcacacaactctttctcagggcatctgccataaaagcttggagctaagggattagtagaattgactttatcctccaataaattcactgggtacattcctgaaacaatttgtacgttgaggaacctacttgtcttggatttatcaaacaaccttctagagggagaacttcctcagtgttcacagaagcctaacttggttttcctcctgttaagtcacaataagttttctggcaagttcccatcatcattgaagaactactcaagtttagcattcatggatctttcatggaataatttccatggaacattgccatcatggatcggagacttagtatacttgcgctttttgcaactaagtcacaatttcttgtgtggagatattccagtgactatcacatatcttaagctccttcgccaactg

SEQ ID NO: 51868 - DNA, 132 bp, Triticum aestivum
  Clone ID: PAT_TA_51868
gcattaagtcaccattggttcatattttacaaatcaccaagtcccagcagctctcctatgtgatcagacctgcattaatcaacaaaggatctttgcgataccctctcacccacgcgtccgcccacgcgtccg

SEQ ID NO: 51869 - DNA, 547 bp, Triticum aestivum
  unsure (1)..(547): unsure at all n locations
  Clone ID: PAT_TA_51869
ggacatacacatattcttatcttaggaacaaacaagaaagataaatggnaaaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgcgtggcgtcggtgcacccgaacataggcagcttccacattgtccagtaccggccatcgtagtacccaggggatgcgttgtgctcacggaagataaacccaaccttgctgaactcgaggcaaggcacccacttggagcggatcaggtagtcgacctgcttgaggagggcctccgtgctgagcggtggcaggtaggacagggtctcgaacttcttaatgccctcgatgggccacacctgcatgcacctgatccttccaccgttgctgacgctgc

SEQ ID NO: 51870 - DNA, 541 bp, Triticum aestivum
  Clone ID: PAT_TA_51870
caagtgtgtatgtattcaaccccgccaagcctgaaggtttgtaagaaattcttttgctatctgaataccagccaagccagaacaacatatatccctacaaaaacatctcagcagaccaaactaacaaatctgcaactgaaccaatctagcagctatagttgtgtctgcgtgttgtctccagggccaggcggcagctccccacccatcttgggggcggctcccagcactctctccatgtcaaaacgcacctcgatgttgcgcatgctgtacccgaccatcatcagccagaacagcaggttcgccagctgagcaccgctcgtctccgacaccgccgtcttcatttgtgcagggtccgagacggccaacagacgctttatgaatgcattcatagcaaacacgacgtcctcacccgcactacttgcaagttccttcagattttgaggttctagagttttcaggtattccaggagctcattgcttccttgagatgatttcctagcaacttgacggctcagttcatcaatttctgcttcaagcaact

SEQ ID NO: 51871 - DNA, 537 bp, Triticum aestivum
  unsure (1)..(537): unsure at all n locations
  Clone ID: PAT_TA_51871
ggcgccggtttggctggcgctccaggtcagcggagacggcggcggcggnattggaattgaaagngaaatgcgggtgngagctgcacgcacaccgaagnaaacttatataccagcggattagggcaagcttttgtaagggaagggtgcacgggccgtgacccatttggctggacactttgggtttgtgctttcagcctcattgccctgatgatccaaggttttactggtaattctccatcatgtgtggcatgtttcttgccgggtattccaaagtatttttcatctatcgtgctaaaaacactcttccgtgtcaacatcgagaaccaaaatatgtaatacccaacattactcgtaaccaatcaccaggaagatgttccaatcacattggcgtaacggacaatagacaaagtcgaagccaatgaagctccaaaaaacctgtacctttttatactcccttcgatccatattaattgtcactcaaacggatgtatctagcaactgaaatacgtcgagatacatctgtttgaccgacaacta

SEQ ID NO: 51872 - DNA, 428 bp, Triticum aestivum
  Clone ID: PAT_TA_51872
ctgcaaacagagagcacttttattcgtttaccttggaaagggttacaggcggaggccgggggccatcataccccggggtacacatgaacatacattggtccatacaacagctcaaatgcgtgggggggggaccagggcaccaaacacacttttaacgttcgagggtttcagctagaggattatgcatttgctgccactctttgcaccggatgcccctgccgggctttttttggccgacggggctctcctttcctttatccttttctcccttttttgggccataatgaccttgacaaactcgtcgtagttgatctggccatcgccgtccacatgggcctcggggaccattttctccaccttcttcttcgacaggttttccccgagggtgggcatcacctgggggagctccgctgaaaaaataaaaccgt

SEQ ID NO: 51873 - DNA, 535 bp, Triticum aestivum
  Clone ID: PAT_TA_51873
ataatattatgtgcatgtgcatatacatagccatcggtagcattcacatacgagcatgctttctcgagtcatgtcgggaacatggacatacacatattcttatcttaggaacaaacaagaaagataaatggaaaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgcgtggcgtcggtgcacccgaacataggcagcttccacattgtccagtaccggccatcgtagtacccaggggatgcgttgtgctcacggaagataaacccaaccttgctgaactcgaggcaaggcacccacttggagcggatcaggtagtcgacctgcttgaggagggcctccgtgctg

SEQ ID NO: 51874 - DNA, 459 bp, Triticum aestivum
  Clone ID: PAT_TA_51874
ggggggcaaaaaaaaaatatgtatatgtaaagccggggctaaaaatctaaaaggcatccccccggacccaaatggggaagggcttacaaacataggcccatattttcacatatgagtagaacgggaagtaaaactgaaaaagccgagccccccacaaaggggactaaaaagacatggttatggggtacttaaacttgcactttaggccttgccggattcctcgcaacctgggggcctgaaggcaaaaaaactgacccattgcacctggcccatgttgtcaaaacccataacccggacaaaggcataaggggactcctttttgaccccccccaccccgggaagcacctggggggggggggggcacccaaacaaagggagtttccaaattggccaatatcaaccggcgaaaaacccgggggagctgttgggctcacggaaaaaaaaaccaaccttggtgaa

SEQ ID NO: 51875 - DNA, 547 bp, Triticum aestivum
  Clone ID: PAT_TA_51875
gtcccgtattcagatctccgttacttccaaaaaaaaatatctatgtacactagctttgatccagttacaaaactgcgaatttcatggtcatatgatgcgtgtgcagtatgcagacacagttgtaacctttgctaacgaccaagtgcatgcatgcaaaccattgttctgaacttctctgctttctgaacagcagtagcgtgtagtccctgcccacgcaatgaagttgcccaagaaccaccatatccaccgtgcgcctgaaccaaatcctctttggcggtgcttacgatggcttcaaatgtggagagaaccgcctgggattttcacttggagatgactctcataaaccggctcacggagctaaacgcggccatgacattggtcatcattgaaggctcctcttcaggttgctcactggcgccgccaccaccaaatattatctcaatatctgttgcatcaggacgactcgaagattctctggcgagcaaataccgattgggtctttttggatcatcatagaacactttccacttttcaggatagcatctga

SEQ ID NO: 51876 - DNA, 437 bp, Triticum aestivum
  Clone ID: PAT_TA_51876
accattaaaacttttttattttacatattgttaatattatgtcgtgcgcaaatatacatagccaccgctagggttctcatacaagcatgctttctcgagccagggaaggacatgaacatgggacatacacatattcttaggaacaaataagaacaaaaaatggtggaggggatcccggagcatatgtcaagatacggcaaaactgcattggaactttatatccgggcaagaggggagtgaactgtaaaggccttgccggactaaaaaaaggaaaggcccaaagccaatgccagggaacaaaaaaactttatacggactttatgttcagacccatgtagcccgcatctttacaaacctttttatttcaccgagcctatcttcgagacagggaaaatatagttacgcctttcacactgcttggaacttacccacaagga

SEQ ID NO: 51877 - DNA, 543 bp, Triticum aestivum
  Clone ID: PAT_TA_51877
aataaaatattcatatatgaaaaagaacgaaaatatagccccggcctccatacaccaaacaatgcatctgctctcgcaaatttcaatctattgctagtttcttacattcagcttgcagccatgataggaagacaagtagtttctcaactcctaaaataatgacatatgccttttccaactaccttctaataatgtgcaagcaagattaaaataactttagacttttaacttaaagcaacagatgctactatacctatacatgtatctgctctaattttatagctagctaggagcagaagtatttaagtctttaagctgcagcaacatgctcgttgattttcctatgaaggcggcagtcagtgaatgataacatcgactttgccatctggttgtacatgctctccgaaatcctccttctccaagaagctatgaaggatcttgttctccactgcttctgcgattgctgcacacctaggaacttgtgatactttcctgaaataagtcaaataacagtgcaatttttatgcataactactgccacgt

SEQ ID NO: 51878 - DNA, 536 bp, Triticum aestivum
  Clone ID: PAT_TA_51878
caacacaaaaggaactagagccggaaaattaaaaccatgtgagttcatcatgactcataagtacaatccaatataacagttacatgcattagaccaaagttcgtattacaagtctaccggacagaaaagaacatatactagcacaagctaccaaatgccgtggcaccttcatttatttcatgcttcagtactagggtgaaagaacttcaccagatttgcattatcttgttgggtgtcgcacttaagttgttgtcgccttgccggttatcctaccccaagtaacaaccacaaacacgtatgccttgtcatacgacttgtcaaagaggcggaaataggcaactctccacactttcttgaacagtagggtgcaaaacacgacccagaggccagcgacaaacccggacccaagtccaaagtaaaagaacaacacaggctcggaaacattctgatttttctgttgattgtcgtgctctggtgaattgtttcctgagcaattcctttcaagaggagtaccacatagaccaatgttacccgtg

SEQ ID NO: 51879 - DNA, 542 bp, Triticum aestivum
  Clone ID: PAT_TA_51879
ggaaaaaataagatacaaattacccatcaggcatgtggcataattgtggcaagaaaattccaatccaacacatcacgggatccaacatcaacggctacaattgtctcaaactggcaagccaaacttcaacagcaaacatggctccatccaccaaaggaggaccttgagatgccatacaactactaccggaaattggtacagagagacaagggccgccatcaaattacgataagacaagcaaacaactgaatccccatgattctcgcaattccgtcgctcctaagggtatcttctccttggtgggctccttgagcgattaggcctcggtgatctcttccgagtatttctctgtttgacagggccactgctaaatgcccagtcaacacttattatctgcgaaagaagctcagttccgtctgattctcttattgcacgcttggcttgctcaaagttctcatactcaattagagcatatcccttcacaaatccagtccggcgatccaaattcaaatgcaagttcttgacctgccccggacgcgtgg

SEQ ID NO: 51880 - DNA, 510 bp, Triticum aestivum
  Clone ID: PAT_TA_51880
ccgacgcgtgcgtgcacgcttaacaaaacaatgaggctgatgcaatagcgtacaaaccgtgtcaacattggactagactagaggacctatgtgtgaaacaggctgaaacgatgatgaagacacatcaattgcacgcgccattacttacgaaaccctctgaaatcaagagagaattttacgatgaaagctgggacctaactggggatattgattaaatggcagagatctcttatgatggcatttccatgtccttgaagaaccaataattctcctgttccctgaattgtacgggttgcatagcatgtgcaccatgtttgggtggaatgactacaaaatcgactggatgaatcttttttgattccggaaaaacatgttttgtttgaactaattatacaagatctacctttttatcgaacaaagattggaagatgttattaactgttctatacctgattaacaggatttctgtaaacactttctaaaaaaaaaataaaagcacgggcgattcta

SEQ ID NO: 51881 - DNA, 256 bp, Triticum aestivum
  unsure (1)..(256): unsure at all n locations
  Clone ID: PAT_TA_51881
aaattcccaaggnaacgcgtgacactggggngagagagatcatcaaatggccataaggcggcatgcactttcagtaataacagttgtactatttgagatgcacggtgttgnctgaaattgatacgcctgcatttgagttgagagaaacccttacgggcaaatacgaccttgctgatcagatccaattgtaaagctagcacagtttttttttttctgaaacctgaaggtggcatccagagaaaactactttcagaac

SEQ ID NO: 51882 - DNA, 581 bp, Triticum aestivum
  Clone ID: PAT_TA_51882
cctgcctgtatgaaagacaagtacatggctttgccggtctcaatctgccacctggctcacttgggaacagtagctatggctgcaggacacacgggaaaagcttccggtgcgacgggctgccgtgagcccggcggaggcgagaggtgcagcgtgccatccatgccatttcgacgctccacaagcattgggccttggacaagatcatggatgttgccatgccctctatttgcccacgcccgctccacgtctgggaacaacaggcttgactgctcggagcgctacccgatttactgatgagaatatatgtcgcaacctggtgccgagtagagtgaatgcggtgcgaaatgtacaagtgctgatgcctgcacgttctaccatactatgctgtgtgccttggaagaacgaaccaagattatggattttccacctaccatataatacctggaccatagtgggcacaagctgtacttggaggcgactgactactgtatgtttgtgtacacatgatggcaaactagcggttctgtcaatgaggtgcaggagccgggcctgcaaatctgacctacaaaagcgccgcgcct

SEQ ID NO: 51883 - DNA, 576 bp, Triticum aestivum
  Clone ID: PAT_TA_51883
agcaattcacgtactccgccatggccccagccgtgatggcatcgtccgccaccaccgtcgcgcccttccagggctcaagtcgaccgcgggcctccccgtcagccgccgctccggcagcgccggcctcagcagcgtcagcaatggcggaaggatcagatgcatgcaggtgtggccgattgagggcatcaagaagttcgagaccctgtcttacttgccacccctctccacggaggccctcctaaagcaggtcgactacctgatccgctccaagtgggtgccctgcctcgagttcagcaaggttggcttcgtcttccgtgagcacaacagctcccccggctactacgacggtcgatactggacaatgtggaagctgcctatgttcgggtgcaccgacgcaacgcaggtgctcaacgaggtggaggaggtcaagaaggagtaccctgacgcctatgtccgtgtcatcggcttcgacaacatgcgccaggtgcagtgcgtcagcttcattgccttcaggccaccaggctgcgaggaatctggcaaggcctaaagtgcaagttgaagtaacacatatacatg

SEQ ID NO: 51884 - DNA, 557 bp, Triticum aestivum
  Clone ID: PAT_TA_51884
gactatcactggacgcgaagaaggtactgcaagactactgcgactactgcaccatcacaggcgccaaggtctaaactatcgagagcgaactaaataaggcagctcgctaccctactatcagtcttcgcgtgcatgacgacgctatacagactaagctcaaacagtcaaacccaatagctacacttaaggatgatggaactgaggaacgtaatgtaccaagtcctctagaagccactccaatcgactgctggaccactggatggttatcaagatgttgaacggtgaagaatcattagatggacacagatgtaccatacatacctgcaatacaaactgtgtatacttatccaccctacaaagggagatgttcagccatttgttgtaataagaaaacactcacaggattattgacaccgtgagagatgagccactcatgctaactataaggagttcatactcacagcacgtctggagttatttccactggatggagatccaaaagtacttgatgaatacatactgaaaaataaagggttgctacattaaggcccattaga

SEQ ID NO: 51885 - DNA, 121 bp, Triticum aestivum
  Clone ID: PAT_TA_51885
gacaaggccaacaaaataatgttcaaaaggggtttcattttttacatgggctacaacaccaggggacaaggacacatccaaaaagcatgcattggtccacaattacataccataatccacg

SEQ ID NO: 51886 - DNA, 477 bp, Triticum aestivum
  Clone ID: PAT_TA_51886
aaagcccgccccattggaatatgggggggtcaaaccaacccaaaaaaagagaggggcaatttatggggcccgaatccgggcgggtttaaagagcaccaaccccaaaggtgggggagcaatctcaaaacgaaggaaacacaacccaggggggccattttatagactttagagggggggaaaaaaggggggggcttcggggggtttttggaacaaccccgaccgggaaagccaaaaaaaacccccgagctttaacttaacttggaaaaaaccttgcactccacggggggggggggggttttgcaaaaaccccccaaggggtcgccgttgccgccggtcccgggccccggccatttggccgccaccaggggcgccaaataaaccacccccgggggggacccccacttgggggggaaccaggggaaaaccttgaccatggtggcccccaaaaccatggggggggaagggtccatcctgggg

SEQ ID NO: 51887 - DNA, 530 bp, Triticum aestivum
  Clone ID: PAT_TA_51887
ccgcaagacaaacagcacttttattagttccccttgctaacagttacagggatgggcccacccctatcccacaccgggcttcacaggatcactcatcgatacatacctacaacagctcaaatgcggtggacggggaccagcgctctgagcgcaccacacccacactatgcacgctttatggttaacaagtgaagatgggtccatcatctgccactatttaggccgaaagcgcctgccaatctcttattggtggacccagctcttctctgcggaatcatactttccattatcactgtcataaatacctgcaataactggaaccaactgatctggccatttccgttcacatagtccagagcaaacataaagtacaccttttgaaaatgacaaatgcatgcctacattggtccttaactatatgaagctccatcctccaaatgaaaccgatattggcctggaaaaccacgcttaaaaacgcaatctactcctgcttgaatggctagtccttggatgaagcgaaccataaccaa

SEQ ID NO: 51888 - DNA, 527 bp, Triticum aestivum
  Clone ID: PAT_TA_51888
attacctcacattataatctatacctaccaaatgccagagacaaaacacaactcataaaccacgcatgccgtcatgaactccagtatgatcaacgcacatactacacaggctacatgttacaaaaagacttcatagcacagcagtttaatgtaatcatatagacctttctcgagcaataacgatccactttcaaccagccttgaccacacgcaagaaacgccagtctactatcaaggtgtaacattgttgttacgcacaaggatgtccaaaagccctttcaagcctattcaaatatataattgttcccaaagattttggccaaatctgacttatgccaaacactgaatactacctatagatcatgtgataacacctggcctggatactcatttcatacagacaaacatgcctaaagcactatttgatgcaattaaaaacacgctcattaaaaaaagaaatcctagagtcatttcacccgactcgtgggtagacaagttaatttcgaaccagtccctgtaggcccacc

SEQ ID NO: 51889 - DNA, 424 bp, Triticum aestivum
  Clone ID: PAT_TA_51889
aacagggtcagatggaaaatctcttattctggacgaatgacacttataacatatcccacatcttcgtacgatcatagcggagaacctatatgacggaggacgaacaaaacacgtgtctacggtaccaaccaagcttgcaccagtatatattgaacgcttcacacccaaaccctgggcccacgctctggaaaccacgctatacacggcacaggaacattctcgggtcttgaccgacatcgaacaggcatcttaaaagccttctccaatctcttgaatatgcccagctatgggtacggattcaatcaccaaactaatggctgaaagcaggcctcttctcaaagctatcatctacggacattggaccaatcttttaactcatttcctccattgcagaaagatacttatatatgctttatgacttctt

SEQ ID NO: 51890 - DNA, 297 bp, Triticum aestivum
  Clone ID: PAT_TA_51890
gggataaaaaacagcagggacaaggggcccgaggttttataaaaaaaaaatcacccggggttgggtttgggggagccggctttaaaattaaaaaaggccggcccggagaaattagggtgggccatacatccccgggccatttagaaggaaaaattgcctggggggcccaaaaaagggggggacaaaagggaagttaaaaaaaaacctttaaacaagggccatgggttaaacccgaagttaagggcttgccaaaatccttgaaacccgggggcctgaagggaaaaaaaccggccccgg

SEQ ID NO: 51891 - DNA, 472 bp, Triticum aestivum
  Clone ID: PAT_TA_51891
ggatgggataaaaatattatgggcatgggcatatacatagccaccgattggattcaaaaacaaacatgctttttcgagacatgtgggtacatgaacatggacatacacatttttttaggaacaaacaagaaagataaagggggaaggaaaacccaaagcaatggcagagttgacaaaaccgcaagggcactttatatgtggcccggggggagggagctgtttaggccttgccggactcctcgaaacccgggggcttgaaggcgaaaaaactgacccactgcacctggcgcatgttgtcaaatccaatgatgcggacgtacccgtaagggtactcctttttgaccttttccaccttgttgataacctgggggggggcggggcacccaaacataggcagtttccacattgtccaataccggccattgtagtacccaggggatgcgttgtgctcacggaaaaataacccaacctt

SEQ ID NO: 51892 - DNA, 257 bp, Triticum aestivum
  Clone ID: PAT_TA_51892
gggtctgaaaggagttttctttgggtgccaccttcagggttcaaaaaaaaaaaaactgggctagctttacaatgggatctgatcagcaagggcgtatttgcccgaaaggggttctttcaactcaaaggcaggcgtataaatttcagcaacaccgggcatttaaaatagtacaactgttattactgaaagggcatgcccccttatggccatttgaagaactcatctcccccaggggcacgcgttcccttgggaacttt

SEQ ID NO: 51893 - DNA, 423 bp, Triticum aestivum
  unsure (1)..(423): unsure at all n locations
  Clone ID: PAT_TA_51893
gtaatgacaaaggtacattcatttgtcggcaggcaataatgcgcggcgccaaatatacacatgtatgacgcacacattccacggaaaaacgaacgancagaaatgctgaaaagagcaggtgggaagaaaggtatgctttacggcaaccgccatcgcctagattaaacgagaggaatagatgagctactcggtttaacagatatgtactcgcggcactggaatgcgccgctgcacagaacaaagagcccgtggaatcgagtaggtggcatagcatgatcttttgcgacaccatcatctctccttattgtggagatacagtaggattcgatcatgagggcagggaacaggaagcacagctggaacttccggtagtgggaattggaaacctgctttgacaaatggcgtgctggaccagaaagtcgc

SEQ ID NO: 51894 - DNA, 375 bp, Triticum aestivum
  Clone ID: PAT_TA_51894
ccgagaaatagacttttttccaaataaaaacgcgtgccgggggttacaaacaggggtcgtcacaggaccaagcgttctgattcctcaggggaaactaaggggaataatccaggctggacttcttcttggctggcactggggtaatgcctgcgttgaaatcttcatggatcacctatgaagggtccctgcataaagcaagcctgccagattccacacaaacagcctttatttgtgccccgtagaaatcattaattgaacgagccagctcctcaaagttggcatcaggatgtccgttcattttttttgggggaattggcaaaatccgagcttttgctttttccgccggatgagggaacccaatctttccggcaccct

SEQ ID NO: 51895 - DNA, 386 bp, Triticum aestivum
  Clone ID: PAT_TA_51895
aaagacaaaacaagaaacatgccgtaaatatagaaccaactcatgcccatctacattgaataaagactattttgaataacctggctaagagagtacctgacctaatttcggctatagaacacgggctcctggaggactgcgtgctcatcaaaattgaaaatcgccttttcacattcttaatcgactaaacagcatttatcgtctccgaaaagcctctgacacactctaagaacactatggctggaacggcttacctgcatgtaaccagcccctaacaaccccctaaacatcaacttcacagagcctaataacacttgaaacccctgcgagcctggggattaactatactacttcttacaggctacacattccaagaatggcctgaa

SEQ ID NO: 51896 - DNA, 581 bp, Triticum aestivum
  Clone ID: PAT_TA_51896
ctccatcaacttcaaaatgtctggttggtttcaagagaagtccggcgacgccaccaagacggcgtccgagacggggcagtccattcaagaccgcgccgttgaggcaaaagaccagaccggggccttccttggtgagaaaagcgaggctgtcacgaaggctgcctccgagactaccgaggcggctaaaaagatgggcgacgaggccatggggaaggtgtccgagacggtggaagccggtaaggatcacgccgtcgagggcaaagaccagacgggcagctttttcggcgacaagactgacgctgtcaagaagacggccaccgagactgccgatgctgccaaggagaagtccaccgaggccgcacagcatgtccaggacaccgctgcacagtacaccaaggataccccggtcgcccccaaggaaaacgtcttccaacaggccggcgggaatatggtgggtgctgctactgacgccaaggacgctgtcatgaacacgctcgggatgggaggagacaagtgagatgcgggtggtgccaccaagaagaccacaaaggataataggcgtgtctgcgcctgcttgccct

SEQ ID NO: 51897 - DNA, 414 bp, Triticum aestivum
  unsure (1)..(414): unsure at all n locations
  Clone ID: PAT_TA_51897
cgnanattacggcaaccagntgcttaccagctccaanagctacccttcgcacaaaattcatgatcctccccgtaaattaatggcgtctgtgcgctcccgactggtgcaactcttgccgccgcagctagggaagggaagcgactgtggagctgtcttgccttccttagctacaggagcaaccctggagcagctgatttatgaacccgggcatccttcgcaaagacggaagtctttgcaaaaatcgcacagcctgtaaggtcctgatatatagtgggctagaataatgatattggctgttatgtactatattgttgtcatattgattttcccttcgacgcagcaaggcagcatgtcatgtatagtattcattttgtaaacttctccaatcaaattgatcaagaaatgtgcaccttc

SEQ ID NO: 51898 - DNA, 590 bp, Triticum aestivum
  Clone ID: PAT_TA_51898
tcgcatgggtggaggtgttggtgcagctagtgacgtatcttcagttgttctcatggcttgtggatgctttagagttaagtaaagaaaccatgagaacagtgaagcaaaatctttggtgggcttttctgtataacattgttgggctacccgttgctgctggagcattgctgccagtgacgggtacgatgctgaccccgtcgatagctggaccactaatgggttttagttcagtcagcgtgatggccaattccttgcttttgagggcgaggatgagttcaaggcatcatgttcagagcagacaaaagcctcagagcaccatttctggtgtgtcagacggagctgatgaggtagagcaaagttatccatcaaaatggaggagtacctgactgaagtttgaagtgacgacatacttattacttcacgaacatttgattctagttcagtcacatagccacaggtgagtaaaaacactgatgacactgtaatcaccaagagtcttaaacattacgtgatgtagaagtcctcgaaccagtgacggatcttgggtcttatcaacaggttaccatacttttgacacacgatttaattaa

SEQ ID NO: 51899 - DNA, 493 bp, Triticum aestivum
  unsure (1)..(493): unsure at all n locations
  Clone ID: PAT_TA_51899
ctcctctcctccagttaatagnaataccatggcccccgccgtgatggcttcgtcggctaccaccgttgcacccttccagggctcaagtccacagccggtctccccgtcagccgccgctccagcgccagcctcggcagcgtcagcaatggcggaaggatcaggtgcatgcaggtgtggccaattgagggcatcaagaagttcgagaccttgtcttacttgccacccctctccacggaagccctcctgaagcaggtcgactacctgatccgctccaagtgggtgccctgcctcgagttcagcaaggttggcttcgtcttccgtgagcacaacagctcccccgggtactacgacggtcgatactggacaatgtggaagctgcccatgtttgggtgcaccgacgccacacaggtgctcaacgaggtggaggaggtcaagaaggagtaccctgacgcctatgtgcgtgttatcggcttaaacaacctgcgccaggtgc

SEQ ID NO: 51900 - DNA, 370 bp, Triticum aestivum
  unsure (1)..(370): unsure at all n locations
  Clone ID: PAT_TA_51900
ataggatcgtatcgctcctattctcctcaaatgggggagcaccgcacgatattggatggtggcgtatgcggagtgggcgaggagggcggtgctccaacattttgtggagatttgttcgatctatctttcgcccacgagaggatccatgccaatcttcttgtgaggcatgtgtcttaggggaaagctttttgttggtcataactagataatgctgtaactttttaatatgtgatgcggacacctgtactatatatcatgaggtggttgtctcgagaacctgatctagggcaagattatanntnaatnatnaatntatnattaaaggatacatccatattatattcaaaaaaaaaaaaaaatatgtggtcgg

SEQ ID NO: 51901 - DNA, 590 bp, Triticum aestivum
  Clone ID: PAT_TA_51901
cttcactgtagacacctcaaggctgcataatgtgaagactaaatatgctatcaccgctggatactgggagagagctaatgtggatcattgggtaacagggaagatgatgtgctactaacatcctctgtgtaggagagcggggtgaaacatctttgattccaagggtgaatattggtgttaacgaccaattttgatacacttggctcggacactgacatctattggggatgcaataccctagtattccaacttgatccccacattgacaagacttattataatactgtatttaactttgttatactctagacaaaggaggctattctttgcatatgccaataacaaattggatggcactgctcagacgacacctggttaatgttaactttgacatgacttacctgatgttattcatatccactagatgttgaatcgagtagctaatcatcactcttttttgggactcattggttaataataactgcatacgacatatatctactcggacctgacttcttaatgaggcatactttttgacgctctttgttatttgcatgcatgatggatgtggagtagttcttcgtaaggaa

SEQ ID NO: 51902 - DNA, 548 bp, Triticum aestivum
  unsure (1)..(548): unsure at all n locations
  Clone ID: PAT_TA_51902
gggagaacacgggcaacgaatatagatagaagcaaagcttgagatggcgcaaaccatggcgtgcatgaccggcctgtcacagggcgtgcgtcntcccagtgcccgcaccggagaggacgacgcgcagccatggttcactcgtgtaggcgtcgtcggtctgggcgggagggcgggaggcactgtgcggccgccgtcgcggtaccttggttctcatggtccagctggagtcatcagaagcgcgtttgctcaggtggtgcacgccggcaccgtcactgtcataaaggttggcccaccgccgactctctccggtggactccccggcacgttcaactacaacgaggcacagggtacttttacctgcccctgaataaccggttctacctgcaaacgttgccaccggtggaggcatcagccacatccaacgtagtggcccaggacattctcaacctcaagccggtcatgaactagatgcaatggccgtacttgatgaacgacctacgactaagggcctgctacctacactatgacctcaagaccgtcatatccta

SEQ ID NO: 51903 - DNA, 410 bp, Triticum aestivum
  Clone ID: PAT_TA_51903
ggagaggggcccattttttggaaaattggatgggaaaagtttaaaaaaagaaaactaaacatgaaatgctgccttggtgggtcgaagggaaaatcaatttgacaacaatttagtacaaaacacccaatatcatttttctaccccactttttataaggaccttacagggtgggcaatttttgaaaaaacttccgtttttgaaaaagaaccccgggttaaaaaaaaaactgccccagggttgctcctgtagctaaagaaggaaaaaaagttccaaaggcgtttcccttccctaactgggggggaaaaagttgcaccagtggggagcccacaaaccccattaatttacggggaggaacaaaaattttgggcaaagggaacctcttggaactggaaaacatttggttgccgaaa

SEQ ID NO: 51904 - DNA, 562 bp, Triticum aestivum
  Clone ID: PAT_TA_51904
gctgaactcgattggaaattatacaaactcgtgtggttcatcactggttacagactgacaaaagtcgctacaagtctgtcttcactactcacttattcgtagtactgctatatttcctttgttcattttacaatacaaacttgtatgcatgacaagaggcattttctttttccactaagatgggaccgtggacaaagatattgtagcatctgcgggcacgatacgttgcagccattggcaagagcagccactcggataagaatgcaccatggtgatcacttgataagaatgcacctaattggtgagccctcagagccaaccagtctcagaggtaagcagtgcagcatgtatagtccagtcttcacgttgtctagtttcagggcttcgactaggatgatatccgcatttttgaagaaggccacatgggcagagatcaagtgatcaaacgcagcaactgatatatagtcaatcccgaacctaggtagttcaccattgcacatggttctagcaaatactccctccgttccaactagcttgatgtccgtgttgtcaactaaccact

SEQ ID NO: 51905 - DNA, 493 bp, Triticum aestivum
  Clone ID: PAT_TA_51905
ttttttttttttttttttttttttttttttttttttttttttttttttttttttttttttttttttttttttttggggaaaggcaatatatgcaagggcttaataaccaatcaagtttcaaaaagaggcaatctggtttttaacgaagaagaaaaccatttcaaaaattacccaagtagcagggggcccatactcccatcaaaaaacaaaacgggcatgttttttctgccccttgataatttacacgtacgggacattcgtactctaaaacttttccccgggaaaattcacacagcacatgatgctgcattgcgcccatgcagttgatcataaacaaccgacggggggggacgggcaattaacggccagctcaaaggctgggcacccttttgggggccccggaaaaaacggggaacaggttgttgcccaaggggtccctgaggggcccccacaggttctcaaaggggccctccccggggacctaggcctggat

SEQ ID NO: 51906 - DNA, 460 bp, Triticum aestivum
  Clone ID: PAT_TA_51906
cccataaacacacggatatatccctttttatttcgcccaaaagaagaccagttttatagaccagctggaaaaatggggctttaaccacaggagccacagtaattaaggtccacaggcggtttgggagaaaacaggcttcccggctcctttttaaaaaaaattggggggctgccagggttaattcacggcacaagaaaaactcagcagcaggggggggaccaaaaaaaaatggggattaaaagggagcgacattcggggagcagttttaagtaaatatacagacggacaagggtctcccggcctaagcttggggtcttctttacctgggccttgatcttttgctaaaggaccgccttttccggggggagggggaacattctgtggagggcgggcatgttctccagcgtttcccccagggggcggttgtcgttgccgtcaaatttaaggggctgcagggggc

SEQ ID NO: 51907 - DNA, 561 bp, Triticum aestivum
  Clone ID: PAT_TA_51907
gcgatctagaactagggccgccctttttttttttttttatacacgtgcatgatcaagttcaaagcaaccagaaaggcacgccagaactcttgcgagaacgattacaaccacgatacgagttctacatgacatcgccggaaggaacgagcaacaaaactgccgctgcaaacttacatataccagacggaaaatactacagtactagcaaaggatggcaaagatgcccgcgtggcttcagaaataggggaagcgcgccatcatggccggcggcgagctggactccttgcagagggagtcgagcttccacccgggcagggagacggcgccggggcgctccctgctggccggggaaggcgagcccgggctgatgggctccttgctcgccgccttcaccgcctcgacggcgccaccgccaccgccaccgcccgccgccggcctaggcgccgggacgatggttatctccggcgtccggctgctgctcccctccatctcctcgctccctatgctgtagatgatcctggaggattttgtttctgcgttggaagtgtagaactggtctgc

SEQ ID NO: 51908 - DNA, 493 bp, Triticum aestivum
  Clone ID: PAT_TA_51908
agtcaaaatttggtgatgtattcccatgtatcaaaaatgaacgatgaaaaaagtttagggcttgcaaagaaaaatgtacgcggacaggatgcgatcgggatgcgtccgcgcgctggacgcacggccactgcattccagaaactgtccagacatgaccccattgccctacccaaacggacagaatccaggcaaaacgaacgtccgtttggggtcgtgcggtggagttggccttaatcaagcatcccaagttcttcactgataccaggtctgctattggtattatatagctccctgaataggaaatataaccttgaacaaaacacaatgcagaacatattttgcttattgggcactgagtttcgaatccctgaaatgtcctccagcggctgaaactttcaccatacggattaggaactcctgaagcaatatgtggttgccgatcccgagaccaaggtttgtgacaaagatcatgttcatcttcatactaaatggc

SEQ ID NO: 51909 - DNA, 347 bp, Triticum aestivum
  Clone ID: PAT_TA_51909
atgtaaataatttagagcgataatactacagacgcatgcactgttccttgtggtaaaaagtgccatactacattcttctcaaggagcctcgacctcatacgcatgacaccaactccatcacatttcgcagaatagttattgacgaatatggtaaccgaggctctactcaatccacgttactgaatggctcattgatgacaccgttgcccatctgtcttgccactcttgacggtgagaagaaccgacttcctgctgacagccacattgtggactgagctccacaaccatgatcatacagtgaccggacctgcccatgtgccccatgctcattcttggagctcatactg

SEQ ID NO: 51910 - DNA, 401 bp, Triticum aestivum
  Clone ID: PAT_TA_51910
gggggaaaacgtaagttcatttaaacaaagactctttcaaccaacccccaaaaaaagatcgaccacatcatctggaggggggcccccatcggacatgcatgccaaaaaaaaaaaatctacttgaaaaaagtatgggagggccaccccctaaaggaggaagtaggcccaaatggccccggaaacccccccaaaaaaaaaacccccggggaactgggaccagccttcggggggctgaaacttggcggccccctttttgcggccgggaaacgtaagggcggccccgggggaaggcccccccccgttgaaggaggcgaccccctacatggggaggcaaaccctgaggatggaaaccaggcccatggccccgagggttcccccctggccgaaaaatggcctgttgc

SEQ ID NO: 51911 - DNA, 304 bp, Triticum aestivum
  Clone ID: PAT_TA_51911
gaaacaatgtggaaattataaggatcaatcatcagttgctccattgatcttaacaacagaccacagcactattatttcagttcaccaattgccgccagcaaacacgccctcagattattatttgacggtcatacgcagggagcaacaagatacagacacacacggtggagctgctggtcacaggaggatacgatagtagctgaggacggaagaggggtgccggtggcccgattgacttcacatcaggcggcgaggcgggcgacgccgtcagctccgtcgccatctcgatctccctctgcgcgct

SEQ ID NO: 51912 - DNA, 433 bp, Triticum aestivum
  unsure (1)..(433): unsure at all n locations
  Clone ID: PAT_TA_51912
aaaaaggaaacatgaactggaaatggaaccaacaaaaaaaaatgggaagtttttaaaagggggggggggggggacaaaaacaaaaaaaacgacccgaaaagaaagctaggggaactgaaactgagttgaaaagggtgaaaacttttttaaaaatttgccatggggggatttggggagcccccaaattttttacaaacagactggcagaaatacatgaaatgatcatcctgcattactgagttactgactgagctaaccattcattcattcaacaataaagggtttgggtaacccaaaaaggccttttccccggagtcgtaacccttggggtcgttaaactccttgggggttttctcctcctcctccnnnnnnnnnnngggggatattttttaaggcttgggatattttttaaaaatattttttgacttttttt

SEQ ID NO: 51913 - DNA, 378 bp, Triticum aestivum
  Clone ID: PAT_TA_51913
aaaaaaataaccaggtacaaaaaaccgggggcataattatcaccgatggaatccagcattaaaactcgacaataaaaattacaggacgtccataataatcgccacccgcaaaaaactaccgggcgaggaactagcacgtccgcatatacaacgtacaaaataaaatgtcaaaggagttcttgccgggaaacttgacctcgagggggctgacgtttttgccgatgctgggaaagttttgcccaaccccctgcctgccggggttgaccttttccgggtaaaccccgccctgggggggggggtcctgcccctcgccgttggggaaaacgcggtaaaactggtggggaatcttgtccttggaccggaggcggttgccggggg

SEQ ID NO: 51914 - DNA, 587 bp, Triticum aestivum
  unsure (1)..(587): unsure at all n locations
  Clone ID: PAT_TA_51914
cggncgcgtgggccgcncggtgaacctgtattcgtcagagccctcgcccggcctcggtcgacccagcaatggccacgccagccgcgctggggaggcatgcggtcagggcgcgcgcggcggcgaccacgctggccccggcgcccctgcccgccggtaacggcggcctgtcggtagcgaaggccatgtcccgggccagagacaacggcatgacggcgttcatcccgtacatcaccgccggcgacccagacctggcgaccacggcggaggcgctcaggctattggacgcctgtggcgccgacgtcatcgaggtgggcatgccgttctccaacccctacgccgacggcgccgtcatccaggcgtccgcgcgcgggcgctcgcggccggcgcgacgtcagacaccgtgatggcgatgctgaaagaggtgacgccggagctatcctgcccggtggtcatcttctcctacttcaaccccatcgagcggcgagggactgggagcttcaccgccgcggccagagaggccggtgtacgaggtcttatagtacccgatcttccttacacggaggcaagtgttctgagcattgaagcca

SEQ ID NO: 51915 - DNA, 575 bp, Triticum aestivum
  unsure (1)..(575): unsure at all n locations
  Clone ID: PAT_TA_51915
tcttaattcaaaagttatagggagggacttatgtcaccacaaacanaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgc

SEQ ID NO: 51916 - DNA, 153 bp, Triticum aestivum
  unsure (1)..(153): unsure at all n locations
  Clone ID: PAT_TA_51916
naacccgtcggnatacatcatcagctactacggccagcacacctgccaaaaacccctccagttccggtcactcctcaccaagcgccgccgacgctgccccgccagcagactgctcaaacctcatcagcttccagtcgatcaatggcgcggctg

SEQ ID NO: 51917 - DNA, 151 bp, Triticum aestivum
  unsure (1)..(151): unsure at all n locations
  Clone ID: PAT_TA_51917
gcggntggtngaagtggncgtggtgttcttggctcatgggacccganaaacctgctatgtctcaacctaccgttccgccgtccanaacagattagcacgtacgctcagctgttctggacggcggatggtngaggtggacgtggtgttcttg

SEQ ID NO: 51918 - DNA, 597 bp, Triticum aestivum
  Clone ID: PAT_TA_51918
caccgagctggtacccgttggacacctctgtatctcctttgcaggggctcaagcccaccgacggcctgctggtgaggaaactgtccaaggcgctagcctgcgaaggctgagacaacggtgcgaaggattaggacgagtgcacgtgaggtccaggcagggcatgacaacaattctagactctgtcctacttgccaccggtcaaactgaggccctactcaaacagggggactacatgatccgttccaatgggctgactggacttgcgttacacaaatgctggtgttattgttggagatgacaaatccatcattgagcactattacggccggccctgcgacacagtataaactgtctatgtctagtacgcaccatacgccgcacacctgatcaagaacgaggaggatgataaacaagactaccctgactcatatgtccggatcattggattgaacagcaagcgccaggtgcaaagcaacagcttcatggtcttctagccaccgggctgcgaggaagccggcaaggcctaaacagctcactcacgacaggccatatataaagtgccattgcagttttgtcaactctgacattgctttgggt

SEQ ID NO: 51919 - DNA, 186 bp, Triticum aestivum
  unsure (1)..(186): unsure at all n locations
  Clone ID: PAT_TA_51919
gtcagtgtagctctcgtcgtcgcccgctttatttccttggcttctagctagagtccgcctgtcgcccgtcgatttcagtgaagttaatgggatgcgcngattttttttctcccccgtataggccggctgttgaatatatgtgtctatcttgaattggcctaatatgggaataatagtactagcagc

SEQ ID NO: 51920 - DNA, 559 bp, Triticum aestivum
  Clone ID: PAT_TA_51920
gatcttcttctctaataatagacaagaaatccacatgagcacacgcttacgttagcaatgtcatcggtgcgcgtttcgggagctgagtggcagcagtggcgccggcgtcagccgcgggtaggagtagccttggctcacaacggacacggatggcggtgccagcaggtacaaggggcacgccgccttcggccaaaaaggaaaagagcatactctactttattgtgcagacgccatcttcaaggacgagcaggtagtatcatggagaccaacccgatgctcaacaaggtggaccgcccggttccgttcacgggcggtaccttcttcaggaaggacggcagcaccacctccggcaagtaccccggtgcctactgcaaagtctggaagctgtttaacctcgggtgcctcttcgccaagagggcttaactacataagcacgatgcgcacacttgggtgcgtgcttcctatctcatagctcgtatttattgctgtaactacatgaaaaacatcgcatagatctgattatatgtacacgcagtgttactactgagatgattcttgc

SEQ ID NO: 51921 - DNA, 374 bp, Triticum aestivum
  unsure (1)..(374): unsure at all n locations
  Clone ID: PAT_TA_51921
cggncgcgtgggcggacgcgtgggcggacgcgtgggcgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatatacgtttt

SEQ ID NO: 51922 - DNA, 181 bp, Triticum aestivum
  Clone ID: PAT_TA_51922
caccgcggaggtaggagatcagggaaggctcacggaacatgactccagcgaggggcagaaaagccggctttgcgatgcccggcaggctacaagctagagttcgctactggcaatgaccgcagcaatgacctatgcatcgtgttgtagatgagtcatggatattattaggagaggtggggct

SEQ ID NO: 51923 - DNA, 591 bp, Triticum aestivum
  unsure (1)..(591): unsure at all n locations
  Clone ID: PAT_TA_51923
gnctagttcatggccgcgtcgctgcagcctggtagcttccccttctgcgccgtcgtcgccccggtctccagcgaaagcatcacagtcctacaacgggtagaagggccggttacgccgtcggagctcgtggagatgttgcagagaaccatcgatgagcaacgtgttgcttttcgagcctcgttggctgatgagcaagctgcggcgttcagagcctctagggctgaggaggaagagaggaggagatcggctctacggctgcgacaagagcaggacgcagcttacctcgagtcacttcggaaggatcaggaaaaagaaagattggcaaagagttttcaggagggagctgtgaagccaaaggcaaaggcaaagccaagcacaaaatatcctggccaggcaggtggagaaactaccaggacaacccagatcagagcacccacgcataaggaaactgcgccttcacacagaacagaagcaaataccaagataatgataagatttcccaatggcgagagaatgcagcagagcttccgtcacacggacacaataagggaaatctacaagtatgttaactccttgggcatgcctggcata

SEQ ID NO: 51924 - DNA, 432 bp, Triticum aestivum
  unsure (1)..(432): unsure at all n locations
  Clone ID: PAT_TA_51924
aaagggcccggggaaaggcctgaccaagggggcaaatttttggtggaaaatcggggaggcattaaaaaaccaatattctttatgaaagatcaaaaagtccaaaagtcgggctaaggtctacatacaaaaagaagggaaaaaaaggggggaatacaatatatcaccaaaatttagtaggaaactttatgaggctctagcacggagttacgaacaaccggtaaattttaatttcaaaggaacttttggaaaaaataattctgaataagctttaactgagctttgaacggnatgagaaaaacggagggtttaatgggtttaacaggccttaattgttttgaaatgctccgcctaatcgccccgtccattcacaaatacattatacaggttataaactttaggcccccaaaaattggaagctctgggtgtttgaaa

SEQ ID NO: 51925 - DNA, 556 bp, Triticum aestivum
  Clone ID: PAT_TA_51925
ctaacttaatgaacttaattaattggctagaaggaaaggaccgggtactccaaccaccatcatttgcatgccatacaagaaaaaactaacaaatacttctagcttattgcttctaccaccacttgtattactaggaacaccaagctaacttgccatcgcaattccggttcgtcgatatttagtaacattgtcctatattgtacatatcacggcatgcagtgcatccttgagactcctggcatatacttccagcctctttaatccttctctcggagaatttgcttcacctagctgcttcaccatcgcactgccgattatcacaccgtctgcaccccactgagcaacctgcctaacatggtcaggggtggatatgccaaatccaacagcaactgctttgtcagtgacctgcttaatctccctgagaagatccttaacgtgcggattcacacttgggcgggcccctgttaatccgttgatacttacaaggtacacaaacccttcggaagctgatgtgatctcattcatcctctctgcctttgtagttggtgttgtaagc

SEQ ID NO: 51926 - DNA, 132 bp, Triticum aestivum
  Clone ID: PAT_TA_51926
tttttttggagaaaataaccataaagttgtccagagatggtatttggacattatatttcagtaaataatccttttaatacctattaacagtgtccataataaccaggaacaaaaggctaatccaagcatatc

SEQ ID NO: 51927 - DNA, 526 bp, Triticum aestivum
  Clone ID: PAT_TA_51927
aaacgaaatttaacataaatccataattcaaggtcgtacaggcaaacttacatagtccctatcccgagtactagtatatgtttacaagtggcatccaatacaaacatattaccttctatgttctatccacatgcccaatatacatgcatacacaatataccttcataaaaaaatattactactaccccatgcatgcaaagtcggccgtgtgttgcatgcatgcatatgcatgggtacacgaccttggtcaggaatcaagtcgaacaggtcgtcgtcgtaaatgttattgccaaatgacccccctaacgatcccgacatgagcccgaggctgctcggcgaggaagggaagctgtccatgcctgcgccagcgtccgtgtcgacgctggcggctcccacgaccggccagtactccgccggcgctgatcccacggtcaacggcaacgtccttcggccaataacgttgacgagctgcccaccggcgtactgcatgaacttcccgtggccagccggcgacagcgagccgctg

SEQ ID NO: 51928 - DNA, 419 bp, Triticum aestivum
  Clone ID: PAT_TA_51928
gcttcaggggaaccacgtagtttcattgggctgaacccaaacattcgcattaacagcatatttttgatatgaaccggggagactaggttaaaaagtaaaaaaaagacctgaactggggaaggggcccgctaggcgtcatccggatgcccaaaaggaaacaacatccatttgctgaaccgtacaaactgggggtccctagcccccgataaaaatcaacgaagtcttctctccctttgttcttcccaccgcataacacaaccatgaccattgcgcctaacaactttggcggcctgcacgggggccccggaaaaaccggtttgttccaaccccacccgtcgaaacaaccccgggggcctcgcaaaataagctcaaaaaaaaacggggggggggcaacacgtttgccccggtagcaccggctt

SEQ ID NO: 51929 - DNA, 319 bp, Triticum aestivum
  Clone ID: PAT_TA_51929
ggttaccataaaaacgggaagagtcaacaaagggggcaagattaacacgcccggccataaacacagccaccgatagcattcacatacgaacataaaggccccagccaaggtggggcataaacagggacatacacatattcctaggaacaaataaaaaaaaccacgggacaaggaaaacccaaagcaatgtcagagttaacaaaaccgcaagggcccttcataaatggccccccacgagaaaactggttaagccttgccggactcctggcaccccggtggcttgaaggcgaaaaaacctacccactggacctggcccaag

SEQ ID NO: 51930 - DNA, 500 bp, Triticum aestivum
  Clone ID: PAT_TA_51930
cacttgggtagtgtaagcagtacgcaaatacagttatgaagaatccaatcgatcaactacaacccgtcccgggcggcgcaaaaccgatcgaaaaagttgcggcgcccggagggaggagcgggccggatgccaccagccgcttcccggcagatttacagtgtggcttcttcgattctcagcggcggtggtggtggtggtgatggctcgaggaggaggacgacgacggtggcggcgggtcgaaccggcgggaggaggcggccgatggggcggcggcagctgtcgtggcggtattggagaatcctgatgatgctgcagcggacgacgtcgacggcagcggcaacggcaacagggtggtggtaggaggaggaggtgcacctgcggtcaccttccatgctgctgctgctgcccagctgggatctcttcttgatgcatcactctgcatgcatggtcaacaaataaactgaaagttcattcaccctaggaccaattcaaccaactgt

SEQ ID NO: 51931 - DNA, 327 bp, Triticum aestivum
  Clone ID: PAT_TA_51931
agacataccgtagtccttgctgagaaattacttcagcaagtcgtgcgtacaaagaaccctattctatgagagaatcacctctggaatcatcagagtagttacaccgagtgtgcatatatagcaaatatctgcgttcataggcatgggagttacactagtaaattaagctttgacatacaagcacgcacccaagggcgcgcaacgtgcttatagttgaccaacctttcttggcgaagagggcgccaaggttgaacccggccatagccttgatggcactcgttgtctacttgctggacgtggtgcagcacctcttcctggaggcggcgc

SEQ ID NO: 51932 - DNA, 419 bp, Triticum aestivum
  Clone ID: PAT_TA_51932
aaaacaagacatcatattataaaaaaaattataggggccaaatacacttgggggcaggcgccagcatacaacttatttttacaagggcccaaagggcgaaacagacaaatccccaggcatattcatttttaagcaaaacataccccccaaggaataagcgcatatttatatgagcggggacccggaaaccaattttaaaaaaacaaaccctccaagcaataagcgcatgccaagaacggacgtataagagggttatttagtaaaaaacatttttaggcacgaggacaaatttactcaaaggttaactggggacttgggggcccaaaccccatagcaggggggaagaagctccaaacacgagtttccttactgagggggtgcggcgctggggggcttaacattgcaggggcaggcgtttt

SEQ ID NO: 51933 - DNA, 509 bp, Triticum aestivum
  Clone ID: PAT_TA_51933
aactgcatgatatttcatatctgaacatgttttttcgtgttacaggctctacatatgtttcaagtctcagacagcaaaaagatcgaccaactaggaagtctgcagaaaagagcattacatgacatagaattttaaagagttcagctctagtgggatcatagcttaacctcgacatccacccccgcgggaagctggagctgcatcaacgagtcaatcgtctgggcggtcgggtacatgatatcaatcaaccgctggtgtgtccggatctcaaagtggaaccttgaatctttgtgcacgtggggagagttgagcacacagtatattctcttcttggtcggcagaggaacaggacccatggtcttggcattagttgtttttgcagcttcaatgatctgcttgcaggagtcctcgatcaatggcacccagtaagacctcagcttgattctgatcttctgtttgggtgccagctcctccccatcctccccaatcgacgacggcatcggaattcc

SEQ ID NO: 51934 - DNA, 387 bp, Triticum aestivum
  Clone ID: PAT_TA_51934
ggggaggcaacagctgacatccaaccaaaaaatgggatgcctgccccaatttctgggggtcaaaaaaaaggggtacaaaccaaccaaaaacccggggtcttgggggaaatcaagtatcttttggaccaaaaagcttaaaattcgggacccgggcggggggtcggaaacccatgttggtggagtcccaaaacccttggggtgggaacccatggatgggcaaaacccctatgggggataagacaccctgctataaatgggggctggtaaaacttgtatatgaaacatggggaaaaaactagctgcatgcatgcattcaaaggtcgggatgtttggattacaagggttgcattcaattccggagttgcagcatggttattgaaaccgctc

SEQ ID NO: 51935 - DNA, 578 bp, Triticum aestivum
  Clone ID: PAT_TA_51935
cggccgcgtgggcgcggccatgggggcgcgctgattgggccgccggccgcgatcttccagtccggatttcctcgggcgggcccgcgcgtgatcttgccatgggttcgatttgttcttcttgttgttagatcgcggctaggagatcagcgagcacgcccagatttctccctttccggatcaatcttatccgagaggataataagccgtcgtccgggagcagcgagcaaagggagggggaggagaagccatgatgctggagggcaaatcctgcctcgtctcgcgctccctgcccagctactgcgacccggactccgactgggcgttcctcctcagaggcaccaagcgctccgcgccggaggacttcggcgcggaggacatggaggaggtagacgccggcggcagcagcgggaagcgcagcaagtcgccttccccgcagccgcacacgccggacatcaccgagagccacggctccagccgccatgcctcctcaggcagcggcggaggggaacagcaaggctctggggccaatctcattggcgagattggccgggacctctccatcaactgcctgctccggg

SEQ ID NO: 51936 - DNA, 456 bp, Triticum aestivum
  unsure (1)..(456): unsure at all n locations
  Clone ID: PAT_TA_51936
acgaccgcgngnaggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcagtggcggaggctacggcggcggcggtggcggctacggcggccagggcggcggcggctacggccagggcggcggtggcggctacggccagggcggcggtggctacggcggccagcgtggtggcggcggctacggcggcggcggcggtggctacggcggccagcgcggcggcgactccagcngccagtggaggaactgagcggtggggccctccagttatcgatctatctaccatctagtcgttttcgttataaagttatctttattgt

SEQ ID NO: 51937 - DNA, 598 bp, Triticum aestivum
  unsure (1)..(598): unsure at all n locations
  Clone ID: PAT_TA_51937
ancactagggcgactgtgaatcctcttgtaagcattctcgtccctgatgcatatggtgcttaagtgcatgaaacagttataaccttcgagttcagtgaaaatcatattgccaagaccgtcggtgacatacttgcggactattgtagcatggacttggaaagtagtgacttgtggctggccatagctattttgtccatcattgtagcactcaccggcattgcaagatgaagactcacctttaatccagtttgcacaaaatcgctccccccctatgatgaatagtattactctcctaggacaattgcctaagcttttgatgaggggtattcaagctacgatccatgatctatatacaagttttggtagtgtgttcacagttaatttgtttggacacaagataaccttcttgattggacccgaggtgtccgctcatttcttccaagcacttgaatcagagatcagccaagtgaacagagccgcttctccgtcgatgctctaaggccatccaagttgaggaaccatgttgatcccatgcttcaagaagtggaggggtactttgcaaaatggggacaagagggcataatagatctaaagcatg

SEQ ID NO: 51938 - DNA, 523 bp, Triticum aestivum
  unsure (1)..(523): unsure at all n locations
  Clone ID: PAT_TA_51938
ggactacgcgttgtagcagcgcttagacggctcgcatctggtgtggtagtttccattatacaagataactatgtagcgggtgtatgagcctacgaaagatttcgcactcggtttctatgactaagcatactaatatcaatacacgtatcataggagggagtctcagaccacaacgtcatacggcgtgtcattgatggcattttgancatataactgtggagaggagctagaaacccagaacaatcactatgattgacacggcctacacactgcaataatactccagccccttaccccgagcaaggaggggcaaaattattctgctgtaaatgtgaatcacacgagggcgacaattttttgtgcaggggggtccactaatctatattggactcacccaaagtcagccgtactggtaacaacaaggtcggcactgcgggagtgaacacaccactgaacggcagtctggacataaatgactcacacagatgacagttaggtccattgctgctgatggatataaaac

SEQ ID NO: 51939 - DNA, 415 bp, Triticum aestivum
  Clone ID: PAT_TA_51939
cccacacgtccgcatgaccttgttcaacatcctgctggacgggagctgggcgccgtgcctgtacggcttctggcaagcgatcttgctggcacgaggtcggcaaccaggtcgacactgatgtcgtctgcactcctggttacgtcgaccctgcatacggccatactcaacaagaagctactgcatgtgcttgtccgcccccctgcggagacgccggcgctggtggaggcgctggacatcgtggcgcacacggtggagtgctatctgaacccacatgctaacaaccggactgccatgaccaacgttgtgaccaacctcaagaggatgcttacgatcataaatacgtactaagcactcaaaaatgatctgaagctagctattatgttcgtaatacctatttataagctgactaacagcc

SEQ ID NO: 51940 - DNA, 577 bp, Triticum aestivum
  unsure (1)..(577): unsure at all n locations
  Clone ID: PAT_TA_51940
gcgcacgtgcagccctccaactggtgccgaggctggaggcgctgcagttgtagcccgtaaagcaccgcataccctgtagcagccttgtcttgtgcctttcaagttccaactcctctcatcaagggtgngaaaaagaagtttaatcagaatccaccagattggatcccctgtcgtctattgattgtcgcttcgtcgacagcaaggactgggaatcactgctcccagagggtcatctgcagcgggttaagatgccttgagttcttgttttggtactcctccggtgaaggcagatacctggagctcttgtttcggcaagtgccatggatggatgacgctgacacccccactggctggtttccccctttggatcgtgatgctgctttacaagatgccatcagctttgctgaagatgcaaatggcatctcccgatccatgaatgatgagcaagcagcctgtggctgtgtgggcagctcaagtggttggctgacgaggcgccatggaaagggcaagcaaaaaggcttggaggagatgagcgcaatgtgtagggctgtagattcattcattcagttgccatggc

SEQ ID NO: 51941 - DNA, 183 bp, Triticum aestivum
  Clone ID: PAT_TA_51941
cgtcccgatccgtccgacgtctccccgtccgggtcccgatggcgaggttacagttgcactggctggaagccatgctagcggtgggcatgatagagggattcctatgcatcatgggcaacggccagtaatacatacacagggcgcgttcacggaatgccgaaacacagcaggatcaacatgtgg

SEQ ID NO: 51942 - DNA, 518 bp, Triticum aestivum
  Clone ID: PAT_TA_51942
cattctcgtcccagcttcccacagaccaaccgactacaagtacaaaaacatgacggtcgaaatctacctattagtgcaatttacaaagcaggacaggttacttctcaccatccaagcttcaaatcttgtggtaacatgcatcagatttggaaggagtcaaccagtcagtcactcagaacttaatcatgttcacaagacactcttcggacattctttcatgagctctgcagaaagcacagatttggtgtcactacctgttgtatgcaccatgggagacaaagaactgataatctggatggccggcacggctgtctctcagccaatcggcagcagcttgccttaagcagctagccagtttccaatcaccatcagttgaggaccagactgagttgctaaacttgtaggaagccaaaccaaaaactgggagtggtatgtttggtgtgctatcaggagcccacagattatctccttgcgggcaatttgaaagctgatggaaagtgagaaagcaggcatctaaa

SEQ ID NO: 51943 - DNA, 506 bp, Triticum aestivum
  Clone ID: PAT_TA_51943
caaagtggtttgccattatttgaacaaacatgcataacatcaacaaggatggatcaattgttgtccaacatcaacacacacacgtccgcacgcacgcacacaaatgggttgtgcatacatattaatttatgaactactcgctccgtttctaaatataagtttttttttatagattctactatggactacatacggagcaaaatgagtgaatctactctctaaaatatgtctatatacatccgtatgtaatttatagtgaaatctctaaaaagacttacatttaggaactgagggagtaggtaccaagcaaccaactgacgcctcttataacttatcgttattttcccttttggctctagcccgaacttgctccactctgtctttgggaaatgagatatcagtttaagctcgaagtttctaattaaatggctccatattactttaatttgcatgtaagcataggcctcgccggggcaagcatgccttccaccagaaaatgatgtgta

SEQ ID NO: 51944 - DNA, 231 bp, Triticum aestivum
  Clone ID: PAT_TA_51944
ggttaccattaaaacgtatatagtcgacatattgtataatattatgcgtccgttcatatacatagccaccgatagcattctcatacgagcatgctttctcgagccatgttggtacatgaacatggacatacacatattcttaggaacaaataagaaagataaatggagaaggaaaacccaaagcaatgtcagagttgacaaaactgcaatggcactttacccacgcgtccg

SEQ ID NO: 51945 - DNA, 472 bp, Triticum aestivum
  Clone ID: PAT_TA_51945
gaaaaaccaaaaaaacacttgcatttttggtccaaaggggcttaccgtcatggcagaacagctaaagcacagatcggaataagacccggcgtaatgctgccttttttgcagccacagctaaatagaaaacatctgcccctgaaagggacgtcaaagacaacatttataccacaaacttgccaaatttgcaaaagccggcatgcattcggttgcaagacgcaaaataccttggctggctcgtaagttatttcaactttacacaaaattttttagggcaacaacttataagaccttgcaaataaagaggctgagtgggttttggaaaccagagcaaacagatacttggttatctgctcccagtctgatacatcccatccattatgagataaatattgcacccaacagataggacagccaccaacttggccggaatcagtcagtattcattgcctccgcatgagacgattccagg

SEQ ID NO: 51946 - DNA, 399 bp, Triticum aestivum
  Clone ID: PAT_TA_51946
gggggggccaaaaaggtttctcatttttaaatcccccaatacaaaggcgaaagaggggaaaaaaattttttgggccggggcataaacaaagcccccggtgggattcaaaaacgaacatgcttttttgaaaaatggggggccatgaacatgggcaaacccatttttttgggaacaaacaaaaaagataaagggggaaggaaaaccccaagccatggcggggttgaaaaaaccccaagggccctttatatggggcccggggggagggaactgtttaggccttgccggactccttaaaacccggggggttgaaggggaaaaaactgaccccctggacctggggcatgttgtcaaaacccatgatgcggacctacccctaaggggacccctttttgacccctt

SEQ ID NO: 51947 - DNA, 511 bp, Triticum aestivum
  Clone ID: PAT_TA_51947
ttttattttttattttattttttttttttatttttttttttttttttttttttttttttttttttttaaaagggccaaaaggggtttcattttttacaccggctcccacccccggggccaaggccccatccaacaagcctgccttgccccacaattccctcccatcatccacgggctacttcccaggaaaaaaaaaaatcaagttccccccgcgatctttttccccgggggagccccccccccggattagttgctaacccccccccggttccttacttgggggcaaaggccccaaaaaagggggcctggcccgggtccgcaaggggacccaaaaggttgtcaatggggcccggccccgtgtacccggcctggaaccacccccccctaacggcaaacatggggaggcggcccttcttgatccccttggggcccaactccttgagcttctcgggcgaacccgggccgtaacccagcgggtaaaaccccaaaccaccggggtcccccacctcgg

SEQ ID NO: 51948 - DNA, 462 bp, Triticum aestivum
  Clone ID: PAT_TA_51948
aaaccaagccccaaaacctttttaatttaaaaaagacctcccggggggttggcagtcctcatggcacaaatccttaggtctaaaacatattaaatccgaaaaattcgccctaaaagcccataagataggtaatccttagcataaaagattccacaggaaaacgggaatggaactgtttagtcaaacaagctgaaccccaggtaataatggttcttttccttagccccctcctttttcttttttttcttcttttaagggggagaagcaccaccagcagccggggcagaagcagcagcagttggagcaccacctccaccaaatccgacggaaaggatgaggtcatcgaccctccttttttccaggaccttggcaaaaagcgcgggccagtaggcctaaaccttgattccgggagccttaaccaccggggggacccacgcttccggggacgcgggggtcgacccg

SEQ ID NO: 51949 - DNA, 131 bp, Triticum aestivum
  unsure (1)..(131): unsure at all n locations
  Clone ID: PAT_TA_51949
caataatgntgtgccttctnnatatttgttgtgaatgaccagtacggnacaggcagtctgggatgacaatcatttcattatacgagccatcgtcatcatgcaccatgctgtacagtatcttgccattggtc

SEQ ID NO: 51950 - DNA, 589 bp, Triticum aestivum
  unsure (1)..(589): unsure at all n locations
  Clone ID: PAT_TA_51950
cggncgcgtgggctagtgctgtacactttgtagcagcaggtggagttgttcctccacaaccgtgtgctgcttcaacttgtcatcaattgttatgtggaccagcccatcaaacgtggagtcttatcccttaattagtttcctggttgattaagcatctctgttaggaaagagtccactcagtttagagattgtattggagtttaaatagatttaccggcttgttggccaaggcttgtctgttatataaagtgtccgacccctctcaataaagaagagaagaaaattgtcgtttactttcatctacttttgagtaattagggttaggtcagtagtatattcttccatcaattgcctcgaaacaaaagttttttatatttcttgtgatatcctgaaattagacattttcctaaagtgccacaacctgtttatagatgcaaaatttactttagtaattactttctgttactgttagccagtgtatgttttagtgtaagacatgcatgcttgttttttcaatttaagtctctgtgcattttacttggatatttagttctggtttagctttacaccggtttctctatcatgcact

SEQ ID NO: 51951 - DNA, 496 bp, Triticum aestivum
  Clone ID: PAT_TA_51951
ccccgcgtacgccatggtcgccgccctgtgcgcggccctggcgcaaggccgtgacggcgggcatgaacgtggaggatttgcgcgagcgggtgggcgttcgcgggcgggttcgcacgactcgcgggcacaacacgcagggcgctcatccagcggctgatcaaccacatgcgcagcaggacgcacgagatgcggacggccctgtagaccttcatcttcgacatcttcaacaacaaccataccaccgggagtacctcggagatgatcttccggctcttgaacccggactacaacatggactactacatacatatctaactctctttcttatacttatactactatataccttcattttgatgctaaatgagctgtgcaatgctgactgcacgtgcatctactccttcatgtactgcatgcatgagcgctaccattcactctttaacttacttgctattatgcttattcatatgatgatacagagatggaaacagttatg

SEQ ID NO: 51952 - DNA, 184 bp, Triticum aestivum
  Clone ID: PAT_TA_51952
gaccaatggcaagatctgtaaaacagggcatgtgcatgccttaattgtttatgctaacaagcatcttctccgaatctttacaaaaaatatatgaaggcacaattattgtttgtaatgccgacggacaggcgtaggatgacaactttattatacacgatatcattgtaagacctagaggacgaca

SEQ ID NO: 51953 - DNA, 462 bp, Triticum aestivum
  Clone ID: PAT_TA_51953
acgatcgcggaatacgcctcggtgcgccaatatatatttgtgtgctgaacctgaactgaagtaactacaagaaaccgaactcttggtcacatttgttggtcagatgagctcgattttcatatctatgtacaacacaacgaagacgatgcttttttattatgtttgtgccaatgcgaagctaggagcgggctccaagtccttgaccgccttcttcaccgcctcgatgtcaatgccggccagcttgcctgtcgccgacgcgacaacggtgcagctcttcctctcctccgcgtacggcaggaacagcctcgccttcgccttggaggagaacagcgccacacatggcttgtcacgggcgttggcgagctgaacggcggccgtgttggtcgcgacgacgcccgcagagtcattgatgaggcaggtgagctgtccaggagtagtgatgaacaggtaggccgtctcctc

SEQ ID NO: 51954 - DNA, 462 bp, Triticum aestivum
  Clone ID: PAT_TA_51954
gaacagaaaaacagcagttctttctgactagtgtgcaagcaaacagagaacctacaaaatagtacgtatatcttctccgatctctattgttgagatggtgtggtttttacatttaccttagccaagcagatcctaatttagtactatatataagcacaccaattttatttctaataacactaccaaggttatgcaatactattatgcacacaaaagcagaaaaattgacggggtagagagagaggccaagaaacgcattagaatgggggataacttcgccgtaacccactgacgttggcgaacaacccgacaagctcttgcttgtatgggaggtaagatctcctccggccagcgccgccgcttcctcctcctcctcctcctttgctgtaataactccatccgtgggcatcggcggcgccgccgccgtcgctcctgctgcttccttcctccacgttcccctgc

SEQ ID NO: 51955 - DNA, 534 bp, Triticum aestivum
  Clone ID: PAT_TA_51955
gtcgggaacatggacatacacatattcttatcttaggaacaaacaagaaagataaatggaaaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacctgcgtggcgtcggtgcacccgaacataggcagcttccacattgtccagtaccggccatcgtagtacccaggggatgcgttgtgctcacggaagataaacccaaccttgctgaactcgaggcaaggcacccacttggagcggatcaggtagtcgacctgcttgaggagggcctccgtgctgagcggtggcaggtaggacagggtctcgaacttcttattgccctcgatgggccacacctgcatgcacctgat

SEQ ID NO: 51956 - DNA, 369 bp, Triticum aestivum
  Clone ID: PAT_TA_51956
cagagcggaaaaggctgccgtttttttacatcacacacagaccattggttctacaaaagggttggtttattacaagcacacacagaccattgctaacataagggtgggccccctacaacactaaaatttgagcctgctcattttcagtggaattccttggggaaggccccttgatccaccaaaaccactttccatccatttgggtcaaggaaaaaggggattttggggttcagccccggaagtggccctggctgccttaaaaactttccacctagttcttagggaaccacttaaattgtttaagggtttttgtacacaacttcagggccaataacaacctgagcataagcagtgcccttgtattattcc

SEQ ID NO: 51957 - DNA, 492 bp, Triticum aestivum
  Clone ID: PAT_TA_51957
gcacttaatttgatacttgtcatggtatatatgaatccttgcgcctatttacatagctagtgctctgcaaaataatacgagtacatgcatgtaaaactccaggcgctgcaagcgggctggaccccttcacgatttaccaccaaacacagccctcctccggtctaaactaagcagaccgtccgacatctgcgacaagccgtgataccatggtctttcttctttgcaacgacagaaaataaaataaaaaccgcaaatcgcgaggcgatgatgatgaacggcagttgtagtgatctatgagtagaacttgtatgtcttggcagaaatgatgatctgcctgagccctccgatgggcgcgatgatcatcagaatcacaccaaggacgatgcaaatccagttggtgaaccatgagaggctgaatctcctgggcttgcagatgatgagccacatgatgcagggcaggaaatatgtcgtcggcgcgaaggccagcccgcc

SEQ ID NO: 51958 - DNA, 350 bp, Triticum aestivum
  Clone ID: PAT_TA_51958
ggggtccaaaaatccacccttttacaggttccaaagggggaagtttttcgttacagggttacgtacatacacaaaaaccatttggtcggatcaattactttgcatcggggatggcatacattcacaggggggagctttgtaaattacaaaaacgggcatgcaagcaaaaacccggccctgggttacacgtaaatgcttttttaaccggggagagcgctggggttgtaaacaaggaggacccccccccccaggaggcccgcgagggggaccgcccaaataaaaaacccggtcgttcccccggggtagggggcaccaaattaaaaccattcctttggcgtgtaaattgggct

SEQ ID NO: 51959 - DNA, 510 bp, Triticum aestivum
  Clone ID: PAT_TA_51959
actcttcttgcaatgctgctcttgatcttcagtaatcgcacattaacattcctcgtagcacaaatacatgacactccatatgttgaccatcatttccaccagaaaaaaaaataattaccgtgacacagctgtctacaatcctgacataaataaattggcctatatcatcaaaacagcaacggggaatcactcccagagactacatagcctttttttacaatgatgatgagaccttctaccatcacttctgaggcgatcagtctcaaggtccagttacactatgccttgctctgcccgctctgcacttcaaaatctgatattgcccgactgcactcaagcatgttctttcatcgaccctgcaccctaatactgcttatggaggcaccagagcaaatgcatatgagatcttcaaagattcatatgtgctgatgaattcgacggtgcaagaaaatgacgatccttccatatctattgatcattcagaatcatcttcactatactgctctggat

SEQ ID NO: 51960 - DNA, 481 bp, Triticum aestivum
  Clone ID: PAT_TA_51960
tcgcgatctagaactagtacgcgagggccgcccttttttttttttttttttgactacgatacaaatacaatatcactgcacaaatacaaatacaatactgactatgactatcatgagctgataattgtgcagtacatatggcttgtttgcaataatcccaatccaggaacagtacagacaatttaaaacaaaatactccaagatcacacattcgttcagccaaactgacaggaaggcagacgtacgctgaaagggccacctgatagacatgcatcggccataggacgatagtgcctttgtaactattagtactattcttcttctccggcagagagaaaatcgtgataccctatgatcttgcatcctttgtgtctcagaccatccagagtgctgtcattcggataatcttttagacgatccactaataccagcctgagggatggaaggtgcagtaatccatcagggattccttcaccatgcg

SEQ ID NO: 51961 - DNA, 352 bp, Triticum aestivum
  Clone ID: PAT_TA_51961
gggccacctattgacaaaagctttcgttcttgtgtagttcgagtgcatgatttatattccacgacgggggaaaaggcttagtgcagttaaaggggtactagtacgtgccttgcacatgcagggggggctttacagggattggagcactataacactctttatttaggcttcgcataccggtatagggcggggacggcccattcgcacgatctacacttgtggataaacgacacgcaattttcaatgctctcactaagttcatttttcgccttttccaggccgtccctctaaaaggtattcaatgggccaagagggagaatcttttgggctccaccaagacctaaccttacct

SEQ ID NO: 51962 - DNA, 505 bp, Triticum aestivum
  Clone ID: PAT_TA_51962
gctatgtctcagttgacagatattttgcaatcccaaaacaacgaagtttttacatcatcaacaaggtgttttaatttctttgatgaaagcgagatcatcaacaaggtgtggggggagcctcaaacacttgcgagtgtcgtacgtatccttttgtctttgatgatacagtactactctacttgcacgcgcgcgctgtcctcgcgagacagtcatcgtcgccaaagctccagagccccagctggctgtcgtcgatcttctcggcatcggcgccgaacaggctatccagccactcgtacgagctgctgtccaagaaaccgaattggtcatcgaacatgaaaggatctaacagttggttggcggagtcgtcggacgctgccggcagaaccgcgtcggcttcgatccggggccgcttcttggggctggccaggtcgacgacggactggctggactccacttcagcatggacatattgcgccatgacctcgtcggacgcggacatgccctg

SEQ ID NO: 51963 - DNA, 520 bp, Triticum aestivum
  Clone ID: PAT_TA_51963
ttttttttttttttttttttttttttttttttttttttttttttttttttttttttttttttttttttttttttttttggttttttttttttttttttttctaacaagcccaagtttttttctgcattgaaaacagggggaaaaaaagtccattgaaaaggggttaaaaaaaaacaaaaaaaacccccatcatggaaaggattttcgaaaagttcaaaaagcagggtttaaaaacttttggaaggaactttttacccgcttttaactggaaaaaattcaaaccagggccaagaaaagccaggatgcccattctcaaaaaaggggggaaaaaaaaaatcggggacctaaaattggggctgaaaaaaattttggtgtttaaaaaaaaacccccgccctttaaaaaaaaaactggtaaaaaaaaaccctaaacttcaaccccacaaagggctggaaaaaacccggcccattgttgccccccgggaaaaccgcaacccttaaaaattgccggggcccccccccc

SEQ ID NO: 51964 - DNA, 482 bp, Triticum aestivum
  Clone ID: PAT_TA_51964
agtcgacatattgtataatattatgcgtccgttcatatacatagccaccgatagcattctcatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacttgtgtggcgtcggtgcacccgaacataggcagcttccacattgtccagtaccggccatcatagtaccccagggatgcgttgtgctcacggaagatgaacccaaccttgctgaa

SEQ ID NO: 51965 - DNA, 533 bp, Triticum aestivum
  Clone ID: PAT_TA_51965
agtcgacagattgtataaatatattatgtgcatgtgcatatacatagccaccgattgcattcacatacgagcatgctttctcgagacatgttggtacatgaacatggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacgtacgcgtcagggtactccttcttgacctcttccacctcgttgatcacctgtgtggcgtcggtgcacccgaacataggcagcttccacattgtccagtaccggccatcgtagtacccaggggatgcgttgtgctcacggaagatgaacccaaccttgctgaactcgaggcaaggcacccatttggagcggatcaggtagtcgacctgctt

SEQ ID NO: 51966 - DNA, 356 bp, Triticum aestivum
  unsure (1)..(356): unsure at all n locations
  Clone ID: PAT_TA_51966
tcgcgatctagaactagtccccgagaccgacgagtgccgcacctacgacagctgagcgtacgtgctaatttgttctggacggcggatagtgaaggtggacgtggtgttcttggctcatgggagcccgagaaaacctactatgtctcaacctaccgttacttacacgatcgggatgtatgtagtaaaaacgcgccaaatattttcccagggacatacgtggttgatatacaattgatattacagacgtttatttaaagttgtnaaaaaaaaaaaaaaaaaaaaaaaaaaaaaaaaaaaaaaaaaaaaaaaaaaaaaaaaaaaaaaaaaaagggggccggttcgcaatctaaaactag

SEQ ID NO: 51967 - DNA, 568 bp, Triticum aestivum
  Clone ID: PAT_TA_51967
gcaggggcgttctaactcttaatcatgattgtacttgcaagatgaatgtgccttcataagccaaacaaaagagttccatagaagcaatgggcaaagaaagaggacacctaattcgctgaggctgcactatgttgcacctccccacggttgaccttcctactgagccatactcatgttgaaataaccaagtatatcacatcatttgtggtccatatacccctggaaaacacagtgacatcagttaatggcatacacatatttcaaaaaaatgtgagcatattttcagttacaatacaaacaccaacaccaaaatcagaagaaacaaaattaagaatatggaactgaacttggcaactaataaatttaacaagccaatatatgacaactcttcatgttgatatggcaaaaaagcaatacttgaaacaaattaatttatctgtaaaaatgacataaggaatgtactcgatacagtcgagcatcagatggattaattcgattctgatataacaattatgcaaaaaatatagttcataacagcatgacaaggtgaagtgaaagcattgatata

SEQ ID NO: 51968 - DNA, 349 bp, Triticum aestivum
  Clone ID: PAT_TA_51968
atcacgagaagctttattcttgttcacgaacagcgcttatttaagccctgcacccccccccgaacggggctgatagcccccaaacacccccccctgcataccctatacgactgggcccaacatcacacatacatttttttgatgcccccatatacccccatcggagggggcccccaaaccggtaaacttaatcatcggccctgaccacaaaattttccttgccctcggggaactccccggggcgggggttgatgtcctcctccagcctgctttcgcccaccttgaaatggccggagccaccgcccgggggaccggggggaccatggggggggccgggggggtcaaaccc

SEQ ID NO: 51969 - DNA, 468 bp, Triticum aestivum
  Clone ID: PAT_TA_51969
ccaccaggggaaagatcctttagatgatgaaaaaacccctgggatgaaccagttgcccccccggcccgggggtcccccccgctgaaccaaagatgcatccccatccatccattggcctcccccccatcatcaaatcccaaggggggctttaattgaccccctccatggaccccccgatgcggatccaaaacagctttcgacggaaaaggaaggttctaccccataatctggtcgaggcccccggtgtttttgaggccgaccccaatccccccccccaaaatgtggccaaaggacccccatgcaaccgtttcggcaaaagtaaacccggccgggtcccccttttgcagcccggactcgcccccctccagtttgagccccgccgtccccttcctgttcgccgacggggccagcccaaaccgcccgggaaacagaataagggttcgtgggggccaccatgatgatattggg

SEQ ID NO: 51970 - DNA, 464 bp, Triticum aestivum
  Clone ID: PAT_TA_51970
gaggagaaatgttcattcagacagattgattacccgatccatgaaggcagaggaggaaatatattccgggtacacggcacacacatacacacaaagacacacgggggtgaacctatgcgagcagcgagcgaaagggaccagacccacatgcacacgaacacctaactacatagcatgagaggatatgctctgggtcgacgcctacctgcacaccataacacgtgctagacagaccgacgagcgcttacaaattaagagttgtaggcgttgcacttgaagttatcgccgaatgtcctggccttcgcgcacaacccggtgggcaccgcctgctgcactgtggtgatccaaaaccacaacgccagctcgaacactagcgccagctgctgcgccaccctgtcctggctggtgagaccatggaacacggtgctctactcggacgcccagcagtagttgttacacgacac

SEQ ID NO: 51971 - DNA, 465 bp, Triticum aestivum
  Clone ID: PAT_TA_51971
aattaaggtaaaacgaggcgatattatattgtcaaagtttcgaagtgttgagatcgcgcgaaacatgtcctagctagtctgttataagtagtttatccaacctgcaggcttcagagctagcatgcctcggcggcggcaacagcgtagcttcgactaggtcctgccggccggatgaagacgtgggcgtcacagcgagacacggccgacgcgcccggcctaccgttaggacttagtaacgcgagcatgtacgaagctacgagaaactggcgttgcgacgacgatggtcctcctccgtggtcgtcacgatctcctctaggtcgtcggcccgctgcggcggcggcgcggtgggcgtgctggagctaccggcgcgctgctccgtcgccctcgcctgcgccgcggcctcctcggttgcggggccacgtccgctgtgccgcttcttgttgagaaacgggatccggaggtgcg

SEQ ID NO: 51972 - DNA, 282 bp, Triticum aestivum
  Clone ID: PAT_TA_51972
aaaagaaggaacaggtttggggggtacccaaaaaggaggcccaaaaaaaaagcccggccccgccggacaaccaaaggggccgccgaacagccgggaggaaggggctttttggttggggcttccttttaaaaaaaaaagaggttggaagccggggggcccaaaaaatatactcactcaggggggatcgggggaagaaaacaagcatcggcaaccggtcacccttattaaaaatgggtcctcgccccccccccactagttgggggggcccccggacccgggggg

SEQ ID NO: 51973 - DNA, 548 bp, Triticum aestivum
  Clone ID: PAT_TA_51973
agggcttaagaaaatcgtaatctgtccaacataccaggcgcacgttcgtgctaatgtggctctgcacataccatgttgctatccaacataggagacacacattttttataaaatgggctacgacataaccctaaacaggacatcatagcaggctctcattacgactaaagtagcctatgacataaaccctgaagcgagcaccatcagttgaaccatgacacgatatttcacatgccaaatagtatattacagccaaaagactgtaacatattgaacataaaagcgtctccaaagacatccatcagcttatttgagagcctcaaactcaagcttcccaacatccaaaagcttgttgatatactgtgttcatgtgccatttgctgaatcagaaacctgaatcatataaggtattgactttaagtgctatccaagggctctgggaaccacttccattggcatactggtcgccgttgacactgctattggcagttacattacctttccaaacaagaggacgcccttcatgctgctgtcgctgccgcgagcta

SEQ ID NO: 51974 - DNA, 532 bp, Triticum aestivum
  unsure (1)..(532): unsure at all n locations
  Clone ID: PAT_TA_51974
gaccaaatgactcatagagcaatgtcattcacaccacaaacaaatgggaggatctggccatgtcaatgcatgcatgataaggagataatatgaactcaacctcacctcacagcaaatagagataggactagcagcttatgcgggaaactcctactccttgggggactagataaccatgttcacacttggggaaggcgtggtaggtaagcacccacccggtcttcatctggtgggggtcgaggaagctctggtcaaactggaggatcttgtcggacaccaacttgccgatgcaggaggagcacgagccgaaggcgtacgagaagggcagggccatcccctcctacttgtccttatagaagatgtagacgtgctccgggaactccatgtccacctcggcctagagcgtcatcaggttgaccttgtacgtcttctgcgcgaggagcctgactaccacgacctgcttggtgtgggcgaggatganggccacggacgcctacgccactcggagcgcatgtggcgccacagcgcgcac

SEQ ID NO: 51975 - DNA, 576 bp, Triticum aestivum
  unsure (1)..(576): unsure at all n locations
  Clone ID: PAT_TA_51975
aggtcacgttccgagcaaccatgttaccttctgcagccctgccgccgtcctagcttattctttttctttttctagattatagcatgggactagatatagacaatataaaagcatcacggaacaatcttgagaaccttcatcttgtcaatccatgcgttgaaggagttggccgtgttacggaagccgaggaatccatgctccttgctcttgttcatgctatccagatgctcgatctcaacattgaacatggcatcgacgaaccaccaattggcgatctcctggagctcagtcgtgataagctcattctcccggagaatctccgcccacacgggctccttccccgccatggcgtcggcgagcacgaaccggttgtcctctccctcataccctgcccattccaccccgaaacgatcggccagcatcggccagagctgcttccacttgaacacatccccattgctgcaattgaaagcttcgttctttgccaacggatggacggcagcccagatctcatgctcggcgatgaggtccgcgtncgaggcgtcgctgaaaccctcccagcgaccctgcagccag

SEQ ID NO: 51976 - DNA, 584 bp, Triticum aestivum
  Clone ID: PAT_TA_51976
gctattgtgagataagcattactaacttcctcctcatcgatcacacagttttattgttttacattctttcctatgaacaaaataaaagacgaatcaaagaaaaacaagactactactacaatctacacagtatcaataaaatggtgtacaatgcagtttccatttcctccatgacgttgcaccatgacgttgatcaccatcacatcgagacaccgatgagaatcaggcggagctccactggctggccttctcgaagccgttgcgtccgtagtaatagtcctgcatggcctgttggatctgggcacgagagttcatgacaaagagcccctgctgcaccactggctcgtttaagagctgccctgccgccagcacgaagcgcagcggcgcaccggacaggttccacacactgagcccatcgccggcgccgagcacaaggcaatgatgcgcgctcgccggcgcggcaccctccttgccaaatacaccctccccctcgatgatgtacatgaaagcgttccagcccttgaggatcggttggtgaagctgtgaccctggttgcatggtgaagtccatgtacatggtcggcg

SEQ ID NO: 51977 - DNA, 595 bp, Triticum aestivum
  Clone ID: PAT_TA_51977
gttgagaaatgattgtactacttgataaatagattgccatcgagctaaaccgtttatcacttcgttttttctatcacacgcggtgggtgtgctgattcagacgaatgcgaagtggagatacagagttcactacagctaccacggtaaccagacaacttccaagaaagatagcgtgttcgattgcgaaagttgtcgctgacaataaataccagcagtagctagcgcttcaaagagtagctctttccagtgaacgcgttgaacttcggctcttccttcttaggaggctcgctccctttggcaggctccttttgtgcttctgcttctttcttgctgcttgcacttgaaccaaacacaagcttccctgttttctggcgcgttgatgtgctggctcctgaaggtgatgcagtttgctgatttgcccttttgttcgagtctgaaggcgcagaacgtgcagccgcagtggccgaagaagctccaggtgctggttgtttcgggccccttaccatccagccggtttcctgaaccagtgaatggtttgaactttggttcatcttcaacgataacctcttgatcttcaacaggtgccctggcctgc

SEQ ID NO: 51978 - DNA, 563 bp, Triticum aestivum
  Clone ID: PAT_TA_51978
ccccgcgtccgcacccaccccgaccccgaagcagacacgacacgcgcgcgtcggcctcactgccaaacttcctccatccctcgcccgcccggacgcgcacggcgcgcgacagacgcccaccgcgtcccctcccctccccggcgaagcccggccggcctggcggcggaggacatgaagccccgggacctgctggagcggatccggcggcccttcgcctcccgccgcgggacgtcggcgtcggcgcggcgggaggaggaggacctggaggccatcgcggcgcgggagcagcgcgcgttccggtacgaggcgctggcggcggccacgcgcaacttctcggagaagcagaagctcgggcagggcggcttcggccccgtctaccggggccagctcgccgacggacgggacgtggccgtccagcaccgcaacgtcgtcaacctgctcggctactgcgcccacggcgccgacgagaagctgctcgtctacgagtacgtccccaacgagagcctcgacaagatcctcttgctccggccgcccgcccccccggccggcccaacccaccgggc

SEQ ID NO: 51979 - DNA, 573 bp, Triticum aestivum
  Clone ID: PAT_TA_51979
ccccgcgtccggtcattcatcgctgatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccagagggaagggcatcgtggactccctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttggggtatctggggaggccaagggtcaagggaaaatcct

SEQ ID NO: 51980 - DNA, 590 bp, Triticum aestivum
  Clone ID: PAT_TA_51980
cccacgcgtccgctcggccctcggtgccgccagcaccaccgccgactgcaccctcggctgtcggtgtcgccagcgccgctgccgactgctcgggcgagggttcttcgatccggcgagttgggagtgtgggcgccatcttccagatcctgtccaagtcgccgccagcgctgacgagccaatcaccaaccgccgcccaccaattgtctctgtgtaggagtcagccaccggtcgccttttctgcaacagtcactcctcgttgccatgcctcaacatcggccaagttagatggatagatcttggattcgtggcacactgttctctcgagagtacatcaatggtgtcaaagagtttatgaacttaattcaagcaaaattcagcgaggatgaagaaatactatgcccatgtagagaatgccttaatcgcaaatactggcatcaagctgttgtgaacaagcacatattgacgcatggcatggaaagtacatatactcgctggatatatcatggagaagacttcaatgcagatgttattgagcatcctgttgatgtgcatgactccgaggatggtaacaacggtgctgaccgatttga

SEQ ID NO: 51981 - DNA, 574 bp, Triticum aestivum
  Clone ID: PAT_TA_51981
gcgcgctcatcggcaaaggaggcaccctcatcaagtcgttagctgaagcatcaaatgctgggatcacggtctcgcaccaccgagtctgttacggtttcaatgacagactggttaacatcactgggcacttggaagatcagctgcaggccatattcctcatactgtccgagctgcttgacgatgtccactacttgtcctcctaccaaagagttggttttccacgttatcatgtttcaagcgttgagcgtgatggcgatgggcaagacgagtatgtccaaagataccacagcaggcctgacacgcccgtggggtcacctgacatcgacgacggcagacacgtagaagggactctgaccatcgctgtcgcgaatgagtacgtgggcgccgtcgttggccgtggtgggagggtcatcaaggagatcgagcaggctacgggcgtgtggatcacggtgttcaaggggaagctcttacctgggatgagagaaagggaggtgcgtgatcaaagggacgcgggagggcggtgggatgccgcgggaggccgatggattcgcgggagcacattctgcggtacgct

SEQ ID NO: 51982 - DNA, 455 bp, Triticum aestivum
  Clone ID: PAT_TA_51982
acaaagcaaataccacaattatcagaaagttttcgagacacttaacatctgatagttactgacaccaacattggagagtcgactgacaaccatacatagagcagagcaaaaatactgacgaccccaaagattttagcatactgtgccattagcacttgacctctttcagcccatgtgcaaagtacaggaaagttggatcagcagctccctccttgtagtacgcgaacaccacgccgccatcatcatgcatgctctcgccaacaaagaactgaaagtccttgagcttgctaagaagatacttcgtggcagactcaacattcttcttgaaaacatctaagtcatccccttcaagcttggcagtgaagttcttgatgtagcgcttcatgtgagagataaactgcttcttgtcaaaagcaagttgctcctgaagacggaaggtgtcaacaatgtcaacc

SEQ ID NO: 51983 - DNA, 578 bp, Triticum aestivum
  Clone ID: PAT_TA_51983
agaaacgcctctatttttctactgtaacatagcataacatttgatgatgacttgccaagcctaactaccgattcctccttgatgagttgacattatcgctgtaaacaaacggcatctttgtctgataaaccaaatgcccatcggcatgtgattttgattaacacgcccgcgcccccccccccctcttctttctctcgcatgcgccgtgtgtagccgatctctctcgatcttgataccgccctacgtccttttgaatcttcactaccactgctgggcgtcggttcgcctccattcctccaatcaccttgattgccaagcctgatgactagtcccattggtaccaaatcaaatgctacgactttcagccgcatgccatgtgctgtcgcaggccagcaacgtgctgacaggcgagagcctgagtagcgtagatcttctggctgccttatgggaaatctctcttttctccgagttctagattgccaacttttccagcgagtatgcctccaccttctgactgatcaggtgtccagtctctcgcgtgctgcgctgcaccacttcaccgcccgacaccaccttgc

SEQ ID NO: 51984 - DNA, 433 bp, Triticum aestivum
  Clone ID: PAT_TA_51984
cccccaaaggggaatatattattattttctaaccttgggaccaagggaccaaaaaaaccaggggaaaaattccccccaattaatgggggggggaaaaaaggaaagttcccacccccccccccctaaaattaaaatcccccccccccaaaggaaaaaaaaggggcctaaaaaccccccccttcctccttttgggagctccgggttaaaaaaaaaataaaaaacccccatctgggccaggaaaaacctatttcgcccgacggggaaaccccgtttatttttaaacaccggaccgggttaattaccaccccttggaaaagcagggggcaaacaaaaggcaaaagttaattcttggcaaagcgggaggccccggaaaattataatatttacaggggagccgccggccggggatttctttaggggggggggggggggt

SEQ ID NO: 51985 - DNA, 555 bp, Triticum aestivum
  Clone ID: PAT_TA_51985
agatatatattatccatagattttttttgtatcatttacaaatagatactcactgcagattttatttggaagtacatataagcattccagattttatacagattttatttggagtacggacgtttgaaaaaaatccgacatgggcagcctaataaatgaagagcatgctcattgccctttcgtttggcaagcccgccgtagaggcaccggcgggtcggagagcgcgccctccacgatctggtcgaagatgaacttgtaagccgcctcggtcaagtgcacgccatcccagctcacgctcctggacgggtcctcgcatgacttcccctccatgaccgtgccattcacctccaccttaacgccgcatccgatgtccttgtcgaagttgtactcgccgccgccgtacccgcagcacacgcgtagagggtccccaaaaccgatcttcttggcttcgctcatcagccggtacatgagcggtgtacacgtcgacgtaggtgaaggcggcctcggggagagccacccttagcctcgcaacggtctccttgagccgcgcgttga

SEQ ID NO: 51986 - DNA, 565 bp, Triticum aestivum
  Clone ID: PAT_TA_51986
atttcatccctgccttctttctctctctgccactcgccgcagcagatggccgcctcggcaatcagaaaccctagcccagccgccgccgtcgccgcgcccctgccctcccgcgccgtgctgcggatggtttcgccgtcggtccggagaggcgcgtccgtcgtggcgtccgcgtcaatgcggccggccaaggcggtcacggccgaggcgccctcccccgtcgccgagagggtgaacggggccgaggtggcgggggccggcatcgcgaggcccgacgcgctcggcaggttcggcaagttcgggggcaagtacgtgccggagaccctcatgcacgccctcaccgagctcgaggccgccttccacgcgctcgccgacgacgaggacttccagaaagaacttgacggtatcctcaaggattacgtgggccgcgagagcccgctatactttgcggagcgcttgacggagcactacaagcgtgctgatggcactggcccactgatttacctcaagagggcaggatcctgaaccacacccggtgctcacaagaatcaaccaaatgcctgtgggc

SEQ ID NO: 51987 - DNA, 353 bp, Triticum aestivum
  unsure (1)..(353): unsure at all n locations
  Clone ID: PAT_TA_51987
atcgactctatcggtcgcggaactgcaactgagatccctgcgaagaaggccaaaacagacaagctcgcagcggagttctccaagtacgttcctggctcaatgactgacaagtacatgaccaaactgcgcaaagaactcgangatggnccgatgaacatctctcaaagggcgacctcggcgaatgggaacagttgcttcgcagccgcttccatgtcggtcttcgatctgttgcagacggcaaagaagacaagngactctcttgagctnntcctgaatgggagtggcttacgggaggatcgtcatacgctgtcgttgacaggcgttgggttctgtatgccatcgggcgcaccttt

SEQ ID NO: 51988 - DNA, 521 bp, Triticum aestivum
  Clone ID: PAT_TA_51988
ccccgcgtccgccccgcgtccgacgaccagagccatccctgtctacttgctagagcttctcctagcttcatgcatgtgtacatagctagatatagataaacatatatacagagtgcgttgcgtacacggtgcgatacgaccaagaggcaatggaggggctgccggcgcaggtggaggttccgtcctacttcctgtgcccgatctccatggagatcatgcgggaccctgtgacgctctcgtccgggatcacctacgaccgggaaagcatcgagcgctgggtgttcaccgacggccacggcgagtgcccgatgaccaagcagaagctcggcgccgccgaccgggagcccacgcccaaccacacgctccgccggctcatccagggctggtgcgcggtgcacgcggtcgagaggttccccaccccgcgcgctcccatcgatgccgcgcgcgtggaaaccatcgtggacgcggccaggcgggggcaggacctgctggtggcgtccctgagggagcttgcggacatc

SEQ ID NO: 51989 - DNA, 545 bp, Triticum aestivum
  Clone ID: PAT_TA_51989
ccccgcgtccgccaagtcacaacctcgcctcccctaccaccatcagcacctacccgaagccaagaaccaccttccgcccctccaccccctggccgccccaacaccgacggatcaggcgatggcagtggaggccatggcagagaagaacaccggcgccggcgcggctggcggagtagccccggagagcggggacaggcgctcccgcttcaggcggatctgcgtctactgcggcagcgccaagggccgaaaggccagctaccaggacgccgccgtcgagctcggcaaggagctggtggagaggggcatcgacctggtctacggaggaggctccattgggctcatgggcctggtatcccacgcagtccatgatggaggacgccatgtgattggggtcatccccaagtccttgatgcccagagaggtcactggagagcctgttggggaagtgagagccgcctctggcatgcacgaagaggaaggcccgacatggttccgctcctgctgatggcttttcattgccctttaccccgggcggcctaatgggg

SEQ ID NO: 51990 - DNA, 402 bp, Triticum aestivum
  Clone ID: PAT_TA_51990
cgcatcggccggtacgccacactccgccgatgttccttcgatcgtgccgcctgtgatcacacctctctcttctctcccgccagctcagccgccggtaggatcggagccgggggagcgcgatggccgcgccgccggctagggcccgcgccgactacgactacctcatcaagctcctcctcatcggcgacagcggtgttggcaagagttgcctcctcctacggttctctgatggctccttcactactagttttattactacaataggtattgacttcaagataagaacaattgaactggatggcaagcgcattaagttgcaaatttgggatacagccggtcaagagcgattcaggactatcacgacagcatactaccggggagccatgggaatcttgcttggtt

SEQ ID NO: 51991 - DNA, 558 bp, Triticum aestivum
  Clone ID: PAT_TA_51991
ccttattactatgtttttcgagtcatgccaatcagagggggcctttcttctggacaaaatcaccagagattgagaacggctagaaaatggttttagaatgagacgacaacattttgaccttaagtggtttcacgtgcataatcaacgccacatgttatcacatcacaattttgaccattctagtccctcttgatttctccccaagccgtgctcactccagggacagtttggccattgtcaaggctagcatctgaactccgtttgccatgtcctccggcgacgcaaactcttcgggcttgtggctgtatcctttgtaacagggaatgaagatcatacccattggtgatattctggccatgaagagtgaatcgtgataagctctgcttatcatcaatttgtattctaggcccagctgttttgcagcaaattccattgcgtttatgactgatttgtcagacagagcagggcggatcctggttgaatgatcttgaattccggataggttctactcccacgggatcttttgaatattgtcaatggccaggatttggtgcaacc

SEQ ID NO: 51992 - DNA, 242 bp, Triticum aestivum
  Clone ID: PAT_TA_51992
gggaagcaaaaacccgcccgccatttttttttctttccaccaaggggcccgaaaaaattggcttaaaacttttttgggtcctacgggcaaaaggaccccttggggggggcctttttctagggggaaacctagttccatacgtcccctaaaaaacaaattatgtttcaccagaaaccattttaacaaaacgggggccaaattcaggcccatgtttaggaagcctgcttgtaaatttcccccct

SEQ ID NO: 51993 - DNA, 573 bp, Triticum aestivum
  Clone ID: PAT_TA_51993
tttttttttttttttttttttttttttttttttttttttttttttttttttttttttttttttttttttttttttttttttttttttttttttttttttgcaaaacaacggccccccagccaaaagcgagggaaaccccatgaaaaaaaaatttgggcccccccggcaaaaagaaagggggaaaaatcccggggggggaaccccacacccccaagcccccccccggggccgggcctggaaaccggaacaaacggcggcatcggccccaggcttgcagctcaatacccacgggggccaacacccgaaaccggggccccccccccggaaaagaaaacaccccggcatcacaagccacaaaccatatattttgcctcaaaaaaaaaccccgcaagcccaacaaactttggggggtaaacccccaaaccccaaagggccggggcacaccaagatcccaacaaaaactaagccccaacaatcaacccaacaatcttccaaaaaaattgccccctcctgaaaggaaaaacggcccccttgcccccggttcttctaaacaccaagggccaacaccatttt

SEQ ID NO: 51994 - DNA, 513 bp, Triticum aestivum
  Clone ID: PAT_TA_51994
gccggtgcgccaacacagcagatgcagcttgcggatccccggcatgactcagatgctgacgatgaaccggactacctgttgtaatttgaacacctaaaaaggttcttggacccgctgcaacgcgtgttctacaacaacaataccgggcgcgaggcactggtgaagaagtgcgcagatgagcacatgcagcagtgcaaggtgctccgcggtggcccccgtgtcgtcgaggtgattcccagggctctcaacctgtcgagtcatgtactcattcatactgaaactaaagtctgaaaggctggtggaggacgttgtggagagtgtcgctgaaggtgggtctgtccggctgtcactactgctggagctacagcgccggtacacgaagatcaacgggaaggtggccatcgccgagacccgattgagcctcatgcaggaggacatgtacatactaacataaacaagatgatagcagaagctctcttgctcttcagctccaaagcgaaagcaggtgaaatg

SEQ ID NO: 51995 - DNA, 548 bp, Triticum aestivum
  Clone ID: PAT_TA_51995
ctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtaaacaacatcgtctctgtctttctactcattttctagctcacggaagtcaataacaatcaaatgtatcaaaaatgtcaatctgatgtgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcagggtgatcaaacgaggtggagggagggtcaagaaa

SEQ ID NO: 51996 - DNA, 580 bp, Triticum aestivum
  Clone ID: PAT_TA_51996
ccagttcctctgccagttctacgcacaccaccgcaagccgccgctcctcggcatcttcgagaactgcagcaaggaaggtatggtgttcacccccattccgcccctagttgccgactacatctctccggagcgcttctcccttggacgtccccgacttacctatgtgctcgactgccgccacggtcgcgtacttatcgaagacctggagcagaaatacctcattgtgtgcgaccccatcacaagtgagaagtgtcgcgtggctcttccatgcaagttcaagtggagctttgtcggagcggtgctctgcacagccggctacaaggggccctccagccccttcaaggtggtattggtgtcctgggatggcgtggataatcaactcctcgcctacgtttactcctcgatgactgacacatggggcaatctcatatcagttgaggctccagataatacttattttcatggtttggcgtagcacccctcgttggcaaatgtcctttactgggccagtttatgaatggggagaaggtacaatactttgagttttggattttgggaccagccaggaaccttaccccat

SEQ ID NO: 51997 - DNA, 535 bp, Triticum aestivum
  Clone ID: PAT_TA_51997
gaaagtacagactcatcttctcatccgtcgtctattgcaagtcatacaacatacttgaaggtttatatatgtgttacaggtacaaaacaatgacccccgcctatgattcggatgggtaaacacatcactctacacaaactgggaaaattcacatcggagcagtcaaggggacataaaaatcaactggggggggtttttttttaatgacacagaatgcatattgatatacatgtcgctctgtccaaacacagctagtcaaacatacaacaagacatcattgatcagccggtgatgatgcccgccaggacatcggtcttccctcttgcgaatatggggtacaccaggcatatcgcgtctagccagccgtcgagagactcccaggtttcagcaaccaaaaacacaggcccatacgttgtgtttatacaaaggccggcgccagggggcagggtcagatcggagcacgtggacactgaaactatgtccgcgacgtctaccttgataaaccttttggctttctccacgagggcgtttgctt

SEQ ID NO: 51998 - DNA, 512 bp, Triticum aestivum
  Clone ID: PAT_TA_51998
ggtcggcaaacatcaacattttcactaaatgagaatagccctcaatgaagcttccttgagggctacaaacaaacatggatccctacaaacaaatcggtttaaaagtaagtaagcaagcaaccaaacaacccccttggaattaaaacatcttcttctcgggttggtatccctcaagaatggtgttgcatgtgttcatggcgcgcgcatccagcaagctgtggttccacagcttaatcatcaccaaacgccagcaccagagcagaggaaggttttgtacaagctgcggtccatgaagccgggagaagccctcgcaggcccaaggtatatgcccatcagctagcaccctttgtttccgaataaatgaattccacatatgcataataagcttctcatctttcgtgacatcaagaaaatcagcaagcatctgcaaccaaggaaacaaaacaagtaataactttctagtagtatgtttctcaaccgtaattaatgagagagagacaaatatctgctga

SEQ ID NO: 51999 - DNA, 137 bp, Triticum aestivum
  Clone ID: PAT_TA_51999
cccaccaccaaaaaacatagttcacttatttttccaaagcataaaaaaaaccatgtccttggggaccttaataagacccttaaccacaagccactcgggatctaaaactagtcggacccgggggcggacccctccgg

SEQ ID NO: 52000 - DNA, 521 bp, Triticum aestivum
  Clone ID: PAT_TA_52000
gtgttcacaacatttgaagctgctcttctgtgtatcacacactaacctacatatgcttctgtacaggtgaagcatgactccaaaatctggatataaacttctacatataacatactatagatctgttgagctgttggctatgtatgtaatgtaacaacaaaggtaaactatgtagatacatgatcaaacacaaaagtcagcaccttcacagtacaaaagagagaggcagccagttccaaacgttggccagtactctggtttcccctttgttgaagaaagctccttccatcagattgcctagccaaagcttcggcatctgaacacaaaaacagttttcgatcttcacaccagccaccggacggacagtcagagatcaacgacgattttgaggcatcgacagtttgggactttgggaaatgtacatacaacagctgcaagcctgagccaggtcaagccatgccaaccattcgtactaccagcatagccaaaagacctacagtggatcccgtaccgcgggactg

SEQ ID NO: 52001 - DNA, 334 bp, Triticum aestivum
  Clone ID: PAT_TA_52001
cgtcggccacctccgtcgctactttccagggctcaagtccaccgccggcctccccgtcagccgccgctccaacggcgctagcctcggcagcgtcagcaacggtggaaggatcaggagcatgcaggcgtggcccattgagggcatcaagaagttcgagaccctgtcctacttgccaccgctcagcacggaggccctcctcaagcaggaccactacctgatccgctccaagcgggggcctcgcctcgagatcagcaaggcagggcacatcttccgcgagcacaacgcatcccctgggtactatgaaggccgggactggacaacggggaagctgcct

SEQ ID NO: 52002 - DNA, 378 bp, Triticum aestivum
  unsure (1)..(378): unsure at all n locations
  Clone ID: PAT_TA_52002
cgggaggaacccggngcgaggagggcaaaggaagagaagaggagaccaccgagcccagcgcgcgcacacgacagnaggcgccgngatctancgcaggagcggagatggggctcacgttcacgaagctgntcagccggctcttcnncaagaaggagatgaggatcctnatggncggnctngatgcggttggnaagaccaccatnctntacaagctnaagctnnngaaagaacgnnaccaccattcccacaatnnngnnnnaatgnnnnaaactgnaaagaacaaaaaacattaattttaaccgtttgggaatagtcggggagtcaaggacaaagatcaagcccccatgngggaggcacttactttncaaaaacacacca

SEQ ID NO: 52003 - DNA, 316 bp, Triticum aestivum
  Clone ID: PAT_TA_52003
aaaacggggggggggggggaaacaaaacatttccccgccgggcatgcccgattccaggggcggaaaccccccccatagcctacaaagggcccccgcccccccatgggaacaaaaaaaacccccttaccccccaacgggaaaacaaatttccccccccttttttctgggattatgggaaacttacaggctttccctataaaaaaaaaaaacctttttttacagaagcagtttcccccaaagcatcagggggggggggggggacaaaaaccccggccctgagtcccgcccccctggaaaaaaggaaggcccctccctt

SEQ ID NO: 52004 - DNA, 601 bp, Triticum aestivum
  unsure (1)..(601): unsure at all n locations
  Clone ID: PAT_TA_52004
atgcaataacttgaagtctttcaaagatggagaaaaacctcatgaaagtatcttcaaaagtttgacaccagtgtgcacgcctcgtcatgctaataaggttcagcctttgggagtagcgagcccacggggccaaaagaagaagtcgggagttgtcaggctctctttcacaaggacatcttttgatggggagcaaactactgaaatatgctctaggaggtacttgattcgtccaagagccgggctattgattcctcaagcgagcgagaaaatatcagaaggttgttggtccattcttgagccttcgaccttcaagctacgcggagaaagctttttcagagacaaaaagaagtcagctgccccaggaagttctccatatactccaatcggtgtggacatgttcatgtcaccaaggaaaatacatcacattgcccagcatattgagctaccatctataaggccaagtgagaaagttccttcggtacttatcgtaaatattcagatacctacatatccgactgctatcttccttggtgacagcgacggngaagggattaacctggtgctgtatttcaaactgaacgaaaactttgagaaagatatt

SEQ ID NO: 52005 - DNA, 475 bp, Triticum aestivum
  Clone ID: PAT_TA_52005
aataataaaatgggtgcgtgatatcaatgttttttgttgatactcaagtatatagtatatacatttacatatcggatggtcatcaaagggatttgattccatgctcaaacagtatgcttctttcctcccaatggtcatcgaaattaccctcgtatactattgactcggaattattctgataagctcaatgtcaaacaggagggttttatctattagtccttgattccttaaaacgaaatctaaagctctttgtcccgaaaatgttgtcggttttgggcctaacttgttcaagtcattatctgggtatccaatatccggtggtactattatccttctaactccaccgggacgcatgcctgtcatagcctcctcaaaggctggtattacctgtcctgatccaaccttaaacttgaagaattctttatcaccaccctcgaaagaaccacctttggtcttgtttcgagcttcaaaaatg

SEQ ID NO: 52006 - DNA, 248 bp, Triticum aestivum
  unsure (1)..(248): unsure at all n locations
  Clone ID: PAT_TA_52006
cgcacgcgtccacgaataaaggccgagggcggcgagccaggcccaatcgccaaaaaccctagcgccgatccgatccgatcgagctctgcctcccctcccatggcggcccccccgagccaggcgagcctcctgctccagaagcagctccgagatctagcgaagaaccccgtggacgggttctcggcggngctggtggacgacggncacgtgtttgagtggcaggtcaccatcatcgggcccgcccgaaa

SEQ ID NO: 52007 - DNA, 614 bp, Triticum aestivum
  Clone ID: PAT_TA_52007
ctcctccccactcagtcctcggttcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccatgaacggccaggacctggacggccgcaacatcaccgtcaacgaggcgcagtcccgtcgctccggcggaggaggcggcggcggcttcggcggcggcggtggcggctacgggggccagcgccgtgagggcggaggcggcggcggctacggcggcggcggcggcggctacggaggtggccgcagcggcggcggcggcggctacggcagccgtgacggcggcggctacggaggcggcggcggcggcggctacggcggcagccgcggcggcttcggcggcggcaactggagggagtgaatggtggggcccctagctggccagttatcctagttaccgat

SEQ ID NO: 52008 - DNA, 609 bp, Triticum aestivum
  unsure (1)..(609): unsure at all n locations
  Clone ID: PAT_TA_52008
cctctttccaacccctcgtcgcctccccgtcctccctctgcaacgacttttctcccctcttgttccaagcccaaatcgagccaaaccccgacgctccaaatcgcccagctcggcgatccgggaggatctgcaagaagccgagacgccggctccaccggagcccggaggggaggcgggcaggcggcggtggcggcgaggccgtcagcggcggctggggtgtctgcgatgataacccggtcgaagctggtggagcagctgcgcgactaccagatccgatcccagcacaagcgcgacattatcggagctatctcatggggcttgctgtgctgtctcctaatagtatcctcatacatgatgctatacttcaggcacttctggttatcagccgtcatcatctccgtcggcattcttctccccgccggcctgtatattttgaggcagaggaagctggctaagaaaagagagcggagattattgttgcctctctccatgtaaggttatcattacattgtagtggtaggttcccctgattntgcggttattcttgactagacagaatccgcattccgggcttgcttggcacacatncaaacagttgataggcctctg

SEQ ID NO: 52009 - DNA, 561 bp, Triticum aestivum
  unsure (1)..(561): unsure at all n locations
  Clone ID: PAT_TA_52009
ggcaataaccgatgttttcagttcattgtagactctgttgaacctcaattgaataaattccaatacctcaatgtcgatatgctagaagattattttcttcagcatcaaatggaaagacaacatgcatgatagatcagttcagcaaatgcacggcagtaaaaagcacaaaaatcatcatatgtaatgaccgcatgcaagaaggcgaatgacttcatgatacgccaatgtgcaattcttgccttgatatcacatagcatcccatggcagtccctggctccatgaaaaaatcttcctggaaatggcctgcctgcttgctgagaatgtcgggagagagttcgacgatgcttagcatcccttcagcacaaaacccatctgcgcacacgaggaactcgttccccataatgaatgatccagaaactcgaacactcatcccttcttccccatgtgcacggcagtaaaccttctccatcacacggccaatcttttcgcaacggctgttaccttttagcatttcccttattcttgacanagtatcgaatatgtcgctcttaccgacatgtg

SEQ ID NO: 52010 - DNA, 342 bp, Triticum aestivum
  Clone ID: PAT_TA_52010
gccaaacaagctttaacagtttgccccaagatgaaccccattattgaactaaaaacggggcccaattaccttccgaaaacagcaggctggataaaactccgctccctcagagaggaataccaggagctagggtgccctacctacgggtcagttagcaacgacaggagaaatgctcctgcacattatgctacataggctgccggggcactagggctaccatggggggaagagggttatcagttatactacgggagttacaacacaagaaacctccatcacaaaccaacatatgatgtgttttgcagccttccaaaacaaaaattcgccatgaatatattttta

SEQ ID NO: 52011 - DNA, 455 bp, Triticum aestivum
  Clone ID: PAT_TA_52011
aagtgctacctgtgttataggctagttttatctcgtcaacgaattgtagtcttccggttagaactgctgtttgcacgcctgacatactttacaaggctgaggatttgttggggactccattggcaagctgctgcgatgattttattacctttgggagcaagatcgcgccctttgttacagagcttgcacacaggcttctaaagccactacattagctgatgcgccaggtgcattttcccaagggtgtcctaaagttactacaccaaattgtaatacagaattggccccaaagatttgggacagagctggcatattccaaacatgacataccacctgaagctaccgtgctaacacctcgggatggatacccagcaccttaacgaaaaagataccgtagagctcgatcgtttttaaataaaatcatctcgcaatcaatgcactaaacctaagatgat

SEQ ID NO: 52012 - DNA, 307 bp, Triticum aestivum
  unsure (1)..(307): unsure at all n locations
  Clone ID: PAT_TA_52012
ctcgtcatgccattcacttgctgcccgtgcctcctccattcaanacaaaaaaggtaagagcagttttgaacttgttctggccgactgtcttttctgaccatgtcgatcagttcaggtgacattttccagatatatggagctgatatttgtagctttttggttattgctgagtgtcattactttattgttactttgcgttatctaaatataatatgtcatggatcacgtcacgcgacatttactatgtcacgattgctacgtctcaactacctgatccgctccaagtgggtgccctgccggcggtcca

SEQ ID NO: 52013 - DNA, 642 bp, Triticum aestivum
  unsure (1)..(642): unsure at all n locations
  Clone ID: PAT_TA_52013
ggtctcgcaccattaggatccccttccccgacccaaatcggccgccgccgagccctcgaccttcgccggagccaccgagccaaccaccgaagctcctcgaactcctcatcctcctccggatcggcgcggatcggagactcccgcgaagcgattcctcctgtcaggcagtcgagatgtcggagtacaagaacgtcgttggggggaagctcaagctgaaggggaaaccgctggatgtcaaggagggcggagtcaagaagaagaataaaaagaagcaccgccgcgaggagtcgtctcaaggcgagcacggcgagctccgcgaaggtggaagctctgaattgccaggtgaccctgacaatgagttcagtgaagctgacagcntgggagaggaagggagtgcgcaagctgattatgaccacctcaccccagccgagaggcgttacattgaacagaagcagaagatcgacgtacacaagctggccaaggtggctgacaagtcgcacagggaccgcatccaggacttcaaccagtacctggcaaatcttagtgagcactatgatatcccaaaggtcggccctggttaattaaggttagcacgagtgttccagtgtgctggacctatgcatgcagctcgtcaatttcgcg

SEQ ID NO: 52014 - DNA, 567 bp, Triticum aestivum
  unsure (1)..(567): unsure at all n locations
  Clone ID: PAT_TA_52014
ccccgcgtccgcccaaaactgccgctgcttcagacgcaccaanaccatctactcaagaattgaaggatgagatacttgatgtgtctgcaaaaatattcaaggcaggaatgtcgcttctcgtcatcgataccgagaacaagtttgtatctacgggattcgccaaggaaattgcaagggttgnncccaagggaaatactactacctgccaaatgcttcggacgccgtgatttccgctgccactaagaccgcgctggcggacttgaagagctagagagcgatctcggagcatcgatcgcccccgcccaattgttgtttgtaccttctggtgatacaagtcgttcgtgcagtaatttgtgcagctgtccttagtcctttctgtaacttttttttggggcgtgcgtttcagctcttatgacccaattttggtgtaggttttcttgtcttctttctttctcttttaccagcaccagcagggctaaaatccgagcataacttcgtgtaaatgtcggaattctcccactggctctccgataattggccctgtaaatctactgctgttaattttcg

SEQ ID NO: 52015 - DNA, 610 bp, Triticum aestivum
  Clone ID: PAT_TA_52015
cggccgcgtgggctacagtatccaaataagtgtcgtggttttagttcaaatttagttcagtatatacatactcgttactgtagagtggagggaagagtgggtaaggtttgaattcccagggggaaggagatggacggccaggatgcgcggcacacatcgatcattttcatttaacaaaaaagtgctattgagcttacacacgcacacatgttatctacatgtatttgattgccacacatcacaccatcacaagacaccatgcatacataggcttcttgtacaggctatgcttactggaaattacccagattttcaccagcatagggcaccgaaaccttgcacaggccaccgccaatgtagtcgaaagccagagagatagccgacaaagcagaaagcccaggcaggagcctctttctgtcctatcagcttccttgttgttcctggatctgcaaactcaagtgtcagatcaagcacaagataataaacgtacagtcacgtcttttttgaccctctatccacataatactctgatttggatttacctgttaacattgagctacaaaggtaagaaggaatgtcactgttactgaaactgagccggcggcactag

SEQ ID NO: 52016 - DNA, 625 bp, Triticum aestivum
  unsure (1)..(625): unsure at all n locations
  Clone ID: PAT_TA_52016
canattttggacttttgtgtgcatcgggnatgcataattaagctatgcattgcctatcatctcctaaactctattacaggaagcatggtttcattttagggcgatgctaggtgtcaaccgactgatttcctggggaaataagtcgggtcgccagccgttcgatgcatcctcctagagccgggtcaacggaagcaacgaccgtatcgccgtagggacgcagggccgcatgctggcagtaggagccgcgcccccctcgccggcagcgcaacgacgctttgccgacggcgccggcgatgctacactgcagctcctaccccgctgcatcgcagctcaggggctccggtgaagctccaatgcagccgccggtgaagctacaatgcagcaccgcccgttgtagtgcagttccgggctcgccggtgaagctccattgcagcgccgacgatgcttcactgcagcaccgacgccggcgcggcggcggtccatcgatgctccatagcagcactcaacgccgtcggtgatgtttcactgcagcccgcaccgacgcggcgagcttcatagcagcacccgacggccccgccggcggagcttcactgcagcgccccaccgcttgctggagctccgctgt

SEQ ID NO: 52017 - DNA, 594 bp, Triticum aestivum
  unsure (1)..(594): unsure at all n locations
  Clone ID: PAT_TA_52017
gcagnactttccccggccgtccatggccacctaccccctcctcctcctcttcgccgccgtcgccgtagccgtagcggcggcgtcgtccgcgggggacaagccaacggcgtacgagatgctggagcggtacgacttcccgcggggcatcctgccggagggggtggaggggtacgagctcgatccggacggcggcttccaggtgtacttcccgcgggagtgcgagttcctgctagcgaagcagtggctggtcaagtacgacacgcgcatcgccggcgaccgcctcagcttctacatcggccccgtctccacgtccttcccgctaagcgacttcgccagcagcccgcactgtcgcggctaccacgaccgcgccgccgtcgctgcggccgtctcgtgaatcatatgctttttacatgtactcctacttagctactgctgctggggggaaatagtatatttcacatggaaaactctattgatacggcctgattatttgaacaagacgcacaagagtcattgtttcaattaaccttctgtgccgtggtggttcgtggatatcacaatgagctctatacgattccagtttagcttgagagc

SEQ ID NO: 52018 - DNA, 596 bp, Triticum aestivum
  unsure (1)..(596): unsure at all n locations
  Clone ID: PAT_TA_52018
cgnacttcagtcgtgccgcctgctcatcagcatataattcctgatcgagcgagcgggagaggaaggcgagatcaggccgggagagaagatggcgcaggggacgctggaggtgctgctcgtgggagccaaggcctcgagaacaccgactacctctgtaagctaccttgggcctctcccttcccccatcgaattctgatctgcttgaattcggctctgcgtttccgtcccctgctcgatcaagtagctcggtgatggcctctcgatcagccagatcggcgcaatattctcgagtcctttatgctttcagtttttgctggtctctaatggatgggatcgattctcgctgacgagttccgtggctgcgaattgttttctgcaggcaacatggacccgtacgcggttctaaaatgcacctcgcaggagcaaaagagcaccgtcgcctctggaaagggaagtgatcctgagtggaacgaaacctttgtgttcaccgtctctgagaatgcaactgagcttgtcatcaagctactggacagtgatggtggcacggacgacgacagcgttggtgaagcaacgatcccattggatgggagtgtaca

SEQ ID NO: 52019 - DNA, 650 bp, Triticum aestivum
  unsure (1)..(650): unsure at all n locations
  Clone ID: PAT_TA_52019
ccccgcgtccgcaccattactactaggcaagtgtcgccctctacatccgaagctggcgccgcgaaggcttctttaatcccgtngaagaaacacaagaaggggcaagaagggaggaggcagcacgcaatcagccagcgctcgcactctacgcttctcaattgacccgatcgaggagtcgcccaggccgagcgaaggggcaggcagccatggccaccgccagcctgtccagcgtggtggtggcggtcgacggcagcgaggagagcatgaaggcgctgcgctgggcgctcgacagcctgcgcctccgctccgacggcgcgctcgtcgtgctccacgtccagccgccgcccggcatcgccgcggggctcaaccccggccccatccccttcggcggccccagtgtggcggaggtgccggcgttcacgcaggccatcgagtcgcaccagcggcggatcacggatgccatcctggagcacgcgctcaagatttgctccgataagaatgtaaggggacgattaaacgaggcgtttctgtgccgattgctgaattctacccttcccccggccgctcgtgcttaattcgtgcttaaattgggtcggattcttggtccgttgaaggtggaggtgaagagccagtggtgggggggggatccc

SEQ ID NO: 52020 - DNA, 495 bp, Triticum aestivum
  Clone ID: PAT_TA_52020
ggctgattcaaggggatagagaaaatcagagtagtacagcgacgattgcagttttgggtcagttttcgaccgattcttctgccaaggcatcctttttacagagcatcttagatactgctaatcaggaagtatgaatggctttcgatcatatactgatagaatctcagccaaaggatacagtgagtctaattcccagtcgtcaattcagcaaggcaggtactgcgacgactcttatggtttgaagttctcatacagctgtggcatggtgccattttaccattgctggtgggagcgacgagtgtctcgtcgtgtggaatgttgtgtctgaagaagatgtaaccagaagcaccaaaacttagttttggttctcccgtgttgtaccatttcctttaaacggatgtgaaagttatcctagcgttgtaggtgcgccggctgtgccgagcaataccgtataaatgttctaagtgcttgtgtactagtagcaattttggtatc

SEQ ID NO: 52021 - DNA, 467 bp, Triticum aestivum
  Clone ID: PAT_TA_52021
gtccacgatcaaccaacaaagacgcgagggtgacgaccgagggccaccatcaggcgttggcaagaggaggtggcggctctcccgctgcaggctcaccgccaacatgaccaccggccggctaaaccgcgcccgtacgcagtcaccccagattaggagaccgtgatacttcttacaacccctccatccacgctctcaggaaatatttacataatgcaaccccttctgctcacggcactggacttttcaccatggatctcatagttggattggaaaagaactgataaacaaacatcatcttcttagcaacaatctttacatgattgtaagcactgtctactgtactacagcatattgtgcaccagcgtaccctccttcgttccagcaatatttacatgaatgcaaggacatatgattcgacatcattgagctcaacaacctatctttcaagttacctaaagagctatgct

SEQ ID NO: 52022 - DNA, 650 bp, Triticum aestivum
  unsure (1)..(650): unsure at all n locations
  Clone ID: PAT_TA_52022
ngattgcttccaaatcaaacccacanacagatatcatgagtctgtttgagaagtcgaatatggtatcaccatttgctatccatcagcagcagcttgcttttaagagcagccatcagtaaagcttgttgctgggtcataaacccacgcgtccgcctccaactcgactcgttccctttccttccttcttcccctcgtctccccaaccagaaacctaaacagaatcccaacccacccccgcagccaatcccaccggacgccagtcagccaaccccaatctcgactcctccgccgcctgaatccggttccgagtccatatttgaggtgccaccatgttcaacaggttatttgggaagcccaaggagcaggccaacgccggcgcgttggccactttggataagttaaacgagactcttgatatgctggagaagaaagagaaagtgttagagaaaaaagcaggcgctgagcttgagagggccaaggaattctcaaaagcaaagaataaaagagcggctatccaatcattgaagaggaaaaaactttatgagcagcaaattgagcagcttgggaatttccagttgagaatccatgatcagatgatcatgttagaagctgctaaagctacaacagagactgttgatgcattgaggact

SEQ ID NO: 52023 - DNA, 646 bp, Triticum aestivum
  Clone ID: PAT_TA_52023
catctttaatgtttgtacctagatgtaaggatactttgtagctagtaacatcagcaaaggagtagttatctacaaagcttggttgaaaggcctttctgaagagaaagtgggctagaagataaacttccccctttatttgtttactcgacttctgtcgctgatctgaatagaaatatatggtgacgaaaccttaaatgaatagctatgttttgcgtagaacgcatttggcaagaaaatcaattgctttagtgcacgtcttgacgctgtatcgaggtaagcattacgatgagtagcacaggaaacaacaaataatttacatgtatcgctgatattggaactactataacagttttctgttattctagttaatttgttcggcttaaattaacacttcttagaaagaagcttaaaatatttttgatttacagactggattacattagtaggttttgacgtgtgtgatggagtagagtatgatggtaatgcatggtttcttcttttgtttgcagagagtacagaattctttatttcaatggagaacaaaatggaagatctcttcaatcttgagtctgacattgttgacttgtccatgtccatcgacacaacaaagactgatgatcatgtcagcaatgctgaaataccatgt

SEQ ID NO: 52024 - DNA, 501 bp, Triticum aestivum
  Clone ID: PAT_TA_52024
gaggaaaaactggccctttttttcccgggggggggggtcatttcctgggaggaatcaagtcccaaatcccaatgggccttttatgttcaagcgataattcgaaacttggagttacattggacaaaacaatccgacattaaatgggggatggccctttaaataggcccaagggaaaccccatggggtggaaaaacttcaaaaaagtttggattttttcccctgggatgggggtttaaaaattgaaacttctttacggaccactggggaatgggccattccttccccatttgcaattcaaccgggtccttgaaaaagctagatacaccaacggcttgattattagtatcgcctggaaaacgggcataggaacgtcggggtatagaaacgttgtttaaacatttaacccccgatcaccctttaacctgaaccacctgtgcctttaaaaaccttgtgccccaaaaaaaaaacagggcgccaagtcccaagctttttggttttttg

SEQ ID NO: 52025 - DNA, 429 bp, Triticum aestivum
  Clone ID: PAT_TA_52025
ggatcgggagaaagctcatcaattgaacaaaaaaacatcatctgcattaacataatcgataccaatcatacaggaggccaaagggatgggtggccaaaaaaagcaacggggtttgtccatgtcccggggggagccacaaaacaacactcggcaagaaagcccctgttcaaagcatatgccaaacgaatggggcattttttctacacacgttttatttgttccaaccccgaacgctctattggatcaaaacaaataatttccatgccacccagtcgatcttgttcctaacggacttgtacaacttcaacttttttaaaagggaattcctttttttcattaacgcgggatccttgtccaacattgcgctcaaggggttcttttttttggttcctacatgcccctaaaaaccggtgagcaaggttctttttg

SEQ ID NO: 52026 - DNA, 579 bp, Triticum aestivum
  Clone ID: PAT_TA_52026
tcgcgatctagaaccgcagcctggcgccgaccgcaggttaagtacgctggtgcgccacctgctgccttcttccccacgaacatcagcagccaccgccacctccgccgactcctccctccaacctttccccaccatggcgtcgccctccgtcttcgccgggatcgcgcagggcccggaggaccccatcctcggggggacgggcgcgtacaacaagggtcccagccccggcaaggggaaccttggagtcggggcctaccggaccgagggagggaaggcccttgtgccgaatgggggcaagggcccccagccaaagccggtcccaaaccaggcaacgggtaaaggagatttggccgacaccggattgggccgattcaaccaggtggagggccaagctaattttgggggctgccagcccggtttttaaggaaattaggggggttccagggcagggctaataaggaccgggttccttaaaaggggaaggggaattcttggcagggacctatcatgaacgcactatttacatccccaagccaacctgggggaataacccaaaagtgttcactttacctggcctga

SEQ ID NO: 52027 - DNA, 219 bp, Triticum aestivum
  Clone ID: PAT_TA_52027
aacaaaaactgggggtttttaattcacgatccctggaaaaaaacaagatccctggaaagaaatggccccatttttacatacatacattatcagaaaatttttcccttacctcggctgaaccgcccttttggtgaacatttttggccccttttaaaacaatttttggggccacctttttaggccaaataagggaagggggggttttttaagggcttttgg

SEQ ID NO: 52028 - DNA, 388 bp, Triticum aestivum
  Clone ID: PAT_TA_52028
accaaaccacatttttttaaaatctccgcatgatgtttacagggcaaagcattcaaaaatggggggggcaaccagccacaaaagaggccccagccgaaacgggggtttatcagggtgaacatgccaaaaaatgcgggtgatttgatcctaaaggggtacggggggcgaaacaattttaaggggggaacactttagctccctactttgggggattgcacacactatgcgggaactggtttttgcttgggaccattgaagggggcaggcctcccattcgcattcccgttcccgttatggacggaacggggctgaaggggtcccttcccattttggggggagtaatttccgttttggggggagccccccctgttttgggggaagccatttc

SEQ ID NO: 52029 - DNA, 268 bp, Triticum aestivum
  Clone ID: PAT_TA_52029
aacgactaaacggttaattcttgatttatataggaggagaacaggtccagctgatcacaaagctcgtcggaactaaaccgacgttacaccttcatgtgctctatcaaaaatgtacacatacttaaaaggcactccacttggggagtcttatggaggctacatagtgacaaatcctaacaaaaagactgaaagaatcaccaccatcagctactcacagacacttctttggattcatgcacggggaaggaaggttccattgtaaaatccc

SEQ ID NO: 52030 - DNA, 487 bp, Triticum aestivum
  Clone ID: PAT_TA_52030
atagcccacaaaattctgacaagggacaaccggggggtttacaaaggcgacagacccggggggggaggggccacataccggagggtttttgggttcaacaaaaggttccgcgccaaaattttggggggggggaaaaattaaacttggcaggggacgggttcggggaaggggggccttgggacgggacaaaaatctcacttcccaccggggggggggaaccgggtctgggcctgaattgccggggcagggggggggccctgataacccccaccaccaaatccacctttgaagcctccgggggttccacgggccctggcgccacgggcacgggctccataaaacctttttcctttaggagggtttaggaactcattggtgctcacagactttttaacacgctctttacggtaagaattttttttttttttaaaagcctccttataagcacccaggtggaagaaaacctcatcatttcccttcttggggg

SEQ ID NO: 52031 - DNA, 353 bp, Triticum aestivum
  Clone ID: PAT_TA_52031
aaagggaaccccaaaggttcttttccaaaacaaaatttttccccaaacaagcaagggaagggggcccaacaaggggccttaggaaaccccaacccccccaaaacgggcccccaacacactggaaacaaacccacattcccggggggaaacaacatttttgggggaaaaaaaacaccaaattgggtccggaacaacaatttgggggcccgggacccaaccaaactggtttgttggtcggggggaaaaaagggcttaaacccaccattttttaaaaaaaaaaattgggggggcccaaagaaggggccccccgaaacccagaaaaactggggggggcaaccgggcccggggggccc

SEQ ID NO: 52032 - DNA, 434 bp, Triticum aestivum
  Clone ID: PAT_TA_52032
ccctgggccagcaacaaactaggaaatttggcttaagaaattcgacccaaaggggccactctaacaggggggcctttataccaaaacaaactctcctccccactacgatcccccaggggaaaataaaaaaaacaatccagccccaaaaccaagggaacatcaaaaaccgggggcttctaagggggggactggaaaatccgtcccattaaaaacaggcaacgtttatatcgggggccagggatatttacaaagcaaaactagaccattttcaactaaaccaatctttatttgctaggcccaccccaaatcgtctcgaaagggaggggggccccaaaaaacacttgcttcgaaaacccgtctatgtatgccccccacccaaaagaaaaacccttggaaagctctaaaaaaaaggcccccctttgggttgttcggca

SEQ ID NO: 52033 - DNA, 484 bp, Triticum aestivum
  Clone ID: PAT_TA_52033
ggcaagaccaggacccctttggaaagcatttcccatgctacctttggacattttacactggaaacgattttacttacaagctacgatcttttttacaagcaacaaaccccaaaaatcgggggggagctgcatttaccgggggaaaaaaacaaaaaaccgaaggaaaatgaaaatttgacgaaaaaaccccgggacagggaaacaacacgacactcgaggggcaaaatataccccccccgcccctcggggcaaggggaacacaatcaggagctctgcccaacaaagcacctgatgggaaaaacaaaacacctcggctggtttttgcatttttggtcgggctacttttgggcggcgctgatggacccctccttgggcaacttcagggtgagggtgctgaacctttgcctcgagaactgccgggaccccttcctccaatccgtccccgccttaataattgccgaaaactcggggaagcttatcttcc

SEQ ID NO: 52034 - DNA, 532 bp, Triticum aestivum
  Clone ID: PAT_TA_52034
cccaaaaaaacccccaaatcatggttggtttttaaaagggaccagccccatgaggacccgggaacatccccaaaccaactccaaacaaaaaaatccccccccaatttccatgggccaaggctaattttgggaaaaaagcccccaactccaggtgccaaaaactgaattaaaaagggggggaactgggggacggccttgggcccctcgaaaacggggtgcttggaaagccccccgggaaggacaaggcgaacggaggtttgaatcccccggggggggagggggggcttttttttgaaacgggcaaatttgggggcccccccgggaagcttttaaaaaatttctttaaaaaaggagttaataagggacatggccttggagaaaaacccaatttcgggggccccctgtttgacccccttaaaaaagaaaatcttggagggcccaaccctttttttgccctttttccggccccttttttggccccccccctttttgaagggggttttgccccccggaaaccgttttttggccttgg

SEQ ID NO: 52035 - DNA, 312 bp, Triticum aestivum
  Clone ID: PAT_TA_52035
ggggggccacaaacgaccataggttcattttttgggcccttgggaaaaccccatttgcgggaaattaccctccctaacccccaaagttttgccctgaaccttcgcccctttaaagggggaaacctcctttgggttttgggcctgaaaggttttccccccctttccccccccaaaaaggcccttggttttggggggggggaaaaaaaaaaatagcccccttttctttcaatggggccccttccccggctgggggggctaaaaaaaaaaaaaaaaaaagggttggggtcaaaaccttttttaaactttttccca

SEQ ID NO: 52036 - DNA, 586 bp, Triticum aestivum
  Clone ID: PAT_TA_52036
aacagtcaccatagctattatatatgaactcacgaactgtaacaacaaaagggcctttccaatctccagcaacatatgcatcacacccaatgcatcagtacaaaaaggataccaagggcctggagactctatatgggcacagcatctattcaaatattcacatttctttataccaaaagcagacaatacgcaacaaaaccagcatatccgacagtaacatgcaaagcagaactacggcataaagctatcatagccttcaaacagcctagtgtcttggacccatgctacaagaacgggatagacgcactggtgctggcgctccttttcctgcaaaccctgcattgtatagcttcctgcaccctgggcaacgtgcatttgcctcgaggatccttttgtggcaaaagagacacagatggaacccgcaagggcaggggaggaagctcgagtctgttgggtcaagatcctcgtagcatatcgggcaagataatggcataaagaggatacttctgatgtgctgcactcatacccatcccccagcagttgccaatcctcgctgggaagctcgactgcttggagatactgggta

SEQ ID NO: 52037 - DNA, 382 bp, Triticum aestivum
  Clone ID: PAT_TA_52037
gaacggaatcaagaacccttgggggggccccgggcccagaaacaaggaatgggtgggttacggacaatccccaaagggggggggggggtttttaaccggggggggccccggggggggagccccgggggaattgcccgcccggggcccaatatttggagcgcatggtgtcccgcttgggccaagggaagggggcccgctcgggggggtaaagctgccgggttattcaacgggcggggcccgggggggaagaaaaagggctggctttccccccctttgggacccaagggtgggggggtttaccccggggggggaacaaaaagggggcccccccccaatggaggggggccttggccttttgggggggccaataggtggcggccca

SEQ ID NO: 52038 - DNA, 509 bp, Triticum aestivum
  Clone ID: PAT_TA_52038
gaaaaaaaaaacccccggggaaagggtttgtttttttaaaaaaggtttgaggccggtttttttttccaaggccccaaggggtttggctaaaaaagggcccccaaaaaaattaaagttgaaaaaggggaaggggtgttatggcccggggcctttttgctttgggaaaaacaaaatcaggttttccaaacaaaccttttttgggggaaggaacaaaccccgccccctttagggggaacaaagttccaagcttttcccttagcttccccactcccttttggacaaggggtttaaaaagggacaggcggccccccttttttgacgggttaaaaaatggctttttaaaaagcgagggtttcacctggcaggggattttaaattttggggaatccccttggggcggttagcccaaaccccccattaattttttttgccacaaccccgggaccaaaatgaaaaaaccccgccttttgggctaaaacccaaaacccccaaataaaaccccccccccc

SEQ ID NO: 52039 - DNA, 591 bp, Triticum aestivum
  Clone ID: PAT_TA_52039
tatctctctctcctttcccccttccctttctcttctccactcgttgccgccgtccaatctccggcgagatcccctccccgacggcagccatggcttccaccttcagcggcaactagaccgcccacttcttcggcttcctaggcgccgccgtcggcctcgtcttctcctgcatgggcgcggggtacggcacggccaacagcacggtgggggtggcgtcgatgggggtgatgcgggcggagctggtgatgaagttcatcgtgcccgtcatcatggccggggtgctcggcatataccgcctcatcatcggcgtcatcatctccaccgggatcaaccccaaggccaaaccctacttcctattctacggctactcgcacctctactccggcctctcctgcggcctcgcgtggctcgccgccgggatggccatcggcatcgtcagcgacgccggcgtcaaggccaacgcacaggagaccaagctgttcgtcagcatgatcctcatcctgatctttgccgaaactcttgccctgtacggtctcatggtcggcatcatcctctgcttgagtgccggccaatgccgcgccgactagaaac

SEQ ID NO: 52040 - DNA, 654 bp, Triticum aestivum
  unsure (1)..(654): unsure at all n locations
  Clone ID: PAT_TA_52040
ccaccccgtcctcctcgtccccctcctcgtccttcaccctccccaccaagccctccccgggcgcaggctccctctccttctccaggcgtccgcggggaggttcaggatggcggcggtgagggcgcaggcggaggcggtggacacgtccatcagcccgcgggtgagcgcgctgcggccgtccaagaccatggccatcaccgacatggccagcgcgctgcggcaggccggggtgcccgtcatcggactcgccgctggggagcccgacttcgacacgccggcggtgatcgcggaggctgggataaatgcaatcagggatgggtctacaaggtacacacctaatgcagggactatggagctgaggaaagccatctgcaacaagcttcaggaggagaatggtctaacctacagcccagatcaggtgctagtgagcaatggagctaagcagtgcattacacaagctgttcttgctgtctgctcacctggtgatgaggtaaagttatcatctctgcacactgcaatttgttaggagaaatatatttcataaagtgccataccatgaaaatagcagcaccaagtgcttatcctgcagtcatttntgtcgttcccagcccataaaagttagcggattgcttcattctttntttgttaaaccgc

SEQ ID NO: 52041 - DNA, 418 bp, Triticum aestivum
  Clone ID: PAT_TA_52041
actataggcctgtctagaactgcaactctataagactatgcactagcgctctctagagccaacacatatatctttagattaatgacatagacacatacattaccattaggcgatatataacatagtgctgccactactcacccctagataaaagacccatgagtcttgcaaggtcaacaaatgcacaaaaaaacgcctgttagtaaaaactctcaagccgagccaacaggtggagcatcgtttcctccaggtttcgcaaaaaaatccgggggccttcacatcccatgcagccgttcaaaacggcccaagcgctcgagaatcttcatctatatgttggtgtcccctgacagtatgatcatttgacaccacctcgtcagcagctgcgaacttcactccacatgcaatgtgtgtcaactga

SEQ ID NO: 52042 - DNA, 643 bp, Triticum aestivum
  unsure (1)..(643): unsure at all n locations
  Clone ID: PAT_TA_52042
cggccgcgtggggtcataagnagggactacgaaggctcggctcgcccctgcgtcgccctcctctggcggcgacacgggnggaaatcctactccgccgccgccgccccttcccccttcccatcacctcgtcgccaccagaggatccgccggcgaagcccgcaccggttctggggaaggtggcggcagggcgcttcctccctcgtgtggtgaccctgtgcggtcggtggctgcggcaggggggctgctccatggcgtcgatccgcgcgacgtcggccgtttcctagcgcagggcgtccagcgtaggtggcgcggtggtggtttctctgtcgcgtggtgggtggtggccggtggatcctggtcggtgggctccagatctggcgcggcaacggcgctggttgcgggcggctgtgcggtggcctcgcagatgcttgtggctgggcctaccggcggaggtgcgggctggtgctccggtgcccacggtcacggccaccggcgtctacctcctttgccggcagcaggtgacggctctcctcctcgcagcacgtcccaagccggcggctttgcttcctcccctccgatggcgctgctccggcggtctcctaggggttcagactggccgagagaaatccgtgcgcggcagcag

SEQ ID NO: 52043 - DNA, 575 bp, Triticum aestivum
  Clone ID: PAT_TA_52043
cggccgcgtgggtttctcttctttgggatgatgatatcatggctctcttaaatgcctcagatgacgatttcagttcaaatcttttgggcccagttgacggctctaattctcaacttccagcagcatcgaactttgaccagaaggatgaagcaaaggctcaatatggcgcgtcttcgtctggttcccatgagaacctttatccagacaccatggttccagatgtgccagtggatgacaatgctggcaaaagatacttcacaaacatgctgggttcatacccagccccacctgcaatggcttcggaattcccgccaaccacaggaaaatccatcgccgcgctcagcgggcctagtcagattcgtgtcacagcgggcatcgtccagctcggtgaccacgccgataactcggaccactggcccctgcagaagaatggagtcttcaatctgctcctttctttcacggtggagagcaacgtgtctacgaagtccattacttttgacgacgagccagccaccccacgggtgagcaccgtgccgacggtgctgcgcggcggcctgtacctcttctttgtctcg

SEQ ID NO: 52044 - DNA, 606 bp, Triticum aestivum
  unsure (1)..(606): unsure at all n locations
  Clone ID: PAT_TA_52044
gggagatgttctctctttcctcctcctgcttggactgaagggagctccctcatctctcatcagcttcatcaggaatatgaacagaccgtcaacaataatccagattctggtactacttccccacgcgtgaattttattttccaaacattcagctaagatcgctgttctaatggccgagcctttttcttgtgctggctttgatgatcaattcagaggctttgctaatcatgcatgcatgggctgttaattaaatcataatttctcaccagcatattgcaagggttgtcttagggcttaattaggtcatcatcgtgcgccttacctagctctttagaatacacaggctacggtgtgtagaaaatatgcatagctagggtcataggcttttcattaaagtcaacacagaaccttaaattatcctccaacanagcaagcacaaagatactttggaacttgtcatgcctnccggctttgtgatcttcaccatcattttataattctcctacttgcatatctaggtgtgtccctggttgcaggaaagttacctaaataatcatactcactagttattactaatgcctaagttttttgtttgaaatttataca

SEQ ID NO: 52045 - DNA, 349 bp, Triticum aestivum
  Clone ID: PAT_TA_52045
ccacaaacaaaaaaggccttctgctttggaagacatgcttcaaacctttgaggccaccccagggtccaagaaaaaaaaaagtttgctctttattccaggaaaaagggtaaatttccctagggctaattagccccctgttttccatcatagggcccctccaatcaaaatcgccctacttggtttttaacccaaaatcccatgaaaccgggttttcacaagctgatcttttttgacagaggggccccagttgtttgtaattttgggcctttgtaatctggacttcaaatcccaaatgcttactgcagggataatttgatccgggatgtgatggccttttaagcggcttttt

SEQ ID NO: 52046 - DNA, 495 bp, Triticum aestivum
  Clone ID: PAT_TA_52046
aacgccccaaggggctcatcgccgtttattaccccaaacaaaaaatacaacaggggctaggtccaacgagtaaatccagggagctttgcgttgcccaacataaaataaaattccagagggggggcggggaaatccctatgaccccaaaccacattatgttcctccgccggggagcatgaacacaaaagtaaaaccacagggttggccaaacaagtctttaaaaaaaaatgaaccctttaaaacaaaatacaatgatggaccgtatgctccttgcttgcaagccctttgtttctagtcggcccggaattggccggcccccaaggaaaggataatccccacaataaggccgaacagggcaaaagcttcggcaaaaatgaggatgaggatcatgccgacaaacagtttgggctgctgtgcgttggccctaaccccggcgtccccaacaatgccaatggccatgccgggggcaacccccgcaaggcccaaggcaaggcc

SEQ ID NO: 52047 - DNA, 522 bp, Triticum aestivum
  Clone ID: PAT_TA_52047
aggggggcgaagcaacaaattattttcatttctgccccgcggggaaagacaattcccttcccccaaaggaaaaggttgaaacaaagcaaatcgctcgcaagttcacaaccaaaaaaagggggaactatttgggggacaacaagggcatgttttcctattttcccaaggggcatgctttaaaaaaaaggcgggggaaaaagccctcaacacccttttttttattgaaccccgggaggggccttgaacaaaaccattgggttttttattttctccatcccaaattggagcgttgacagggcaccaccgtaggaaaaacaaatgcccttggcatccccaaatgcatttccagggacaagcgcgacctgggctttttttaacaggaacatgcaaaggggctcaaagcccttgatagggccaaaaccccctacctcggatccctaataggagctgaagtccaggaacaaataaaaagcaccccgggggtctgatatttttacccctggcagttccctgaaacttttt

SEQ ID NO: 52048 - DNA, 493 bp, Triticum aestivum
  Clone ID: PAT_TA_52048
ctcatgaacaatcaggggatcgctcgccctcttttttattggggaaatagatccgttgacacacatggcatgtggggggaaaatcggagcatgctgacgaggtggggtcaaatgacataccgtcaggggacatgaacatatcaaagaagaggctcgagcgcttggcccgttccgaacgccacatgggggggaaacgctccggattgtttccaaaaccagaaggaacccctgctccacctgaaggctcgggttgagagaaattactaaccggcccccctttgtgcataaatttgccctgcaagaaaccaactgtcttctggcttgagaatagcagcttatttgttctcttcataattcgcccaatgggtgctgcttttttttctggctctggttccattcccatgattttttccctcaaccccgatgcctccccttcttctcttattttagcctccatggcttccttgaaggatgcttgcaagactgccttccc

SEQ ID NO: 52049 - DNA, 530 bp, Triticum aestivum
  Clone ID: PAT_TA_52049
tcgcgtctataactgtccccgatgactggcgtgcctgttgtggacgaaacctggtcctgtgtcatcgatgagtgccattatgttgcatctgctaccgggttcggcttcccttggccacatgaggaggccttttggtgggcgggcggtgcatttgatatactcctgatagccgttctggcgcctgatcccacagtttgtttcattcctgctcccgctgatcctggtatacaagtttcggctgttgttcagtttgtggctgttgctgcttctgtttcttgcccgaatcttcgcggcatcggcgatcatcatctgtggtcgcttgtcctatggcctttggtctgtgctttcctctcttctatgtgtctcccgatcgcttctccttcggtcaaaatgtgtttgtggaacatgttcttgagattgttgcacctctctgattcgctggcgagctcagactgctctttttcgttgcgcgctcgttgctctcgccactctttgcctacgtcatacttgttatctcgctctgcttcctg

SEQ ID NO: 52050 - DNA, 469 bp, Triticum aestivum
  Clone ID: PAT_TA_52050
ggggaattcggccccccccggcggggggggggcccccggaatttcgggccgggccctggggggggacccattttccctttagggggggggtttaaaggttgggggaaaaaagggcaaaaggggttcccgggggaaaatggtttcccgtcaaaattccacaaaaaaaaaaaaccgggaacataaaagggaaaacccgggggggccaaagggggggccaacccacattaattggggggggcccactggccccttttcaagggggaaaaccggggggcccgcttgtttaaaaaaatggcccaccccccgggggaggggggtttggtttttggcccccaggggggttttttttttacccagggaaaggggaaaaagttgttggcccttcccccctggcccctaaaaaagtaaaaaagggggcccccctgttttccccaaagggaaaaaactttttggaggggggtaaacgggg

SEQ ID NO: 52051 - DNA, 610 bp, Triticum aestivum
  Clone ID: PAT_TA_52051
cggtagattagctagattttatgtgacctcagattttcttttcaaggatacatcatgggagaggtgcatcaatagcatagaagaagagccaagcggtcacaactcgcctagtcgaacctctagccacaatggcaaggaggaaagactcacagatcaagggccgcgtctggaccaacaccagaaacctagaagcacaacaccaactacatcacaggctaggtcaacgcactctccacccttcacgcctaggagtcggtgagtgaacagcgggaaccagctggttccgaagaaggtgtcaaagctggtgctggcgtacattgcgccccaagaacccatgctcacagcagccaccatcaccaacggcacaatgccccaatcctcgacgaagcatcgacgaagccaccacctccagcaacaattctggtggcctccatggcaccccggcagcacctccaagtaagacgcgacgccactgcgccgctgctgcctagctagtgagccagcctaaagattcccctggtgcccgggaagggcacggacatgaccaagacgacgcctccaaggaggagacgcacccgcaggcgtcgtcgtcgtctgcaacgggctgctg

SEQ ID NO: 52052 - DNA, 393 bp, Triticum aestivum
  Clone ID: PAT_TA_52052
cccgcccaagaaaattctttaaaaaaaaaaaaaaaactttgggcccccgcatacaaaaagggggccccttttggggcccgtataaccaggcaagaaatatagtttttcaaccgggttcccatcccctattggtccccaaaaaatttccaggggttagggggggaccaggccaaaaaccaacaatgttaaaaaaaaaaggggggaaaaaaaaaaggcttaggggaacaaatttttttccaggaaagggttggttgttttggggcccccccatttttggacccgggttgaaactagccccccctttgggttccaaattggtctccacactttgacgagcaaaattaatggttgaagggcaaccccgaaaagaatgccagcccaaatccccccaac

SEQ ID NO: 52053 - DNA, 574 bp, Triticum aestivum
  Clone ID: PAT_TA_52053
caaaacatatggcactagttaattacgggggcaccccctgcgatgcctgaacattttggtctttaacattagacccttgatggggggaggaaacccccggggaaggggccggcttgaggggtttttcaaaaggtgaagcccaaccccccttgttgttgtcttgggggggcttttccaaacccccggggcttgaggggagcataagggctagctagcttgatctttcttttaaagggtttctttttttccaggcccccttcaccacaccagcttgtgaaaaggttttttttgccctgaatttgcagatccccaaacatgttttgtagggtaagttcctccccctccctttgttaaacctgcaatatgttgatggtgaaaaatgttgctagtcgaaatgctaagtgcatccgggtgtccgatattttggtggccactaacatgcttgcagggatctaattttctttttaagaaaattagaacaagatatgtgctgggggttgtttagaaaaaaataataaccacattgttgctcttgtttaaatttcaaacaaaaacttaggcattagtaataact

SEQ ID NO: 52054 - DNA, 217 bp, Triticum aestivum
  Clone ID: PAT_TA_52054
aaaggctaaacggaacaggctaattttaaaacttgcataagtccatggatcccccccgggtgccaccgaaccaaatgaaaaaatgcgatttgcatcctacggtcctacttttaccccatcccaaaaagtttggatgccccccccctttcccttccttccttggttcgttctcacggttcgaaagccgaaaccagacacatttaaaacggccaacggg

SEQ ID NO: 52055 - DNA, 316 bp, Triticum aestivum
  Clone ID: PAT_TA_52055
gccacacgtaccactctaaagaaccatccaaaagcacctcttaaactaccttttgaagtacgttattgttggcgatgtcattggcgctgccagtaacactagcagtgacatgaccaaagtgatcatagacctgaacatgatacaaggaaacgcatgaaacgaccatatgaaacacgataacaataggcggcgaagatatacgagatggaagacgagatgtaggtgagggctatcttgaaaggaatcacgagcatagtgacaaacatcatgacaggatgccaaatatggtgcagaagatggctgtgtacagggattt

SEQ ID NO: 52056 - DNA, 663 bp, Triticum aestivum
  Clone ID: PAT_TA_52056
cggacgcgtgggcggacgcgtgggccaacccagaccagaagcgccctctctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgccggtggtgtcataaggagc

SEQ ID NO: 52057 - DNA, 601 bp, Triticum aestivum
  Clone ID: PAT_TA_52057
ctcaacacgtcgagtctcgtgaaactactaccatggagtcacttcaggttagggtatcggacttggtcgagtccaatgggaacggttccggaatgattccccgggagcaatcgctaggtctaagcagtcgcccggaggtacgggtgataaaaacgactccagagaatcccatgcctaatttgaacaccaaaaatgaatctgaagacggtgtcaaatattgtctcctggaaaccgctgacggcgaggaaacggtggagcctccagcggaagcaaggagatgatggaccagaccagtttttgtacgggtgatgaagcgaaggcactgaacttgtggttttctcataggtaatagctctctttgtacagcacatctggagactgaagtactgaaacctggaggcacacaatctgtggatatgacgattacaccgcatcgcgcgagctgagatttgcagctcgcaaattgaaaccgggcaggccaatttgggcagattgagatttatagccgtgatttgaattctcggcgggcatttagaaattgaagtatcaacatttcagaatccctgaaaagcattattggcagggtgaatttgtgcaagca

SEQ ID NO: 52058 - DNA, 594 bp, Triticum aestivum
  Clone ID: PAT_TA_52058
gggaccagggctgacatgaaacctgttcttccaatcgatttcttgtgctgaatctagttgtatttgcttctgaccatggaaaccgcacttcctagtttgtatttgcttctgaggtgcagcgatggagtaagcagatctgtatttatatgaatgaataaccatcatgtttggatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaaagaaccaaattttactaccccgggcttgcaaggtaaaagtttttttttggggcccccaaaattaatttcccggcccgggttttaaaaacgtgggaatgggaaaaaccttggggtacccaaattaaatggctttgaaaaaaatccccttttcccaagtggggtaaaaaccaaaaagccccgacccaatcccctttccaaaaatttccccaccctaaatggaaaagggaacccccccttaacgggccattaaaccccgggggggggggggtttaccc

SEQ ID NO: 52059 - DNA, 142 bp, Triticum aestivum
  unsure (1)..(142): unsure at all n locations
  Clone ID: PAT_TA_52059
gcgttcggnagcgatcgattaccctatcttagtagaatggagtagccttaatggnaaattatatatatggatcaccaaataattgatcttatggtgtattattattgtatgccaataaacaataagacaaagagctgtggtt

SEQ ID NO: 52060 - DNA, 401 bp, Triticum aestivum
  Clone ID: PAT_TA_52060
ggcatcgctgtggctgtacaggcagatcctggacgccatcgaggccaacgactacaacaacttcaccaagcgcgcgtacgtgggcaaggcaaagaagttcctgtctctaccggccgcgtacgcgagggcggctctctcgccatgagcaaagcaatcccgtagatcagatgttttttcttcttctttttctttctttttgtcctgtcaccctacaatgatttttgttggctgttgtatatactcagctatatgtttgccatacgcccgccgcggtatttaggtcaagggaccgacgtcgggccccgctgtactgaagtctgaaacacttgttgttaccacacagtggagaatcaaaattgctccagttgaatgaagaagaaacaaacactctttcttcctaa

SEQ ID NO: 52061 - DNA, 245 bp, Triticum aestivum
  Clone ID: PAT_TA_52061
ggggggggggagccaaacaaattaagggggggtttaaccccaaaaataaaacccggggcaaaggccccaaaagggcaaggttttttggccccagccggcccccccaaaggaaattttggggttttaaacaagacatttttccggtttaaaattttaaaaaaagggaccccctttttttggcccccccaggtccttttttaattggggggtttcacacaggcccccccggtccattggttctttgg

SEQ ID NO: 52062 - DNA, 468 bp, Triticum aestivum
  Clone ID: PAT_TA_52062
caccacccatttttttagggagacattatttgggcatttacagggacttaacaccataatttaaacacaatacaacagttatttttcttttgatacaacgggggggcaaaagaagggaacctttacttaaatggttccaaaaatgggctgggggggaaaaagggcctcaaaaaatgataactggggggacaaaaagaggaaaattataggtctggactttttaaaagctttcaacccttaaaaacctttccctgggcttttggttttccattttattcatccaatttgaaatttgggaaaagccttttcaaataaattgttccaggaccaccaattcaggttaaggagtttttaccacgagataccacttggtttggtggcacattgaaaactgaaatttttctgtggttcaagggaaaccttttttttaattttgggcacctttgggaattttggaacagggttttt

SEQ ID NO: 52063 - DNA, 457 bp, Triticum aestivum
  unsure (1)..(457): unsure at all n locations
  Clone ID: PAT_TA_52063
cccgcgnatctaggggggggcaggggggaggaggggngncaccncnaacacacaagttgatcattgatctttancctttttctttncccccctccaccataatccacctttttcatatcctantnnttttttttttaacccctacttcattatcttctttatttgcttcatcacccttncttncttacanaactctcccttnaatctctactttatcatcatttcntntnacatcaccaaacttaaccttttcatatcttattnttcccctcctttcctttcttttatcncctcttctttaaaatntactacccatcaaccccattttcataatatttcctttttacttttacnaccctacttnnaaaacattctcacctttccttccttttcctcaccattatctttcntctcccttatattttttttnatattacttctttccccatcctctctt

SEQ ID NO: 52064 - DNA, 474 bp, Triticum aestivum
  Clone ID: PAT_TA_52064
aaaaacaacaggtttcccggggtaaaaggcaggggacaaaacccgggcaagggggccggccgaaaattacaggcggggcttgccccccaaaaagagggacaggggcatttaaccaagccgtttttggccatgaccgggaactaaaagaccccggggcaagaaccccaaggggcaagcccccccccccgggggggggggggggccctcaaaaaaaaggggtaaaaaaaaggttaaccccggcccaaaccaccacaaaaacgggggggggggggcccccattggacaggccaaaacagccccagcaaccaaaaaaaaaaacccccgacaaaaacagggaaaacgggcaggcaaacacctgggggttatttctcttccccttaaaaaggaaccccctttgaaatttttccctttttgccattctccttgggaaccccccaatttttttccccgccttaatgggaaaacaggcggggg

SEQ ID NO: 52065 - DNA, 491 bp, Triticum aestivum
  Clone ID: PAT_TA_52065
aagcaaagaaaaagggttctccttccatagacgggttacatataacggggtacaaaaaacaggggcctttatagcagggggggtcttatagcagcgttcttagggcgggggggggggttaacatatcacacaagggagccttggtgccggagcttgggtcgtttatttccaccacggggtggccccgggcctgaaatcggtctccacccacgggacaaaaaccaccttgccggcgtaaacgtccgggggaaccaaggccaacgacaaaggggcaggcccacggacaaccttgccctgggtggtggaccgggaaccatgggaggggcaaaggaacttgttttcgggggggttccacgggacgacccatccaaaatgggggcacacggggttgatcccctagggggggagggtcttggcggactcaaccacaagggggggaggatcacccttgaacccctgggcaaacgtgcggtccttggggccctgccttt

SEQ ID NO: 52066 - DNA, 511 bp, Triticum aestivum
  Clone ID: PAT_TA_52066
aatcagggtcaacagtagaggtacacacgttgtcggggtacttgtccgtccggtcttggtgtagtgtacatggcaaacataatggtactaagcgccggtcgtcgagggacttgccaaaatccatagagccggtgtgtttgttcgggcgccggtcttgccggtgggttacttgacgaatctccaaaatcttcgtggatcatccttggacttggcggtgttagtctcctcgggccaacagtgatgtgcaagggccagaacgaccgacagcttgggtggctcctcaaggccatggagacgacaggcagtaggaggctgctagtgcaggcagggccaccgcgaggacccgaaggggtttagaaggaggtgctcgcgagaggagcctcgcgatggtgcagaggtcgctgatggagaagattgtcaaggaacgggtggagaaggatcggcctgggcgtgatgcggtagcggggagcttcgcagagccagccatccatggcggtccaaggtcgccgag

SEQ ID NO: 52067 - DNA, 374 bp, Triticum aestivum
  Clone ID: PAT_TA_52067
aaataaacgtctggaatatcaatcgcatatcaaccacgtgtgtccctggaaaaatatttggcgcgtttgtactacatacatcccaaccgtgtaagtccccgtaggctgagcacatacttgggtgtctcgggctccaatgagaccatgtaacaccagggccaccttcactctgcggcgtccaaaacaaattagcacgtacgctcaagtgctaggggtgctgcactcgctcatctcggggatgtccttgcagtacttctccaacagtgtcggagttcttgatcttgtcccgggcgaggctggaggcggcgctgatctgctccaactcgtaccacgccgacgatcacttcccgctggcggagttccacgcatccgac

SEQ ID NO: 52068 - DNA, 339 bp, Triticum aestivum
  Clone ID: PAT_TA_52068
aaccgaatagagctggattaatttataaaacccggggggcccaggggacaaaggacaaaaaacccccggctttggtcaaagggggggaacgaacaatcaaacgcgggtacaaaatagatacaacaggggccgggtttgcaaagcgggctcgacgaacgtaccccgggctttcacagggggatcatatcagagcatttattcaggggtagggggaaaaaaaaaaaaaaaaaaaggggggggggggaccccaacggactcgggatttatggggggggctataatcggggaagagggggggaaggaatcgaccaggggatcttaaaacaacccggcacccgg

SEQ ID NO: 52069 - DNA, 409 bp, Triticum aestivum
  Clone ID: PAT_TA_52069
acggggcccaaaaaaccaccctttttcaggttccaaaataggaagttttttggtacagggtttcctacaaacccaaaaaccatttggggggggaaaatactttggcttgggggtgggctaccttcacagggggggggtttttttattacaaaaaccggccttcaaacaaaaaccccgccccggggtacacctaaattttttttttaccggggaaagggctggggttttaaacaaagaggaaccccccccccaagaggccccccagggggaaccccccaataaaaaaccccggcttttcccccggggtgggggcaccaaaattaaaacatttcttttggggggaaaatggggtggaacccccaacctttggcccccactttttaaagaaaagggacaccccctttttggc

SEQ ID NO: 52070 - DNA, 214 bp, Triticum aestivum
  Clone ID: PAT_TA_52070
catctgggaaagaactcaagatagaatcatacttaagggcttggtgacatattatcaacagggaagttacattgccggcttccaaatttgaacaaacataaaaggcctgaaagcagcacggcccttatggggatccatctagcctagcttggggaggacatcgccgaaaacagtcttgggctccccgtaatacttttcggcctcgggggggctc

SEQ ID NO: 52071 - DNA, 400 bp, Triticum aestivum
  Clone ID: PAT_TA_52071
aaaaaaaaaaaagtttgtttttttttaattcaacgggggcaattttgattctccactgggggggaacaacaagggtttcaaactttaaaacaagggggccccacgtcggccccttgacctaaaaacccgggggggggtttgggaaaaattttgctgggtttttacaacacccaacaaaaattattgggggggggccgggccaaaagaaagaaaaagaaaaaaaaaaaacctttgttctacgggattgcttttctcatggggaaaaaaccccccttccgtacccggccggaaaaaacaaaaactttttttccttgcccacatacccccccttgggaaaattgttgtaatccttggccccaaaggggtccaaaaattgcctttacaaccacaaaaattcccc

SEQ ID NO: 52072 - DNA, 328 bp, Triticum aestivum
  unsure (1)..(328): unsure at all n locations
  Clone ID: PAT_TA_52072
ggngcctatcacaattggagttacttctggtgcctcactccaacaaggttgtcgaggatacgctacacaaggtgtttgacatcaagcgtcaagaagttttgcaggttgcatagattttcagcaaaatggtcaggggataataatagctgatggcctggcaaaggttagtagaaccgttgaacaacctatcgttgtacagtagctaagaatgtaatgctttagcacatacttctacaagaatatctgtgctgggatacatatatatgttgtaatcacttgtaccacgaacagttgtacacttgtattctgctataaccctttgcccttg

SEQ ID NO: 52073 - DNA, 532 bp, Triticum aestivum
  unsure (1)..(532): unsure at all n locations
  Clone ID: PAT_TA_52073
cccagcgtccngacttcttctccttgaaactttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactcct

SEQ ID NO: 52074 - DNA, 560 bp, Triticum aestivum
  Clone ID: PAT_TA_52074
gcacgcacacgacacgcataagaggaggagagagagagactgcgtccgtctactagggctggaagctattacgactgggtccagctctgagtgcgtggacgaccactggtcggggctggccatgtcggtgtcggaccaggaggcgcccggtcgatgcgatcccttcggacgccggggaggcatgggcaatgcaaacgagggcaaggccatcttcacgcccgtggaggtggaggagcgcaacatcatctgacgcaagctcttgaaccaggtgacgagcatggccatacggctgcactcccaccagatcaccgacttctgcaagaccatggactctgaccccaagaacaggcagggctagatcctcctcgccaacaacaacggaaagaagctctgattccttgtttgacccaactaacaatacaaccttgcttctcctaccttatctactagaaaaaaggaaattccttgtagtaggagattgactgcctgcatggatgtatactagacttatatattgcatgcatgcttgtattatactatctcgtagagacagcactgag

SEQ ID NO: 52075 - DNA, 559 bp, Triticum aestivum
  Clone ID: PAT_TA_52075
atcaaaaagtctcggcgcctatgcccaacagccacccgggaggagctcctcgactccggcatgccggatacactcggggcgtcatctgatcagagaggaagattgatgatgacatcagaaaggttaaaccagtcttccgacagaattagagaaagccagataacagcacttgatacagaagaaattggcgtgtcgattcttcagaaccttcataatcaacgagagacactgatgcatgctcacaaaacattgcatggtgtggatgactccatcggcaaaagcaacaagatcctggcgtccatgtccaagtggaacaagtggtttgtctaggttgaattcgtgttatagaaagctaggaagtaggaatgtattggatgacgatttaaacgatgttagcaaccacgagaggcagccgagacaaatgataataatactaagcctccttagattcatgggaataggaaaaacatagaaagtgagatgatgtgtatatatattcctatagaaaaagagatgtcatttgttgcatattattgaaaattttccatttgggcgtaat

SEQ ID NO: 52076 - DNA, 259 bp, Triticum aestivum
  Clone ID: PAT_TA_52076
gggccccaaacataaaagggggggttttacccctttttttctgggattttttggtagataggggacatgggcaatcgggggggcttggggggccaaacaaaatttttggaggggccaacaagccttttggggggccttttcaaggaaagcccctttgcccgggggggcggttaccaaactggtttttaccggagggggggggggggcccccccaatggggttcccaaactcttcgggggatttcgggaatcgctttttt

SEQ ID NO: 52077 - DNA, 279 bp, Triticum aestivum
  Clone ID: PAT_TA_52077
atagcttatttttcttttttttccttttttttcttctttttatgacaacacaccctctggaactttgcttaatcactatttacgccctttggcgtcatagcaaggtttaaccgggggatcgacaagacataggacctgtcctgcactcctgaaatttggggggatcacagcactggcttgcaacttcttaacctgtacaaagcagcctatgcgccgcgtacgttgacaacgagtgaaaacttaactgaagacacccctcgtcgatgaccctaataattg

SEQ ID NO: 52078 - DNA, 635 bp, Triticum aestivum
  Clone ID: PAT_TA_52078
accattaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttgaggagggcctccgtgctgagcggtggcaggtaagacagggtctcgaacttcttgatgccctcgatgggccacacctgcatgcacctg

SEQ ID NO: 52079 - DNA, 473 bp, Triticum aestivum
  Clone ID: PAT_TA_52079
gggggggaaccggcccaacccccggggggggggcccccaaaaataaaaaaaaggggggggggtacaacggtccaaaaaacccaaggaaaaaggggtaaaccccccccccaaaatttaacccctttttaaaaaaaacaaaaggggaaaaaggcccccccaaatctaaaaacggggaaaaagcaaagggttgggaaaaaattcaacaaggtgacccctgaaaaaaaaaaaactgacccggaggggcttttgaaaaacccccccccccccaaaggggaaggcaaccccaatgggtttcctccgggcctggaaaacccccttttcaaaaagggttttaccccccattttttaacaccaaaaaaaaaaagggcgggaatggggaaaacttaaaccccgaaaaagggccggccccaaaaaaattttggagggggattggccacaaccttaaaccaacccccaaaactggtacccaaaaa

SEQ ID NO: 52080 - DNA, 733 bp, Triticum aestivum
  Clone ID: PAT_TA_52080
agtggaaacgtatcagcaacgaacccaacccaatatcgggatgccttgctgacgaatcaaccaacccactaaaaccaatccgcgtcaacagctcaacacccatctcctctccgccgtatctaatcctccaccatccgacgcgcaacaggaaggggaacagccagatcgatccgtgggactcacagtccagcccaatccaggcagccggccggccggatccgacctccgcccgccgccatgagcttcctcttcggcaagcggaagaccccagctgagctgctgcgggaaaacaagcgggtgctagataagtccatcagggagatcgagagggagaggcagggcctgcagactcaggagaagaagctcatcgctgagatcaagaaggtggccaagcaaggacagatgggagctgtaaaagttatggcaaaggaccttattcgcacaaggcatcagatcacgaaattttatgccctgaagtcccagttgcaaggtgtatctctccgtatccagaccctgaaatctacccaagcaatgggggaagccatgaagggcgtcacaaaagccatgtcacagatgaacaggcagatgaatctaccagcactccagaagataatgcgggactttgagatgcaaaacgagaagatggaaatggtcagcgaggttatgggtgatgccatcgacgacgccttggagggggatttaggacggagggagtactaggcttggtctttct

SEQ ID NO: 52081 - DNA, 315 bp, Triticum aestivum
  Clone ID: PAT_TA_52081
acctcaagcggcaacgagtacgcggcgagcggcatggcgcattcaggtttcagagtttgcgtaatttagaacagaatcatcaaacaagtgaagactgaagaacggagcacctgatattggaaaagtccaaccttatgtcaagttcctgatagtaaagtttcaggttgcaaaccgtgctcaaaagatagagagctaaatccaagggtaagccatcacattttgaaaccaatgatcaaactggagccatcgctcaacatttgtaccaatttcacttgccttcagaagatctggtacaacatgaatttgtttttcccg

SEQ ID NO: 52082 - DNA, 491 bp, Triticum aestivum
  Clone ID: PAT_TA_52082
tcctaatcttcccaagccacaggagaacagacaagagcacaacccttggagactttcttcttccatagtaacccaacccacccttcgccaagatgtataaccctccgtcggggcaggagatgtcctacacggaccacgtgcagaagcgccacgaggagaagggctgcatctacgcatgcgtgttcacggcgctgtgctgcttctgctgctacgagacgtgcgagtgctgcctcgactgcctctgctgctgctgcaactagaccaggctgccgtgcccgacatggacggaggccgcaaggcgcagcggagacccaccggcctccaccgtcgcctttcataataagcatatgtgtctagtgccttagctcgatgagaactgtatcagatattgctgtaatactatatgcccaggacaaggctatcactgtaaacatcgattatggtttgtgctgcatcttaatttaattagcatcagattccggttccctggg

SEQ ID NO: 52083 - DNA, 220 bp, Triticum aestivum
  Clone ID: PAT_TA_52083
caccgccgacgctccccagatcccgccgccatgtagacggagaagaagcatgctgagagaacatggcgggatagacatgtggacgagggtcgacggcagcactctccggctcgagagagtcggcgagcgcactgaccgcacgcaacccaactctgactaggagcatactgtagcaggacacagcacaaaaagtcatcccaccgaataccggacacacgac

SEQ ID NO: 52084 - DNA, 495 bp, Triticum aestivum
  Clone ID: PAT_TA_52084
aatccagcaagcaagaagcacacaggaagctcctagccaacaccaatcaaagcctccatccaatcccaagcaacctcgaagatgtcatgctgcggaggaagctgcggctgcggcagcgcctgcaagtgcggcaacggctgcggcggctgcaacatgtacccggaggtcgaggccgccggcgccaccctcctcgtctccgccactgccacccacaaggcgagctccggcgggatggagatggcggcggagaacggcggctgtggctgcacccagtgcaagtgcggcaccagctgcggctgctcctgctgcagctgctagatcattgatcatgcatgcgccgcgtgcatcatatctatgatctatctaccatctactaccatgtaacgctgcctgatcgagggtctttgtatttatgtacgcacctgcctgcatgagcagagcgggtgccatgccatgcatgtaaacccctaaataaaatctcccgtggttttgctc

SEQ ID NO: 52085 - DNA, 578 bp, Triticum aestivum
  Clone ID: PAT_TA_52085
aattcaattcattgtgatcatcatcatcctcgacccaaagctcatcttcttctccttgatctttttgggtttatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcacctgcggcgacaactgcaagtgcaacccctgcaactgctaagctgcatgcgctcgtgtgctggtgagccacgccgacgcgcataaaccgtcggacggcatgctcttatggcggccaccccgggtgccccgccccccccgaggtccccaagcccgaagctcacaactatccggcctgaccccccgccgccccccctgccacccacgtaccccaccgtgaggctacttccctccggaagcgcccaggcccacccatcggtcacgacccccagcccccctaatttgttctttccccccccccccccat

SEQ ID NO: 52086 - DNA, 871 bp, Triticum aestivum
  unsure (1)..(871): unsure at all n locations
  Clone ID: PAT_TA_52086
cactcagccggccatccatcatccctcccactgaataccagcacgataggtgccagccatggcgaggcgccgccactcttcctctggtctcctatgcgccctcttcctcctgatcactgctgccatggcagcggacggtgcaggggcgcgacagcggaaattgcagcaagtgccagggccacagccgctgccactaccaaacccacgcccacaaccaggcccacagcccgtgccactaccgattccgaacccgcagcctgacccaaacccacaacctttgccgaacccagacccaaacccgcagccacaaccattaccgcagccacagccggacccaaacccgcagccacagccattaccgcagcctcttccacaaccactgccggacccaaacccacagccacagcctttaccaccacagcctctgccacaaccactgccgggcccaaacgcgcaaccgctgccattaccgccgcctctgccactatcaccgccgggcccaaacgcgcaaccgatgccattaccgccgcctctgccactaccaccgccgggtccaaacccactgccgctgccgcaacctgatgccccgggctcatatccgcaggtacaaccgttgccagactcaaacacgcccggccgacaaaataacgcactacagggaccacttggaaatggtgcagccccagccttatattcatgcggtgcaacctacgtacatatattcttcatgggtttattgttgtactattttgcttagataaagtgacgcttgttcatgtaaataaatttactatntctctagactccataaaataatgtatcgattgggcatgatctctttgnattacatttatactagnatattatttga

SEQ ID NO: 52087 - DNA, 440 bp, Triticum aestivum
  unsure (1)..(440): unsure at all n locations
  Clone ID: PAT_TA_52087
cgctcaaggcggcgggcgggaaaactatcgnacgatcgaatctcagtcaaatcaaaacaagngagcgagcatggcgtcgtcctctgctgtgagcaagcgcggcgacgcgggcggcgtcctggctgccatctcgcggtcctcggtggcggcgcacggccgcgaggcggcggcggnggcggggaagctgctgcggagcncggggaaggcggcgcggagcgccgggacgaccctccatgcgctggccgtgccgctcatcatcgatatggaccggtagcagcagatgatcgacctctacctccaggagcaggctcttctccgctcgccgccgcccctcgccatataaatccctcctctttcgatcgacctcgacgcctgccgcagctgctgatgaggtcacatatggttctgttactatcatctgcaggcaacaactccatcac

SEQ ID NO: 52088 - DNA, 391 bp, Triticum aestivum
  unsure (1)..(391): unsure at all n locations
  Clone ID: PAT_TA_52088
ccgcttcgaggctgggcggggcnggggaatcacaaaaaaaaaaaaaaaaaaaaaaaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaggacctaaagggcctaaagcgcccaaaaaaagaggataaatggccccaaaatcaatttttttgggcccccgggggcccttaaggggcgtncctccgtacttctaagggccccctctgattttttttggttgcggggggggcaccggaaaacttttttcgcgatctcttggggggccccccctttttttggttttgttggggaattccccacgtttttgggtgcaaaagggtg

SEQ ID NO: 52089 - DNA, 611 bp, Triticum aestivum
  unsure (1)..(611): unsure at all n locations
  Clone ID: PAT_TA_52089
aaggcacacacgcacgctctatagtctgcactgcacacgtgcacacacgggtgcatcgagcatggctgctggcatgaatgctagtgctctgtgcttcgtcctgctagtcgtcatggcggccggcggggcgtcggcgcagctgtcgacggggttctactcgagctcgtgcccgggcgcgctgggcgcggtcgcgtcggtggtgcagtcagccgtggcgaaggagccgcgcatgggcgcgnccgtcccccgcctcttcttccgcgtactgtttcgtccggtcctgcgactgttccctgctccagccgtctcctgcatgttctttacaattcatcacacaatgaccttccgagtgactcatacccttgtcaagaatgccattgtgcaatttgatgcatcccctttcaaacatcgccacctgactcattatgcacttgaaatctttagtaataataaagctgctgcacctgccaagaacgaagctgctgagggactagaggatgatgttgctgctgctgccaccgaccaagcaaagaacagcaaccatgtccacactaatcttgataaccgccaccagggacttacactgtactctcacattgagcaacaattca

SEQ ID NO: 52090 - DNA, 811 bp, Triticum aestivum
  unsure (1)..(811): unsure at all n locations
  Clone ID: PAT_TA_52090
ggcccgcttcgagccggccgggccgggcctgccttgtccccgtcccctctctcctttcccaacccaaaccaggagcgccctccctccctccccacccagggaaacccaccagccatgaagggggccaaatccaagggcgccgccaaggccgacaccaagttggcggtgaagagcaagggggcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccatcgccgcctacaacaagggcgagagtgctgctgctgccgccccaaagaaggcggccaccaaggaggtggaggaggaagatgaggaggaatccgacaagtccaagtcggagatcaatgacgacgatgacgatgagggtagcgatgaggacgaggacgacgacgagtgaagaagacgcatcttgtcaaggctgctggctccggcggacaaaggcgggagcggctgctgcgcgagaaccgacgtgagcttgtgtgcggtggtgtcataaggagcctgtccatctccactagagttatcccaagtttcacttcacaattcgtgatgttgttttaccttttttnttcttgtcgtcgtcccgctgcctgctataacggacagcg

SEQ ID NO: 52091 - DNA, 651 bp, Triticum aestivum
  Clone ID: PAT_TA_52091
tcatctgcattacccccatctcctcctatcctccggcgaaacccagccccagtccaccccaccgtccgcatccatggcgcccaaggccgagaagaagccggcggcgaagaagcccgcggaggaggagcccgcggcggagaaggccgagaagactcccgccgggaagaagcccaaggccgagaagcggctgccggcggggaagtcggccgccaaggagggcggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatccagacctccgtccgcctcgtcctccccggcgagctcgccaagcacgccgtctccgagggcaccaaggctgtcaccaagttcacctcctcttaggctgttcgtcttcctgtgtctcgtagttagctgttcgggtgtgtttgtggccgtgttatcctgtaagaatcgcaccgcgatgtttctgtatctcgagaaatggtaatggtgcctgcctg

SEQ ID NO: 52092 - DNA, 231 bp, Triticum aestivum
  Clone ID: PAT_TA_52092
aatacaaaaaaagatggtgtgatcagagacaacaagtccggcgtggtgcccgacaagccaaccggtgtggcttgcagtcgaggaggaagaataggtgctctgcagggccgtatgttggcatgtgcagcagaagcgactgaacagggcccccaacatcggaggggggcccaaattgtttgttaatcaaggttttaactgaaccactaatactacagtaaataaccattgggc

SEQ ID NO: 52093 - DNA, 588 bp, Triticum aestivum
  Clone ID: PAT_TA_52093
attttccatcgattcctctcaccccgcagctctcacctcctactgttgtctctgccatggcccatggaatcagcaacttgagatcgtagcaatacacagcaggggccgagtcgcgacgccgacgaggcaggccataccgcgggttgagcatgcggtttgactcgggctgcggacgcgactcagcgggacggcgccggcttggtcgtggccaaaactggccaggcgcaaccacgggcgactcacggcgtggggcggctcgacggagcatctcagatggcggcgagttggcgaagacagagcaacggcggagctcagccgctcaacgtgagggttcggcgaggcgacttaaaaaccgcgggttcggctgaagtagtacgaggccgactcgaggatgaaggcagcatcttgaagccaaggcgattcggcgactcggtggtccggggaagactcggaccaggcgagttgtggcgttgaagatgaaatcctcctccgggttgtggttgaccaaacattttttttaaaccgttcccagctagcactttccttgacagtagctagcactttccttggtgtgacgcgtagtagtct

SEQ ID NO: 52094 - DNA, 495 bp, Triticum aestivum
  Clone ID: PAT_TA_52094
tactcagcaagcaagaagcacacaggaagctcctagccaacaccaatcaaagcctccatccaatcccaagcaacctcgaagatgtcttgctgcggaggaagctgcggctgcggcagcgcctgcaagtgcggcaacggctgcggcggctgcaacatgtacccggaggtcgaggccgccggcgccaccctcctcgtctccgccactgccacccacaaggcgagctccggcgggatggagatggcggcggagaacggcggctgtggctgcacccagtgcaagtgcggcaccagctgcggctgctcctgctgcagctgctagatcattgatcatgcatgcgccgcgtgcatcatatctatgatctatctaccatctactaccatgtaacgctgcctgatcgagggtctttgtatttatgtacgcacctgcctgcatgagcagagcgggtgccatgccatgcatgtaaacccctaaataaaatctcccgtggttttgctc

SEQ ID NO: 52095 - DNA, 586 bp, Triticum aestivum
  Clone ID: PAT_TA_52095
aagcaagacccagcctcctcagtcctcacagcatcctctcagtccttagcttccttccctcgccgccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactttgaatg

SEQ ID NO: 52096 - DNA, 725 bp, Triticum aestivum
  unsure (1)..(725): unsure at all n locations
  Clone ID: PAT_TA_52096
ccggctcgagggccggcctgggccccgggaaataaannaannaaaaaaaaaaaaaaaaaaaaaaaaaaaaaaaaaaaaaaaaaaaaaaaaaaaaaaaaaaaaaaaaaaaaaaaaaaaaaaagatcatttaaatcagcgaaaaaaacttttcccagaaaaaaaaattcatactacttctccttgaagtgttttccgggcccacatatttgggaggatgccttcgcacctgaagatgaacgctgcagctgccgaatcaaactgaaagcgggcggaaaatgtaccctcgttgtgacggactcaggccgccccccccgcaccaagtcgcccccgggtatcgtcctcgggcgggggccctcgagaacaaggctggaacatgtgggagagcggccgcacgcgcatccccggggagggtctgcagcatgcatgaaacaactgcaagggaaaccccttggaagtgttaggctgcttgaactcctacctattaatgggatggaggggaaaaaatacgggaataacgggggtttaattggttggactccagcaatggtgcgcgcgtgtgtgctttacttgctcgctctcccactaggccctgcccttgctgcccctgtgtgcatgggtgtgcctgtgcccctgatgttgcttcgtccacctcccctaagtagggagtgctgaataggtacgaatgaaaaatttccctaaaaaactaccccgggccccgcccggcc

SEQ ID NO: 52097 - DNA, 634 bp, Triticum aestivum
  Clone ID: PAT_TA_52097
gtaaatacgtagcaacacaagcttagccatgacgatgaggaagcgcccctcgtcctctcttctcatatcaccgctgctgtttatgcttcttccagcatttgctcttgctgccgggaggcacaacctgatcactagagaccctcagtacggcccacaggtgaacccaaatctagaaccactggcaggaaaacaggcagatccaaaccctcaaccattaccagacccacaaccatttccaggaccacgaccagacccaaaagccgcaaccgctacccgagcctaaagctcatacaaacccacaaacactgcctgagccacgacctgatccatacgctcaaccattaccaggaccgcaccctgacccaaatccactaccattgccaggccaaaacctggaatggttgatgaacccactacctaacccaaactcgcggccactaccatatccacgggcaaacccaaaccctcggccattaccaggaccgcagactgatccaaatccacaacctttaccagacccaaacccgaaaccattgccgaacccacagcctaacccaaaccctcatgcattaccaggaccacagactgatccaaacccacaaccattaccagacccatagccgaatccatcgcc

SEQ ID NO: 52098 - DNA, 526 bp, Triticum aestivum
  unsure (1)..(526): unsure at all n locations
  Clone ID: PAT_TA_52098
ctcgaggcnncggccgggccgtggaaataccaaaaaaaaaaaaaaaaaaaagagaagaacgacagaaaaaaaaaaaaaagagcgcactgcctgtatcttcgtcctagttgatgtctcacagaaaaaaaaagaaaaaaaacatcagagagagcgacagtcggggttgtcttcctcgtaggggtcctcaagacttggaagcgccattgatccttaccaagaactgatctgggcctgtcatgccctagtccgagacgctaccaagaatgctgttgctgccacctacggccaccacactcgtgttcgcgtctcaatgccccgccgagcgagttcggagggttacgtctctacgcgacaacctcaacttatcctctgggaaacaatttccgggttagaggacctgggactgagccacggcgcccgaaaattacaagtgcctcaaggaggaagatatctaccactgccgttgggccatgctctgcgcggaagatgtactggtgccggaaggactgggaatggtcaactgtcc

SEQ ID NO: 52099 - DNA, 569 bp, Triticum aestivum
  Clone ID: PAT_TA_52099
ccccccctcctcccctcccccgtcgccgctccccagatcccgccgccatgtcgacggagaagaagcacctgaaccccatgcgggacatctaggtgcacaattacgccctcaacatctccctcggccagagcggagatcgcctcacccgcgcctccaaggtgctggagcagctgatcggactgccaccgctgcctctccaaggagaggcacactgccaggtcgctcgtgatgaggcgtgctgagaagatcccctgctatgtgactatcaggagtgagaatgatatgcacttgctggagagcggcctgaaggcgcaggagtacgagctgctcaggcggaacttctccgacaccgctggatttggcttcagcatccagttagccattgatcatccgtacgaagtacgacccatttaccgtgatctacggcatggacttctttgtagtgctcaagcgtgctgggcactacgtcacccgccgtctctggtgcaacgtccgcgtccagaacctccagaagtgctccaaagttgatgccctctatggttttcccttcatgtaccttggtgtcttcc

SEQ ID NO: 52100 - DNA, 558 bp, Triticum aestivum
  Clone ID: PAT_TA_52100
tctttgtgatcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactcct

SEQ ID NO: 52101 - DNA, 511 bp, Triticum aestivum
  Clone ID: PAT_TA_52101
atactctccaaagaccagctgcaagagaggttgctattagctattcatgaggcaaatgaagggtttggatttggttaatcagtcattcccgcacttgtgcattcgctgctgggtatttgtacagatagtacgggagttgcaataggcaagtgggaatgtgtgcgtgcttgttccagagtctgctagatcccactatttggcaacatgaagcatcagccttaggcactaccaggaggttctcgatatttgttgggaaatggccgagatctaccagaatcattgcattgcaaacaagttactgcaaagaatgtgcagtgagtgggagtttaaacagacaccaactatttgatgttcataatattgtttttctttatggtcagctttgaccgttgccctgttaaaatgccatcttgtttacattggatttagctggaagatcttttgaagtcttttatagatgtgcggaatagactggtggaatgcagcaataagactagtgcagttttctcat

SEQ ID NO: 52102 - DNA, 748 bp, Triticum aestivum
  Clone ID: PAT_TA_52102
actcaacactcgcctctgctctcctcctcctccgccgccgccgacgccgccacctcggcccagtcaagtccccatcgccgtggaaatgaacacgtcctggcgtcgcaaactagggacagccgggaggaggtgaccgtgctaggtgtcggcacaagatgatctcggagacggcgccgcggaactacgctgcaccgcaacttctagcagctcaaccgcaacttccagctcgtggagggggtgagcgagctcgaggtggactgctggatcggcacccgcgagatcatggccgccatcggcaccgccatctaccacgagaagaaccgcatctgcgtcgacaccaagggcttccgcatacaagatgatcttcgcgtatgcctcacttcgccatcaacgcctccagcaccgccgacatccgctacatcaagatcaagaacattcctcgctcagaagaacgtgaagaaggaggacatgatcgacgcagacgccatcttgcagcccgataaagccaaggatgagatcgtcctcgactgcatagtgatctccagcgtcgtatccagtgccgtcgtactcatcaatgataaatgactcgtcaagaacaaggatatgatgaagctgttgcaagcgatctacgtgagcgacaagttcgccatcagagatgagtatagtgctaaaaccgtcccacaagccgagtttctgcctgccagtgtacagcgtctttgcgtcgatgttgagatgttgaactttctct

SEQ ID NO: 52103 - DNA, 380 bp, Triticum aestivum
  unsure (1)..(380): unsure at all n locations
  Clone ID: PAT_TA_52103
attcccctaaaccattaacgngacaaaaaataaaaaaaaaaaaaaaaaaaaaaaaaaaaaagaaaaaaaaaaaaaaaaaaaaacaaaaaaaaaaaaaaaaaaaacccaaaaaaaaaaaaaaaaaaacaaaaaaaaaaaaaaaaacacccaaaaaaaatttttatagagaacaaaggagccgaaaagaactaccccagaaaccctaaaggaagcccccaaatttaaaatttgccaaaaaaaagccgccccccgtggcccgaggggcggggaataaggcgcacgcccccctctctagggttttggggggggggggggcccccttgcgcttaaccgccccccccggggggccccctgcttcgttttgggggggaaaggggccc

SEQ ID NO: 52104 - DNA, 627 bp, Triticum aestivum
  Clone ID: PAT_TA_52104
attcctcgaatcccagcgctgtcttccagtcctcccacctctctccactctttcgatacctcgtactctgcacctctactgaaaccgagcatgacgaccaagtcctacaaaaagctcgctacgttgaaaaccctggtgaagacatacacgatgctcatgacgaaaagggagcgtccggaaaggattgcgcagcctacatgaagaagaagaatgacgacaaccagcgtcgacatccacgagatctacttcttcaacgcgtgtcgacatccgcaaccccacatcggtgtctcttcctaaggcatgtctatcatgaactccttcatcagcgacatcttctagaaactcgcccgagagtcggactgtctgccgcgctatcacaagaaacccaccatcacctcacgtcagatccacaccggcgggcacctccacctccccgtttagttcgcctagcacgccgtctcccaaggaatacaaggctgcagcaagctctcctcctcgtagattgctgccgtacatccgagtctgctactgatggcatgtcttgattttgctcacgtgtcaagacatattacaggtatgccatattctgctatcaaacagtgctgaatgacattgatttgctcaatc

SEQ ID NO: 52105 - DNA, 808 bp, Triticum aestivum
  Clone ID: PAT_TA_52105
actcaaaaatggctctcggggttggcttctcctccccttccggttcgggttctggttcggttcgggttcggttcgagagagaggccgagtagctagcctagtctagggtttcggtagagaggaagggagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcggtggcggaggctacggcggcggcggtggcggctacggcggccagggcggcggcggctacggccagggcggcggtggcggctacggccagggcggcggtggctacggcggccagcgtggtggcggcggctacggcggcggcggcggtggctacggcggccagcgcggcggcgactccggcggccagtggaggaactgagcggcggggccctccagttatcgatctatctaccatctcgtcgtcttcgtcatcaagttatcttcagtgtcgtcgtcgtcgtgttcctgtgtcagtcagtcttgagtcgtgtgtgtcgttcggtcctgtggtgtttttgatcgcgagctcgagtgtcgctctggtccgggttaa

SEQ ID NO: 52106 - DNA, 209 bp, Triticum aestivum
  Clone ID: PAT_TA_52106
actttgtgtctttttctagtgccaatgtttcaatcattatgtttctgatattttctgtgtcaatgtttcgattattatgtttcagaatggctgagacgttggttgcaaggtcaagaatgggattagtactagtttcaaatcttgtaatctttgtatcgtgtcctttgtaatacaaacaagttgatttaatacatgagaaatttcttttt

SEQ ID NO: 52107 - DNA, 530 bp, Triticum aestivum
  Clone ID: PAT_TA_52107
acatcagcggcagctagaagaaaaaacaggctaagccatggccgtgcacaagagcgttgcaccggcgctcctcgtcctcctaccgttgatgctgctctcctctgccacattggcacgccaagttcctacaggcccgaatcccatacataatgagttcccgccgccggacacgccgttgccaccactgcggccagtgcccccgcctggccacctgccgccggcgggaacgagcacacatgtctctgcggtgccgaggccgatccctcctacaggcaggaaccccgaagataacaactacctgctgccgccatcaccagcgccttcgcaggcttgatggttccgcggcaatatgtgcgccttggatacgacgatcaagtcaacgtttgtgctacttatccctgcactgcaagcgagctgcttctgcggtgtgtaactacatgtttttgtttttgccaaaactgtgtaactatatgtaacggtgcatgcatgtgtatccgtcgagcaataagatggacggtttgatcttgaat

SEQ ID NO: 52108 - DNA, 495 bp, Triticum aestivum
  Clone ID: PAT_TA_52108
aattcagcaagcaagaagcacacaggaagctcctagccaacaccaatcaaagcctccatccaatcccaagcaacctcgaagatgtcttgctgcggaggaagctgcggctgcggcagcgcctgcaagtgcggcaacggctgcggcggctgcaacatgtacccggaggtcgaggccgccggcgccaccctcctcgtctccgccactgccacccacaaggcgagctccggcgggatggagatggcggcggagaacggcggctgtggctgcacccagtgcaagtgcggcaccagctgcggctgctcctgctgcagctgctagatcattgatcatgcatgcgccgcgtgcatcatatctatgatctatctaccatctactaccatgtaacgctgcctgatcgagggtctttgtatttatgtacgcacctgcctgcatgagcagagcgggtgccatgccatgcatgtaaacccctaaataaaatctcccgtggttttgctt

SEQ ID NO: 52109 - DNA, 500 bp, Triticum aestivum
  Clone ID: PAT_TA_52109
aatcctccaagaagacacaagaagctcatagcctatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcagcatcgatcatatcgatctactactaccataccatgtaaccgctacctgatcgagggccttatctatgcacctgacctgcatcagcagtcaggtgccatgccatgcttgttgtaaacaggcccccctaaataaaatctccctggtttaacc

SEQ ID NO: 52110 - DNA, 380 bp, Triticum aestivum
  unsure (1)..(380): unsure at all n locations
  Clone ID: PAT_TA_52110
tttccgttggcgccggccaatgtcatttntggagaaagagccgcatcctggtgcacatcatagcagccactctgtccctttcatgggctagaggtcgtcactggctgatattgagccctaacggaagacactccgtgcactctcgccatggtgaagggccaaacggcacaatgctgaacctaatgagttttatgcaagtttggattttcatctgctgcaaactttctgtggaatactgctatgttgcattggctgctagggctcattattctgtttgtgttcatcctttgttgagagaaaccagggctccctagtttgtatgtaccttttgtgcctggagaagtatctataatgacctttgaataaactgaatttcgaac

SEQ ID NO: 52111 - DNA, 792 bp, Triticum aestivum
  Clone ID: PAT_TA_52111
aatcaaacgtgctatctacatcaactctagcacatacgcatcgtgtatctcagacacctccatgtactcgcacaccatgctcggagcagaaatagaaatcgagctccctgagctgcgtagtggtctctctgatggtgaggatagatgcaaccttatcgcctctcctcgaggcagctccgaagaccaaaatactataccatctctttctccgagagatggatagagatcactgcccaggcttttccattaaatgcaccaagctcgaggaagacaaaagacctcagctgcagccgatccccgtgagcaggctgcctgacaatataaagtgctggtgacctgtcgattaactatatacgccaggtgatcattttgaatcatgacaggatgaataaggacaataatgaatctgtggtaacagatccaattacatgagtgctgattgatgaacgatcgtgcgtattgatgagctggttgtcttagatatgagcatggatcttactgaggccatgatatgctcctgaatcaccgacgagattggtctgcactccctgcgacagagagactgacacattcagataacttgagcgacgtctggcgaaaggttgtacgagggtcttgactggctctccaaaacattgccacactagcttgaagcgcctcgacaatcttgtatcaagaaactaacaagctgtatgtctcaacaactcactgataccactatatataatgtgatatagatacaccggacaacagatagtatgtgtgaggatgtgacaggcagaagctcccttc

SEQ ID NO: 52112 - DNA, 726 bp, Triticum aestivum
  Clone ID: PAT_TA_52112
attccgaaacctcctttaccgcagctacctacaaaatttttgaggatcaaggatgttgaattgcctgcttccttcatacaaaagtaccttgtgcagaaactcaatctttcaagtgaagctgaggtggagttgatgtgcgctggcaagaaagttgacccagcaatcaccctgcatgacataacggactgctatctggacaaaggaccgaacggttgggtgcggtcgtccgtgggctcccctgccaccgggttcatcacgaccgtgttctacagcaggccggagctgcccacacccccaacaccaccgccaccacctgaaagtcaccatggctgacccagagcgccgcctcatgcccgaaccagttcggcctcactccagccgtctatttcagagccctctggttggtgccgcattgatgccaaccttgcgaggctcagctcggctcaccttgccttgtgatatgtagatagatgttcggttcacatgccttgcggggattctgatttgatctgttgttctttaccatttttcttcacctgacggagtagctgtacctatgcgtgtttgtaatcctgtgttgagttgttgagtgctgctgtaactggacttgaagcctttatggtgtgcctctgtaatgtttgtagcactatttttactgtaagctcttgtacaagttgtcgtcgaaccggaaatttggttatatatggagtagcgtatggagtgctg

SEQ ID NO: 52113 - DNA, 602 bp, Triticum aestivum
  Clone ID: PAT_TA_52113
agacttccacgaaaattctatagcggtccaacgacgtacagccatgaacgcactcctaatgtatgacgatggctcctgatctagatagtagatcggcaggacactccatgtgagtcggatacttgggttctcaggtagtatacgctgagcaaaccaaacgttgtaagtacgctaagtcagtcccgcgtaggactcgcatgcgtgctgtagtgagcatcaaccagcttaagatcgcgaaaccgcaacagatcgcttgctgcataacttgccgcatttagctaaatttgtgttctcatgcatgttctgccacacagctatttgggatgtggagtatcaaacactccagtataaatctgaacttaagatgcattgcttcgccgtgtcggagctgcaggaggccgccgaggcgtacctggttgggccgctagaggactccaacgctctgcactatccgaaccatgaccctaatcatgatgtttgaggacatgcagctctaacgccctatatccgaaccactaaaggtaggcccccattcagagctcgacgagatactgcgtagaacctgctcagaaatgaagttaactgtctgaaggggcgatatg

SEQ ID NO: 52114 - DNA, 566 bp, Triticum aestivum
  Clone ID: PAT_TA_52114
aatgggaggaaggaaggaaggaatgcaggaacgaggaaaggaaaaaaaggtatatccatgggctcccggctttaaggatcgtcgtcgtcgtgagcggccttgtcatgatgatgatgatgatggggcgagcgggcgctgacgagtgcatggacttgtgccttcacgattgcgccgtcaaggggaagaacttgacccaggagcaatgccagtacgcatgcaattacggctgcccctttggcgccgcccagcacgctctatccaatgcccccgccattgccaggaatggcgggaagaataccgtccatgtcctcatccatgtcctcgcagcagccatgtggctctagcagtagcacctgctagctccttcatcggcaccaacctggagtggagctcctccatcgacggcgtcaaagggcatcaaagcagcaagcaagcgtcaagatcgatgttatagcggacgtatgctatgtgtatgcatgtatgtatgtgcttatgtatctttatttatcaagcgtgaagtgaagatgttatatcggatatataatatacttctgctattttttgac

SEQ ID NO: 52115 - DNA, 599 bp, Triticum aestivum
  unsure (1)..(599): unsure at all n locations
  Clone ID: PAT_TA_52115
ggcccgctcgaggccgggccggggnctgaaaatacaaaaaaaaaaaaaaaaaaaaaaaaaaaaaaaaaaaaacctatgtctaaactctagaaaaaaaaaaccaaaaactttctccccccccccccctcgcccccgcattgggacggaagggggctcccccccccgccaaaatgggagattttttatgaaaaccctgtaggggaaaaaccatcacactttaagggggggatctctggagacaacctccaaagcgaagggcaagatcccggagaagggggggatatccccggggccaaaacgcctctttttttccgggaaaaaggtcgagaagaggcccaccctctccgcatataaaatttaaaaagaaggccccccctccctgggggtccccctccgggggggggccccaaaaggcgcgaaaaaaacctttaccgaaccccctaaaagaaaggacaaaaacaaaaaagggaagctctccgccctccccttttaaaaaggggaccacaccccccccaaggggacccggctcacgaaaaagagtccccaagcccactgcgccgcgggaagatttatgggcaaaaacttttaccgccactatt

SEQ ID NO: 52116 - DNA, 789 bp, Triticum aestivum
  Clone ID: PAT_TA_52116
aaacgaccccggaaaaaccccaaaaaaggcggcggaaaggggaaaaggggaagaacatggacgggcacgtcggccagttcttcgagtcagtcagctcgatcttccgcgggagcgacaccctccccgtctgcgaccgcgacatcatcgccggttgtgaagcagaggttgctgaggctgcaaatgaagaacagaagaacgacagcctcatgaggctgtcatgggcgcttgttcactctaggcagcccgaggatgtcaaccgcggcattggaatgcttgaagcttctttcggcaagtctaacagtccgctacaaacaagggagaagctctatttgttggctgttggacactacagaaatggggattacacaagaagccgtgagcttctggaaagatgcttagaggttcaacctgattggaggcaagctcttactttggaaaggctccttgaagagaaaaccaaaagagatggtatgattggcatggccattgtgactggcgcctttggacttgtggggcttgttgctggtggaatcatagctgctgcttcatcgtccaggaagaaatgaggctcctgtatgcggcgaataagatgattagatgagcaagagcttgatgtaaagttgcgtaatcttaccttgatgagcaagaaccatgtgcgcacttatccttttcctttcctgtttccacgttggaccaaccttaaccgcactatgagttgtcatgttacgacatttctaccgtcagacacttttacccctgccctactgatagaaagatgcatgttaagcc

SEQ ID NO: 52117 - DNA, 788 bp, Triticum aestivum
  unsure (1)..(788): unsure at all n locations
  Clone ID: PAT_TA_52117
aagctccacgaccccagcgcctcctacagtcctactgtcagcctcagctcgcccgaagcaaagctagcgagtacgcagcgcgcgatggcggccgcgaccatggcgctctcctccctggcgatggcgggcacacctgtgaaggcctccagggcggcgcccttcggggagggccgcatcaccatgcgcaagacggcgggcaagcccaaggtggcggcgtccagcagcccgtggtacggctccgaccgcgtgctctacctcggcccgctctccggcgacccgccgagctacctcaccggcgagttccccggcgactacggctgggacaccgcgggcctgtcggccgaccccgagaccttcgccaagaaccgggagctggaggtgatccactgccgttgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcatgcgcagagcatccttgccatctgggcctgccaggtggtgctgatgggcgccgtggagggctaccgcgtggccggcggccccgctgggcgagatcgtggacccgctctaccccggcggcagcttcgaccccctgggcctcgccgaggaccccgaggccttcgcggagctcaaggtgaaggagatcaagaacggccgcctcgncatgttctccatggtcggcttcttcgtccaggccatcgtcaccg

SEQ ID NO: 52118 - DNA, 657 bp, Triticum aestivum
  unsure (1)..(657): unsure at all n locations
  Clone ID: PAT_TA_52118
ngaattcnnaannnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaaaaaaaatttcccccaacccggcctttgttcccccccttcttttcccaacggggaagggggaaatcccaaccggggggggggattggggccaaatcccacgggggggacggaaaaatggccaaagggggggttccccaaaaagggggggaccttaaagttcccggggggggaaaaaaacccccccccgggggggtcccgggtttttgggaaggggtttggccccccgggaaacgggaaaattcctttctgggggcccccccgggggggaatttggagggcggccccggggtggggaaacccccccaaaaattcgcccggaaatggttccccgggaacaaaaaggggtggggcccccggccccttcttttttttttggggggaaaaattcagaatatttttttggcggggcgggggattttcatggccctcctttggggggggacccttaaagccttttaactttcaattttttaggccttggaaattggtggaaggttcctgggttttgtttttgaggggataagtggg

SEQ ID NO: 52119 - DNA, 423 bp, Triticum aestivum
  Clone ID: PAT_TA_52119
ccttgtctcatcactctcccccgattcggccgccgacctcgccgctcctctatcccacggccgcccgccgccttctcctccctcccatcaccttctctacgccggcaggggcttccacctgtggattggggatctgcaccggtgatgggctcctccttcgcccacggcagcggctccgccttgcagggccggggcgggagcgggagcgggccgtgctttggcccggatcgtcagctctggcgtggaggaggacctcttgtgcgcggtggcggttggaggaggagttggattcgccagcaaccgcgacagaatcatctcagtagtccttgatttttctctacacatttgaatttcagttgcctggtggtcattgtgtgcgcaattctcttaaatattttgtatcacttatactcccttcgttcg

SEQ ID NO: 52120 - DNA, 454 bp, Triticum aestivum
  Clone ID: PAT_TA_52120
acacactcacactcacactcaagaagaagaagaagaagaagaagaagcaagaagaggaggaaggacgacagagaaagaagagccatggagcactcctacagcagctacagcggcatcagcaactacggcagcgcaaaggagaggaggcctgcgctgaagagggggcagctgaagcggcagatcgtgaggaccatcagcaacctcatggcgccgaggaacgacggcgccggcgcggacaagagggcatcaggtcgcaccagcatcggcgcctacaactgacgctgaggacgccatcgagtgtcagatgcactcgcacggacgcccgcttccttcagacctgattagcttttttactttgtagcttcatactggactagtactgttttttcttcccaagtcttctccgattgtacagagttctgcgattgtacagatgaatagagaggttatatgc

SEQ ID NO: 52121 - DNA, 366 bp, Triticum aestivum
  Clone ID: PAT_TA_52121
gccgtggcggcgatgttgaagaacaacatgctcgtcgcctgcgtgatgctcctcgtggtcctgctgatggcgacgcagatgggggcggcggtggccggcgacgccggcgcgggacgccgtcgcctgctcgatgcgtgccagtacagaaactgcaactgccgcacttgctacattttccactgggcctgttgcggcttgtgctgcccgccggcgtaggggacggcggcacacacggcccgctgcagtttctcacatgcagaggtttgaataatgcacatgtacgtggttacagtaacatgtggctgctcttgtctgtcccaatgctagtcgtggcctttgaaatttgacaaatttaacctgtgcatg

SEQ ID NO: 52122 - DNA, 593 bp, Triticum aestivum
  unsure (1)..(593): unsure at all n locations
  Clone ID: PAT_TA_52122
gtaggcgtgggaactccggagagtttggcttgagcaaatgtcgatgctgctgcaatgagaagaccctttctgcatgtaattcaggcaatagctgagctcccagcctcctaagactggcatgggcacatcaataagggcatggagcccatcaaagaggaggtcggagcgacgttggacctggatcaactcatctaaatcaagcggccggcctcggctgggagtcaccaacgctccacctggacggcgtcggctgggacagctccacatgcaatggctggccggggaccagacctcgacaggaacgtgttgccctttgagccggtgcagagcgacaagttcgtagcatcgttatagttttttgcacaaagatagaccctgtagtactgatcaggtgaaacagatcgatgtggcactggtactgaactgaagcaacaatttgttcaacaaaatatgatccaaatagagcgcatattagtttctataacaaggatcgtcgccggttttgtgccattcatgtgttttttccctatatataggattgctctttcgttttggttnnnnnnnnnnnnnnnnnnnnnnnnnnnnnnnnnnnt

SEQ ID NO: 52123 - DNA, 451 bp, Triticum aestivum
  Clone ID: PAT_TA_52123
gccttttcagcaccggtctggtcggtcggcgacggttgggaccggagggagggaggagcgatggagcccctggaggcggcgatagcgatcgtgttcaacgcgctgctgctggtgttcatggtgaagctcttcttcgccatgttccagatgaagctcgtcgtcatcctcttctacctcgtcgtcgtcctcttcgccctcgccttctccggccgcggccccgccggcttctaggttaggtccttcgtttttttcccccttgcttcggttggctcccgatccatccttcaggctgtacagcagtgcttcatcttcgagagaatactagtagatcatacctacctcggtgcatgtctggttggttaagagagatctagtctgtgatggtgatgactccgagctgcaaattgtgtgaagtcggccaattaacaagtgctagtacagctttatatgg

SEQ ID NO: 52124 - DNA, 561 bp, Triticum aestivum
  Clone ID: PAT_TA_52124
atttccatcctccccattcttgatccccaatctggaatccgccgccgtcgtcaatggaggtggagggagaagatagcttcgtacttccggccgactgggacatccccgaagctgaatgggccttgatgtctgagtctaccaaacgtcagatcaaagagaacttcgctctagaagaggaataccgtctccgcttccgcagcgccgaagtcggggtcggcggcggcggcagcggcaatctcaatactgatttcaagagccccgtcccgcagcgacgttgacaagaagaaggccaagaggcaacgcgggggtgtggagctgagcggaatcgagatgcactcgggcgtcagcttccctcctcagttatcctaaaacttgaaagctaggaaaatgatgggcatatgcggaatatatgttatatgactcccgtttcccacactttagtttcataatacgccgatttgtgtttacctttcaaatattcagaggctcgttgatagtccttattcttgaagattttgtttctacgataatataaaggcaggataattttggccgatgttg

SEQ ID NO: 52125 - DNA, 592 bp, Triticum aestivum
  Clone ID: PAT_TA_52125
attatctcactccgtcattcctcctcgacctgaattccccggatccactcagacatagacttcttcccctatccgatcccagatacgataagcgatgtcgtgcctgagctgcaccttgcctcaagatcctgctcgtcttcatgctgccgccgctgggcggcttgctccacgatccctgatgcagaatgcaccgcctggcatctgccgtcatgctcatcgatccctgggctacactccccgggatcttctacgcggtctacacgctcgttgcgctcacctcagagtaccactgtcccaactacaacagccttgcttactaatcctgcacctgctccaattgcgagagaaacctctcccctgagtgctgtcaatcaacctagcgcgattacatctaggactgacgtggactagccttatctatgaccacctgcaaaagctcaaaccattgcctgtttccgccctggcgtgctgtaaatatgatacaaccgaatcgagttccttaactctgaaactgaacaaaacaaaatgtccctcaggactgtacttgctcgtgctatccgaatctattacactgaagcctcctctacggtga

SEQ ID NO: 52126 - DNA, 580 bp, Triticum aestivum
  Clone ID: PAT_TA_52126
aattcaattgtgctcatcatcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgctacttcgct

SEQ ID NO: 52127 - DNA, 648 bp, Triticum aestivum
  Clone ID: PAT_TA_52127
acatctcatctgcaatcccctctcctccttcaatcctccagcgaaaccccaccccgccccaccccaccgtcagcatccatggcgcccaaggccgagaagaagccggcggcgaagaagccagtggaggaggagcccgcggcggagaaggccgagaagaccccggccgggaagaagcccaaggccgagaagcggctgccggcgggcaagtcgtcggcggcggccaaggagggcggcaaggcgaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgctaagctggcgaggtacaacaagaagcccaccatcacgtcccgggagatccagacctccgtccgcctcgtcctccccggcgagctcgccaagcacgccgtctccgagggcaccaaggctgtcaccaagttcacctcctcctgagtctcgtagttagctgtttgggtgtgtttgtggccgtgttatcgtgtaagaatcgcatcgctatgtttctggatctcgagaaatagtaacggtgcctgcctcaatgttcac

SEQ ID NO: 52128 - DNA, 569 bp, Triticum aestivum
  Clone ID: PAT_TA_52128
gatcgaatgcgaaggcagttcacccaaggctgctagtaaactttctgctgaagctcctctgaaagaatatcttgggggatactacagaagcggtccgcaagaatgctttggatgtaatagtagaggtacaggaattggaggaaggtgagcttcctacggagcctgaccatgtcctccaagagaacccagttactcacaataatagcctgcatgagcttacagctggtacccttgagtgtgttgtgccgtcaatggttgatgcggaacctcccttgaggcatttttctaatgagaagatccctgtgaacatgttggagcacaagggggagagtgtatcatgggaagttgctgaagatctcaaggtgatgaaaaaatgcaaaggcaattcacccaaggctgctagtaaacctcctcctgaagatcctctgaaagaatatcttggggataagaaagtgtctgaaagttgtagcatgaaaagtgcacctcttgatgtggaagcaggggtacacggcgacggtatcatgagacgtatggtaacattcacagctagaaattatcctgaagaagcc

SEQ ID NO: 52129 - DNA, 581 bp, Triticum aestivum
  unsure (1)..(581): unsure at all n locations
  Clone ID: PAT_TA_52129
acctttagcgcaacgcccaacgccagcgcttctgtgcagcacccatcggcgttgccgatgatgcgatgcatccgtcgttgctgcgaggaaacggggcgtccatgccggcgctgtctgctgcaaagcaacacggtgcgtgagccgctacaaggcgaccggtgctgcgagggatcggtgaccgccggtgccaggccacgttgcggcagtggagcatcgcccgcgccgccggagctgcaatgaagcgccgcgaggtcgttgaagcgccgttggagttgcaccgggaccgttgaaacttcgatggggttgcattgaagcgccgtcggtgctatgcggcgctgccatggactggtgcgtggtgatgccatgggagctgcctgatccttcggctgggagcgtctgaatcggacggccctggggggcggtttaactcttcctcaattcagccggctgactggtagcagtcaccaatacacaatgcttccaactcaaatccacagtgtatacatccgactgcaaattcgaactataattaggcggattgcgcttcaactaccaagtggncggcttggtaagctaccagc

SEQ ID NO: 52130 - DNA, 688 bp, Triticum aestivum
  Clone ID: PAT_TA_52130
atctatgccgcccacccgccattgctgacctccccttcctgccactgccttccttccttcactccacactccaccacaccatgaagccccccggagccggagccctctcgcctcgccacctcctgcccctcctcctcctcctgctctaccacctcgccgccgccggcaccgcagcaaccgacgccgacgcgctgctggcactaaaatcctccctcgacgcatccaaccgcctcccgtggcacccctccacggcccgcaccctctgcaccgcctggccgggcgtgcgccagtgcgaccccgccggccgcgtcaccaagctggtcctcgagaacctcaacctcacgggcccgctcaccgccgccctcctcgcgccgctcggcgaactccgcgtcctcagcctcaaggccaacgcgctctccggccccgtccccgacgggctcgccgccgcgctccccaacctcaagctgctctacctcgccggcaaccgcctctccggcccgctccccgccagcctcgcgctgctccaccgcgccaccgtgctcgtgctctccggcaaccgcctctccggccggatcccgcgcgagctcgcccgggtgccgaggctcacctcgctgctgctcgacgggaacctgctgacggggccggtgtccgcgctgccgcagagcaagctccgggcgctcgaagtctc

SEQ ID NO: 52131 - DNA, 694 bp, Triticum aestivum
  Clone ID: PAT_TA_52131
aaatagcgccccgagctcccttgcactgcacacacagaaacacacggcagaggcagtctaaaccctgtacacgcacagcagcaggagaggtagcttggcagccatggcgaagaaggcggcggtgatcgccacgctgctggccctgaacctgctcttcttcaccttcgccgacgcctgcggctgccactgcggatcctgccctagccccggcggaggcggcggcggtgggggtggcggtggaggtgggagtggtggcggcggtggtgggagcgggggcagtggaggcagcggtggaggcggttctggaggaggaggcagcggcggagggggatctggaggaggcggtagcgccggaggcggatcaggaggaggcggcagcggcggcggcgggtccggcggtggcggatcgggaggaggcggatcaggcgggcgcgcgcggtgccccatcgatgcgctgaagctgggggtgtgcgccaacgtgctccacgggctgatcaaactgcagctggggacgccccgaagcaaccgtgctgctcgctgatccaggggctcgccgacctggaagcgggcggggtgcctgtgaacgtcgctcaaggccaaactcctgggctcaacctccaaatgcccaatttatttcacccccctcctcaaataatgaaaaaaaaaaatcccctccgccttcaattccccccct

SEQ ID NO: 52132 - DNA, 566 bp, Triticum aestivum
  Clone ID: PAT_TA_52132
accaaactcaatccctcgccggcgaagcacccacacccaaacccctccggctccaatggcccgcacgaagcagacggcgcgcaagtccaccggcggcaaggcgccgaggaagcagctggcgaccaaggcggcgcgcaagtcggccccggccaccggcggcgtgaagaagccccaccgcttccgcccggggaccgtggcgctccgggagatccgcaagtaccagaagagcacggagctgctcatccgcaagctccccttccagcggctggtgcgggagatcgcgcaggacttcaagaccgacctgaggttccagtcctccgccgtctccgcgctccaggaggccgccgaggcgtacctggtcgggcttttcgaggacaccaacctgtgcgccatccacgccaagcgcgtcaccatcatgcccaaggacatccagctcgcccgccgcatccgtggcgagagggcctagagcgcttcgagcttggttggagggtggtagaggtgttagcttctgaatctgtgatgcgtggtggaaatctggcgttgtggtagtaggatccctctgttcg

SEQ ID NO: 52133 - DNA, 649 bp, Triticum aestivum
  unsure (1)..(649): unsure at all n locations
  Clone ID: PAT_TA_52133
ngaatacaanaaaaaaaaaaaaaaaaaaaaaaaaaccaccatttgcagcactatgccactgcaaaaagaaaaagagccccctttgcagaccttgccactgcaagacgaagagcgtgcaaggaataaaccaaaccttgttgcgacccctgccatgccgattaggaaggaggccctgctgggggccatgagcctggcgctggttggggcggctccgggggtggatgcgtgccatgtccaaggggggcaagctgacggggggaatgccgggaatccccaccgcgcccaagccgagcttctggtgttgcgccaacctgccctcccacaatgggtgcttctgccagaaccccaaggacccctccctcgttcgttacatccccaccccccacgcctgctagaccctggtctcgggcggcttcgccgtccggctctgttaggttagggcccccttcgcctaccgtgaatggttcaacaataggtaggatacctccctcgcccatgccagatgaaagacattataatatcttagccctaactgatacttgagaaaggatcatgctggctccatgaacacgcgcatgtttctgcccgaccctggatgctgcaataaaatgttgggggatgatcggggcttgaataaaaaaaaggcccc

SEQ ID NO: 52134 - DNA, 736 bp, Triticum aestivum
  Clone ID: PAT_TA_52134
actgagcccgaagccaaaggtaatccaatccgcacagaaatccccatctcaaaaccctagccctcatccccgatcccggcgagagagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggcggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgcctttcgccgtcgtcgccgtcgccccgtgtgtcccgtgtcgtgtcgtcgatctaaataagagagtcgtgtgtcgtgtgtcgtgtcttcccctggtccgtccggtgagatctcc

SEQ ID NO: 52135 - DNA, 382 bp, Triticum aestivum
  unsure (1)..(382): unsure at all n locations
  Clone ID: PAT_TA_52135
cggccgctcgagcccgccggcctgnnnatcatagacgcgacgcacctcctcccctcctgcccccgagcaccgcagccgccgccgccgccgccgccgccgccgactgcagccatgtcgctgatcgcgggtgaggagttccagcacatccttcgtgtgctcaacaccaacgtcgacggtaagcagaagatcatgttcgcgctgacctccatcaagggtgtgggacgccgattctccaagatcgtctgcaagaaggccgacatcgacatgaacaagagggatggagaggtttccgaggaggagatggaccgactgatggtggaggtgtataaactgggattgttaaaggagatgtaatggttaattaaaaggaaaaaggataata

SEQ ID NO: 52136 - DNA, 842 bp, Triticum aestivum
  unsure (1)..(842): unsure at all n locations
  Clone ID: PAT_TA_52136
aacctcgccccctccgatccccaccgaagaatctccgacagatcgaagccaaggctttctcgtcctcctccccaagatgcagatctttgtgaagaccctcaccggcaagaccatcacccttgaggtcgagtcatcggacaccatagacaacgtcaaggcgaagatccaggacaaggagggcatccccccggaccagcagcgcctcatctttgctggcaagcagctcgaggatggtcgtacccttgctgactacaacatccagaaggagtccaccctccacctggtgctccgccttcgcggtggtatgcagatcttcgtgaagaccctgacgggcaagaccatcacgcttgaggtggagtcctcggacaccatcgacaacgtcaaggccaagatccaggacaaggagggcatccccccggaccagcagcgcctcatcttcgccggcaagcagcttgaggatggccgcactctggcagactacaacatccagaaggagtccaccctccacctggtgctccgccttcgcggtggtatgcagatcttcgtgaagaccctgacgggcaagaccatcacgttggaggtggagtcctcggacaccatcgacaacgtcaaggccaagatccaggacaaggagggcatccccccggaccagcagcgcctcatcttcgccggcaagcagctcgaggatggccgtacccttgctgactacaacatccagaaggagtccaccctccacctggtgctccgcccttcgcggtggtatgcagatcttcgtgaagaccctgacgggcaagaacatcacgctggnaggtggagtcctcggacaccatcgancacgtcaa

SEQ ID NO: 52137 - DNA, 130 bp, Triticum aestivum
  Clone ID: PAT_TA_52137
gttgaactatgccaaaatgtgctacatctattgtacaattagttgtactgcttgttcacatgcttgttaagatttgttgcttaaattgttttttctatctctaacatctaaagtgacaattttgtagaat

SEQ ID NO: 52138 - DNA, 598 bp, Triticum aestivum
  Clone ID: PAT_TA_52138
agacagagttggcaagcaagcgcagacagacagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccagtttgttgacaagtacggcgccaacgtcgacggctacagcccaatctacacgccggaggaatggtctgaatctggtgaccgctacgccggcggaacgaccgggcttcttatctgggccgtcaccctcgccggcctcctcggcggcggcgtcctcctcgtctacaacaccagcgctctcgccggctaagagagcatctacgtgtaacacagggccgggtctctgcttgcatgcacgtctctgtaatctacgtagctacctcctgtgaatgtatgtcatcaacgatgcaaagtaattgattcgaacagatggtttatgtatgtacgtaacgcagttaccatatactcc

SEQ ID NO: 52139 - DNA, 638 bp, Triticum aestivum
  unsure (1)..(638): unsure at all n locations
  Clone ID: PAT_TA_52139
ggccgggcccgggaataaaaaaaaaaaaaaaaaaaaaaaaaaaaaaaaaaaaaaaaaaaaaaaaaaaaaaaaaaaaaaaaaaaaaaaaaaaaaaaaaaacccatttttcccccgaagaaaaaaagttcgtctcgtctcgtcccgccgaggaatcaacagccttgggggggggaaacgcgcaaaagcccaaaatggggagggaaaggaccctcaaaaagttgaaggggggaaggggaacccacttcgaggccaacaaaaaggccttgaacttccagggcaaaatttgcttgcaaattttcttctgccccccctctgaaccaaagggcaaggagcttgccgaggcaaagcgcccaaaaagcgagctcgcccagggtttccctcccctcaagcagggatttctgcccattcggccggagagggggttaaaggagagagagagggagaggttgtcttaacccccctacttttatcttgtcccccaatgactgtttgttgccctaaaaaaaaaaaaaaaaaaaaaaaaaaaaaaaaaaaaaaaaaaaaaaaaaaaaatggaataatnnccctttgtggggggcaaaaaaaaaaaaaaaaaaaggcccccaaggggttttatatggggcccgtttggggggcgc

SEQ ID NO: 52140 - DNA, 699 bp, Triticum aestivum
  unsure (1)..(699): unsure at all n locations
  Clone ID: PAT_TA_52140
tcgagggccggcnncgggccgggaaaatacnnaannnaaaaaaaaaaaaaaaaaaaaaaaaaaaaaaaaaaaaaaaaaaaaaaaaaaaaaaaaaaaaaaaaaaaaaaaaaaaaaaaaaaaaattccccccccccccacacacacacacagagcctaagcccatttttttaaaagaaaagcctcccccttcaccttcgttttctttcctctcggaagttcaacttttgaagggaaaaaggggttacctccaaggggggggggatcgttggaagcctcttcgggggggtcctcccgggaaaggcaaacccccccccaaggaggggggggcacccgtcgcccaaaaaaaaaaacgggaaaaaaaaggggcccccggccttcgggccgaaaaatgggatcgggggccccggaaccccaaaaaaaaacgggggccctcacccaaccacgggggttttcggccccgccggggtaaaccccaagtgggccgcaaccctccccccggaaagcccccttgaaaaggggggcccccccgggttgaacaaaaagggggggttccccccgctcaaggacgtcaaaaacccccccgtcccctgatattcgccaaggggaaaaaaagcccagttcaaaatcttaataactccgttaagtggggctcgacttccaactaaaaataacaaataaccgtgaaggggggggcccggg

SEQ ID NO: 52141 - DNA, 541 bp, Triticum aestivum
  Clone ID: PAT_TA_52141
aaaacctcctccgccgccgaagaagggtcgaccaagaagaagaaaccctcaatcaaacaaatcaaaaaagaaaagaagaagcgagcgaggggcagaatcagcaatggcgggcggtgggctgtccggcggcgcggccgcgttctgggcgacaagagcgctggaggtggtgaagcggaacgactccccggggttgttgtggaagcggatcaagctcaccaccacccgcaagaacaacgccaagaaacgcctaaagcgcctctggcagaacgaagcagttataagggcttctgctcaagcagaatcatcgtcaacttcaaacacagctgccgcatctgagaaacagcagtagcttgctagtcaactcatggtttgtggtgaagaaactgatatgcagttaaaagatgggcgttgaacttgcataacatgctgaatcctaaaacacatccttccgtatatttttaagtttgtcttgtcagaagtttgaacaagtgcatgcatgtacacatcgagtttcttcatcaagaggatatttcttgccgcc

SEQ ID NO: 52142 - DNA, 495 bp, Triticum aestivum
  Clone ID: PAT_TA_52142
acactcacactcacgcatctcactctctatcactcacgtcatgttcggtggatctacggtagcactaacttcagctagctcagcctctagccactccgtgcattttcttgcatccacgactgcgatggccaccgctgatgtccagaacccgacggctcagtgctgaccgaggaggagcccacggtgcagacgcccgtcgccgccgagtacgtcgtcaagacgtgggaggcccccgcgacgggcgaggcccacgccaaggcgcctgctggctccgccgaggtgcaggagatcaacgaggtggcacctgccgccgctgacaccgagaaagccagggagtgcgacacaagactcgcgaccgagatcggaggcctacgcccgcacagagactacgcggcggccgtggactgcgacagacaccaaggacttccccattgaagtgtaacaactgcgaccgagtcggctaatgcggtagataaccctcctgacgagcctgaa

SEQ ID NO: 52143 - DNA, 396 bp, Triticum aestivum
  Clone ID: PAT_TA_52143
ccccgccgcgctccgcctcccgttcccctgcacgccgcggcgccgccgtctccgtccccgtcggcgcccccgaccccgcggccgtcaccatgatcatctccaagaagacccgccccgatatctgtgagcacctcttcgaggagggagtcttgtacgccacgacggactacaaccgtgcccaagcagccgcaggtggatgcctcgacgctggaggccatcaagttcacgaagagtttcaagtcgaaggagtagatgatggagactttctcgagtgagcactactactggtaccagaccaacgacgtcgttgagatcctctgaaattttcccaacctgccgtatgagattgtgccataaaattctcaagaagtccgaatgagcctcgtgacgatcttt

SEQ ID NO: 52144 - DNA, 594 bp, Triticum aestivum
  Clone ID: PAT_TA_52144
gcaaggtagatgatctggtgaaggacaggattgaatcgcagaaagaagaaaaagccaaagagcaggaagagaaggacgtcgttgctcagcagaacatgtacgctcaattactccctctcgccttgcctgctccgcctggtatggggggtccacctccgatgggcgggatgggtatgcctccaatgggcgggatgggtatgcctccgatgggtgggatgggtatgcctccgatgggtcctggtccgatgccggcatatgggatgcctccaatgggaaactactgagtcggcttttgaagaacatagatgatgtcgattgtttcagtctttttttacacagagggagcatgaggatcccaaaggtatctttcaagttgtagattgatttgggctattggttgtttcagttaatattcttttggtaccggggcaattttggcgagcaatatctctagccgaggtagagtaaatttactggttgctatatattatgatcgggtaggatgaggatgagattaggttccagctgaagaatgagaggtggaagactggtaccatttgtatagcttgtgtgataaaaagactagacattttg

SEQ ID NO: 52145 - DNA, 526 bp, Triticum aestivum
  unsure (1)..(526): unsure at all n locations
  Clone ID: PAT_TA_52145
cggnacgcgtgnggcggacgcgtggngcggacgcgtggngcggacgcgtgggcggacgcgtgggcggacgcgtgggcggacgcgtgggaaattccaaagattcctgacctttatcttgctcattaccgtttcttaattaaccaaggtccttcagaattgaaagaggatgccaaagccaagttattcgaagcaattaaagaaaacaacatggcacctttttacaaggtcatgactgaagaattacaattgcctttggatcaagctttatacgacagcatggtttcaaacaatgaagaggaattaaaaaagtttgatgaaaaagcggcaaaagctgaacaaaacgagggcgaaacagaagtgaacgaagccttattagcaaaagcagattattatgccaagattgcggataaagaaaatgcgcttgctgcttacgaaaatntgttgaaaaggtcttttacaacaggtacacgcattgatattattttnacctatgtttggattgggttttttttttatgacaacaacc

SEQ ID NO: 52146 - DNA, 502 bp, Triticum aestivum
  unsure (1)..(502): unsure at all n locations
  Clone ID: PAT_TA_52146
gcgtttcggggagagaacggcaaggagctcgacgggcgcaacatcaccgtcaacgaggcccagtcccgccgctcgggcggagggggcggcggcggcggcggcggctacggcggccagcgcggcggtggcggaggttacggcggcggcggcggctacggaggcggcggcggcggctacggggggcggggcggtggcggctacggcggccagcgcggtggcggcggcggctacggcggcggcggcggctacggcggtggtggcggctacggcggccagcgcggcggtggcggcggtgactccggcggccagtggaggaactgagcctcgaatctcccagttatcgatctatctaccgtgtcgtngtcgttgtngtcttggtcagcaagttatcttnggtgtcgtngtgttcctgtgtcagtctgagtcgtngtgtgtgtggtgtttttgatcgngagctttggtgtngttttgggcggggtttntttgnggctgggtacgcggg

SEQ ID NO: 52147 - DNA, 521 bp, Triticum aestivum
  unsure (1)..(521): unsure at all n locations
  Clone ID: PAT_TA_52147
cccacgcgtccgggcgcagctcgtgtccatggcgcgcgacccccgcgtcgccatcatcgacgtcagggacgaggagcggatctgcgacgcgcacatcgccgggtcgcaccactacgccagcgacggcttcgcggaccggctgccggagatcgccgaggccacccggggcaaggagaccctcgtcttccactgcgccctcagccaggtgcgcggaccatcttgtgcaagaatgtttctggactatttatcagaggccaaggaagagtcagcggtgaagagcatcacggtcctcgagcgtggattcaacggatgggagctttcagggagagctgtttgccgcttgaaggatgctccttgcaagggtgtatgctcttgaagtcttnagtattnatgtaaacaaacatgatgcatttntcaagtgcagaggatgctgntntgnatgttaccaagatgatcactatttacagggttagccgttcgtagtnaattacttntatagnagcacacattaaaatggcata

SEQ ID NO: 52148 - DNA, 375 bp, Triticum aestivum
  Clone ID: PAT_TA_52148
taaactcggtgatgcggtggtcggaacattacttggggcactatactaatccggtggaaatggttttaatacttatctcaattggcgaggaacgtttttgcactgcctgaaatttattatcaaaggcttctactttcatctgcatggctttggctttgatccggagcttgtgtggcaaggcaaaggaattcacttttggaactttaaccacagttgcatgcacatgcttgagttcaactggagaattgatggggacattgtggacctgttgctcgtgttctccatgagatgactttcctaccgccccattcttattttgcggcgttctcggtgagttgtttgaggatcgtttttcttccaggggtgggggagagt

SEQ ID NO: 52149 - DNA, 311 bp, Triticum aestivum
  unsure (1)..(311): unsure at all n locations
  Clone ID: PAT_TA_52149
taatttgccctctttgtagtgcaacttacagcatggaggaatgaatcaaaggttgatggtatttgatttgcatgggattggtgttcaaagggaaaaagaaaaaaggtgtgattnattagtaattgttgtaattaaaaaatatggggggggcgttttagtggatntaaggttttttcggggggtgtgggaggtatttgcttttgtttggtgttnnntaaattgaattgagtggtggtggttttaaaaggtngtgattgggaaaattttggggttggtgttttattgggtttggtgttggttcggttttgggg

SEQ ID NO: 52150 - DNA, 570 bp, Triticum aestivum
  Clone ID: PAT_TA_52150
cccagcgtccgcggacgcgtggggttgtccatgatggcttatccaccgtacaagccatggctaacaagacaagtttaggtcgattagctctttctactgccaattctactttgactactgtctcaagatacgctcaacctaaatatgttcaatcctactatgaatcttatatacaaccacgcattgaaaaggctgatgctcttggatgtcgttcgttggatatcattcaaaccaagtttcctgtggtcaatcaacctacagaagatatcctaaagacaccttatcaaatggtggatggtatgaaagtaaagattgactctacttttacacaaccagctcatcaagtagccaaagaggccaataaacgttttggtacggtggttgataacgtagaggctgtcttgaaccgttatttacctccttctgaagatgatggaaaacatcaagaaaaagaggtcaatcaagctatacgtgcctactatttacttaaccaggccacctttcgtttatctcaacatgttcaagagcaggtcaagaccacagccggacacattcctcgttcaccttccg

SEQ ID NO: 52151 - DNA, 484 bp, Triticum aestivum
  unsure (1)..(484): unsure at all n locations
  Clone ID: PAT_TA_52151
gccgagcatcctggtgcgccatcctggccgtggtcctggccacagccctcaacacagacgagagacgcttaccagtgtggttgccagactggcggaaacagtttctcatactgtatatgctgctactgatgcaggtactgcggctactgcgacgcctactgtgatacccagtgtaagagctggtgcaccagctgtggccgcaccagtcccggccgcagcctgtggggcatcatgtccagcatcatcttcaaggacctctttgttcagctcattgtttaccaaaatgactgcgagtagtacaggtgctactacttgttcgacgccttcgtcgccgtcgccgccttgttcccgtcgttgggcacggngagggggacggggacggtggnggggttggtgggggnntttttgggggagacttctggcgggtggtctggggggtgggnnggggcgtnngnntgggggtactgttgggggtagtggttgg

SEQ ID NO: 52152 - DNA, 574 bp, Triticum aestivum
  unsure (1)..(574): unsure at all n locations
  Clone ID: PAT_TA_52152
cccacgcgtccgggacttcgagcaggacccctcgtctgcgccggagcctccaccgccgatcgaggggtcgtaccagctctttggtgctacctacacaacggatgtggtgctgccaagtctggaggatcaaggtgttcgccagctttacccaaagggtccagatatcgacttcaagaaggagctaaggacactcaacagagagcttcaactccatatcttggagctagcggatattttagtggagagaccatctcagtatgcccgcagggttgaagacatttcactcattttcaagaacttgcaccatcttcttaattccctacgaccacaccaggcaagagcaacattgattcacctccttgagagccaaatacagcgtcgtaagcaagcgattgaggatataaaacagaggagagaggaggcacaaaggctgcttggggaatcactggttattattgaggggagccagcagcaggttatgactccaatgtgaaggcctctgatatcctgngtttcaggttatgactccagtgtgaaggcctctggtttcctgggtttcctggtgccaagttgg

SEQ ID NO: 52153 - DNA, 510 bp, Triticum aestivum
  unsure (1)..(510): unsure at all n locations
  Clone ID: PAT_TA_52153
tctttgcaaagtgcacatttgtgcacacattattggatgatatcaacgacgttagtgccaccttggtggagtatcggaagctagacgcagccatacagagatggaatgagagtgctgtttcccttgtgcccgactacttgaagaagttctataataaacttctgatgtgcttcagggagttcgaggatgagttgacacttaatagtagatacccgattgatcacatcaagaagatgttccaacaacagtcaaaattttatctccaagaaactgagtggttacaccagaaccacaagccaagctttaaagataaactgcatntggttgncatgtncacgggcgtcaccgcgctatgtgtgtatacgatggtttgcatgggcgatggagcgnccaagggagcactngagtgggcagttggatacccagatgtgatcatggtgtgcgccaagattgggcgcttaatgaatgaccttgttgggtaatttaaacaccggaacaataggggggacg

SEQ ID NO: 52154 - DNA, 580 bp, Triticum aestivum
  Clone ID: PAT_TA_52154
gtcagcagacaacttgccaccccttacagagacagatactttaatccaccatgaagaacatgatcgtgaactgagccgtgtagtgatggtatgcttggatcctgattcagccgatactgtcttcacttgggcgaacgacaattttattattcctagcaaagatctcgtggtgttggttcatgtacgtcaaattgatatccctgttgcaccatatattaacacaacaggctatattgatgatatctctgaagaaagaagagaagaaagtcatcgtttactaagatactatgctcaagatcttcacagaaagaagattgcttgtaaagctatttcaatggtgggagaccctaaaacagaactattaagaaaaagtaaggagatcaagagtgatgtggtattgatgggagcaagaaagatgggcgcgataaaaagaacattactgggaagtgtaagtgattatattgtacataatgcaccttgtgcagtaattgtaactaaaccaatggaacctgaacacgttgaggagcgccgtaaatcaattcagacactcacatctgataataacgcaaaatgattaaat

SEQ ID NO: 52155 - DNA, 532 bp, Triticum aestivum
  unsure (1)..(532): unsure at all n locations
  Clone ID: PAT_TA_52155
atacttgaagaattagccgtcagaggccatcatacgactttctatacacgtgacgatcaggcaaagttcatcaagaactttcctactgttgatttggtctcggccggtcctgctgtagcaacaaaagaagaaatgggaaacttgattcgcaatttaaccacaaaggaaccagttgataggctcgtttatatgttggaagaattttcacagaactttacagaggattatctcaatcatatggatttgtttagtaaaaaagatgtggatcttgctctttgtggtcatatcatgacggcctgtgttgaagcttctatcgttaataaaataccttttatagtcacttccgcaatcccattaactcctgatacagcagccccttatgtcaacaccgatatgctatctcttcataacccaacaagncaaaacgttccattttttacacgtttaaaagaaaaggtgattgatcccatacgcgttattatcaaagctagggagcttcatcaagagatttcaaccaagaacagatggcact

SEQ ID NO: 52156 - DNA, 392 bp, Triticum aestivum
  Clone ID: PAT_TA_52156
gtctcgtgaaaatgtgaaaatggttcggatggcttccgtacccgatttcggcacgcaatggcgtccagtgtctctgtagacagcacttgctaacgccatccgcgatgcctgaggcgtcgcctgaacaacattaaggacggtgtggcgctgcgggatcgctaactgcagacagagcgtgcgagaaacggctatggccgtcacaaacctatgggatatgataagaacaaccggccggtggcgtccctgacgaccccatatgggctgaatggataagaacgcgctgccatggccaaggacgaagaccacatggcacacggccatatgggtccgacaacagctgtgacacttgtcgcaaagacggtcgacactgtagatgacatactgctctagtt

SEQ ID NO: 52157 - DNA, 467 bp, Triticum aestivum
  Clone ID: PAT_TA_52157
caattccctgaacaagaagatttaaataatactgtagactcttactctgttactattaatggcttcatcttttgtacgcgtcatggcctagaagtatgcgataaatgtcccacggataatcgttcggcgaataatatgatggtggaagatatgcttcatgacaagctgtcagaagaagaatactcaaccaaatggaaaggtgatgaacgagaacctttttcagttgcccacaagtggactcgggtcgctaaaggtaaaccgggctgcatggcgcacaagacggtggcgtgtgatgaatgctttaattggggtgagcaactctaccgtggtattcacggcggtcgtaagccaagagtgtctcgtgttcaacgcaagagtcgcgataacactgacaaattgtcataatctctcttgtattgcggaaaaaaaaagtaaaataaaaacagacacgatttacatgctctttt

SEQ ID NO: 52158 - DNA, 538 bp, Triticum aestivum
  unsure (1)..(538): unsure at all n locations
  Clone ID: PAT_TA_52158
tccaaaacaactccattagagcttagtgtagaagaagctatcaatgaatcaaagagatcaagttcatttcttgtacatatgcttgggatgattgaaccaagtcaaatcaaatcaaatgaaatagcaaaggactcatatgaagaatgcttacagctaagagaatatctttcagaacaactttggtctgttactgactatgaaggtatctcttctgttcaatctgctttggatgatctttcttacagtttatcaaaatacgaatccattaatgatactattgacagagagtgtgaattcatcgatacttctcgctttatctctgcttgttaataatcatatatacccctttctccattctcatcacaataaactttttgtcgtcttttaaaaaaaaaaaaaaaaaaaaaaaaanaaaaaanaaaaaaaaaaaccanaaaaanaaaaanaaaaaaaaaaaaaaaaannaaaaannaaaanaaaaaanaaaaaaaaaaaannaaaaaaanaaaaagggggggccccttttaaaagaaccaaa

SEQ ID NO: 52159 - DNA, 546 bp, Triticum aestivum
  Clone ID: PAT_TA_52159
aggaaaacgaatgattctttatttttttcttttatagagcatcaagcagacttcaccttcaccgacgattgctttaagccataggaaaccaagcgatagacaccaaagagtgacccaaggacgacagaaagcgaaaagagataaagatccaggttgtatgccttcaagaaggaaagatcgcgtctgacatctcgtcgatggttgatcttgccatcctgatgcagatagagcgcctcttctaccacatcagcaccgcgttggacaccatggttggatcgaatctggaccaaggccttgaagcgactggcattctgtctgtatcgatcatcacgcaagacctcttgaaccaccttgattgcctgctcctgatcgttcttcttcattcgacgtccatagccgttctcttcggccatgatagcagctgcaggttgatcgccaaagaagggatagacgacgatgggcacaccattgtagagtgcttcataaaccgaaccagctcctccatgggtcaagaacaattgagtcgagggatgatgaaggatagcg

SEQ ID NO: 52160 - DNA, 535 bp, Triticum aestivum
  Clone ID: PAT_TA_52160
ctgcctaattttatgaattttattgaatttcaaagaaataaatttactaaactagttagttttattttatttttttggcgaggcgaacgacttgacatacggctgtcatcttctaggaggagatccgggagaggattccattttgaacactttcaagcatttttcggcacttttgcttatcaacacctaaatatttaaataagatggtttggtataaaaaaaaggcataatacatagtattgcatttaatttggtcattatgtcgaacacatcatcaagtctgttcaaaccttgtgcattacgagggaaaaagaaagatccaatttcgaacaatcggtatactttggtatacaccagatacataacaaatacattagcgtgatgcccaaaatgccaaatacaggtgtatcttctggaaagtctcttttcagcatcaaagccacttcatccttcattaagtttcctagtttagtaaagtccggatggtgtgcttgatcttccatacaacgttgggactctttatttccatgtgcag

SEQ ID NO: 52161 - DNA, 558 bp, Triticum aestivum
  Clone ID: PAT_TA_52161
gtattgaaatcatttacctttattgaatatatacttacaaacaacacatacaagtacaaaactgtggtaaaaagggaataccttggaaaacccatttattttcattggctattgcctacaaataacacgcagcgtacaccattagataccttaacagtttaattaccaaggacttcaccagcactactctgatgatttggggaaaccagaaagcttttctccaatgacacgctgtgcttcagcgactagcctcttgacaacttcccttgctggtacaatctcggtgattagcccaacactctggccagcatacatggccatgctatcgatatcgcctgttgttgtcgcattaggaacagtaccagcaaaccggcatatatccttgtgcacaccatggatgatagaatgacctataataggctgattttcctctgtttcatgatctggaagattcttccactcaacatagaaaggtgtcttcaggacacgttgtggagcaccaggccatctagcacgcccgaacacagctgtatagtccgtgcaattcatctcaattag

SEQ ID NO: 52162 - DNA, 180 bp, Triticum aestivum
  Clone ID: PAT_TA_52162
cattatccggagggcccaaggcttgaaagggccctcaactgggatgctaatgagtaaactgggacttgggaggcttggtaagcctggcccccagcttgcccaagtggagggccgcgaccttctcgtcgaggtgcttggggaggacgtacacctttttcttgtacttgccgggggcctttt

SEQ ID NO: 52163 - DNA, 521 bp, Triticum aestivum
  Clone ID: PAT_TA_52163
cccgaactaaaaataatagcttctggaatgcatcatcataacagattgaagttttcaaagcaaaagaaaataacagatccataacataatgacaaggctggatgtggactctactttgcctgactgaccacacagctagtatcatccataaatgaagagagtcaaattcgtacccacaaaatgttatcaggaaacccagtcctacatagccctggagaagagttcaaccatgagcctgccacagtatcagttcagatgcgtacccaataaggtatctgcttttcttttcacattctggcggtgtttgtgatcaaccaaaggtcagcatcaagaatgtctctgccgatagtcaacgactcaccaaggcatccaatattaaatggttaacaagttgacacactgtactcgacgtgatctataaatcaaataattcatggctagttcagccaggtgtttcagacggttctccattacaaacctattacatcttagaatacagtagaatacattaaaagtgggca

SEQ ID NO: 52164 - DNA, 501 bp, Triticum aestivum
  Clone ID: PAT_TA_52164
aaaggacgacaatacaagggatttattagccaataaggtctggttaaaaaataatcccataattggtaaaattctttggcataggcctaaacaacagagggaatatgggtaactataacattctttggatttttataacgcgcacccgcactccaatggaagcttccggggatgaccattttatcgtaaatcactgcaaattggttatgcataaatggatcactatgggcgtattaaaaaggaattccccagggatcatgcagcctacaaacataagcacccttttaagggcccatctgatcattatctggaaggatccgaacatccaaaccttttttataagcatcactcaacacacgagccgtttcattgtcagtcaaagaaaacacgcaaacataaagtgttctttttgcaaaaaaaagcgcaaagggaaatgtcaaatagctttcttcaaaagggaaaaagatgggaacacaaaaggtgttttcaggtaaaggccct

SEQ ID NO: 52165 - DNA, 454 bp, Triticum aestivum
  Clone ID: PAT_TA_52165
tttttctttttttattttattttatttttattttattttttttctttttaaaaagaccacaaaaagtttttgggggggaaaaggggaaaggggggttttttgattttaaacaagccgagataaagggggaaggttcgggaaatccccccccccgggaaaaagaataaaaaaggggtccgtttttggaaaaacgggaaaaaaaaccccccaaagcaaatggaacaaaaaaaatccccttataggcggaaacaaaccaaagggggtcgaaaaaaattcttttaaggggaaacattcttaaaaaaagcccctggctttttaattggattggattggaccggggcaaaaccccccaagcatttggccaaaaaaaaaaccgggccccttggaaaaaaggaaagcttttttaaaacaaaacttaaaaggaattttcttggaacggcccccggggtcaacc

SEQ ID NO: 52166 - DNA, 548 bp, Triticum aestivum
  Clone ID: PAT_TA_52166
gcaggtcgcccttttttttttttttttgccttggaacttttttgcattgattcttcatcaaaacattaacatccgagtagaagaaagttctcaacaggaagatttatactgaccaaaggccagagttctgaacccgctcaacatttacaaagaaagaaagaacatacaggtgagcaatggtgaaaattttgaagccctgacaggctactttacttggtagaagtaaactcatacatacatggcccctcagaatcaagttgaccaaataagtattggatcaggttcttgcagtgataactgatatgcaaagatcactctataagccagggtgtttgaactgattcccattgagcaagctcaccctctttgaaccataatccgatttctcgcttgccgttatcagggctgtcacttccgtggacgacattccttcctgtttgaactgcaagatcaccccttatggtcccctggctcagcttggaaggggttagtagctccgatcagtttgcgagctgacgcaacaacaccattaccctcccaggccatgc

SEQ ID NO: 52167 - DNA, 462 bp, Triticum aestivum
  unsure (1)..(462): unsure at all n locations
  Clone ID: PAT_TA_52167
tttcccagcgtccgcccacgcgtccgctgcggaggaaactgcggctgcagcaccgcctgcaagtgcggcaacggctgcggcggctgcaacatgtaccccgaggttgaagccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcgtatcgatctactactaccataccatgtaaccgcaacctgatcgagggcctttatgtacgcacctgacctgcatcagcagtcaggtgccatgccatgattgtaaacaggcccccctaaataaaacctcccttgattaactaanaaaaaaaaaaannaaa

SEQ ID NO: 52168 - DNA, 597 bp, Triticum aestivum
  Clone ID: PAT_TA_52168
atcattactgctgctcgtaatgactttatcaagcgattgtctcatgagaacatggatcaagaagcttatgattacgcagtcaagcattatgaagaaagccttgagtctgctcgtgtgtccatcttgactgaggtgacagaagtaaagaagattgctattgaagcccacaaggctggaaagactgaggtcctcgatgttgagcttagtaagaaggtcatcgaatctactgaacgtatcaaggtcgctatgggatcttctgtctcaatcacacacaaaactcagtcaggaaagaaactttcttctgctgattcaggtgctgtattgcaaattgaggtgaaggatgatcaggaaattgttggtgaacaaggtgtagaatttgaacgaaaggaagaatcagtcgatgtagtccgtaaagacaaggtccaaaaagaaaaacatggttctagccttgaaaaagttgttgctgggtcgttggctattggtgctgccgctgctggtgctgccgtcttggttcatgaaaagaacaagaaggatcaaaaagaatctcaaaagcaaagctcagtcctcaaatatgacacgggcattgccacgattgag

SEQ ID NO: 52169 - DNA, 462 bp, Triticum aestivum
  Clone ID: PAT_TA_52169
ggacccgggcgatggcaggaccgagggctacggctccacgccgcggaaggcgacctcgggggcaagaaggcctgggcctacttcctcttccacaacgtcgcgccccaagcggggggaagcttagtactacctccgtaaactaatataagagtgtttagaatactaaatactaatctaaacactcttatattaggttacagaaggagtactactatacagtaaagcggaagagaatgagacctttttgagaaggttgttctaccacatgttattgggagtctggaaagaaaagttgtacacacgcgcttctccttcttcgttgcccgcctcgccacactacgccacgccacgcctcgcctagtcacggcgcgcgcgcgccgcgcgttgaggaatgagccgagccgaagcttatttttatcggtaaaaaatggttaattaaaaatatgttgaattaccgtgaag

SEQ ID NO: 52170 - DNA, 403 bp, Triticum aestivum
  unsure (1)..(403): unsure at all n locations
  Clone ID: PAT_TA_52170
ataatccanacatcatgcctgctcttccattcaactcgtccgctgcttcgtcaccttcatcatcacctaccttgtcgcctaccatgacgccttcaatagttctccatcccgcatcgggtgtctcatcacagaagaaggagcttctcaagccaaaggaagatcctgcgcaggcctaccgcatccgttatgcgcagtacctcgcagctacctttggcttctcgatgcaagctgcgctcgccgaggcggattgccagctcgcaccgagacgcacctcaagttcgagcatgtcggaagctgagtcgttacgcgcgatttgagctggtgaatcgcggaagggtgttttatgactttatgatgcatatatagggtaatgggcattgggatggggtatttggcgcatagt

SEQ ID NO: 52171 - DNA, 514 bp, Triticum aestivum
  unsure (1)..(514): unsure at all n locations
  Clone ID: PAT_TA_52171
gatcttggaaggatgcaaatgcacgataggaagaaagctatatgatgacaacgagatgctcgacagccatcatagagtcctcacgtttggaccatacgtctccatgccacacanntccacaccgaggtggcncccttcttagaactcaagnaatacgagcnnncactcaccaaggttgcaggctaggtgttgtagctaccgtagagcacctaggaatagatcatctagaagcagcttcagaaagctacagnagcaaccgctagagcaaaattaattatcataaagcatagaccagacaccagtagagcatggtattagtgttcatacactagatggttatagttcttcagataggacaattgcatcagatatgactatatcaacatcagacgtgaatgcacttcatttgtacacgatgacaaagtgcatagcaatgatacatccaccagtgagcaatattgcgtgtagagtcaactgatactttcccacaattggcagagtattggcttccctc

SEQ ID NO: 52172 - DNA, 588 bp, Triticum aestivum
  unsure (1)..(588): unsure at all n locations
  Clone ID: PAT_TA_52172
tcgagnatggcaatttctttgggtccctactgggccttgtctacagtttctcttctcagcattgttgggctttatatgcttttcactggttcaggtgaagaatttaacgttggtaaattacttcaagaaacttctccttatgcttgggccttgactggtatgggtctttgtattggtctctccgttacgggtgcagcttggggtattttcattacaggttcagcacttttaggtggtgctgtcaaaacacctcgtattcaatctagaaatttgatttccattattttttgtgaagtcgtcgccatttacggtgtcattatggctattgtttattccgctaaattaagtgatgtacctgccgaccagttatacactaattccaacttcttcacaggtcatgctatcttttggggtggtttaaccgttggtatctgtaatttattatgtggcctctctgtaggcgtaacaggatcaagtgctgctttggctgatgctcaaaatccagaattgtttgtcaaggtattggntgtagaaattgttggttcagtactcgggctctttggtcttatcgttggcttattgactact

SEQ ID NO: 52173 - DNA, 563 bp, Triticum aestivum
  Clone ID: PAT_TA_52173
ggctcggcggtgatcatcctgatgccgctggtggagagctgggacaccatcagcatggtgtgcgcggggatgttaaccaacgacatcgtgtaccagcgcctggacgacgtgaacctgcggctgagggccatcatgggggccatgcccgaggccgagaagcgctaccagcagctgcagcggaaggatgaggtggagatgcaccccgccggcacccacccggccgacgacagcgaccaccttttggagaactagaatgatcgatgtatgtatcatgtatgtacaggggcacgtttatttccggtcacaaaaggtgtaaccattgtcacgggacaatgcgcacccgtatcacgtcgggtcactggagtttgtaatatttttcttcgcgtgtgtaaagatatgcgtgattgggtatataaatgcgtgtgtctcgtgtgtctatggccgtgtcctcaaaacatgcaattcttccgtgcacgaaagctgcgtgaatcagccgtgcactcagctaggaactggcagaccagctaatgtatgcatatgtgtgtgtatttttatatgggtat

SEQ ID NO: 52174 - DNA, 205 bp, Triticum aestivum
  unsure (1)..(205): unsure at all n locations
  Clone ID: PAT_TA_52174
tgnttggcccgagagacgcgtgatctttgctgttgctcattggaacctcntttaactaggtactctcgcactgttatttctgcttctcggcgggtggttcactgcggctcctgtgcgctgggccctcgcctggtctttggcttggcttttctgttcctcttgccctggtggggtgccttggtggcctctccgcgttgcccccctt

SEQ ID NO: 52175 - DNA, 208 bp, Triticum aestivum
  Clone ID: PAT_TA_52175
aacccctgaacatttaacccccgattttttttttaaaaattatttcgacttgcttttttttcagcctttttagggtcaagtgcccaacattgttccaggctcctcaaagctgattttggggtaaagtttactggcactaaggagattttgctcaatctttgcccgctcaagcacagtaaacttgtctggcaaaagggctttttgatgc

SEQ ID NO: 52176 - DNA, 445 bp, Triticum aestivum
  Clone ID: PAT_TA_52176
gaaggaaaggaattttattggataacgggaataggcaaactggtgggccaagaaaaaaatatccaatgcataaaaaaaaaatttttaaagaaccctgttttttggggggggggggggggtttagggaatgcaaacattacaggttgtaatgctgttgggaagtaaaaaataaagtttttgaattggaaaatgttcctatatctgcttgacctgataattgaccaaaagtaccttttaaataatcttgcacaactttacactggcagtttccatgtgttaaaagcaagtttcgaaaataaacactttcatcacgaaagttgagttaccttggtcttggaatcccttattctttttttttaaaaaggctgatttttcttctaattcttgaacccaccttttcttcttttggctccctttttaacccgcctggcgattttttcccaac

SEQ ID NO: 52177 - DNA, 488 bp, Triticum aestivum
  unsure (1)..(488): unsure at all n locations
  Clone ID: PAT_TA_52177
gacgtcntagctcttctcttgtgtctcctnttttcntttctctggccgtcgttttccatcggcnntttccgcgtgtgntcttcggggggggggggcttgctgccgggccccggcttcgctcgccgcccccggctccccgccggcggggcccctcccccctcnttcgcggcgngnggcgngtggtcctggccgggccctgccgcnccccctttctctcgtcgccggtctcccgccgccgccnctgtccccctgcccgcntcntccccgcccccgccccgggcgcggggccccccccccccccgcccgcgccccgcgcccgcgcgggtgcccccccccccccctcgcgcccccctccgttcccccccccctccggcccccgcggcccgcccngcggcccgccctccctcccttcccccctttcttttttccccccctttctctctctcctcccccgccgccctttttctgtctttctccctcgcttcctc

SEQ ID NO: 52178 - DNA, 540 bp, Triticum aestivum
  Clone ID: PAT_TA_52178
cattggatctgtgattggatgttaatcgagatccgagcttttattattttgacagtcttcaatcgggataaagtgactccggattcgaatctataggctggccctgttcccgtttttgttttcaaggttggcttgatcacggagaactcgacggagaatctttccggcaggacttttgggtatagcatcaataaagcgcacacttcttatttgtttataaggagcgacttgatctgctacatatttcatgatttcctttgccaacttttcagatggttgaaagtctgatttcaaagtaatatatgcacgaggcaattctgttacttgagcactgtcgtaaacaccgacaacagcacaatctgcaattatgggtgatttcaacaagatgccttccaattcagcaggaggaacctgaaatcccttgtatttaataagctcttttaagcgatcaacaacaaaaaaatgctcatttttatctacaactacaatatcgcctgtatggaaatatccttcattgtcaatgcaatctgctgtggcttc

SEQ ID NO: 52179 - DNA, 534 bp, Triticum aestivum
  Clone ID: PAT_TA_52179
ataatatactagtataagatttcttattatttttcaagaccacacaatccatacacgcataaatacaggcgaccatattgtaccagacgcaagttacaccacagagcacgtgaccagtagcacgaacgcatgcagctagcttattgcagagacaccgatattataagagtgcgtaagcaacacacgcatgcctgcatgcatgatgctctatcgatcttattggagtctatacgacgatcggtggacgttggatgcattgcatgcatgattactcagttgcagtagctgttgtggacgggcatcctgtactcctgctgcccgccgtacgcggcctgcttctgctcgcggtgctcgtggtacgcgtagccgccggcgccgagggccgccgccccggccacgccggcctcgatctggtgcttcctcgcgtgcgccgggtccttcttcacctcgtacccctcgtacagcgcgaaggcaccggcggcgagggcgccgacctcgccgacgcgctccctgttcttgtgctgctgcacttac

SEQ ID NO: 52180 - DNA, 541 bp, Triticum aestivum
  Clone ID: PAT_TA_52180
tttttttttttttttttttttattttttttattttttttttttttttttttttttttttttttttttttttttttttttttttttttttttttttttttttttttttttttttttttttgaggaaaaagggggaaaaaactcctttttccgggaaaaaaaaaaaatttccatccctccggcaagggagtttttttaagaaaaaaagggcaaaaaaaaaaaggggaaagaaatttacattttttatggggaaaggggaaaaagcaggggccaaagtgaaccgggggcattggagagttatggtggggaggaaaacaaaaacttggggggggggggggggggggccttgtcgaggggggggcccaagggaaaaaaaaaacaaaacccgacgggggccttggaaaggggccccaagggcggggtaaaaaaccgggggctgaaaacccgggggggggccgaaacactttggttagccgggagggcaaaaatttccgggggggccccaagggccgcgaagaaaccccccggcggggttttggtttt

SEQ ID NO: 52181 - DNA, 451 bp, Triticum aestivum
  Clone ID: PAT_TA_52181
ggaagggaatcccgggggaatttatgataatcaggctaacatcccccacttaactcagagccccaccccaaggccccagggcaatttccggcaaaaggcatgaacctcccttgggacccatccaagccccgaagcagcatggcttaaacccttgccccctcaagaaacgaaccaaaaacaaaaattctagaaccacatctcggcccctttggggttcaactctcggggataacaaacagacgggacatagggtccccataatcaagaccccgccctaaaagccccttattttaaattggatagcccgccccccccttaaaaagcttcacgggccccaccatagcccccgcccccttgggcaccaccgccgtaaccgccgcccccgccaaagccaccaccttctccatagccaccgccggcgggggagaagccccccccacccgaagggctt

SEQ ID NO: 52182 - DNA, 203 bp, Triticum aestivum
  Clone ID: PAT_TA_52182
caaattatagtccaatttttaaattgggccttgatgagttactgttaataaggtggggggccatacggccaaattttttttcgcactatgtccactttttttgggggggggcaattgcaaatcccgcacaaaaaaagggatgggcgggcgtgcacttgtttttttcgtttatggggggccccaggggggcaaaaaaatgaccc

SEQ ID NO: 52183 - DNA, 526 bp, Triticum aestivum
  unsure (1)..(526): unsure at all n locations
  Clone ID: PAT_TA_52183
cggcgccgcccttctcnttttttttatttttgttttatttttctttttttttatttttttttcttttttttttaacggaaaggaggcgccatgttttaaagttggaggcatgagcaaggacactgctggtggaaaacacgggcgtacaggtacagagttaaggaacacacgacggttttattttattcagcgcgcgcccgggcgggcccatgcagcggctaatgatgggggtggagggggtggtggttgcttgtccaggtgtcctcctaatcctcgggctcgcctcgccggccggcctcctgggcgccggctcatttgcaggtgcaacaagagcagccgcacccggggccaaacttgcagggggtgcattcgcagaccccggtctccccgccggtcatgttgaacccgccggagctccccttgtgggaggcggagggcatgaccatggcgggggcgccggcgggggcctccacaggcggggaacattttgcaccctacgcagccgttgacggacttgcagccgggg

SEQ ID NO: 52184 - DNA, 409 bp, Triticum aestivum
  Clone ID: PAT_TA_52184
aggcttgatatgcttacaatttttacatgttcggagcggcggaaaaagaggtggaaaaacaacaccaaagggggggggaggggagtattatcaacaaccacagcaacccaaccccgctctaacatggggggccccataacccaggggatgcagaggggacggacaagcaaaggggaccaccggaatggaacggagcgcacaacaaggcgggccccgtgtcctacacaaagagctcgggcccggagacgaggaccccggggggacccgggaatagccacccggcgccggaaagcctgccaccctccccggagaccgggacgtgcaaatcgcccagcaactaggggaaaaccttcatccgggggaaaatgagggcgcgcacacaattgcaaaaaccaaaggaggccggaaa

SEQ ID NO: 52185 - DNA, 565 bp, Triticum aestivum
  Clone ID: PAT_TA_52185
aggttacacactgaaatgtttgtttattgtaagaaatgagtggcatctacgttacactttgaaatgatgatattattttttttagtctttagtgacattatgaatagcttcagcaagatatttgacattagaagaagaaataccagccatggagattctaccgtcttgtgtcaagtaaacatgccaatcagatttgatcttgttgacttgttcgggtgtcataccagaataacagaacataccgatttgatcagtaatatgtctccagctctttttggatccaaaatcattttcaagatgacctctgagcttttctctcatagtaataatacgatcagccatcaatttgacttcaccaagccattctttcttcaattcgggtgtgttcaacacagtgctgacaatatgagcaccgtgaatgggagggttagagtacatgggacggatgatgatcttcaattgtgaatcaacacgagccttttcttcagcatcagcacagacaatagagaatgagcctacacgttcaccatagagacccatgttcttggcaaaggattgagccaaa

SEQ ID NO: 52186 - DNA, 526 bp, Triticum aestivum
  unsure (1)..(526): unsure at all n locations
  Clone ID: PAT_TA_52186
gagaggctcttcccggctccattactatnatgaaaccacatcatccatgtcagctcttatacgagcagagcagttcaatcaagaaaagtaacaaggcgaacttggagtgcccttattgtatgtagaaaggactataaaacaggcaaacgtaaaaggaaacacaaaacgtacgtactgtacagcgaatgcaacgcacataagttaatggctctgccagttcaaccattaatttcaatcaaggacacatactgtaccttgtcggtaccagcatgagtggcgtcttctttcggaaagtcagtgcccctgcctcctccatgttgatatcctcacagctcaccccatcagggagctcccagttgaagcagtagagcaagttggccaagatgaactcgacattggccacgcccatggccaatccagggcagatccgtcgtcctgagccaaacggcaaaagctcgaaatgtgccccattgaagtcaacatccttgtcctgaaacctttccgggcgaaattcctttggatcatc

SEQ ID NO: 52187 - DNA, 168 bp, Triticum aestivum
  Clone ID: PAT_TA_52187
aaaccaacacaagggcttttatttccttttttgcacagacacagtacgacagacgaacccgggaacaccgggtcacaacacccaccattattggtcatggggtttacacacgatattcatttcactggtacacatttttattcagttcatgggccccctccttggctc

SEQ ID NO: 52188 - DNA, 566 bp, Triticum aestivum
  Clone ID: PAT_TA_52188
tttttctttctttttcttttctttcttttttctttgtttttctttttctttttttcttttttttttttttttttttttttttttttttttttttttttttttttttttttttttttttttttaacgggaaaaatggggggccattaaaaaaggcgtttaacggacggaacagggaaaccaaaaggggtttacaggatcccccggggaaacataaaaaattgggaggatggggggggccccaaacttttataaagccttacaaaaaaaggggttccaaaaaaataaagctttaatcaggtaagagccccccagattggggtctcccttaagcccccaaaggggggggggggggggaccccgccttccgggggggggggggctttttggggcccttggtgtcgcggggggggggggggatcccgctctccccaggggggggcctgaacttaaaggcctgggccttcctggtcctctcgagggggttccttttgcgccccccctttttggttgaaaaggagaggcccctcgggatctctggggcccgcccgggggccttgggggggggg

SEQ ID NO: 52189 - DNA, 176 bp, Triticum aestivum
  Clone ID: PAT_TA_52189
gggggttgtcccggcatttcactggcaatgtgtcaatggaattgcgaaagctctcctggactctcatctaccaggggaggatcttccagcgctggttgtcgccctcgcaccacttgcagagcacgacctcggtgccgatgtggacgccgccgtgggccttgtcgtcgtggaaggcg

SEQ ID NO: 52190 - DNA, 311 bp, Triticum aestivum
  Clone ID: PAT_TA_52190
tgaaaaaaatttttggtttttgggcttaagccaaggcggcctttgttcctgttccccctcccggggggccccatttttaatttcccgttccccccggttaaacccccccaaaaaatagcctgccctgggaaaaagttggaatttgggttaactgggggggggggcccttatttattttaggggaataaacaattgccttaatgaccccgtaaatggggaccacttcacaaaaaataatggaaataaaatttttaaattgaatacaaggggttttgacagccccccctaaaagggctgaacctgtaatgaaa

SEQ ID NO: 52191 - DNA, 444 bp, Triticum aestivum
  Clone ID: PAT_TA_52191
atataaaatatacatataaaaatatacatacatatgaaaacattagcggggctggaaggtcctagcggggggggcgggggattaatgcagctttcgggcccggaaaaattggatggttggggggcccgggcctagacacacgagacacacgcatttttttacccaatcacgcatttttttacccacgcgaagaaaaaattacaaaccccagggacccgacgggatacgggggcgcattggcccgggacaatgggtacacctttggggaccggaaataaacgggcccctggccatacatgaaacaaacatcgatcattttagttttccaaaaggggggccctgtccccggccgggggggggccgggggggggcatttccaccttattctttcggtggaggtggtgggagcgcttttcggcctcgggcctgggccccatgaggggc

SEQ ID NO: 52192 - DNA, 401 bp, Triticum aestivum
  Clone ID: PAT_TA_52192
gagaggctcaaaccggcttcattgctatctttaaacctcattaattcctgtcaggtattatacaagcaggagcatttgaacaaagtataagttacagggtcgatcattggtactgcccacttatttactcgcccatatggactccttacccacgcatagcgtggcatggacaacacacaccgctccttactgggcagctgaatgcatcatacattaggtaatggctctgacagatgaaccatcaattgcattcatggacgcatactgaaccttcttagtaccatcgtcagtgccgtgttctttcatgtaaacatatcccttggctgatgcatgttgacctcctcacatgttatcccgttgtggttccaaaagttgacccactacgacaggtccttctccat

SEQ ID NO: 52193 - DNA, 613 bp, Triticum aestivum
  Clone ID: PAT_TA_52193
caagcgtaccttgtcttctttgacccaaacactgtcgaagttgactctctctttgacggtgttgacttccaatccaacatcactcgtgccaagtttgaagaaatcaactctgctgccttccaaggtactattgaacccgttgaacgtgttttgaaggatgccaagattgataagaagaaggttgatgaaatcgtcctcgttggtggttctacccgtatccccaagatccaatctcttctccaagacgtctttgacggtaaggaattgaacaagtccatcaaccctgatgaagctgttgcctacggtgccgctgtccaagctgctgtccttaccaaccaagctggtaacgaaaagacccaagacctccttttgttggatgttgtccctctttctcttggtgttgaaatgcaaggtggtatcatggctgttgtcgttccccgtaactcccccatcccttgtcaaaagtccaaggttttcaccactgctgctgataaccaaaccactgtcactttccccgtctacgaaggtgaacgtttgatgaccaaagaaaacaaccttctcggtgaattctctctctccagtcttatccctgctccccgtggtacccctgaac

SEQ ID NO: 52194 - DNA, 595 bp, Triticum aestivum
  Clone ID: PAT_TA_52194
gcaaaagtctatgatttagacaaacaacctacaccacaagaggcagaatatgtagtaaaaagactttcttcaagcttcaactttttagacaacacaaaccagcccatgacacctttagacgacaagtctttaaagattgctactttttctttacagaaatatcttaaagaaaaagatttcgcaaccgagttcttggaaagaggaggacttgtatctttatgtgaaatcattcaaagttcgagcggcaacacattagcttatgcactcaattcttttctttcgcttatggagcacaataccggctgggacacactggatgacgtatttgttgcttacattgcaaatatcgtagtcacccagcctctgtcaaccattgctcgacctgcgactgccattttagaaaagttagtttgcgcgaatgagttgcaagaagagaaaacgggcgtttcgtgttttggatatccaacgatccacagggcaatgataggcgaaccagatttgatcaagatattagtagaccgactactgagtccagaatatttattgtccacttcaagtttatcactcttaatagccatgctgagacatgccacag

SEQ ID NO: 52195 - DNA, 579 bp, Triticum aestivum
  Clone ID: PAT_TA_52195
caagcttcttgaggtccacttagccggctggtccatcaacgatgagctccacagatgccccagctggcaccggaggcctcgccggtgagtcgtggcagaagtcatggccagaagtggtgggcaagtccataaaggaggccagggagatcatactcaaagacaagcccgacgctgacatcgtcgtgctgccagccgggtcgccggtgacccgggacttgaggcccaaccgcgtgcgcatcttcgtcgatactgtcgccgacacacccttcactggctagctctacctttgcaggtgccaaggaatgtatgcctgcgccatgtatgtgcgcatgcgcatgaataagttttaagtaattgataaataaacggctttgctaaaaatcagtcgactgagacttcgcgaagtctcagtcgacactacaatccgttgatcttgcattgagatttgtgcaaataatttttttttcattttttttcttcttgcatactacattgtttgactgagacttcggtcgactgagacctagacaaacccataagtaaatgctagcatgtcgagcatcagcatggcatggattg

SEQ ID NO: 52196 - DNA, 517 bp, Triticum aestivum
  unsure (1)..(517): unsure at all n locations
  Clone ID: PAT_TA_52196
ctttcataatanttcgcgacaatatgggtaaatcaaccatacgtcagactacaaagcatgatccaccttctatcagcgattgttcagaaagaagaccttcggttacagaagagtgtgatagtgtattgacaagattcacagctcaaacagcaccagaacctatttctatcagaaggaacagcagaagaagtagtgccaccgtatttggtatttccaacgttacttttgacgattacgtacaaaaagacctcgtttcaagttcctggagttaaaaacaagatagtttataatcttcttctttgctgaactaagtgctctttttggttactttaaagagtctacttctttctcactttgatatacaagtgtatggcaacttcatgtcttctttctcaatgtccttctttctgtaaattcatgtaattagcttcttttttttaataaagattgtagtttataaattatnaaaanaaaaanaaaaanaaaaannnaaaaaananaaanaaaaaannaaaaa

SEQ ID NO: 52197 - DNA, 421 bp, Triticum aestivum
  Clone ID: PAT_TA_52197
cccagcgtccgtgctattattacaagatgtcaggaggaggagtagcagcacttcaaaaggatcgtaattttattgctgttatcggtgatgaagactctgtcactggtcttttacttgctggtattggcaatgtaaaccaacaacaaaagagaaattttctggtggttgactctaaaacacctttaaatattattgaagatacttttatagagtacacaaaacgtaaagatattgctatcatcttgattaaccaacatgttgctgaggatattcgagagttggtagatggtcataatcaagcatttcctgctgtacttgaaataccttctaaagatcatccttatgatcctgagaaagacagtatccttaagcgtgtcaaaagattatttggagaataataataaaactttctttatttgtt

SEQ ID NO: 52198 - DNA, 560 bp, Triticum aestivum
  Clone ID: PAT_TA_52198
cccagcgtccgcttgcacaccactacgaaagatccaacagagctagcagctagctatagcggagccgaacagagtgcagcagagtactagggtgtgtttctcggcatgtcgacgaggctggccgcggaggtgcggtggtgcggcggcgcgcggagtgagcggccgacgctgcgacgacggcgcagcggcaggacggtgcagctcggcgggcggcgcaagagcggcagacgcggttgcaggctggccgtgtcgtggctggtgcggtggcggctggtggccgagctgctgcggcccatcaagaaggcgctgattgagatggcggccgggcagcgggggctggtggcgctgccgctagccagcttcccgttcgtcggcgcgctctcgctcccgggcgccgtcgcatgacgcgagactgggcgtccggcgatagcgcaagaaggcttggatacaatcagcgagtaggatacgtatttggctagtttagctcctatatttatactcttgtaaaccgcgtgtaaacaaccagatctcaaagcaataataatgtcctcaggagcggc

SEQ ID NO: 52199 - DNA, 598 bp, Triticum aestivum
  unsure (1)..(598): unsure at all n locations
  Clone ID: PAT_TA_52199
cgccttcctccctcgccctcgcctccccgccgccacccaacccaagcacagagctcccggcttctcccccctacgaggcaaggatggtgagggttagcgtcctgaatgatgctctcaagagcatgtacaacgctgagaagcgtggcaagaggcaggtcatgatcaggccttcctcaaaggtgatcatcaagttcctcatcgtcatgcagaagcacggttacattggtgagtttgagtatgttgatgaccacagatctggcaagattgttgtggagttgaacggcagactgaacaagtgtggagtcatcagcccccgctttgatgttggtgtcaaggagatcgagggatggaccgccaggctgcttccatctcgtcagtttggttacatcgtcctgacaacctctgctggcatcatggatcacgaggaagccaggaggaagaacgttggtggcaaagtgctaggctttttctactgagcgggaattttgtgaaagttgtatttcagaccggtgtgataggatgttatctcaggacatcaaggttgtctactttntgcctgcatagctgctatgcctttgttatgttatgttggattcag

SEQ ID NO: 52200 - DNA, 582 bp, Triticum aestivum
  Clone ID: PAT_TA_52200
ataaagaagcacttccatcatgaacctaacaggcgcttctgtttctgaatccattcttgctgctcacgaaacaagagacattgtgttgccaaatcaaaatgaacatgtagctcatgttgctattgacattggtggctcattggcaaagatggtttattttacttcttcagcagacataaaaggtggcagattaaactttaaaaagtttgaaacagagaaaatagatgaatgtatcgaatttgtagctgccttgatggcagatgttagaaccaagtcgcgtcaaaataataagcttgtgttaaaagcaacaggaggtggagcatatttgttttatgacaagttgaaagaaaagctacctggtgtagttattcaaaaagaagacgaaatggaatgccttattacaggcttgaacttttttattacagaaataccttatgaagtatttacttataatgaacaagattcagatccaatgaagtttgaaaagaaaacgaacgatatttacccatacatgttggttaatattggttcaggcgtcagtattttgaaggtgacaggccctgacgaatttagtcgtatcag

SEQ ID NO: 52201 - DNA, 513 bp, Triticum aestivum
  Clone ID: PAT_TA_52201
aatagagcaaaatttattaattatactttttacacaaaaaacaaagagaggatcgaccttttctattcattctttaaactacagattctttataaaaagaaatttaacgacgttgagagtagacgtgagcgaaagcacgggtagtagcacgcttcaacttggattgagcagccttgaggtcatcagcttgagcatcgtcagcgttgagttccatcaattccatagcttcagcaagagcagtttcaatggcttcacggtcaccacgacggagcttcatgttgacgttagggtcagagatgttgttctcaacttggtagacgtaagattcaagatcttgcttggcttggacaacggcttcacgttgcttgtcagattcagcgttcttttcggcatcttgaaccatacgttcgatatcagcagcagagagacgagtagagttggagatggtgacatcagccttgcgaccagtggtcttgtcttgggcagtgaccttcaagataccgttggcatcca

SEQ ID NO: 52202 - DNA, 218 bp, Triticum aestivum
  Clone ID: PAT_TA_52202
agtctaacacattagacgcgtttatacctcactagctaccatgtctctaaacaactaccttgttttatgaggtggtagacaggcccgaaatactgccaaaagctacaatcctagaagaaggaagattaacaaaactggcacccaactatccaggacaaccctatttttttcaaccatcgacatagcccaatgatcataaggaaaaacccactaacaac

SEQ ID NO: 52203 - DNA, 516 bp, Triticum aestivum
  Clone ID: PAT_TA_52203
cacgcaacagggttactatttccccttcgctacaacacgcactttatgaccattgttcgccacttgacacacagtatggaacctaggatacaaaatcaccatgagacgaaaaccgtgtcgtggtcgcaaaacctgaaagagagtgcacccagcgtgcaaggcacacccttgtgcaaaattgccgccaccgaggtcgtcaggaaacatcggggagagcgagaacaaccctacacagctagcccttaaacaggagtggcaataaacacaccaatacaataactgaggagactgaaaccaatgggtgagcctatcactgcacgaaaccaaatatcagtttaactgtgttatggcatcaggagaccaggaacgcgatgggcgtcttgcttgggtccccgaacgattcgacagactctagggaatacccggtaattgcatgcaggtgcctggaggcggaacaaattgacccttagagagtgatggtatatcgcgtgcctacaatgggccttgcataatccg

SEQ ID NO: 52204 - DNA, 284 bp, Triticum aestivum
  unsure (1)..(284): unsure at all n locations
  Clone ID: PAT_TA_52204
atttcggctantgggacgtttttgtcgtttagagtgcaaaagataattgctcgtgttgttgttgattggctctgtcagggtccctgtaggagaggatccggtcatgctgagtcctgggtatctttgtatctgttttatttcataaactgaactcagttcgattcgattggttaatttgtcaaaagatcgcaacacgggagggaatttatcagaaaagtcaccaaacaggattgtcttttgggatgtgcttaacttgtaatatctccatttttttccagaagttg

SEQ ID NO: 52205 - DNA, 200 bp, Triticum aestivum
  Clone ID: PAT_TA_52205
gttgccgggagcgggggtgttcccttttggttaatgggccgttggggtgttctcctccggttgggaccccgggagagcgccttgatcgggttggggacccttaaccgttccgcccacccagtttgttttggggtcctcgccgggtcgatgattggccccaaaccggccaggggggctggtggcttaaaccaggggagata

SEQ ID NO: 52206 - DNA, 540 bp, Triticum aestivum
  Clone ID: PAT_TA_52206
ggcacaattcaaatcacatcatgaacagtggacaccacatgagtcaagcatgcagcgttggtacctccactcactgaatcgcagacatacatgaggaaaaaacgagcgcatcacgcgccgtcgatcacgcgaaaacacacacgcgtgcgatcatgcattcacgaaatcacaggagctgagcaccacatccaagtggcaaaattccgcaacgtctcaggagcagcagcagacggagcacctcacgatgccgttctcgttgcactccgtgcagcgacggaaccctgcgcccccgtcgcccgtcccttcaccgtcctcgtggtcctcttcgtccacgtacaccttgcagctgccggagcaggcctcgcatagcacgaaccgggcgttcccgaacgcttggcacgcgccggggcccccgctctcgcacccgtcgagcctggaggccagctcccctgtctcgtgcagccgcttcagctccttcgcgttgcccacgagctccccgtccacgaacaggctcggcagggtcggcgcggccggagccca

SEQ ID NO: 52207 - DNA, 277 bp, Triticum aestivum
  Clone ID: PAT_TA_52207
ggtttattttttgcttcccggggggttggcacttgacctttttcagcccatgtgcaaagtaccggaaagttggatcagcagctccctccttggggtgggggaacaccacgccgccatttttatgcttgctttcgccaacaaaaaactgaagggccttgagcttgctaaaaaaatactttgggggggactcaacatttttcttgaaagcatttagggcatccccttcaagcttggcaaaaaggttcttgatgtaccgcttcatgggagagataaactg

SEQ ID NO: 52208 - DNA, 516 bp, Triticum aestivum
  Clone ID: PAT_TA_52208
ggatataattgaacataaacatggcgggttcatatatctgtctgatccagttacacagatgattcgacgaatttcgagcactatgtattaccaaaaactcttgtttattccgcaagctcgccaggtccaacgaaggagggaaatggagaggggaggaagagattgcttctgggaagaactctatacatgtgcactcaaagcattcttattgcgggaagctgccttcagtatgaacttgaagaacttcagttgctgggcttttgctctgcacccgatgatgccccaactgatgtgacgaaactgcagactgcacatttgacggacctcgcgccatactggtacatgagcagcattcgacaactcccgcagtttacatgcgcaacctgattcgcttccattgccaggttgacagtgtggcagcaagaacactgtacacttgtggcgccgcgtatgtacatgagaagagtgtggcatcctccacaaactagctgcgccatttcagtcccgggagccgga

SEQ ID NO: 52209 - DNA, 315 bp, Triticum aestivum
  Clone ID: PAT_TA_52209
atggggccgaaaaataaagagggggagtgccgcactttgggaccgaaattttttgcccataaaagggagaaaacttggacggccctgaaacaaatttttgatttgcgccccccatgggctggtcttacctgcccgggttggagctgaaacgggtcgcgagcttttggcccaaagacttgtcagcctgagacccgtgggagagcccgatggccctgatctcatgggggagggggggggcccacagcgcggcgatccatctggggatgaatcgctcttgccttgccggggccatgggggggggcctttccccggggt

SEQ ID NO: 52210 - DNA, 547 bp, Triticum aestivum
  unsure (1)..(547): unsure at all n locations
  Clone ID: PAT_TA_52210
ttntttttatgtatatgagtacataataaaacgatcgctttatttactcttcttctcttagctcaacatttgtatcttctaattcaccatagacatcactagggttagggttgatttctggtataaagttatgctcagaataagaaaaggagtgtctcgatctacgaatattggaatgcttcaaaaatgctccagtggcacccaaatggccttcatgtctcaaaaataatgccttcatctctccatttgaccaaaaattgattgcataagaaagtgtattcattgtgatgggatgtcctcgaataaagcatccaccaaaataaattcgagtcaagttgtgttgttttgcattcaaatatgcaatttgcccaatattattactgaccataaataatagacttttggcaatgtcttgtgcttgaaagttaccttgcgattgtcgaacgccttttttaaatactttaccaaagctactcgctattcgtgtcgactttaatccaagctttgtataatctgagccatatatgtctcctaccataagatctat

SEQ ID NO: 52211 - DNA, 349 bp, Triticum aestivum
  Clone ID: PAT_TA_52211
cccacgcgttcgcgggcgcgtgggggccgacggaggagacgagctgtagctgctgggcgtgtgggcgagcccatacgtggtcagggtgcatctcgcgctccaccttaagggcgtgagctaccaggtcgtctaggaggaccttgccagcaagagcgagctcttcctccgctgcatcccggtgcacaagacagcccggatcctcatggcacagcgggaggcccgtctgcgagtcccagggcatcctccagtgcatcgacgaggccttcgccggcgtcggcccgcccctcctccccgctgtcccctactagcgctccgcctggcgattctgggccgcctacgtcgaggtcaa

SEQ ID NO: 52212 - DNA, 421 bp, Triticum aestivum
  unsure (1)..(421): unsure at all n locations
  Clone ID: PAT_TA_52212
cccatagtgcagacgcgaggatgcacctagcctcatnactcccaggcctaggaatggtagatagatagtcagagccttataanntagaataaagctannagtaagtgatattttactaggagagctaagtaatagcaacaggtgccagtagtaatgggatatagagctaataccgtacccgagtagagtaccctcgtangatgagcccagagcagtagttagttagagaagggaaatatagccacgagacaacnaacgagttagttcgatatantttgaatcaaaaaatggttttaaaccgagttanttcattttgcattccatcnnataaattgcancttgagtatttgcttacagcctagncctaccaaaaaccgtcttgtanttttgatattgaaggtaactatcaactataaaaatg

SEQ ID NO: 52213 - DNA, 188 bp, Triticum aestivum
  unsure (1)..(188): unsure at all n locations
  Clone ID: PAT_TA_52213
ctcttctaaggagaggcaaaggccangacgagcgagnnactagttaacacgcttcgataaaaatctagtcgcagtgaaatgtcataggacaatgcagttctccagtctctagtgctgtgncgttagtacctccagctatgatgaattctagggtagataatacagtanccagttattttcccgccaat

SEQ ID NO: 52214 - DNA, 434 bp, Triticum aestivum
  Clone ID: PAT_TA_52214
gctacacgagggtgcaatggagcgtcgtgtgagtcgttgaagttccatcggggctgcaatgaagcgtcgtggggccgttgaagctcgccacggattgcaatggagcgtcgccggtgttgccatggatgctgctgcgctgggtgttggcattttgagcagcacccagtgttgcgatgcagcagttgctggcggctccggtgctgcgatgcaccagtcgacggcggctccggtgctgcgagattgccgacaggtaaagacgctggatcatgggcgtggtgaatggaagaacagagaaagaagacaacgactttgtttgttgaggaagaagacagtgactctgtttgttgagatcgcacggccaccatccatcggatccgacggctggctaggcggcttaattttgtgacaaatcaatcggaaatttgagagattgg

SEQ ID NO: 52215 - DNA, 342 bp, Triticum aestivum
  Clone ID: PAT_TA_52215
ctaccgtgctcctgctgcccccatccgctagcgtgcggcggctgacaggggaggagagtagagagagcacagatggccagagtctctgacgggccaagctgggagaagcggctggccgacgctccggtgggtagatcgcggcgcccttctacgacaagaaggaggccgtcatagctggccgcgcaggccaggcgacctctaggcccccaagctccccgtccgcgtgcacccggtgttcgaggagttcctcgccggcggcgctgccggcgccggcagccgcgccttggccgtggatgttggtggatgaatccagaaggctgcctccttcctggagccggtggg

SEQ ID NO: 52216 - DNA, 386 bp, Triticum aestivum
  Clone ID: PAT_TA_52216
cgtcctggtcgtcgacccgccccaccgtcgaaaagtgccaggaagctctccaagcagctcttctacacccgcctcgccagcattcctggccgttacgaggctttctggaaagaggttgatgctgtaaagctcttgctgaaaaacagaaaggacctgaaggctgagcaagccggggttgccgcattgtttggcattgagttgtatgcatggcttcgtgccggtgagtttattggtagaggatttaccctcacaggttgatcgctgacgtctagcatgagcgcacattattagtctacatacatttgccgtctagctatgagcgtacattgttagtctacattttccatcggatacagtgttcgttgatcgaaagtttgtgcttttct

SEQ ID NO: 52217 - DNA, 380 bp, Triticum aestivum
  Clone ID: PAT_TA_52217
gctaggagccagagaggtgtcgctatgtactccgcccagggatcatgatgtccgcctgagtgactgtcactgcagggaatcacgttagatcagatatagagcggccagtgacggagatgatctaagaattcaatcactttatgcctgttgtcttttggaagagattgctcatctgtagccttcttcattctctgccgtagtggtcttctatcttgtgaaggagtcaatgagttttgttctggcgctttttttagagttctcttgatggtgctagaccagaccattgattcactcctgttgcatttatctatctatctttctgtctatctatctatctatctgtctatctatctacagacggcggccgttctggtggatcc

SEQ ID NO: 52218 - DNA, 592 bp, Triticum aestivum
  unsure (1)..(592): unsure at all n locations
  Clone ID: PAT_TA_52218
atgagcttgtgggtgctttagtctattatgatggtcaacataatgatgcgagaatgaacgttgctctggccatgaccgcagcctgttatggtgcgacggtcgcaaatcactgtgaagtggtcgacttaacaaaggatgacaagggaaaagtgaatggggccaagttgcgagacacgttgaatggagacgaatggatcgtcaaggccaaaggtgtcatcaatgccaccggtccattcacggacggtcttcgaaagatggatgatgcacaaaatctggacatcgtcgctccctcggctggcgtccacatcatcttgcccaactattatagtcctcgaaacatgggcttgctcgatccggctacaagcgatggtcgtgtcatcttctttttaccctggcaaggtaacacgatcgctggcacaacagattctcctacagaagtcactcagaatcctatgccgaaagaagatgaaatcaattggattttggatgaagtctctcactatntgagtgcagatgtcaaggtgagacgtagtgatgtgcttgctgcctggtctggtattcgtcccttggtacgtgatcctcatgcgaaaaa

SEQ ID NO: 52219 - DNA, 574 bp, Triticum aestivum
  unsure (1)..(574): unsure at all n locations
  Clone ID: PAT_TA_52219
tcgcgccctcgacgccgccgcacgctccgagagagaagaaaagaaaggcatccttagcccgcgccgccgccaccgccgcgagagcggcgctccgcccggcgcccctcgccggccgtggcctcggctcctccctgccgtcttcctcccccgcacgggccgcccgcctcctccgcaggtggggcggggcggggctggagacgctgctgcccctgcacaccgcggtcgcgtcggcgcgcctcaagtcctgcatcgccggcgactccacctgctggtgctccctctcccaaggttttaaaaagcgcatctgatcatgggtaggagctgcgcaggtgagaagtgaagccgccgaggggaaaacaaagtgcgttggnggtgctgatagggcttagaacatgtatggccagtgttgggggcattggtctgggtgaatgggctctgaacaaaataatgggaactggggcccgcttgggctgcgggggcctttggtgggggggggggccgcctgggggtgggcgtggggggtgtgggcggtgggttgggggggggtgggtgggaggccgggggggatgggtgg

SEQ ID NO: 52220 - DNA, 543 bp, Triticum aestivum
  Clone ID: PAT_TA_52220
gaaacaaaaataaatttatttgacgagcagaatggttaaagttagtagaaagagggaaaaaaaaagagaatatacattaaagttttaaacaagaaaatacgtcaattcaattaatattgcttcttgttcttcttatagtggttgataagtccattggtagaagcatcgtgggaagcgacttcaccagaagcagagagttcaggcaaaatagccttagccaattgcttaccaagttcaacaccccattggtcataagagttgatatcccaaatagcaccttgaacaaagatcttgtgttcgtacatagcaataagagaacccaaagtagcaggagtcaatttttggaacaagaaagagtttgtaggcttgttgcccttgaagatcttgtggggaacaatgttctcgacaacattggtacccatctcagcacgaacttgctcctcattcttaccgaccatcaaagcctcagtttgagcaaagaagttggataataagatgtcgtggtgaattccttgacggataggattgaaagtttcaactggg

SEQ ID NO: 52221 - DNA, 155 bp, Triticum aestivum
  Clone ID: PAT_TA_52221
aaaaaattaactatcttagctttatttaattaaaaggtgggaatataataaatttaagcctgggagttgagggaggggcccccccgtcccctatggggggggggtggtccccaaggggttggcgccggaacccttccgaagtgggggaacactgg

SEQ ID NO: 52222 - DNA, 547 bp, Triticum aestivum
  Clone ID: PAT_TA_52222
acaaggtatgagatgtattcattaatttatttaaaatatacagaaaaaaaaaccattccttcttattggcgtgccttatcaagattatctttgacgtgcttcataaactcagctgttgtaacatagtgctcagtcttgaggttctttccatgaatagctaaagctaaatctttggtcatcacgctatctctttgaacagcatcaatacaggcttgttcaagatcaagtgtaaacttggtcaattccttattgttatcaagattggctctgtgtcccaagccacgagtccaagcaaagatagaggcaatagggttagtagaggtagggttacccttttggtattcgcggtagtgacgagtgacggtaccatgggcagcttcagcttccatcgtctttccatcaggagtgaccaagacagaggtcattaaacccagtgaaccataaccttgggccaagatgtcagattgaacatcaccatcatagttcttacaggcccatacaaagccacctttggacttgagtgcctgggcaaccatatcatcaatca

SEQ ID NO: 52223 - DNA, 544 bp, Triticum aestivum
  Clone ID: PAT_TA_52223
aacggttatttccttggctaaattgatgaccaaacttgaatctcaaaatccgttgcggcaccacataatctgagacaggttaagacgatagaaatagccgtagcaaattcaaccacacaaaggatgatccaactaatacatggcagagtggatgcccgtctttcttgctacacatgaaatgattcactgaatgtttcttggctggctatgaaacaaaataacagtttatggtgcattgacagctacagtctcatagctcagtcgcgctcgctaatggctgttaggtgctgatcaatctcctctgtcgtgagcgaccggaagacacggtcttctttcctcacaacaccgacctcgatctcggtagccttgaaatcttcctgcagaacagattgcaatgcagaaactgcaatctgaacagtttcgtcatatgtgaactgcgggctatccttcattttcttctccagaaaatttattgcttcctgctccttcagtccggcactagttgccttgtgtccaaagaagtgacctgcgggggcacacttga

SEQ ID NO: 52224 - DNA, 540 bp, Triticum aestivum
  Clone ID: PAT_TA_52224
atttttttcttttcttttttttcttttttttttcttttttttttttttttttttttttttttttttttttttttttctttttttttttttttttttttttggaaccgggcaacaaatcaaaaataaacaaagggaaaaggcaaattgggagaaaacaagctggggttttcaaaaacaaccacgaaaaaataaaaaaaagttcgcgaaaaacagggggacaaattcgggcttaaaaaacccgggaacaaaaagcaaacccaactgggaaaaaaaaaccaaacagggcatccactaaaatattcaaaaaaacaaccccctttttgagctgggaaagctcttgcctgaaagccccaccccttttaattttagccaaaatgaccttgaacccggaaaaggcattcagggatgcttttttttttgggaaaaaaagctttttaccccaggagcgggtcccccattggggtttcaaatgagcttcccccctggccttgaaaaaaggggcctttttagggatcccctgggtggcaattttgatggggg

SEQ ID NO: 52225 - DNA, 469 bp, Triticum aestivum
  Clone ID: PAT_TA_52225
aggggcggaaaaataaaatcgggccttatatgggggaccaacaagggacgacacgcaaacatttggatttgagctaagcccatactacatccatgcaaacacaggtgggtaaactggaaatccggcactaggaaacacgactggcgacgggacaatttactgggaccttggtggaacacacacacaacagattaaccagaaacagggggaacatttttcaacactactaagcaggggcgggagctagctaggggggcaatgggtggatcgatctatggggtggagtaaaccatcttgatctcggggaccccggggcagttgccgccggggacggagtgctccaaacaggggttgcccctgttgcctccggggggggggcaatgcccctgcagcgggctgccgtgcggggggacggagacccgggtgggcatgttggcctgggcggtgctcaccttggaggacgccccgc

SEQ ID NO: 52226 - DNA, 531 bp, Triticum aestivum
  Clone ID: PAT_TA_52226
gtcatggcgaacgccatgaccaatatcatcatgaccaaacttaataacacatcgtttgttcccaaaataagtctcaaaaccatcatcatctaggttcctcctcatggtaggaacataaatagcattattaagaatgagggtgaagccatcttttagcactaacgggagagtcccaacagcttcaacattagcctcctttccatttgcaactctaagagttcgctcccccctttgaagcgtcctcacggtaaggaatccccttctttacaagccatgccttaaagccatcgcaatccttctgcttatgtccgtcatgtttgcaaaacttgcaataaggcttcttaggtgcagaaggctcattagcaacagaaggctttgaccttttggccccagacttgcttgactcggccttatgtgaaggacctaattttttctgagtcttattttcaccattaaactttctcttccctgagttcatgaaagtaagatgagcgtaatcttttctctcaatcttaagtcgctcctcttctt

SEQ ID NO: 52227 - DNA, 538 bp, Triticum aestivum
  Clone ID: PAT_TA_52227
actctacgacgacacatcttgtcttattcatcgatgctgacaccatggaacaaaacactactagcgctacatgaacaacaacaataacaaccgggaagaaaacaagactccgtgactcggtagtcggtacacaaggtcactgaccggccggccgactcactttattcgattcaccatgacccagcgcaaggctgcaccatgcacccaactagagctgggcgagcatgcccatcctagctagctagtcaccgcggcggacgtcggcggcgaggctagatctcgtggcacctgggcccgggccagccgaagtacgggtcaccgcacacgcggagggaagagccagactcgtccttgaggcagttcttgcaggtcttggcgcacttcttcaccttgtcgtggcagaagcaggtcggcggggcagacctggtgcacagggtctggtcgcagcacttccacgggctcgccttctcgccgtcgacgacgttgagctcctggctaacaggcatcaccgccgacgtcgtttgttgacccggttgac

SEQ ID NO: 52228 - DNA, 474 bp, Triticum aestivum
  Clone ID: PAT_TA_52228
cttaaaaaaagaaattttatgggaccggaaatagggcatcccccccattacatgggaagccgccccccggcggggtcccccaaaggccaaatctcccttttttaccaaaaaggggggaaatgggttttcccaacccaccggcccaaacttaaaaaaagggggggggagcaacccaggggggaacccggggcggggaaggcccccccccccggggggggggggggaggccaagctcccggaccaccccagcccaacccgggggggggtcccccaccccgggaaaaaaaaggggggtctttttaaaaagggaccccgggacctcccccgggaagaaaccgggggggaaacttaacacccccccccccaggggcgccgggatgccgggggggggaaccccaagaaaaaggcttttggccaaaaccccggaaagggggaggaaggccccgggggaaaaagggcccctgaaccttttgg

SEQ ID NO: 52229 - DNA, 534 bp, Triticum aestivum
  Clone ID: PAT_TA_52229
tttttttttttttttttttttttttttttttttttttttttttttttttttttttttttttttttttttttttttttttttttttttttttttggaaccgggcaacaaatcaaatataaacaaaggcaagaggcccatttggggcaaacaagctgggggtttcaaaaacaaccatgacaaaatatgaaatagttcggtaaaaacagggggacaaatttggggttaaaaaacccgggaacaaagagcagacccaactgggaacaaaaaacccaacagggcacccactaaaatattttaagaaaaaaccccctttttgagcttggaaagcttttgccagaaaacaccaccccttttaattttaaccaaaatgaccctgaacctgtaaaaggaattaagggaagctttttttttttggacaaaaagcttttaaccccaagagcgggtctcccattggggtttaaaataaacttcctccatggccttaataaaaggggcccttttagggatacccttgatgtcaattttaaggccggc

SEQ ID NO: 52230 - DNA, 442 bp, Triticum aestivum
  Clone ID: PAT_TA_52230
aaaggggaaaaaaacaaaaacgtttatttggaaaaaaagaacccagtatttttaacaaacatggtctcgggaacgagaacgtcttttacgggtatgggcccctttgggggaaaaaggcttatcttcgggggattaaaatctttaagagggggatctatggcgccccttaggggagggggatctggggggtcttttaggaaatcgggggcgagatctgaaacgaggggcctttttggatctttctcttgaactagagggggacctaaaacgctcctttttcctagggctttcccttgaactatcaaagggaaaccggccccggcccgaaaaaaatgttttcggttttcccacgggggagcccgggggcgaactgaaacgggcttttttggcgggtgaactaaaaaatcccctgtaaccctctttgggggggctttcgcttggg

SEQ ID NO: 52231 - DNA, 182 bp, Triticum aestivum
  unsure (1)..(182): unsure at all n locations
  Clone ID: PAT_TA_52231
tttcttgcatttttgangcgctaaccctgcttccgaaagatggaactccattcattttcatcccgctgtcgtcccctggtnttaccatcattgccacatccatcagcagttgggtttcgaacatctgtcctgaagaagagtcaaccacaatgtctatgataatcacttttgctcctgcttct

SEQ ID NO: 52232 - DNA, 543 bp, Triticum aestivum
  Clone ID: PAT_TA_52232
gaatgtgaagaaaaatttctttttattaaaatgattatatgaattgtataaagttatattactatgatatgtgtataatatgtaaaaaaggggagaaggaaaggattagtgtggtgtagtacatacaatagaaacaaaaactatttgtctattcaagaaggacctagtgttgtctctttgaatcttcacgtctttttgcccaagccttgatgatcatcaaagcagccacataactgagagtgatggaagttaaagcgacaacgacattcatcaagaacatagaatctacattattacgacgtaaccataataaagtaccagagttggatgccatgaacagaatagaaccggcaatcaataagaaagcgccaacgagttcagtagggggtcgactgggcgtcttttctgaaggtgcgttacggtagaggatgacgtaagtagccaatcgagaaacagcagccgaagagagtaaaaggccccagagccagtgaatgttgctagagtaagcagtgtcctggtgatgatttcccatggagataccaa

SEQ ID NO: 52233 - DNA, 172 bp, Triticum aestivum
  Clone ID: PAT_TA_52233
aaagcgccgcgtggggcgtggccctgaattaaaaaggtgttggggaagtggttgaggtcggcaaaactgacaaattccccggggaggttctcgtgctgggacaggcgccccttgtagacctccagcaccttttttagtttctccaggctttcgtccaccaccgtttggttgg

SEQ ID NO: 52234 - DNA, 540 bp, Triticum aestivum
  Clone ID: PAT_TA_52234
gaacaaatataaaacaaaaaattttaattgaaaaaaagaaaactttacaaaattacatggtagatgcgatatagaatagatatgagagagagagaaaaaaaggggggtatttttgaattagatgtcaagagccaaagattccaagacgagttgaatagcatcttgtactctatcattaaattcatttaatagatctatttccactcgagataatttcctgagtaaccactgagattcagatctggcgtccgtcgattgttcattttcacgtacgacattaatttgaaatggttgtcgtagtttccattcgactgtgaccactgaagaagtatcgactggatgaacaagagaggttgcttgacgtatcaagattctcgaggactgttgagcgttgatgatcagaccgagttgatgactgatcttttcattcagacgtggaagggcagtaagtagatgaagtgtcaacttttcgacttgttcctcttgaaggatatcaagttctgttatttgtggaatgtcagtagctaccagtggactcac

SEQ ID NO: 52235 - DNA, 527 bp, Triticum aestivum
  Clone ID: PAT_TA_52235
cgaagtgggcatttatttctgacttgaggccaattattttaagaaaacgtcaatttccacaagcttgacagtaataaaaatcacattgtaagaatttatttgttgtacaaaacaaggtgaaacatgacatagatatgttaacttaataaggacaagctaatgcacccattggatcatatgcaggaagtacggtaggttgattatccaagagtgatactagcttgcgtgggatatcattcttttctaatacaatctgataaacaaaagaagagaaccattcatccgtcatcacccagaatcctttatcacccgtggtatctataccccaagagttttctactcgccatctgagtggatttccatctttatcgaggtgtacaccagtgaataccatagcatgagtcattaaactttccttgtataacaatctttcctcttttgtcaaattaaatttgacattgaaagccaattcataatcataaatctttgtgtccatagcaccgatacgattattactgaactgtcct

SEQ ID NO: 52236 - DNA, 418 bp, Triticum aestivum
  Clone ID: PAT_TA_52236
actgctatgattgtcaccatagcaatatgattcttggaaacactgtacctaaataatggtacagaagagcaacaaaagtgatgaaaggactttttcatctatttaatatcactacagcaactgcaccgaatatcatacaagcttcatacagagagcaaaaggacttgatcgtgaaggtgccacagtaccgatgattcctagtttcgtcacaggtcgtcctacaggtcaggaaacaggaagttatcttgccttggacttgggaggcacgaatcttcgtgtgtgtgaatttgaactgaaaggtgcaggccactatgaattacgtcaacaaaagtatgtgatttcggaagaactcaaaagggcgatatgcgtcacttgtttgattttattgcagattgtgtggataattttatttttgaat

SEQ ID NO: 52237 - DNA, 619 bp, Triticum aestivum
  unsure (1)..(619): unsure at all n locations
  Clone ID: PAT_TA_52237
agnacttccanatcgccgtcgtcatgaacgcgctcacgctcgtcggcgtcgccgtcggcttcgtgctgctccgggccgaggcggccttcgaggagtcggaggagtgagtgaaacccaacccaacgccgtgtgcctgccctgaccagccgtttcagttcagttcagttcaggctgctgtttggctggcgcgtaagccgtgatatataaaacgtgatgtatgctattttacatttggttttgtatcaatgacaatcgattgatgaataaaaaaaaaaaaaaaaaaaaaaaaaaaaaaaaaaaaaaaaaaaaaaaaaaaaaaaaaaaaaaaannaaaanaataaaaaaaaaaaaaaaaaaaaaaaaaaaaaaaaaaagggggggnggttttttaggggttaaaattttatttaggggggtttggaaggtaatagtttttttttgggggganttaatttaatttaatgggcggttgttttaaaaggttgggattgggaaaaaccttgggttttccaaatttaaattgttttgaagaatatnttttttttgggaggtggtgggtatttggaaaaaagggtgggaacttttttgcttttttccaaacattttccccccccccccc

SEQ ID NO: 52238 - DNA, 470 bp, Triticum aestivum
  unsure (1)..(470): unsure at all n locations
  Clone ID: PAT_TA_52238
cccagcgtccgatggtaacagctacttcgccacaacaaaatattnngttgaaactttacnnttaaagnnaaaagnaagnnccagccaagggagnncctgnaaaatgnaagnaaggggcatttgnnggtatttgggcttatgggttcaaactcatttggnnaagccnntcccatncattatgaatcaaaacaaattggttacattaagggttatgttcgacgcttttggcagcatagtgaagatcacagaggtacacctgagaaaccaggcagggttgttaccttaataccttatgatgaatggaagaatatcgagagtgtggaaggacatgataaagtaacctggggcgtagcattcaagataccttcagacgatgcagaagctactcgtgcctatttagatcatagagaaaagaatggatacactgctcatacagtagatgtatatagtttagaggatgacgttactcc

SEQ ID NO: 52239 - DNA, 183 bp, Triticum aestivum
  unsure (1)..(183): unsure at all n locations
  Clone ID: PAT_TA_52239
ggttgaaagcctgtacaaggttaggtacctgggagctgggatacgaacccaactgaatggcgaacaaaaatcaataatttatccatttgttatctcccatcccttttctaccccgtacaatgtgcacattttacaatttgnatnagnaactatnatnataaacataaaacctttagatatttc

SEQ ID NO: 52240 - DNA, 265 bp, Triticum aestivum
  Clone ID: PAT_TA_52240
atctgttaaatcatgacacatagcactatctacagtcaaacgcactagctataagcatcacgcgatattatctgtcgttaagggtgatctcgcacaacctcaatcacctgttcagatacatgaataatgcacatacattacattcatatcactctcttatatcccgtgtacgcaactcatacgtacggacatacatgacactagctaccatatactcagagagtgtaatctggaaagtgatgtgtgtagcacatgattggatgtt

SEQ ID NO: 52241 - DNA, 435 bp, Triticum aestivum
  unsure (1)..(435): unsure at all n locations
  Clone ID: PAT_TA_52241
gnttcatatacacanatgattgcccctanaagagagcttgaggactcttccaccgagagttccanaacctgcttgctgcggccgatcggtatgcactggacagactgaagattnngtttgcgcccagnaagnnttgtgggnatnaagtgtcggtagatacagttgcaactatcttagcttgggctgaaacctacaactgccaggagttgaagaacaggtgcattgacttctttgtggtggaggaaaatttcaagaaggccatcttcaccgatggttatgcgttgctggttctgaaattcccagagatcattgctgagatgaaaaagagggtttaggagatgacacaatgagatatatctccatgtatatagttcaggtgttcaagcgatagtactagatgtgttttggaacgtggtgagtggtatgcggcatctt

SEQ ID NO: 52242 - DNA, 435 bp, Triticum aestivum
  Clone ID: PAT_TA_52242
atttcttgtgatgtaggactccacctacaagtactttgaggtcatccttgttgatgttgctcacagcgctgtccgcaacgatccaaggatcaactggctctgcaagcctgtgcacaagcaccgtgagctgcgtggtctcacctctgcaggaaagaaattccgtggtctgcgtggcaagggtcaccgccaccacaagaacaggccctcaaggagagccacctggaagaggaaccagaccgtctccctccgccgctaccgttaagcttacgtggtgttatgtcctgtggaacctgtcctatgctggagtcttttccaccgtcaaattttgctacctttctgtggctgaacgtccaggcatgcctgttgaactatttgctatgtgcctgtgttatgtgaaatttgaatgatttaagtagtccttgatgtgtgctgatt

SEQ ID NO: 52243 - DNA, 598 bp, Triticum aestivum
  Clone ID: PAT_TA_52243
cttttataaagaatggctgaaattagaagaaagcttgttatcgttggtgatggtgcttgtggtaaaacttgtttgttgatcgttttctctaaaggcactttccctgagttttatgttcccactgtctttgaaaactatgtagctgatgttgatgtagatggtaaacgtgttgaattggcattatgggatacagcaggccaagaggattatgatcgtcttcgtcctctttcttacccagactcacatgttatcttgatttgttttgctgttgattctcccgattctttagataacgttcaagaaaagtggatttctgaagtacttcacttctgtcaaggtcttcctattgtcttggtgggctgcaagaaagatttgcgtaatgatcctaacactattgaagagttgagaagaaattcccaaagacccgttagttacgaagaaggagctgctgttgcccaaaagattagcgcttacaaatattatgaatgttctgcaaagactggagaaggtgttcgtgatgtattccaagaagctactcgcgctgctttgatggtcaacaagaagaagaagaagagtggttgtactgtgttataataaa

SEQ ID NO: 52244 - DNA, 590 bp, Triticum aestivum
  unsure (1)..(590): unsure at all n locations
  Clone ID: PAT_TA_52244
aaagaatattttcaaaatgcttatangaaaaagcatgttaacaccantatagaaaacagttatcgtaaacaaaacttacctatcagacgccaaagtttacaagtatttcaaaaagattatatcattaaaaagataccaactcaacctgaagagaaagaaaaaaaacagcagcatgaacgtcgtcgatgtgtatccaatcctaatttattactaaccgttacatcatctaagcaacaagaagaccaagaacaaccagtaaaacaatccactgctcataaatttgttgagttattaagacctagtaaatctgaagtaacgttttcacagaaaaagaaaaaaccgacagagaacagattaaaacacgtattttctcgtctacaaaagaaaccagctttattcaacgatcaaccagtttatacagctttattatcttgcgtttcaaaggaatttagtaaaagaatttcattaaagcccatagcagtaaaagatggcatagagtatcacaatacatttactggttcagaggctgtggattgtttattaaatattttaaaaattcgagatagaaattttggtttattaattggacg

SEQ ID NO: 52245 - DNA, 490 bp, Triticum aestivum
  Clone ID: PAT_TA_52245
accaaaccgaaaggccttccaaaagcaagccggtattttccaaaactccaaggatgccaagaagcgtaaccaacgttggttcaaggaagttggtaacggcttcaagacccccaaggaagccaaggtcggtacttatatcgataagaagtgtccctttgttggtgaagtcaacatccaaggtcgtatccttactggtgttgttgtctctaccaagatgaagcgtactcttgtcgttcgtcgtgactatcttcactacattcccaaatacaaccgttacgaaaagcgtcacaagaacatctctgcccacgtttctcctgctttcgacaaccaagccatccaaactggtgatttggtcaccattggccaatgtcgtcctctttccaagactgttcgtttcaacgtcattaaagtctctaaggccaagggtaccgccaaggctttcaacaagttctaagcttgttaatgttaataaaagtaatattttattctt

SEQ ID NO: 52246 - DNA, 577 bp, Triticum aestivum
  Clone ID: PAT_TA_52246
agcaatccttctgggctgatcctagtgattttggagatatatttgatgtgaatcatttcatctattctttaagagatgaggtgaaggttatcagagaactcccacagaagtttaatgggaaagttccattatcaatgcaaccagtcagctggtctagtgagaaatactatttgagacagatcttgcctcttgtacgaaagcacaaggttatacgttttagcaggacagattctcgccttgcgaacaatggccttcctctgaggctccaaaagcttcgctgccatgttaactacaatgcattaagatttacaccatccattgaggccctaggcaacaagatgatatcgagtctcaggaaaactggatcttttgttgtgcttcatctgagatatgagatggatatgctcgccttctctggctgtacacacggatgttctggtcaagaaacagcagagctcacgagaatgaggtatgcatatccctggtggaaagaaaaggaaatagactctgagaagaaaaggctcgagggactctgcccgcttacacctggggaaacaacattagtgctcaaagctct

SEQ ID NO: 52247 - DNA, 396 bp, Triticum aestivum
  unsure (1)..(396): unsure at all n locations
  Clone ID: PAT_TA_52247
agcgtccgcgcgccacgccgtcgggaccgcctacgcaggcgggcgctcgcagggcggccacggcctggcgctgctagccaggcgcaggcgggcgcggccaccgcttgggcgcagnngggcccgnnacgaatgggncnnggtctaagnncggnatgaggcggcgaccgcgaggaccccgcgccggcgacgaggtcgcgaacgaagaggacgaggcctaggctgcgtcttcaccaactgaggggagattctttggccgtccattcgctcgaatggagagcaacgtgggctgataacgtgtttgaattggtaaatggagagaacgaggaaacaaatcgaataaatggattgaactggtcaaattccatttgaatgaaaaaaaaaaaaaaaaaaggggcg

SEQ ID NO: 52248 - DNA, 462 bp, Triticum aestivum
  unsure (1)..(462): unsure at all n locations
  Clone ID: PAT_TA_52248
atgagnaaggttanntttagttggttaccttttatcttttggcattcagtggtantcttgatgatgcatcctctcacgatttcactatacgattgatgtcttgcttgctttatttattacttatatgacatggaatgtttatttacaatacatcagagaagcatccatgcgttacatgtttggtttcacaagatatgcttcactcgatctctttcaatccaccatgacagatggagcacaaatctatcaatacctcaactggcaaccctatttattaggtcaagattggataatgactctttgtatttatgtggatggattagatatncgtnttcgatcgatgggtntattggatgaacaaggtgaattagttngatcgaatattaagtnaaatnatttnatgaaaaccatngtttaattgtnttttttaaaattaaaattaatntttaatntttttattgc

SEQ ID NO: 52249 - DNA, 325 bp, Triticum aestivum
  unsure (1)..(325): unsure at all n locations
  Clone ID: PAT_TA_52249
gtactcgtgtntaacgctctagtctcganagaatacagacagagcgaagtggtctatactgtagaaagcgtaggggtccatagaatacagatgttggaggcatcgctcatgtgacgtgtggcattgaaggttggacggacacggtatgagactatgcacgtatgcggagaaaatatattaaaattgctagaggaactttgctaattatggatgataaacatatagtacgattttagtacttcctgcatgttaaagtgaggatgagggacattaattgtatttgttatagataataataaataagtgtttttgattgtaataaata

SEQ ID NO: 52250 - DNA, 584 bp, Triticum aestivum
  Clone ID: PAT_TA_52250
cacacctcgtgatggtgctcctgtagagattacaggtcttttaaagagcacattgcgatggattaatgagcttgtgaaacgtaaggaattccagtggtccagtgttgatcacattggcaaagaagacaaaacaattacttatcatgactggaacgaacttttgcaaacgaattttgaaagagtttactatattcctcaagatcctgcacaagataaggattatgacgtgatttccaaaattatcaatcgccgaggtatttataaggatgtgtacaaggctacatatgcctacacagagtatcaacttcggcccaactttgctgtcgctatgaccgttgccccagaacttttcaggaaagagcatgctcaacaaacaatcaaaatgtgcaaagatgttctattaggacccttgggtatgaaaactttggatccagccgaccagcaatatcgtccttactaccacaactcagatgactcggaagatttccagacggcgaagggtagaaattatcatcaaggacctgagtggctctggcctttaggttactttttgcgtgccgcactccactttcatgctatccctc

SEQ ID NO: 52251 - DNA, 489 bp, Triticum aestivum
  Clone ID: PAT_TA_52251
gggcccggggccattattaaaaaaaacaggcaaaatccccgggggaaaaagtttcaaaaaaaattttcaaacggggggggggcaaaccaaccacccaagggaaacaggaacgatgctgggcccaacccccggggaaagccaaacacacattttattcaaaaactttgggggggaaatggaaaaacaaacaaaaaacaccctcggtgccaaacactaaaagccccaaacaagcttcaacgggtggggccccacccttggggaaaaattgggggaccaacccctttttgggggggaaaagggcagggggacaaatggatgggccccaaaaaggctctcccaaaaaaagccccattgccttgggggaggtgccactatccaagggaaaggggggaaacattcctggaggaaaaaaaaaaaggccaccttttttaaagggtaaacggaaccactggtggtttgggccccccacaaaaaagaatcccccgcccc

SEQ ID NO: 52252 - DNA, 293 bp, Triticum aestivum
  Clone ID: PAT_TA_52252
gggccgttgaagcagcgcggcgccgtggtgcgccacgggacggtgcactggctcatctgggacctggtggacttccatgccatcgacgtggacgccgtgaccggccgcgtgtccctgcagaagctcccggccccgaggccgcgcgacatggaataccacctctacgacacgccacggataagcgtcgcggccgacgagacggcgctatcgtcgctctgccttttcagggagcccctccgagtagagacctggacgaggggggacggcggcgaggagtgtggccgagactgggc

SEQ ID NO: 52253 - DNA, 576 bp, Triticum aestivum
  unsure (1)..(576): unsure at all n locations
  Clone ID: PAT_TA_52253
cccacgccgtccgacgtgntcagatttacttaatgcctttgactacagtaataaaagtgactacagcaaacaataatcgcacaagtaccaggccaagatatacatcaagtcctttacttcaaagatatcagccacgcgcagaagagcaagtcgtgggtaaatctcgtagtcgattttcagaatacgaagacaacattattcgagacggtgttgctcaaggtttcacttggggacaaatctcggaactactgccacatcgtaagcgtgcaacgtgtttcaatcgctatagaacattacaaggtgtcaggaaatcacgtaaattaggtacggatgctatttcacagccgaatgatatgatctatcaaaccaagttatccttctcttntgtgagtgaaaacagtngtgaaatatcatgatnaccttcatgatctgatgatgaantatgttattgaccacctgctatgacaacaaccactcgtcgtttacatagagtgtntttacctttaaataatactggacctttggatggtggtgattctggttttgatgacctgtgaacacatactcatacacatc

SEQ ID NO: 52254 - DNA, 541 bp, Triticum aestivum
  Clone ID: PAT_TA_52254
cccacagctttcgcgacagcatggagtggggcagggggagatcctactgctcatggagcgggccggggtcgggccccgggaggagacaccgagcccccaccgccgacctgccgccgtggctgggggttgcctgaagcatctcacaagtctaaatgatccacgttcactgcctgcttgccggctcgctcaccatcctgctctcaagccatcatctcctccttacaaggtccaatccactgcctccctctcttcctcctgctggagaacacactctaatatgctctctcctacctggacgtgcaatccatccttctgcttccatcctatatattgttgatggctatgatcggactgacatcaagctaacactgctatatggcatagtcctcatctgcctttatcatcactgtggacctactacagctgctacatgacacctcagggtcggttgagacttaactctgatgatgatgaccttgctctgaacatattataccacgtgaggaatcatcagcatgctcatgacgtattcctctatctg

SEQ ID NO: 52255 - DNA, 426 bp, Triticum aestivum
  unsure (1)..(426): unsure at all n locations
  Clone ID: PAT_TA_52255
ccctgcctcccccangctcgttagggttttctcttttttcgggggagaaactcagnggcggcaccatgctcgtgtaccaggacaagctttccggcgacgagcttctgtcggattcgttcccttacagggnaggctggnagnaacngcgtgctctgggaagtcgatggccattggggcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagnagcttttcaagaaagaatgttgaggtccggccac

SEQ ID NO: 52256 - DNA, 580 bp, Triticum aestivum
  Clone ID: PAT_TA_52256
gttgctcccttggttcgatggtatgattgctgctgatgaagcctacttcaaggctcacggtgaacctcttttctcttctcacatgttggatctttctgaagaacccgttgaggaaaacattgagacctgtctcaagtacctccaacgtatggcccccatgggttgtttgttggaaatggaaatcggtatcactggtggtgaagaagatggtgttgataacactggtgttgataactctgctctttacacacaacccgaagacatttgggaaatctaccgtcgtttctctgagatcactgacttgttttccattgctgctgctttcggtaatgtccacggtgtttatgctcctggtaacgtgaaattgcaccccgaactcttgggtaagcaccaagcttacgtcaaggaacaacttaaggccgaagatgaaaagcccgtctacttcgtcttccatggtggttccggttccacacgtgaagaaattgatgttgctcttaagaacggtgttgtcaagatgaacattgatacggacactcaatgggcttactggaagggtctcagagacttctacgaaaacaag

SEQ ID NO: 52257 - DNA, 472 bp, Triticum aestivum
  unsure (1)..(472): unsure at all n locations
  Clone ID: PAT_TA_52257
ggctgacagcgtatctgataatggttcaaagaaggtgaacgtaaagatagcagagttcccgctttgtctcagtctgctcgttctggtcttcaatttcctgtaggccgtattcaccgttatttgaagtcaaaaggacacagccattcacgcgttggagcaaaggctgcagtatatacagcagctattcttgaatacctaacggccgaagtacttgaattagcgggcaatgccacaaaggatcttaaagtaaaacgtattacaccaagacatttacaattagctattcgtggtgatgaggagcttgatgctcttattaaagctactattgctggaggtggcgtacttcctcatatccataaatctctcattggaaatacaaagactggaaagaagatgtaaaaaaaaggaggaaaaaaaacaaaagtcaatattttttataataaatactataaacatatgcaatggtnttaac

SEQ ID NO: 52258 - DNA, 573 bp, Triticum aestivum
  Clone ID: PAT_TA_52258
gtcatcttcttgctctgctcctgctcggatccaataccctgctcctcaaccctcttcgcggcgcggtgcggagcggaacaacacactggagtcggcggagatgtaggtagtgacggttgacgaggacaagatgcccgtgttctacggtggcggcgctcacatcaacctcaaggtcaatgggcttgatggcattgaggttttcttcactatcaagagatccacacagctagaataatctgatgaacgcttactgcgaccgttagtctgtggatttgaacttcattgctttcctttttgatggtgctatgctcaccggtgagcagtacccctgcatgatcttgagatggaagaaggcgaccagatcgactccttgcttaataccaccggcgggtgctttcttggaccttataaggagctatgttgcacactgattgatctatgtagaacgctacctttagaactagagtaaaatgtctgaattgataaaactcgtgaggctatagctctgtgtcatagcatgagtgggggtctgacggtgaaatcacattagagtactgttgttgtcaagactga

SEQ ID NO: 52259 - DNA, 447 bp, Triticum aestivum
  unsure (1)..(447): unsure at all n locations
  Clone ID: PAT_TA_52259
agcgtccgnccacgctccgcccagcgtccgctcctcccccaccccacacacaccgcacgcgtttngaattttccgcccaccaccaccggnaggagcgagctccagnnccatggccgccaagnntgctacccgnacgnngtcagcgacgaagtacctggcggcggtcgccaaggccaagcgcaagctccgcggcttcatcgccgagaagaactgcgcgcccctcatgctccgcctcgcgtggcactcggccgggaccttcgacgtggccaccaagaccggcggccccttcggcaccatgaagtgccccgcggagctcgcgcacggcgccaacgccggcctcgacatcgccgtcaggctgctcgagcccatcaaggagcagttccccatcctctcctacgccgacttctaccagctcgctggagtcgtcgccgtcgaggtgaccggcgg

SEQ ID NO: 52260 - DNA, 239 bp, Triticum aestivum
  unsure (1)..(239): unsure at all n locations
  Clone ID: PAT_TA_52260
cggggggcgaccnngaccgcnccagngggngccgggccnngagnncagcagggcgggnncancnnccgggagcacaagcgncncccggggaccacgacggccgcnacgggnaccaaggggaagcngccnnagnncgggngcaccgacgcgccgcgggggancaacgaggnggaggaggncaagaaggagnacccngacgcgnacgnccgcancagcggganncgacaacanngcgccag

SEQ ID NO: 52261 - DNA, 495 bp, Triticum aestivum
  unsure (1)..(495): unsure at all n locations
  Clone ID: PAT_TA_52261
ctcgcttctcctctcggggctccgcttcgccttctccgcagcgcagccacttcgggatcgggaagcgggaggggaagggagaggcaggcgagtcgccgtaggccgtacccggccgcagctcccctctctccgcccccgcctacccctgccacccgtccctacccccgccacgcacgatgagctccgcccccgccccgccgccgccgccgccgnagnccttgncccccgncgacgaggggcggncgagggaggccacggaggtggacgaccgggtggccttccacgttgacccgttcctcgtggaggcgctcganaaccctcgncaccggcttatgattttgngggtggaattggttttactgaattttatgnggaatgttgnnctgggtgaatttgggttgcagggttttgnagcttgttanttgtggtgtggtggtggtggtgttgngcaggtttttggttttgagtttgngtgtttggttggtttaggtggtg

SEQ ID NO: 52262 - DNA, 614 bp, Triticum aestivum
  unsure (1)..(614): unsure at all n locations
  Clone ID: PAT_TA_52262
tttcccagcgtccgcccagcgtccggccacgcgtccgcccacgcgtccngaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggagttttaaaggataaaaagtttaattaaggttggttggggggggatagtttttttttagtgtancttaatttaatttaattggcggtgtttttaaaaggtggtggttgggaaaactttggtttttccaattttattggttttggggnaatttctttttttttgggttggggtattaggaaaaaggttggnattgtttgttttttttaatttttgtttattttttttggggattggtagtggttttttaggggttttttatttgtggtggttttggtgtttttgggggggttggggttttttttttttngttgtttttgtgggggtttttttggtttttttgngtttttttttggggggttttttttgtttttttttttgttgtttttgtttggggtgtttttttttgggtttttgtgtttttttttttttgtgtgtttttttttttttttttataattttattta

SEQ ID NO: 52263 - DNA, 422 bp, Triticum aestivum
  Clone ID: PAT_TA_52263
tccggccttccgggtcgcccagcgtccgaacaaatcttttttttcgcaactgtcttggcagcctcgttgataacaaccttcttggtactggaaagtatctcaagccgccatctatggtcatgctggtggtgtttgggctacctctgctggtttccagtgcacctttgagtcaagaaatatgtggggtgctaacccgaaaagccctgctcatggtattcacgttgcaggtgagaaaactttgtaattagagctgatgaacgttccatctacggtaaaaagggtgctgatggtatttgtatcgtcaagactacgcaagcatttttggtttgtacttataaagaaggcattcaacctggtaactgtaccaaggttgttggaagcattagctgattacttgggatctctgtggggctttttaaact

SEQ ID NO: 52264 - DNA, 429 bp, Triticum aestivum
  unsure (1)..(429): unsure at all n locations
  Clone ID: PAT_TA_52264
nacaacaggtttcatcattccattctcaggtgttagtctttgtcttcttgtctcttccatgagctcggttcatctgctgttcctgtttctggtaaatctggatcttccactaccgggccgtctctgggcatctgggacaattctgccctccctcctctcatttccagccggggggctcctccttctaacaagggaagtaaaagcgatcttcaagctgaaccttactacatgcaaaagaatacagaatggtatgagtcccatggtggcaacctgacatccatcggaaagcgagatgacaatttggttggtggcatgactttggatttacctagcgatgctcctcctatcagcctctctggatctaccaacagcgcctctgatggtggtaaggttgttgctgctactactgctcaaattcaagagttcacc

SEQ ID NO: 52265 - DNA, 391 bp, Triticum aestivum
  unsure (1)..(391): unsure at all n locations
  Clone ID: PAT_TA_52265
gntgatgaccgctttatcttggactacattcataattcaaggataaatatcaacataagacaagtatactgaagctactttagttattgaaagtttgctcccctgccgcctcccaggcccacaatagatgagcaattgtttgattaactgcatctggagtttattctgaaatgttgctggaagaagaccaggagaagcattcatgttccttcaaagggtaggcctccaatggacagagggcatttttgataatgtcataccctcagcaagacctcagttatcattaatgcgagagattgtatatcacttaatggcttagtgccgtatgtgtgagtagttgttcatgttgtgtactcttttccagaaaatttacttgccaagatctctgtct

SEQ ID NO: 52266 - DNA, 578 bp, Triticum aestivum
  Clone ID: PAT_TA_52266
cccagcgtccgccgcaactacctcaaagaacaatctcgcttacgcaccaccgtcttcgacaccactaccccacaacaccaataccgaaacaaccgtggcaatactgtagcaatggcgatgacgaaacgaagcagtagtagtatgagtagtaatagtagcattcattcgtactcgtccgcgagcaatgtccgcgctagctgctactccgtaaacgctgctaccgccagccttcacggtttccattactccactaccccgtctgccggggccgggtggtgttcctgaggtcagctcgggaattccatcacccccttcaagtccccccctcgccgccaaaaacgcgtccaccgcccaaggtggcaaggcgcgcagagggggggcagcatacaccatcacgggagagtgtgagagactcttctgcgagacactgcgatctgtattcctgggtgaggggagccagcatcgccagaactcgctagtgatgggtatgccatatgacaacactacgactgcaaccaccgctatcaccaacgactacggtgtcgatgctcgtcgctactcggactcttcgactgact

SEQ ID NO: 52267 - DNA, 587 bp, Triticum aestivum
  Clone ID: PAT_TA_52267
tctaaaaaaaaaaaaaaaaaaaaaaaaaaggggaaaaaaaaaaaaaaaaaaaaaaaaaataaaaaaaaaaaaaaaaaaaaaaaaaaaaaaaaaaaaaaaaagaaaacaaaatttaaaaaaagggggggtcctttttacgggttccaagtttacttacccttttttgcgtctcatttaatttttttttgggggcccctaattttactcccttggcctttttttttaccccgccttttctggaataaaccttgcttttccccatttttttttttttgaaaaacttccctttttccccggtttgcttttttcgcatttgccccccttttttcccctttcctaacatttggaccgcccctttggctatggcttccccccttttggcggttttttttccccggggggtgtgcttttttcttgcccgtttccctttcccttttcctttgcctttcccccctttttttttttttttttccctcctttttccccccctttttttgtttttccccctctttttttaattccgggtttcctttttgggcccctttttctccttttacggcccttttcccccgaatactttttttggg

SEQ ID NO: 52268 - DNA, 325 bp, Triticum aestivum
  unsure (1)..(325): unsure at all n locations
  Clone ID: PAT_TA_52268
tcgacgttgcatctaagctcatgcagcgcgggttgtgggctaacgttgcacgaagaggtgtnctgatggttgttctccatgcaggtgatgaggatactaatgtttacaatctcatgctctggtagaacgaccatacctatacaagctatagctcttaatgatcgtactgtccattccaacaatattgtttaatgtgttagctgtgtagggcgtgagcgttagtttaagcgtttgggatggcactggttaggaaaagatcagggccttgttgttgtagtggtttgaaatcacccagagtgtgatttttggggaggacaggagttac

SEQ ID NO: 52269 - DNA, 577 bp, Triticum aestivum
  unsure (1)..(577): unsure at all n locations
  Clone ID: PAT_TA_52269
ttgcttaattcaagagttatagggagggacttatgtcaccacnaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgc

SEQ ID NO: 52270 - DNA, 453 bp, Triticum aestivum
  unsure (1)..(453): unsure at all n locations
  Clone ID: PAT_TA_52270
gtcgagcctcggttctgtttgcgtgtccgacctcgcttgcccggatcaattcgtcgtcgactctgcggttgcgctcgcgcacctcaacctgctcatccacattgacttcggcaccgtccctgttgcaaactccgccgaccctcgtcatcaggtagatccagggactccgttcgccccacacctgcgcggattccaggtggtgccgnctttcgacatgacatggccttcgaagactgtgacatcaatgaacagntngccggagcctgtggctgnctcgacaaccttaccaccacgtnctgtgagctgtgcccggttcacattttttccctggnttnctctctcctgtnggtgccngaggaggtggacgtggtttctgggttgtccacctggtgtttggttgattgtttgaggtgnggctgtggttgtgtgttgggtggtgactttgtgattggt

SEQ ID NO: 52271 - DNA, 500 bp, Triticum aestivum
  Clone ID: PAT_TA_52271
ccattcagcggtctttgcgctggtatgtctaagtctacaatgcctcaagatcattacacgtccacctcaccgtgacagtctagccgcgctcactgcccctcagcctgacggcctgtccgtacttctgcagcttcgtaatgagctggtcaccctgcttgactacgtctgcgtactgcttgttcttgtcgtcgggtcggttggtctcgatgatgcccttgacgcggtcgatggtgcagggtatgcggtcggcggcgatgaatcgagcgaggtccttgtcgaggaagtcaacggtgacgccaaagtccttggccatgctctctaggccgacgaccctgtacgactggaggagttgctggtatccccgtaggcgcatctccctcacgtaccagccacggtgctcgtacatgtagcgatcctggctgaggaagttggtctcgacctcaccaagagcaccgaagaaggtcttgtagtcaccctcgtacaggctcttgacgagcttc

SEQ ID NO: 52272 - DNA, 579 bp, Triticum aestivum
  unsure (1)..(579): unsure at all n locations
  Clone ID: PAT_TA_52272
cggncgcgtgggcggacgcgtgggcggacgcgtggggggagccaggacttcttcgacctgtccgtcatcgacggcttcaatacgcccatgagcttccagcccgtcgccggcgcgccgtgccgtgcggcgacctgcgccgtggacatcaccagggagtgcctgccggagctgcaggtgccgggagggtgcgcgagcgcgtgcggcaagttcggcggcgacacgtactgctgccggggccagttcgagcacaactgcccgccgacgaactactcgaggttcttcaagggcaagtgccccgacgcctacagctacgccaaggacgaccagaccagcaccttcacatgtcccgccggaacaaactaccagatcgtcctctgccccgcccgaaatgatttacacatggatcagtaagtagaggacgtactactccttgtggtcttccttacttatgatgatcaacgatcatttctgtgtgtgcccatatataatgtcacatgtgcgtgcgtgcatggctggtgcgtgccattcagcgaataaatgtataaataaaatggaaatgtaatttctacgattatgtgg

SEQ ID NO: 52273 - DNA, 592 bp, Triticum aestivum
  Clone ID: PAT_TA_52273
gaaattccccaatcctctcctggttcttccaatccctaaaactattctctcaaatcttgcttgattttcaagatggcatcggagcaggttgaaatccactgcgtttcttctgtgatttgaggttggcggtgctgtgttgccgtccagattcgccagcttggctacggcggctaggcagtaagctttgaatcatcaggtcgcccctgtgttagttgataaggaaaggagaagctagtaatgtcttgccgcatctagccgcactgccgccggtatacagatttgttaatctgcaggtgagcttcttgctgtcatccgccaatatacggccactgcctcctctgcatctgaccatctgtatgagaaggtgataatagcacctgtgattccctttggattattgcgattagtactgactgcctgtgaactcgtcaagtcaagcttatctttgcttggtggctggattaaaatattctgcttgtgctgcgtgtgtgcatctaagagcaactcatactaatacatctacttgccattgtgcacgagtgtgttgctggtggagtgctcaaaaataagtcctgtgtgactgggtgtttgt

SEQ ID NO: 52274 - DNA, 596 bp, Triticum aestivum
  Clone ID: PAT_TA_52274
cttgccattgcgtctagcactctagcacaatccaccaatgcttgcgatcctaatacgtgtaaattacccaattgtctttgcccttctcaaacccctcctggtggtcttagtccaaaagatgtgcctcaatttgtaacaattacatttgatgattccattcaacctcaactgttggctacagcacaaagatttattaaatgtgaagaaccctaatggttgcgctgcaaagggttcatggtatgtgtctatgcaatataccgattttgctcttgttcaacaatggtatgctaatggaaatgaagttgctgatcatacatttactcatgttggatctccttcttctcaagaaattgcggctgctcgtgccatgctgaatcagtatggtggtgttccccttggaaaaatcaagggtttccgtgctcctttcttaaactatacgactgatacattaagagaaatttctaaacaaggttttcaatatgatacttaggttactgctgatgttgatgattgctactggccatatactttggattacggtttacctaatgattgttggaataacgtttgtggtactcaacttaaacttcctggta

SEQ ID NO: 52275 - DNA, 424 bp, Triticum aestivum
  unsure (1)..(424): unsure at all n locations
  Clone ID: PAT_TA_52275
ccgacgaacgaaccaagctttctcgtcctccgaaagcagnactttgtgnaaaaccctcaccggcaaaaccatcacccttgaggtcngagtcctctgacacgatcgacaacgtcaaggggcgaagaatccaggnnacaaggngaggcatccctccggaccagcagcgcctcatctttgctggcaagcagcttgaggacggtcgcaccctcgctgactacaacatccagaaggagtccaccctccacctggtgctccgcctgcgtggtgngaatgcagatcttcgtcaagaccctcaccggcaagaccatcacgctcgaggttgagtcttcggacaccatagacaacgtcaaggcgaaagatccaggacaaggagggcatccccccggaaccaagcagcgcctcatctttgctcgggaagcagctt

SEQ ID NO: 52276 - DNA, 576 bp, Triticum aestivum
  Clone ID: PAT_TA_52276
cccacgcgtccggaatacataaatgccctttctagcaatgttgagtatctagcttcacgagatgctacaatcatgggaagcaggaatggtcatgctcccatcttcctatggtacaccctcaacaggaaaggctatagaggttttcagaaggaagttcagaagtgcttgagaaatgcacattatctgaaagatcggctcaaggatgctggaattagcgctatgcttaacgagctcagtagtacagtagtttttgagaggccaaaggacgaggagtttgtgcgacggtggcagcttgcttgtgagggaagtatatcacatgttgtggtaatgcccagcgtcaatgtcgataagctggatactttcttaaatgagttggtggagaagcgggtaacctggtaccaggaaggaaaatgccaatctccttgcattgcagctgatgtaggccaggagaactgtctttgtactctgcacaagacataagtttgtcaggagacactctctgtgagtggtacttgagtatttacattggttggtgccgtatttaccaccttccaatcgtgcatcctttattgttcc

SEQ ID NO: 52277 - DNA, 601 bp, Triticum aestivum
  unsure (1)..(601): unsure at all n locations
  Clone ID: PAT_TA_52277
ngatgcctcctaaattcgatccttctgaggttaagatcatttaccttcgtgctactggtggtgaagttggtgcttctagtgctctcgcccccaagatcggtcctcttggtttgtctcccaagaaggtcggtgaagatatcgccaagggtaccaaggactggaagggtcttcgtgtcactgtccaattgactattcaaaaccgtcaagctcaagtttctgttgttccctctgcttcttctttggtcatcaaggctcttaaggaacccctccgtgatcgtaagaaggaaaagaacatcaagcactctggtaacatctctcttgacgacgttatcgaaattgcccgtaccatgcgtttcaagtctttggctcgtgagctcaagggtactgtcaaggaaatcctcggtactgctttctctgtcggttgtaccgtcgaaggtcaaaaccccaaggatctctgtgatgctattgacgctggtgaagttgaaattcccgagaaataaacgtagcaattttctgtggaagaaaaaaaaagagtgtcaataccttttttaaaaacttttcttgtatacataaatgatttctgcagtttcttattgtaaaa

SEQ ID NO: 52278 - DNA, 391 bp, Triticum aestivum
  Clone ID: PAT_TA_52278
gtgacgcagctgacgcaccacggcatgctgttcgtgccggtcgggtacacgcacggcgccggcatgttcgccatggacgaggtcaagggcggcagcccgtacggtgccggcatcttcgctggagccgatggcagcagggtgcccagcgatgctgagctcgccctcgcggcgcaccagggcaagtactttgccggcatcgccaagaagctcaaagccgtctgaactcagatcacgagccgtgtcccatgattcatatcaagtactcaatcagtacaggatgatttgacacatcattttcagtggagcagatttacacaattctagacaatttaactgtactgcattttaatttcttgtttggacaaataatacaatttcttgttctgagtgg

SEQ ID NO: 52279 - DNA, 473 bp, Triticum aestivum
  unsure (1)..(473): unsure at all n locations
  Clone ID: PAT_TA_52279
ggnanaggagaaggggtggagactctggnacaccagagtggtcgggtgccaacttctatgacagnnggtgctcaagnaaccgtgcagggnnncggcatggtnccctnncaacccgnncagccccatgggnnaaaaggngnngctacnagnnaagnagncagnnttctggnactanagcctggaagtgagagcagtagccagcacgctcttgccaagtccaggatgtgatgaaggttgagaaggaataatgattaagaagaaagctctgagataattggatagaataaaagcggcacgagggcacatcagctctggaaatagatacgaattgatcactataattggcatggaattgcctagctatatatactcctacgaattatgtcaggctccaattggatatgtcaaatcggggtaaactttattgacgatgtctttcaggtcgtcatttttttcttttgaaaagtgagagc

SEQ ID NO: 52280 - DNA, 440 bp, Triticum aestivum
  unsure (1)..(440): unsure at all n locations
  Clone ID: PAT_TA_52280
attttgagtggtactgngagaacgtcaaggtgattatgtctttacagccaatcaatatggtgaatactctttttgcttttcaaatgaaatgtctacatttgcagaaaaattagttgattttgaaattcttgttgaacacgaacttcgtcctcagtttaaaaaagacgaaaaggaacaacctaaaacattgacagagatggaagaaagcatctttaagctctcaacctccctcacaaacattgctcgtacacaaagatattttcgaacaagagaaaatcgtaattcggtcactgttttctcaacgggtgatagactattttggttttttattttatcaagtttggccatcatttctatggctgctttacagatattcatcatcaagagcttctttaatacaaaaaagggtggtgtttaacaaaataaataaggcttttatt

SEQ ID NO: 52281 - DNA, 595 bp, Triticum aestivum
  unsure (1)..(595): unsure at all n locations
  Clone ID: PAT_TA_52281
ggtgacntaccgaattcacttggcggggcaggcctcacaacaccaaaaatatacttgcacacttcatgcagcattggcaacaatggagtctttgaagaaattccagtacgcagaatttcagccaccaaaagattttgaatggattttgtcggctataaaacttaccgcagaatataagactatcactgagaagaacattggagaagaagcggatatggcacaaaggggttggagacgccttgaggctggtctatacactcttcaagagattggcgcggaaggacacaatactctgcagcctaagaaagacccgatacgtttcaagcttaagtcctattcaagaattgatatcaacgaaaacgaaggcgaaggcctgaaagtcgcagttcgtgatgtaagagctggaacagttttcttgatatatttcagaatttcccgaaactacttcaccttgaagcctggagagatttaccactacgacgccacgaaggcttatgtaagcccgtcattttccatccctgcttctcatgtggtaatgatgattgggtaaggtgatactgcgatatgcacagagctgcctaacggaggtacacaa

SEQ ID NO: 52282 - DNA, 579 bp, Triticum aestivum
  Clone ID: PAT_TA_52282
cctccatcgcgtcgcacccaaccctaacccatcccaccctcgcgccgccgccaccggatccatccgcaccgccgccgccgcgaccatgggcttcgacgtgggcgtcgtccccttcaaccccgacggctggggccctcccgacgcgccgggcgcggcgccgctgctgggcggggccgtcgccacggcctccatccccttcgcgcccttctcccgctccgacaagctgggccgcatcgccgactggacgcgcaacccgggccacccgggtgcgcacggccaccacgcggccgcggcctcccgcgactcggtcttcgacttctcctcggccgacgactcgctcgccgccgccgccgaggactcgtccttcagcctcgtggacgccaagccgccgcccaagcacccgcgcttcggccccaagtggcgcttcaaccagcgcccccagctcccccagcgccgcgacgaggaggtcgaggccaagcgccgcgaggccgagaaggagcgcgcccgccgcgagcgccactaccagaaccaccgctcccaccaccaccagggcttccgcggcaaccagcagaacaccgc

SEQ ID NO: 52283 - DNA, 589 bp, Triticum aestivum
  Clone ID: PAT_TA_52283
tgatttattttattatcaagtttatctttcttcagttttatccatgttttatttcttttaaagcaattaaattgaatcaacaagaagactttgttgcattattaacattttggatagtttctattttatttttatcagttgaatattttactgatattttcttattttggataccattttatacagaaataaaacttttgattttattatggcttattctaccacaaacacagggtgcctttatattttaccagcgatacttaaatccatttttcaatcaacatgaaaaaacaatagaacaaacactgatcagtgtacaaaatagtcttaaaacaatggttttatcttggtttaagagagttattccttctagcatgattacaaatgaggaaattaaagaagaaaggactatattaaatccatatagtttattttcttatagtatgaaggctgaaggaaaaagttcatcaatagctacgagtgatagtgacaatggcgataatacttggtcagcttatttttcaagttggatatggaagaatagcaaaattgaatgaagttttctttatataaaaaccatccattttta

SEQ ID NO: 52284 - DNA, 586 bp, Triticum aestivum
  Clone ID: PAT_TA_52284
gctaatctatagtagaattttattatttatttcaatcgtgcatacactagaattaggtcaaacatgcgatcctgcaccactttacaaatcaggcacatttgaatatgatgactcttgtagtaacatttatctgttttgtgatccaacaaccaataaatgtaattacaaaggctgcagtaattcagactatattaaaaactgggatacaagatttagacatattccaacaagatgtaacagttcaagtttttgccctgacaataattctcaatgtactcctcttctctctgttggagctcactgtgaattgcaaagagatgatgaatgtgcaggatcaaatgcaatttgcttgaattctacttgttttattaaaggcgctcccttgggtggtaattgtggtgctgataccactgtttattattcacaagatgcagacgaaaatatggtccagcaaacaattattcgtgataattgtacagatggtacttattgccttggatcgacctgtgttgtttctaaaccactgaattctgcctgtgatcaagatcgtgaatgtctctcgggctcttgctccaatgatggtctc

SEQ ID NO: 52285 - DNA, 500 bp, Triticum aestivum
  unsure (1)..(500): unsure at all n locations
  Clone ID: PAT_TA_52285
naaaaaaaaaaaaaaaaaaaaaaaaaaaaaaaaaaaaaaaaaaaaaaaaaaaaaaaaaaaaaaaaaaaaaaaaaaaaaagagaaagaaagggtctaaaggttctaaggtttacttactttgtgtatgcgtgcttttcacctttttttgttgtgttttctgggtttcattttaattgaaccgtcggttctgcttggttgggcgcctgggttaactggtggaggttttggggtttccttgtttttttgcttttcccccttttcccttttggcctcttggggtattggccgggagggctcgcctttcccccttttgtccattttttttgccttttgggacgttgtttgtcgcgttgtattggccctttggggtgggggggtttgggggatttgttctgtttattttgtcagtttcctagggccttgtcgttgccttttttccctttttttttttgttttgttgggcggtttttccccgttttgcctttaatttttttggttcc

SEQ ID NO: 52286 - DNA, 610 bp, Triticum aestivum
  unsure (1)..(610): unsure at all n locations
  Clone ID: PAT_TA_52286
attgaaagatataaggaacgaagccaaacagcaagcttttacgaataccttgtccagctagaagataatactactttctcttcaatcagtgaaaagtcagaatttattacatgccttttggatgatttaagaaagcaaacagactgggatgaaaagacttcagcaaaagcattgtctattttaaaaatattaggccgcaatgtagatggatctgatcctttgtttaccaaagaggcaatgaaccttttatcgaagcttgctggattacaacaacaaaaggagatattagacacacttacttcaagagaagcactcaaatgtatagtcaactctatttatttaaaatccgaattaaagaaatacttggaacccacaatcgaatcccttcaaaacttgttatgcaatgataccagtcaagaaacacaatttttaacttgcagaatcctgtttttgttgacagtcaaccgaattgatttggttaaacaagtaatgaaacttgacattgcaaaaggcatagaaaaagtattgctagaaaacgtatcaatcctgaaagacaagaatagtcagcctattgatcaaaatacactcatcaatcctgccnactgttagt

SEQ ID NO: 52287 - DNA, 588 bp, Triticum aestivum
  Clone ID: PAT_TA_52287
gcgagctccaccctcggacgagtaatggcgatcaagaagggaggcgcggcggggctgaagcagatcctgaagcggtgctcgagcctgggccggcggcagcagcagcagggccacgggcaggagcagcggcactgggaggaggaggaggaggcggcgccgtcggacgtgccgcggggccacttcgcggtgtacgtgggcgagtcgcggcggcggttcgtggtgcccatcgcggtgctggaccggcccgagttccgctccctgctccgccgcgccgaggaggagttcggcttcggcggcgccggggacctgctcgtgctcccctgcgaggagctcgccttccgctccctctgctccgcctcctccctcccctgcgccgccgcccgctgaggccccgaccttccatttgttcggtccgtcggtccggcctggcgccattgccaggcgggccgacggccggcgaggtgcagtgcagtgtgtaaatacggatccatgcatcgattcgacgcggcgcatgcgcgtattagcgcgcgcccttggagccaccattgatttgattgccgtgtgtgggctggaagaagatggaggaag

SEQ ID NO: 52288 - DNA, 367 bp, Triticum aestivum
  unsure (1)..(367): unsure at all n locations
  Clone ID: PAT_TA_52288
naaaaagaaantttctcgagggggggtgcctttttcgctttctttgttgttactgggttttgcntcaagcaccacttaatgccggtatcgccatcacttctcctgtacttagtaccgaaataaaaggtggctctaacttacaacgaggacggctgaaaaaacgggcaatgaaaatggtgggggagggaagtgctactgactcgtattgaaaatcttacaagggttatctgttaaccnnaaatagttgggagtgcaacaagtggcacagaagggatatgtttgaaggagtggaaaaacagtacactagtattgctttactttggtattaaaaataataataaaagccggttgtaactttggatcacac

SEQ ID NO: 52289 - DNA, 246 bp, Triticum aestivum
  unsure (1)..(246): unsure at all n locations
  Clone ID: PAT_TA_52289
gttcctcccttggcttcgaggcaggagccacacggagaattgaaccgcttgagacagttcaagccaatcctgacaagattcatttccttgaagtcatcatgcctcaatttgattctcctcgtggaaccttggaacctctnggttgccaactctgaaaaccgttaaaagcggagaattcatctttttttgtatcattcgttctctatttcattactacagtaaattcataataaaatcatatttttg

SEQ ID NO: 52290 - DNA, 604 bp, Triticum aestivum
  unsure (1)..(604): unsure at all n locations
  Clone ID: PAT_TA_52290
cgtttcgtttggctttacttgtgntgtgatacacccatgccagaggtgttggaaaaacatggagattatcgaaccatgttttctattgtctttggtcttgccgccaaggatttagatgtcactttgacttgggatttttttgatgtggtagaagcacaagagtatccttcattaaaagctattggcaatagaacttacgatgcgattgtgctgacgggatccaaatacaatgcacatgataacacaccttggatagtcaagttggtcgatttcttaaagacgatgcgagtggaatataaccagagtgttcgattggtgggcatttgttttggacatcagatcatactacgttcatcgggtgggacgacgggtagaaatgaaaaaggatgggaggttggctacactgaaatacaattaacctcatttggaaaaaccttttttgacaccgacaggacatttttgagagtcaatcaatttcatcaagatcatgtatcaaagttaccggatggatttcaaactttagcctttacagagaacaatacaccacatcatgcgactgtctctgatgatcgtcagtgtattactgttcaaggtcatcctgaat

SEQ ID NO: 52291 - DNA, 320 bp, Triticum aestivum
  unsure (1)..(320): unsure at all n locations
  Clone ID: PAT_TA_52291
aattgtntaagaataagaaagtggaagattaagaaagntngtgggttagagatatagaaaagaaaaagtgaaaaggattaaaaaagagggaattnntaatnnaatnaaaaaaccnattttggtnttagtgtggntggaggatnttnntatgttntantatataagtntnatgggtgggatataggttttatttatgaattgntttgatggatntggtgttgatantattganttgattgagtgttatgagaatggatgttttatgtttgtatttagaagatanggttttttgttgtggatgggattagattgggagttat

SEQ ID NO: 52292 - DNA, 431 bp, Triticum aestivum
  unsure (1)..(431): unsure at all n locations
  Clone ID: PAT_TA_52292
tccgaaatccgggtcgaccagcgtccgcaaaccaccgtccagctgcgccgccgcccacccgcatcgacctccgcagctccgaccgcgacgagctcgaggagcacctccgctctcaaggccgcacggccaaaatccgccgccgaatatccaacgctcctctctncgaaccaccgtgcccctccaaccccatctccaacccgctcctccgcctcctccacccgccgcccgacgccgcgccctccaaggcccagcgcataggcctncaccccaccggcccgtagtcgtaaggcgagagactgacagccatgggaggaagagaggaatgctaggggtggtggagaaaggacgtgtgtaaaagatctaagattanggtaggagtgaatgaagaagttgtagggtgtaattaattgntggataccgttaaaaataaa

SEQ ID NO: 52293 - DNA, 241 bp, Triticum aestivum
  unsure (1)..(241): unsure at all n locations
  Clone ID: PAT_TA_52293
gaagctagncctcgtcatggtgacaggggggggcggcaattattacacccctccaggttctccaagcatgttngaccatttcacccggaccgttacccgccaaagctgaacccaccgacgacgcttaccgccagtnntcagaaactacagggnagtgggacgggaatgggacatcggtnccctataacctgggnaccttatttggnattttaccatggtacccccaaaaggggcctaacgg

SEQ ID NO: 52294 - DNA, 587 bp, Triticum aestivum
  unsure (1)..(587): unsure at all n locations
  Clone ID: PAT_TA_52294
atccatttctctcctcctcctcctgccaccgatcccgaanagggaggaacccggcgcgaggagggcaaaggaagagaagaggagatcaccgagcccagcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgccaacaagcaagatcttcctaatgccatgaacgctgctgaaatcactgacaagcttggcctgcattctct

SEQ ID NO: 52295 - DNA, 466 bp, Triticum aestivum
  unsure (1)..(466): unsure at all n locations
  Clone ID: PAT_TA_52295
gtcccgtccccagccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggncactggaagcacagtgacatnaagcttaaggacgacaagactttgntctttggngagaagccagttacngtntttnggngtgaggaaccctgaggagatncngtggggtgaggttggtgccgattacgttgtggngttcatgggtgtgttgattganaaggacaaggggggtgttgatttgaagggtggtggggnganggtggtgtatgtgtggttgtggtttagatgtgggtatgtttt

SEQ ID NO: 52296 - DNA, 462 bp, Triticum aestivum
  unsure (1)..(462): unsure at all n locations
  Clone ID: PAT_TA_52296
nntcgcgaaccctaattngaccaggctgtgcctgcagatcccgtncccttctgtcgccaggagcagaacccacccgttnggaccgtgccgngtaatcgtcatggggaatgaggaaccngttgatttaagaagttttttgaggagcggtgcaggccacagtgtgtaaagccactgtgtgagtgtgagaaatgtntnatgagagttgaggtcgatgattctgggctcatgctctggagtgggtagtgttttgactattggtgatgggtngattaatgtgtgggtgcgaaggtttttggggtggtgatgtgatgttggggggttgttttgagtgagtgaggttggttgttgggctgagtcttgttggggttgtggtgtttgggggggttgggggttgtggggtggttgtgtggtgttgtggtggtgttggggttggggggtgtgtttgtggtgtttttggggggg

SEQ ID NO: 52297 - DNA, 559 bp, Triticum aestivum
  unsure (1)..(559): unsure at all n locations
  Clone ID: PAT_TA_52297
cgcgtgggnnnggagtgtgggggtagaacagttttggggtgaggttggggtggttggggagcttggtttgttttttgttgttgtggtgtgagtgatttnnaagtnnnagagtttgaaatgagttgtttnnatgntttttgntgaagtttagtatgtatggttggaaaaaatatttggaggtttgttggtngaaanggagagatgagattatgggagatanagtgggggtgtgatttgtgatgttttggggggaattgnatattttatgtttattgaggtgatgttttataggagtgtataggagtttgtgtntgttattttattggtggtgatttatgtgtttgggttttttttaaataattggtgagatatttttgggattattgattgttaagttgtgttgttttttgtttattgtgtttgtgtttttttgtttttttttgtttgttgttgttttttttttgtttttttttgttttttttttttttggttggttgtttttttgttggtgtttgttttttttttgtttttgttttttttttttttttttttttttttt

SEQ ID NO: 52298 - DNA, 225 bp, Triticum aestivum
  unsure (1)..(225): unsure at all n locations
  Clone ID: PAT_TA_52298
agatgaacaagaaagaaagaaattnaagaaaatgaaatataaatggaagngcgtgtttggaaaaagaaagggaaatgatgtganaatgtnnagtgattnaggttgtangtnnanaanagnagntgtnaanaatnaggatgaatnnatggtttattnangtntttntttttgtggtgtannnatttgtttatttngtaanaaggtaaggaaggcagtattaaaaag

SEQ ID NO: 52299 - DNA, 315 bp, Triticum aestivum
  unsure (1)..(315): unsure at all n locations
  Clone ID: PAT_TA_52299
ttagaaaatattggaaagnaaagaagtannagttaagaaggagtttaaatggtgtntnagttggttgagagnnanngtgttggtgttgaggtttagaaggggaaggatatttgnaagaagaagattgttgagtttgtggaagtggttggtnttttngaaagggttttttgttatggatganatggaggaggttgggtataattgtgagagtgggttggtgtggattgttataaagatgaagaatgagtatatgtttaatatgtttatatagtatgttttttaggatattgatgtgattgtttttgtggaaaaggt

SEQ ID NO: 52300 - DNA, 294 bp, Triticum aestivum
  unsure (1)..(294): unsure at all n locations
  Clone ID: PAT_TA_52300
ttcttggnacgcgtggngcgcgtnggggttgtggtagggccgttccaagaggggcgctngtgaaattgttgggagtggnncgcctggtaattattancangttnggttnaggtgttagttgggtgtgaaaatgaaancttattattattagattacctaaggacgaacgttttatatttggtgggtgggggaggaacangaangttgtttttttggattaanaatanngaaatatatttgttgngtntgaaaataatgttattgtggattgaaaaaaaataggggtggttgttt

SEQ ID NO: 52301 - DNA, 586 bp, Triticum aestivum
  unsure (1)..(586): unsure at all n locations
  Clone ID: PAT_TA_52301
tcgctgttttgggtgctattatgtattatattgactaaagtaacagccatggttcagcattgtattgacccttccaactgtcagtttttcccacttcacagttgctttgcaacagaggaaggattagtgtgtaaaagtagagataagccagggtttgaaatgagtatggacccagcttatacacttttatattcacacatatacttacaaaatgacactggcttaccttgtttttctatacccataaccgatgagcttataaattatgtcgactatcgagggccagatgtaattgatgttgaagatctgccattaattggaaactgcagtcgattgtctttttgtgataaaaaaacaaaaacttgccaaccgaaacgccctgtaggttctcactgtcgacataatatgcagtgcattgttggtgacggcggtattcctggccactgctccaacaagtcgatatgtgaggttagacatgacctcccagcttattattatgacagtacacatcagtggaagatgggtgaagaatggncagctgctacaatagctcttgttgtttcgggtatgattgtgctctgtattg

SEQ ID NO: 52302 - DNA, 454 bp, Triticum aestivum
  unsure (1)..(454): unsure at all n locations
  Clone ID: PAT_TA_52302
ccggaaccggaaattcccgggtnngaccccagcgttcggtagcagnatntgttttgttgnaatggtgaaaagtggaggggtacgctgaannttgttttatgtnntgaaaagcatnggtctatttgggatnagttggattggtgggagagtactntngtgcaatgagaaaagggataagtttgtgntnnnntgnatgnatnaagagnnnattaggttgtgtggttntgagagttaaattgnnattgnntgtgntnagagtnntgnagttattatttnttntgaattttgnnatatttgataggatntgttgnagaaagattttntaaagatggggttgtaaaatattggtgtttgaaagaaggatgatgggttgtataggtagtagatgtttagaatgttgattaaaattgaagggtgtggtattggtgtgtagagtaattttgtgagaatggtt

SEQ ID NO: 52303 - DNA, 282 bp, Triticum aestivum
  unsure (1)..(282): unsure at all n locations
  Clone ID: PAT_TA_52303
gactgataaagtcgatgatgcggtgggcggtaaagtatttgggggagtatactagtataggtggaaatggttttaatatgttatgtcgattggtgaggaaggtgtttgtgttgctggaaatttatgtatcagagggttatactttgttgtgtgtgggtggggattggatcgggagcttggtgttgcaaggtgataggaatttatttttggaanttttantaagttnggtgnatatgtttgtgtttaattggagaatgggttgggggatttggtgaattgttg

SEQ ID NO: 52304 - DNA, 217 bp, Triticum aestivum
  unsure (1)..(217): unsure at all n locations
  Clone ID: PAT_TA_52304
ggtaccgganattncccgggtcgnacccagncgtnccgcggnagcgtgggtcgaccgggtgttgggccgttgttgcggcgtaacagattttgtaaggcgagaagtcgaagttgctgttgaagccacttntggccaaatgtccgttggaagattgctnttncaagnaaagttnttngttgtgctcttgttcacgatggtnttgntngggggggggggg

SEQ ID NO: 52305 - DNA, 383 bp, Triticum aestivum
  unsure (1)..(383): unsure at all n locations
  Clone ID: PAT_TA_52305
gggncaccatcttcttcacccagggggggggggcccgnccaccgtgacgggagtgtcaccggactcagggagggctcccggcttccatgtgcacgctcttggcgacaccaccaaggctgcatgtcaactggnnaccacacttncaaccccgctggtcatgtgcatggggcacgcgagagagaaatccgccatgctggtgatcttggaaatgtgacagctggagtggatggtgttgctagcatcaatattactgactgccatatcccccttactggaccaaattcaattgttggccgtgctgttgtcgtccatggtgatgctgatgatcttggcaagggtggacatgagctgagcaagagcactggnaaacgctggtgcacgtg

SEQ ID NO: 52306 - DNA, 493 bp, Triticum aestivum
  unsure (1)..(493): unsure at all n locations
  Clone ID: PAT_TA_52306
ctgcaacaactgcaggtccttctcgggggtcgacgtctgcgacgacgcccacccccagtgccccaagggctgctcggnctgccgngtggtgacgccgagcccttacaagacgttccggtgcgccgacatgaagagcaccgttgatgggtattggggngggccatgcaagaagtagtgatgcgttnagggtttnaggcttagacgaggtgtgccgnttaaaataaagtttagatgagatgagnagtnatggtgnctatgnttgtgtgtgggtngatttatacggncaanaatatgtatattgntatngtngtgtnttggtcaatgtgtttttttttttgagaaaggntggtggtgtttgtttttgttnangtattgttggttggtaaaganatgtgatgattgtatttgttcaaagtaaaattatatagggtggtggtttttgaggatgtaaggttangtatgggtgtgtgggatgttgtagtttttgtattgt

SEQ ID NO: 52307 - DNA, 497 bp, Triticum aestivum
  unsure (1)..(497): unsure at all n locations
  Clone ID: PAT_TA_52307
gtggagtcaatactttttctcccgaaggtcgtttatttnaagtagaatacgcgattgaagctattaagctcggtactacagntattggtgttcaaacctttgaaggtgtngtnttggttgttgaaaaacgtgttttttttanattattggaacctagttcaattgaaaagattatggaaattgacgaanatttaggttgtgttgttagtggaatgacagtcgatgcaagaattatgattgaacatgnttgagtngttgtttagaancatggatttacatatgaagaaaagttgaaagttgaaagtgtgatttaaagtgtttgtgatttagtattaagatttggtgaaggtgntgaaggtgaagagttaattatgagtngtttttttggtgtttgattanttattggtggagtngatgaaaatggatttgaggttttttatggttgagttttgtggtttatttatgaaataggaagtttaagtaattgtatgttggat

SEQ ID NO: 52308 - DNA, 636 bp, Triticum aestivum
  unsure (1)..(636): unsure at all n locations
  Clone ID: PAT_TA_52308
tccgnatcccggtcgaccaccgtccgcccacgcgtccgcccacgcgtccgcccacgcgtccgggacgcgtgggcggagcgtgggtggagcgtgtgcatcgcgttgttgcctggtgtttgcatcagtcnaagggcgttcagtcttagtattgctgtgtgtttnangtgctgtacggttttctctggggtgggattgnatatttntnnnggtgcttttgatgcttttcttatttttatttttttnttgttttttgtttttttnnnttcttttttttttttttttgtttnttttttcttttcttttttnntnttnttnttttttgtnnttttttttttttttttnncttttctttttttttttttttnttttttttttttttttttttttttttttttttttttttttttttttttttttttttttttttttttttttttttnttttnttttttttttttttttnntttttttttttttctctttttttttttttttttttttttttttttttttttttttttttttttttttnntttttttttttttttttttttttattttttnttttnttaatttttttttttttttttttttttttttttttttttttttanttatttttttttttttttttttt

SEQ ID NO: 52309 - DNA, 563 bp, Triticum aestivum
  unsure (1)..(563): unsure at all n locations
  Clone ID: PAT_TA_52309
cgttactaaagttcacgctcgtcaaatctttgactctcgtggtaaccccactgttgaagttgaagtcaccactgctaagggtgtcttccgtgctgctgttccctctggtgcttncactggtattcacgaagctcttgaactccgtgatggtgataagtctcaatacatgggaaagggtgttaccaaggccgttaacaacgtcaactctgtcattgnccccgncttgatcgaatccaagatccccgttaccgaacaaaaggccattgatgatttnctcattgnattagatggtactcccaacaaaggtaagcttggtgccaacgncattcttggtgtttnttttgctgttgncaagggtgntgntggtgataagggtgtncttttttatgttnantttgntgacttggttggntnnaagaagnntttngttttttnngttgnngttttgaacgttatgaanggtggttttgatgntggtaanaagtttgngatgcaagaatttatgattntttttagtggtgccaagaggtttaaggaagttatgaagattggttgtgaagttt

SEQ ID NO: 52310 - DNA, 228 bp, Triticum aestivum
  unsure (1)..(228): unsure at all n locations
  Clone ID: PAT_TA_52310
aaaaaaacggcgggggcggtgctagcgngcgngcggcggcggcgaaggcttccttctccgaggctccccccggcaaccccgacgcaggcgccaacatcttcaatatcaatcaccacccccatttttgggggggccaccacaacaagccaaccgcnnncccgnaggaaggcagcaaaaccaccgctggaacttctacttaaagcaaacaaaaccaagctgtggagtggg

SEQ ID NO: 52311 - DNA, 394 bp, Triticum aestivum
  unsure (1)..(394): unsure at all n locations
  Clone ID: PAT_TA_52311
cgtccgtgtnatatttaaaaaaaactanaggcatccactggaaaaaaatacccaaccttttgcaaacttaaaacactatagaaaacgatgatgaccaacaaagcttggaaattaatgtgaatcaaacttttgaaaaattaaaaaaccagaatgnaacaaaactgtacttcaatgtaaagtcgtttccttgattcgtctcgagaaatataaagaagcgctcaccttgattgctcgtcaattcagaaaagcagacattgacatgtcctatgaaaagatctattgttattatcgtacaaaccagtttgtgcctgctatggaacttttagaacaagtcaagtctactaataaggattcttccttactttaccttgaaagcacaaattctttaactctc

SEQ ID NO: 52312 - DNA, 529 bp, Triticum aestivum
  unsure (1)..(529): unsure at all n locations
  Clone ID: PAT_TA_52312
tgtcgctgctgctcaagctgatgggcgccaagaccctcctcaagagcaacgacctctacgacgacatgaacccgaagtatgtgctcgttggtgatctgtcggagctcgctcatgaacttgttctcccgcgggtacaccatcgtcttgaacatgtaatcgttgaggtcgttgctcttgaggagggtcttggtggtgtgcgctggtgctcaaggtgatgggcgccaagaggaccatcgaggtcggggtgtacaccggctgctccgtgctcgtttccgcgctcgtcatcccggacgacggcgggtatcgtcgcgcatcgacgtgtggatggagtacttaggcggcgggctccccgtcatcaagaaggtttgggtcggtcacaagggcgtgttccgtgagggccctgtcggtcccttgctcgacaagtttatggncgtcgaggacgaggggagcttcgttttcggcttcgtggacgccgtcntgttcatgtacggttttttccacgagcgggtgatgctgttcgggcgcgttg

SEQ ID NO: 52313 - DNA, 306 bp, Triticum aestivum
  unsure (1)..(306): unsure at all n locations
  Clone ID: PAT_TA_52313
ctcaccgtgctcgccgtcggggactggggaaggggtggacagtacaaccagacactggttgccgagcagatgggagtggtcggcgagaagctggccgncgactttgtcatctncacgggcgacaacttctacaacgacggnctcgccggcgacaacgacacggncttnttgatggggtgcttgaccgacatntacaccgnctgcaggcttcagaagccttggtacatggtgttggggaannacgattacacgggngaagcgctggngcagtagagtcttgggatgtgtgaggtggatagttggtgg

SEQ ID NO: 52314 - DNA, 353 bp, Triticum aestivum
  unsure (1)..(353): unsure at all n locations
  Clone ID: PAT_TA_52314
cccagcgtccgggcagtgcagctcggccgcgtgcggaggtcgtcgtcgcgtcgcctggagcggccaagnagttctccggaagaacgacctgcactgctgcagccggccaaattcaaccaggtgcaaggggatgctgnnagctacaacttcctcgacgtggctttcggcccctacagcgactactggcgcgcgatgcgaaagctcctcgtcctggagctgctgagcatgaggcgcgtccagtccttcgcctacgcccgggccgccgaggtcgaccgcctcgtctcctccctcgccggcacccctccgggcacccccgtcgacctcagcgagaagctgtacgcgctctcggacgg

SEQ ID NO: 52315 - DNA, 558 bp, Triticum aestivum
  Clone ID: PAT_TA_52315
cccacgcgtccgcacggtagttatcaccatcccttggctcgtgcattgcaaggggaacgcacactgacaaaagagatgctaatgtatcccatcttcatctctgacgacgaaaacgcccttgaacatatcgacgcacttcccggacaatatcgtattgggatcaacaagctaaaggaattcatcgcccctttatataacaagggacttaaatctgtcatgttgttcggtgtgcctttaaaagaaggtgtaaaggatcctacgggttcccgtgcagacgatcctgaaggacccacgattctctctgttcgtttacttcgaaaggaatttcccaatctgtttgttggctgtgatgtctgtctgtgtgaatatacctcccacggacactgtggtatcttgcgtgaagatggcacgttgaataacgatctctctgttcaacgtatacaacaagtcgctgtcaattatgccaaggcaggcgcacagtgtcttgccccctcggacatgatggacggtcgaatcaaggcgatcaaagaaggattaatggaagcaggtcttgcgcat

SEQ ID NO: 52316 - DNA, 395 bp, Triticum aestivum
  unsure (1)..(395): unsure at all n locations
  Clone ID: PAT_TA_52316
tcggccagacgttacccgggacggtacggcggccgctacggcccgtgttatcggcggggcgtgttgccggggttggtaccaccgtgactgcactccggtactgcctgccctgctacgaggtccccgaagacatggaccgggctgtggtgcacaattaggtggatagctagctatgtatttggttgtgggtaggattgatggtntgaaagatggtttgttagatggtttttttcaggttacttatatnttaggtttaatttatgtgatatttgattgtgtgtttgtgtgtgtgtgtatgtacgtatgtaggtacgtagtgntgtttgtttggttgttttattggttngtgtgatgngtgttgtgttgtgtggaggggttggatggggggatgtttg

SEQ ID NO: 52317 - DNA, 295 bp, Triticum aestivum
  unsure (1)..(295): unsure at all n locations
  Clone ID: PAT_TA_52317
ttcgctggnaatgacctcatggnaggatcttgnccgatcttgncgagtggctcaaagcgcggctctaacaaggcttaagtggggtgtacatacaccgtcatgaatgccgtcggcgaacggtagttctgatggttacgtgggcttcggactgtactggacttccgatggctatcgggtgggtctggggatgttgagtcgaagcatgtttttgctttcttggtactgtggaatggaagggtctagcgcgaagtgctcgggcttatgagatcacgaaatacattttaatcgctctttg

SEQ ID NO: 52318 - DNA, 548 bp, Triticum aestivum
  unsure (1)..(548): unsure at all n locations
  Clone ID: PAT_TA_52318
ggcggaggtaccataaacacacgagcacacgccgccggcgcgtttaccgtgggcgtacgatacgccacgagcccaggagtggggcgaggggtcgcgctggcgttcatacccgcattgtcgcccttgaagctggccttggtggtacgaggcttgtcggcgttggacgataaggtggccggcgtgctctgttggggctacgcgtatcggggctccggctccatctgatgacaggagacagccaggtgttgctttttgtcgccaacaaccacgaggtcatcgggaccgttcaccgtgccaggctggaccaactgctggagaccccctgccccgtggccgtggtcgtggtacatgaagcgcgatttccctctggctgtcgcaggctgcgtgacgttctatattgcactttgtctaattgagtttgtgaaagtgtctaccgcgtatggacttcatgggaccattcactaggaactcacgcctgagatctttgtgctcatcagattgggtctagtttctgtgaacttattgntgaagtggttagcttggtttgg

SEQ ID NO: 52319 - DNA, 579 bp, Triticum aestivum
  Clone ID: PAT_TA_52319
ccccttttcgacccactgttcccgcgtgttctgctcgcatcgccttcttccgccccgatctgcttgctttcacgatgaccttcgccgtcgatcatgcgtatggctgagatctaggttgtcctgtgttttcttgacgtggtaatgattcttgagttttactgaacgtggtctgctggtgctcaactgtgcgtccttcttccgccgttcatcgaccgtctgctgctgctgctcattcttagcagaggtctaccaggtccagaatatcatcttggctcgatcctgccctgtactgtgcttagtgctcctatcaaggatgtgtgctgttgtttacttcgtcgttcctgttttagagactcttgcagctcgttgtgctttgccggccttgttttacttgtatgaggtgactgaggacggctctgttttggctggggtagagcttgagcttcctttggaaggcgtcggcgcggtgtcacggaggcagttcttttggagcacagcctggcgtggctgcgttggcgcttacgatcacgctgctgtgcaggccatcaattgagactacaactatgaatgcatgatggc

SEQ ID NO: 52320 - DNA, 601 bp, Triticum aestivum
  Clone ID: PAT_TA_52320
cgagaccaaaccaaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattg

SEQ ID NO: 52321 - DNA, 602 bp, Triticum aestivum
  Clone ID: PAT_TA_52321
cggacgcgtgggcccgcgtaccaagccaccgaccaacatggcagcgtctctccaagccgcggccacgctgatgccggccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctcacctacacccttgacgagatggaaggcccgctcgaggtcggcgccgacggcaccctcaagttcgaggagaaggacggcatcgactacgcggccgtcaccgtgcagctccccggaggcgagcgcgtgcccttcctcttcaccgtcaagcagctcgtcg

SEQ ID NO: 52322 - DNA, 510 bp, Triticum aestivum
  Clone ID: PAT_TA_52322
ctaaaaaaataggtcgactgcatttcatttctatgtaggaaagacaattaattatatacagacgaaaatgcctctgaagactttcccatccgctctcaagctatatggatttggatcatccaccaggtccaagaaattgccatcggcaaatacgaaaaaacacagctaactgcaatgttttagagaggtatatcactatcatttggtagctacagatccaagcaatcatatatatcaaaattcaagatatccatgtggacaaaaaaattgtttttggtgctctccctcttccatctcctctgttgagcttcacatgcagcagcatcggccatgtgtttgcttttctgtcgtctatactctcctctctgatgtatggatgtatacgtctggaaatatataatccgatgatggtcatgggaggcttgcttcagcttcagcctaggaagtccagaaaccaaggcacgcactggcactattcctcctcaagatgtcatatcgatctgcttctgc

SEQ ID NO: 52323 - DNA, 575 bp, Triticum aestivum
  Clone ID: PAT_TA_52323
gggagacagttgatgacaatgaaatggacttgcctgatgatcctgcaaatgatgatctgcaaaatgcagtccagaatagcattgaaatggaaaatgggtcattcaattcccaagatgaaacttctgttggaagtggtccactctctgttgcttttggctttgttacgcgactggcgagtgagatcttcgcccgaggtaaaaagcatttagatgggtcaaactcagatgctatggatgaagttgaatctcagcagtctaacgaggtttcagaatctggtgatgacattgataaaaacgaggatgagaaccgcatggcagcatcggagagcaccactgtgacaacaaatgacactaatgctgagaagtccgtagatgtagttatggctgatgagcctgcagattctgattgcttgaaacactttgatgttctgcagtgccctccggaccatcactaccttgaaaacatagcacatggtaccggtggaagaaagtgggtcaaaaaagttcagcaagaatggggcatactggagaagaatctaccagattatatttatgtcagggtatttgaagatcgt

SEQ ID NO: 52324 - DNA, 133 bp, Triticum aestivum
  Clone ID: PAT_TA_52324
gaagccaaattgagacatgactcgtttggattctgcgggtgtactatgatgatgatcatattgatcagtcaattgtgaatgaaattattgaggaaagagcggggtacgcgtgtgcgctgccaccaatttttcg

SEQ ID NO: 52325 - DNA, 589 bp, Triticum aestivum
  Clone ID: PAT_TA_52325
cccacgcgtccgctgtagaaatcgaagccgaagatgtcattcgtcttatcctacaatttctaaaagaaaaccagtttgaggaaacagcagcaacattagaatcggaaacatctgtcaaaattgatacaattcaaaataaagaccaatttataagggagattaaacagggagaatgggatattgtgctgcgtcatgtagtagatctgaagattcctgcacagaagctaattgatctatatgagcatatcatacttgaacttgctgagttacgtgaattgggagcagcacgtacactgttgaggcagactgaacccatgtacatattaaaacaaagatttcctgaaagatacctgcgcctagaacacacgctgtcaaggacatctttagattcgagagaaatctatccaaatggaatgacaaaagaaaaacgacgacagactatagcacaagctttgataaatgaagtgacgattgtagagccatctcgcttaatgactttattaggcgactgtattaaatggcaacagcagcaaggattgctacctatgaacgagccctttgatttgttccgtgactctgataaagtgca

SEQ ID NO: 52326 - DNA, 579 bp, Triticum aestivum
  Clone ID: PAT_TA_52326
aaaataagtagaatttcgtgaaagaaataatatgttgccagggatacttgtatgtatgacagcggaacagagaaggctgctgattctgcattcgatattgatcggtatgatgacaccggtgcagttagatataatggtgtgaatccttatcagaataaattgccttctagtggaggcaaagagtcatcagtaaagcggtacaataagccagaaggagctgctggggtaagaagcggaaggtcgatagcccaagacacacatgctagctcaggaccaagaccatctgaaaagatcttaaatatatctgctaacaataatacgcggaatcctccctatcatgaaactgcaagaaatgttggcacatttgagcatcaggtgcccattgggaagaaagatgttggctcaataaaatcaaatgcgacaggtgcacatgctaaagttacacgcatgaccgataaatccaaagacttggtgcactcaagttcattgttggaggcagcgaaagcttcatcagttgctggtggatctacaggccaacctgaaagcgcccctgattttaaaactgtctttgttagcaat

SEQ ID NO: 52327 - DNA, 585 bp, Triticum aestivum
  Clone ID: PAT_TA_52327
acctcaaggacaaacgtgttcttattcgtgttgattttaatgttcctatgaaagacggtgccattaccaacaacaatcgtatcgttcaagctcttcctactgtaaaatatgctcttgataatggtgcctctgctgtcatcttgatgtctcacttgggtcgccctaacggtgaagccgttgccaaatattctctcaaaccagttgctgctgaggttgaaaagcttttgggaaaacctgtcgaattcctcaacgactgtgtaggcactgatgtcgaaaagacatgccaatccgccaaggacggtaaggtcatccttttagaaaatcttcgtttccatatcgaagaagaaggttctgctaaggttgatggtcaaaaggttaaagctgatgctgaagctgtcaaaaagttccgtgcctctttgactactcttgctgatatatacattaatgatgcatttggtactgctcaccgtgctcactcttccatggttggcgttaacctttctcaacgtgcagcccggttccttatgcaaaaagaacttgaatactttgcaaaggcactcgaaaatccctcccgccctttcttgc

SEQ ID NO: 52328 - DNA, 301 bp, Triticum aestivum
  Clone ID: PAT_TA_52328
tcgcccacgcgggaaagaaaaaaagcacacaggccaccgattctatctcacatgtgtcttggcattgttcttgtcttatgtatataacaatgatgagaacttggagactgactgactggtaaaagagaagatcacaaaccaaaatgacttcactgatcaggggatccagacttaggctcaggacagagaaggggtacaggcatcactatgctgggttatatgaattttgattcttgcataacatttattgcatcctctcctcagatcctgttgttgcattactccattgcccttggtgcaa

SEQ ID NO: 52329 - DNA, 409 bp, Triticum aestivum
  Clone ID: PAT_TA_52329
aaaaaaggcgcttcccccgggggggggggaacggaccctggcggggtaaaagaaaactcatcctggtggggccaaccagatgggtccaaaaaaaaaagaacggggggtttttttccgggggggcaatggtaaaaagagggcggccaaagggaatcgggcccatggatcaattcggataaggctttacaacaaaataaggttatcggccgggggcagttcacgctttgccgggggggggggataaacttttcaaaaagggggggccctggccttggggcccttggcaggtgcctgcttgtggccgcatttgtccacgggggggttaaggggggggggggaggggtttgtagccagccactgctcgacgggaaaaaactgctgccccccccccctggggggccccgggggc

SEQ ID NO: 52330 - DNA, 564 bp, Triticum aestivum
  unsure (1)..(564): unsure at all n locations
  Clone ID: PAT_TA_52330
agagaaggcaagcaagtggtggtgaccatggagttcaaagcggccgttttcaccgccgccgtgctggccgtgctcctctgctccccggcatcggcccagaagagtccgccggcgccggccccgcgctacgtggacctggcggcgctcctcgacgtggccggcccgttccacaccttcctcggttacctgcagaagacgaaggtgatcgagaccttccaggcccaggccaacaagaccgacgagggcatcaccatcttcgtccccaaggactcggccttcgcggcgctcaagaagtccaccttctccaacctcaccagcgaccagctcaagacgctgctcctctaccacgccttccccaagtactacccgctggcgcagttcaggaacctcagctcgctcaacccggtgaacaccttcgccggctcgccctacacgctcaacctcaccgacgacatgggcagcatcagcgtcgagtccatgtggtccaagcccaagatctccagcagcgtctacgccaccaagcccatcgncgtctacttcatcaacaaggtgctcctgcccatg

SEQ ID NO: 52331 - DNA, 569 bp, Triticum aestivum
  Clone ID: PAT_TA_52331
cccagcgtccgtagaaagtttcgataattcgtcaaggaaaatgtttgatgcaactcaagaacataaaaccgaaactaagtttactttttggtctaattcagctacgtctttatccctcgttttactatcaatatttgaagcagctatagtcatttccttggaagctgtgatatatgccaacttttctcaaacagctttttcaaagaacaatttgggtctaggtattcccgtgtatctattaattttcattctttcacaaatatatcaagtattcactgcgtgggatgctatccgtgcacaaaacttaatacaagttattgcttttttattatttaatctctgctgctttgcgtatgccgtgttccaattcaaacaaatagcagacgcattagattcaaaaaaccagggtttagaagaagtagctagttggttaaagtcttttatttatcgcttattaattgcggttgctgtcattactggagtatgtcaattagtttatctttatcttggtgcgagattatatcaagaatttggttgggtaatttataaaaggatcggcgctgaccctg

SEQ ID NO: 52332 - DNA, 552 bp, Triticum aestivum
  unsure (1)..(552): unsure at all n locations
  Clone ID: PAT_TA_52332
agtaaagcagctgtcctactgtcgcatacacacacaagtgctagctagctaatcgatcagccggcggccatggcggaggagaagcaccaccaccacctgttccaccacaaggagggcgaggacttccagcccgccgctgacggcggcgtcgacacgtacgggtactcgaccgagacggtggtgaccgccaccggcaacgagggggagtacgagcggatcaccaaggaggagaagcaccacaagcacaaggagcacctcggcgagatgggcgccgccgccgccggagccttcgccctctacgagaagcacgaggcgaagaaggacccggagcacgcgcacaagcacaagatcgaggaggaggtggccgccgctgcagccgtcggcgccggcggcttcgtcttccacgagcaccacgagaagaagcaggaccacaaggaggccaaggaggccagcggcgagaagaagcaccaccacttcggctagatcaccgttgacgtgcggtggccggcctcgccgncggccgtgcgtgtgcttacgttacgtgtgttccat

SEQ ID NO: 52333 - DNA, 538 bp, Triticum aestivum
  unsure (1)..(538): unsure at all n locations
  Clone ID: PAT_TA_52333
tctttttcttttccaattcttgatctaaaaaagggttcatattaggttctctcctttgttaacagtctttccttattacccccatatctttccttccttcctttttttacatatgcctgacaacaacgctggggtggaaccactcaagaaacgcgccaagattgtgagtgcatgcgctgaatgtcgaagaaaaaaaacaaattgcagtggagaacaaccttgccgcacttgtcaaaaatcagcagcgaactgtctttatcctacagccttgcagaacgatgaaaaacgaaatgggttaacaagagttgctttagaatcgattgaggaaagattaataattatagaagatatgttgacagctctttcatcaaatcaatctactattgacccatatttacaaagattaccatccattcataacctttcggcaccaacggcttatgataataaatattattcaacaacattatcaggtactcaaacttcttctactctaaatcaaattacgaaaaaacgaaaacgatnaaatagcaaggga

SEQ ID NO: 52334 - DNA, 582 bp, Triticum aestivum
  Clone ID: PAT_TA_52334
atctggcctctcgtcttcaacaagttactagtcacttggttccatccagcaatgttgccaacaagattggtgtcaagtctcctgaagatgtcgttattgttgctgctcttcgtacagccatcactcgtgcccgtaagggaggtttcaaggacacgcttcctgaagaaatgttggctggtgtattcaagggcttgattgaacaaaccaagattgatcccgctattgtgaatgatattgctgtgggtaatgtcttgcctcctggtggcggagcaaccaatgcccgtatggctgccctttatgcaggcttccctgagacatcctctgttagtaccctcaaccgtcaatgttcttctggtcttcaggccgttgttcaaatcgctacagctattcaagctggtttgatcgaagtaggtatcggtgctggtgttgaatccatgaccaagaactatggtgctgcttctcttgctcccacatctgaaaagattgctgataactgtccttctgctgctgactgtcttttacctatgggtattacttctgaaaacgtcgcagccgaattcaaggtcactcgtgccaagcaag

SEQ ID NO: 52335 - DNA, 540 bp, Triticum aestivum
  Clone ID: PAT_TA_52335
agacgcccgtcgtcgtcctcttccgccatggggaagaccaccaacaaccacctcctggccggagagaaggcggtgagctgcggcgctcccaaggcgtcagaaatcaacgagctcgccgtcatcaaaaagctccatcttaggaccattgatgagctttggactagatagctcgattgtttcaggtttcttggacgaattggagcaactacttaagggtgttgctatgatgaaagagctgacccttaggacacgagattaccttgtttcctttggtgaatgcatgtctacaagaatattttctgcatatttgaataaacttgggaagaaggcacgacagtatgatgcttttgatcttggctttataaccactgacgatttcacaaatgccgatattctcgaagcaacttatcctgctgttgcaaagaggctacatggagattggattgatgaccctgctattcctatagtgactggtttccttgggaaaggggtgggaaatcatgccgcggtccacaacgtttaggaaagggccgggcagtg

SEQ ID NO: 52336 - DNA, 142 bp, Triticum aestivum
  Clone ID: PAT_TA_52336
cccacgcgtccgcggacgcgtgggcggacgcgtgggcgaaaaagcatgctcgtatgtgaatgctatcggcggctatgtatatgcacggacgcataatattatacaatatgtcaactatatacgttttaatggtaaccaatgg

SEQ ID NO: 52337 - DNA, 587 bp, Triticum aestivum
  Clone ID: PAT_TA_52337
cgacgcgatgccaccaccgtctctcccgctcctcctccccttctcctccccattcctccaccctctccccacctccgcctcccgcctccgcagatccctctccctctccctctccccgtgcccccgtccgctcgcctccccttccccctcgttcgccgtcgccgccgtcaacgacgacgactacgactacgacgacgatgtcgtcctcggcgactgcctcgtgttcgaggacgaggccttcgaggcccccgacctcgacatcggccgcccgtcccctcgccccagccgggcggcccgtggcgggggcagcctggtgccggagcggtggaaggacgccgtggaggagatcaacctgacgaagaaggagaagcgccgcatcgcgcacgggctgcgcttcgggagccgcctcgaccgccgggtgccctccgccgtggccgcccccgacgagtaccgcgcgtaccgcgaggggaggctggacgccgagctcggccacggcgcgcgcgactacctggtgtcgccgctcgagagcaagtcccgcgcgtacagtgaggtgaggctggacacggagcccgggcgcgccgtgcgcg

SEQ ID NO: 52338 - DNA, 584 bp, Triticum aestivum
  Clone ID: PAT_TA_52338
gaaagagagagcggagacgcggagctaccgcgtgagaagagcgagcgagcgagcgagccagcagctcagcgagctcaacgaccgccgcggcgacgatgtggagcaccgactccgacctcgacgagtccgcgtcgacgacgacggcggccacctcctccctgtcctcctcatgctccctgcagccgcagacgcccccgccccctcgccgcagacgcagccgtaaccgccgccgcgcccagcgccgggtcaagaacggcccggaggtggaggagtcggaggcggaggccgaggcggaggaggtgtggtgcggcgcgcagtgggaggcggcgtggccacggagggcgcggccggtggtgctcgccggggaagacgcggcccctgaccgcgccggagcgggcgccggggattccggcgtggggcgtgccaggagcctgacggacgacgacctggaggagctcaaggggtgcgtggatctggggttcgggttcagctacaacgagatccccgagctgtgcggcaccctgcccgcgctcgagctctgctactccatgagccagcggttcttggacgagcaccagccgccg

SEQ ID NO: 52339 - DNA, 583 bp, Triticum aestivum
  Clone ID: PAT_TA_52339
acagctgcgccaacagcaacagcccagctaagcccagctcgcccaccaccagacgtaccacgtacagagagctagcagcaccatccatggccgccgaggagcccaagaaggtggaggtggaggcggcgccggagccggaggccgtccctgccgcggagcccgaggcccccgccaaggacgtcaccgaggagaaggccgtcatcccggcgcccgagccggccgccgaggaggagaagccccccgccgatgactccaaggccctcgtcgtcgtcgagaaggttgcagatgaacctgttgctgaaggaggcggcaatggtggacgtatggacggaggtggacgcgcacacctacaacccggccatctcgccgatcgtgtacgagtgcctcatcaacccgctcatgcgcggcctgccgaccaaccagacggtggtggacgagagcctggagaagctcaaaaaggtactggaggtctacgaggcacgcctctcccggcacgagtacctggccggggacttcgtcagcttcgcggacctcaaccacttcccctacaccttctacttcatggccacgccgcacgcggccc

SEQ ID NO: 52340 - DNA, 581 bp, Triticum aestivum
  Clone ID: PAT_TA_52340
agtatttggtgtgccattagaagaacttggtaaagcttcagaaaataaaataccgcagtttatttcaaccttattggctgcaattcaacaaggtagtgatacattggctgaaaataaggatcaagtttggactacaccttgtgcacttgatcgtgttcatgctgcctgtttagaattaaacggccctcaaggtttattgacagtagatatgttgagcaaatacgaacctgcattattggtcgctattctaagatactttttacttgagttacccgattgtatcatgacttatgaaatgtatgaaccagtcaaaacaatattatcaggaagtaaaagagaatgaataagaaataatgaaaatgaagacttatttttttttgctggcagatgaagaatccagactagcatcattgtgtaatttgatctcaactctcccagacgctcattttttcacactgaaggctattgtcaatcatctccaaccaatcgttcaaaatacatcttcggacattgtacatgccatctgtcaatccttaggccctaacatgcttcgacctaaatcagagagttatacaacttta

SEQ ID NO: 52341 - DNA, 99 bp, Triticum aestivum
  Clone ID: PAT_TA_52341
cccacgcgtccggtatgtagctacgtacgcacgtacgtagtcctctttgtttggttcgaataataagaaatgtgatgcgtgtttagtttgcaagagggg

SEQ ID NO: 52342 - DNA, 330 bp, Triticum aestivum
  Clone ID: PAT_TA_52342
cccacgcgtccgcccacgcgtccgcccacgcgtccggagagacaggagctcccccaacactcgctcagaagcagcagctccagcttcccccagggagccaaaatattcgcgccaattgggaggcatgggcgccaacgggcacccgccgcccgccagcgccgacgcccagaacgggtcccactctagcggcggcggcggcggcggaggaggaggtgggggcgggggagggggagcaaaccctagctccggcggcacggcggcggcgctccggcacgacccgggcctgtcccgggagtggacgccggaggagcaggccatgctggacgagct

SEQ ID NO: 52343 - DNA, 381 bp, Triticum aestivum
  Clone ID: PAT_TA_52343
gggcactatggtgggggcagcttttggctaggggtgtgagcaacctttggatcactcgtagacatgcaatgagtgtgatacaagtcatgtcggccgggctatcggtatccgtacggcccatgcccgatcatctggggatatgtcgtaacacttggaagacaccaatgaacttcaacatgcttacgacggtgatgatgattactacgaactggcctcttggctgaaccctaatttactgggacagaactgcactcaggaatatactaagacaccgatggagaacctcgtttaaaaaacgaaaagaaaacgctcattatttatacgcttctgcctgtcttgcgcgctatagacctatcttatctagacctatgggaatgatga

SEQ ID NO: 52344 - DNA, 539 bp, Triticum aestivum
  Clone ID: PAT_TA_52344
aaaacatcaacgcacatgaacatatcggagagcactccacagccacaggaacacgtagcatcttttatacaactgaccgcccgctggcaaagctcaccaaagccgacggatggcatgcgtccagcttcgacaacttctcgcctcccttcggtatcattctttactacatctttaccttcgtcgtcatggtcatcctgctcaacgttctcatcgccctctacaactcggcctacgaagacatcacacagaacgccatcgacgagtacatggctctcttctcgcagaagacgatgcagttcgttcgcgctcccgatgagaacgtcttcatcgctccgttcaacctcatcgagatgttcttcttgattcttccattcgagtggtggatggacgagaagcgctacgacaagctcaacgatatggtcatggcagtaatctactcgcccctcctcgtcatcaccgccatgttcgaacaacaagaagcctgggtcgtccgagacaaccgccgccgcggcgaagacgacgaagacacaaccatggag

SEQ ID NO: 52345 - DNA, 601 bp, Triticum aestivum
  Clone ID: PAT_TA_52345
aagattccttcctttgtgtacatgcatggtgatgacctctttaatgatgcaagtctcttggatttcctgaagcatttgtttctgaccaaggttcagatggaatctatcattggagctaatgtgtggcaagctcaactgattgatgattcagtcatggaccaaggttttgtattttcatatgttgatctaatgatacattgctggttgaagactgtttttcggaaaaatgattggattaatcaaagggctttgattgctattatggattctctttgtagacttgcgtttatactgaaaagacgaaaattgatacatccaatgttgatagaggaatataggcggctagaacgccaaggtaatcagcaactacagcagcaacaacaacaacagcaacagcatcttggtgagaataatgggtcgcctaatctggctcgttttattcgaagtatggtttatgaaggcaatgtagtacctactttattagccaataatgacgaatggtttggtcttagagggattaatatcagtaaagcacctggaattaacagccaccacatctggtttgtatttgaagcattgatagcagaaacggccgttgaaa

SEQ ID NO: 52346 - DNA, 563 bp, Triticum aestivum
  Clone ID: PAT_TA_52346
agctcacgcatctctctcggctccggcaagcaagcaccagcgctctcctctcccctcgcttcctcgctgcaatgtcgaccgacgtggccgccgatgtcccggcccctgaggtggaggtggccgccgaccccgtcgtggagaccacggccgaggccgccgccggcgacgcgaagccggccaaggagaccaaggccaaggcggccaaggccaagaagccctccgccccgaggaagccccgcgccacccccgcccacccgacctacgccgagatggtgtcggaggccatcaccgccctgaaggagcggacggggtcgagccagtacgccatcgccaagttcgtcgaggacaagcacaaggcgcacctcccggccaacttccgcaagattctgtcggtgcagctcaagaagctggtcgcctccggcaagctgaccaaggtcaaggcctcgtacaagctgtcggccgccgcggccaagcccaagccggcggcgaagaaaaagcccgcggcgaagaagaaggcgccagccaagaagaccgtcaccaagaccaaggccaaggcgcccgcc

SEQ ID NO: 52347 - DNA, 482 bp, Triticum aestivum
  Clone ID: PAT_TA_52347
gccacgacgtccgcgacgacatcgtcgcccacggcgggatgcacttatggctccatccagcgtcccagcacggctacatgcaaggctacatgcccgacctgctgtactacctgtacgcctccaaggaccggaacaaggccctgatcaaggccctcatcggggcgcttcacaaggagggtgtcaaggtcatcatcaacctccgcatcaaccaccacaccgacgggcacaaggactgctggagcatctactgcatcttccagggcggcacccttgactgccgccttgacttgagcccccacaagaactggccctacgaccggggctacggcaaccggacacagtgaccccgacactggggccgacttcggggtcgaccaccttaaccaccaccttaacacagacgtccagaaggagctcaactagttgatgaactggatcaaggtcgacatctggttctacggctggcgctttgactactccaa

SEQ ID NO: 52348 - DNA, 419 bp, Triticum aestivum
  Clone ID: PAT_TA_52348
cccacagggttgcgagccgtccgtttgatgagtgcccgaggctgctcaacaagttcggcgcaaactgctgacccgaggcagttggggtcaagcaccggcaccctgctactgggcgggaacatccctaaaatacttcggaaaaagcatcccaatcaacctcatgctcatcgacgtcgccgagggaggtctcgtgggaggcgccaagtgctacaagatcaccaaagggctgtgtatttgactacaagctacacccgggtggaccatgtcgacccgctaggcctttccaccgaccccgaccagtcggtgtttctcaatgcgaaggatatcaagaacgggcggctggccatgttctgcatgctgggcttattcatccaggcctactggaccaggcagggccccttcgcgaacctgcgcccgca

SEQ ID NO: 52349 - DNA, 368 bp, Triticum aestivum
  Clone ID: PAT_TA_52349
gcggctatatacctacatagtacagccatggcccccaccgtgatggcctcgtcggccacctccgtcgctcctttccaggggctcaagtccaccgccggcctccccgtcagccgccgctccaacggcgctagcctcggcagcgacaacaacgggggaaggatcaggtgcatgcatgtgttggcccatcgggggcatcaaaaagatcatgaccctgggctacttgccaccgctacagatcgtgggggcttcttggacgggacaactacctggaccgtttcatggggctgcccagaactaataggaaaaggggctcgaatagatcaatcgtgtccgcctcacgttctcgtagtgctctcctcttaatacga

SEQ ID NO: 52350 - DNA, 348 bp, Triticum aestivum
  Clone ID: PAT_TA_52350
cagaagcagccttgcaatgttcgcactggtcatagtcatggccgtggtggccgggaaccggggcgtcttcatcacctgcaactacaaccctccgggcaacttcaacggcgagcgcccgttcctcacccttgacgccgaagccaagtagtacatacgtgcgtgtgtgttttttttgcgggtgacgtgcgtgtgtttatctgtgtgtattttgaatatttacgtctattcttatgttacgtacagtacgtacgtaaataagcccacattccggcctgcatgtatccatgcggctctgtggagcgtgtaaatgtaaccatatatacctccacatgcaaatgtctttccttt

SEQ ID NO: 52351 - DNA, 615 bp, Triticum aestivum
  unsure (1)..(615): unsure at all n locations
  Clone ID: PAT_TA_52351
cccacgcgtccgtatctttctcgtgctggttcacgtatttcccattacattatcctttttcatatcaacaaaacaataaatcatgtataacaagaacaataacagtccttatccaacaacagcaccaacaagtacccgaagaagaacacatctcaaaccgagtcaggtggnctgtcttgcaagaatcttttgtagtaaacgctttaccagatgctaccataagagctcagttagctcaagaactcggagtgactgaacgaactgttcagatctggtttcaaaatcgtcgtgccaaagctcgtaaatcatctactttggaacccaatgttcgaactggatggatcgatgtccccgtagcagcagtaaaacctaaacaaaaggaaccggaccatcaaccatttcaagccacttttcgtactttagttacacccgaatgttatgaagaatcatcacatatcaagaaaagacctcgttcaaattcaaaacctgaaaaattcgttactacccaatccacaacatcactaacaccaaaaagagccatgtctgaaggtgtgagtcgaatgacctgtactcaagagaacccttcatttctattcctgtcactatgcttcgtat

SEQ ID NO: 52352 - DNA, 593 bp, Triticum aestivum
  Clone ID: PAT_TA_52352
atgctggaggtaccgaacagggaatgcctggtggtgttccgccaatgttaacatcactgtccgctcctgcagatcccaaccaggtgcagccatatacggctcatatgaatggaacttctaatgctaatggtactacaaacaacacagtggttacccctgtgttgcaaactcctccagcacccactatacaggaatctggtaagaagaagagggggagatccaggcgtgtgcaagataccactactgttccttcggttcctccagttcaaccggttccaacggttcctccagttcaaccggttccaatggttcctacagttcatttggttccttcagttccttcagctcctccagaagttaataatattgttctccagacacctccttcagccgtcacacaggaatctggtaagaggaagaggggacgaccaaagcgtgtgccagatgtttctgtcttaccaactccattgcctgcagcagatggtacacctattttacagacacctcctgcatctagtgtacatgaatctgttacaaagaaaagggggcggcgacccaagcttgtgcaggatagtccagatacttcaactcct

SEQ ID NO: 52353 - DNA, 574 bp, Triticum aestivum
  unsure (1)..(574): unsure at all n locations
  Clone ID: PAT_TA_52353
attatantccgccatctttnttgtaattatttgagctcaacagaagaaaaatagaatcttataaattcctaattagaacaanngttgaacttgnnctcttgcatctgatccagccannatgaagaattaacaaagctccaaaacgancttgaaagagctgattgccatgtttgaagcacaactacccgaacagaccaacagcaagccatctccagcaaaacataataaaacagaagcaccagcagctactgcactaaagacccaaacattcgctgttgatcaggaagtgatggctagatggtcgggcgatggacagttttataaggccaatattactgccattggaggtgctgatcaagtattttcggttcgattcaaaggatacaatgaaacggaatttgttaaagcagaagacataaaagcaatccccaataagaaacgtgttggtatctttgaaaacattaaggatagccatagcagtaacgccagcagtgacgaaaacaataaaaagagaaaagcagcagaccagccaaaggtcagcaaaaagaaacaagcatcagaaaatgaacataaa

SEQ ID NO: 52354 - DNA, 606 bp, Triticum aestivum
  Clone ID: PAT_TA_52354
gtttaaaaacggacaataagcctgaagatactgttgttaacagtgaagcagaggaatctgaagttgaagaaggacacgaagaaagcaacgaggaaggccttttagacgaagttcctgatgatattgacgaaatagaccttattcatatgaaaattagtgatttacccagccttcgcttggaaagatttaaacaactggagcgtctttatcttcgtcaaaatttcatcattgacattgatggacttgaaaacttaaataatcttcaagaacttgatttgtatgataacaaaatatcgcacattcgaggactaaatcacttgtctcagctgactgatttggatctttcttttaacaagattaagcatattaaaaatctcgacaagcttactcaattgaaaaatctttattttgtgagcaacaagatttcaaaaattgaaaatttggatacatttccaaacttgaaaaatattgaattaggagcaaacagaatcagagttattgagaacttgaatggtttggttaatttgacagaattgtggttaggaaaaaacaaaattacaaaattagagaacttgagtccattgaaaaatttaagattgttgagta

SEQ ID NO: 52355 - DNA, 580 bp, Triticum aestivum
  unsure (1)..(580): unsure at all n locations
  Clone ID: PAT_TA_52355
cgcgagcgggccgcccttttttttttttttttagtagtaaatgaatgtgtgtttattgatatcacaataataaaatgaagccatagttttaataaacaggagtgacggtactgatttggatatcactatnagaacgttcttgcttaattctgattttatcttttgaagccaacaacaaaacttcataaaagcgtcgggcagcatctgctttcttatatgtagtagtaggtgctaactcggcaaacttaacagtaccattgaattgcatgtggttttcaatcgtttcaaatgttctgcgagtactttcatgaagagactcatcagtttgagagtcaaaagatccattttcgacactaatgttttcggtatccctctggaattgattgaatcgttctctatcaaaatctcctgtatcaatgtcaacatcgtaatcattaaaaccctcaaaaggctcaaggccttcaccagctggagtaggggcaccaaggtatgtctcgccttgcgcgtgagcttccaaagcagacgcacgtcgtttacgactgatctttgaaaacatgttttccaaatcagtaccaagagc

SEQ ID NO: 52356 - DNA, 512 bp, Triticum aestivum
  Clone ID: PAT_TA_52356
cgcaagcgggccgacctttttttgtttttgtgaaactgcggatggagtaccggctgattgagctgacactgctgaaggagatgatacatgtactaaacgggagaggccgccctgaccaccctactactatccgcacaccgccacgcacaatgctaactttatctttatggaccaagccgacgctaactgaaaagtcgtgggtcgaacactatgctaagctgtcatatagccagcatgcaggctgctaactgctgcaaacttaacaatccataatgaatcatgcgtgcaccgcaacgggcgtagcatgatctatcgtatctttctactacaaacataccatgtaaccagaacctgaaccatggcctatattaacgcacctgacctgcatcagaaatcaggtgacatgccatgaatgaaaacaggcccccttaaataaaacctcccttgttttactatcctcaaaaggctcaaggccttcaccagctggagtaggggcaccggggggtgtctct

SEQ ID NO: 52357 - DNA, 590 bp, Triticum aestivum
  Clone ID: PAT_TA_52357
cccacgcgtccgacgagaatgaagggtatgttgatggtatcttgagaggctactactctggtattttgaactcttcacagtatttaaactttacgcaatgtgaaactcttgaagatcttcgtcttcaactgggagctactgactatggttcactcttacaaaatgagccttcccccattgctacctctaccatcaccgagaaattaactcaaagtctcgttgacgagtttcaatatattcgtagtaacgctgttcaaccattatcaaagtttttggattatatcacataccaatatatgattgataatgtcattttgattattacgggtacacttcatgaacgtgatactcatgaattacttgaacgatgccatccacttggtgtatttgatactatgcctgctttatgtgttgctactaccgttgccgagttatataacactgttcttgttgaaactcctttagccccttactttgccaactgtcttagtgcacacgatttggatgaactgaacattgaaattatcagaaacacgctttataaagcctatctcgaagacttttatcaattttgccaaagtattggtgga

SEQ ID NO: 52358 - DNA, 296 bp, Triticum aestivum
  Clone ID: PAT_TA_52358
accacgcgtccgctaagcaagcgctcggaggcttgcatcatacaggcacatggctctgatgcaagctcaacctgatgtccttcgcgctcgccgcagccgtatccgtcttcttggcggtggcggcgccgcgtccggcgggcgtggcgtgggtgcaattgtacctgtacatacaggatgtgatgggagacagatcaataatggtagtgcgtggacggcgagggcacttgcggctcgcacaggattaagaataagatgttgcgtgggggtagttgggtgttgtgagcgttttgggtttg

SEQ ID NO: 52359 - DNA, 521 bp, Triticum aestivum
  Clone ID: PAT_TA_52359
caccctgacatacaatcctatatgtcggacgcatactatcccagctcacccgagcgctggaagtaagagtacatttgatggagcatgaagctgtggcggtagtggagatgaagagataccggtggggtgtgtgggtctgacggctcgtggagtacgcgcagctgatgtccacggtggaggtgtacgatcggtacgtagtggggtcagttgaatggttgtcgatggtggcgtagggtatggaggagccgtcagacgtcgtgtgggcaatatgacggttggttgatactgtgcggagttgtataagaatttgattcttggctgcactgtgagtcttgacagaaaggtctggaaaaagctgtgctggtcatgctgctggaggttgagtgatagttatgaatatcctaccgaagcaaagacgtatggttgtttttcctggaagtggagaggtgggcattactttgtggtatagattgcggatagcttctgttttgaagttgctgggtttttactttgtggtggtg

SEQ ID NO: 52360 - DNA, 261 bp, Triticum aestivum
  unsure (1)..(261): unsure at all n locations
  Clone ID: PAT_TA_52360
attacaatatttaactttcagatgtatccatagcagttgtagaggcatcctctcttgctgattcagcagctactgattcagaagcagagacaccaacaggtaatctagttcttcaggctcttcgtgatacattacaacaagataaagaattaaacattcacaacacgtctcttggtattgtgggtgaagataaagaatttgaaattgttgaaggagatgcnttacaacggtttttggttttacttggtgtagagagtggtt

SEQ ID NO: 52361 - DNA, 119 bp, Triticum aestivum
  Clone ID: PAT_TA_52361
cttgccttttgggaagatatttacttttaaacttatgaagcacgtaagtttaatagtagtatgttcgccatattggacagcacgcgcgtaagatcgcttcttttataaagaaccagaac

SEQ ID NO: 52362 - DNA, 501 bp, Triticum aestivum
  unsure (1)..(501): unsure at all n locations
  Clone ID: PAT_TA_52362
tgnaaaaaggtacannaaaatcactgtaaaagacaagngccgaagacgatactcaagtatggggttnttgaaaatggacaattgatttcaaagaattcatctttagtcttggatattgaaggaggcgatttaagagtaggaaagaagttgattcaatatggacgtaaaaagacaatggcacataaccaaagatggggtattcgtaacggttacatttatgcttcagcagacccaagacttgtattggaagtaaaagataatagcgaagcgtccggaagtcaaattgttactagtgttcgtaaagtagaagagaatgattttcaacaatggaaaatcgttccatacaaagaagtaacaaaagaagaacaaaaggaagaagaggaagaacaagaggaagaacaagaagaggaacaagaggaagaacaagaggaagaataaacttttttacccgctacttcccaaaaaanaaanannnnannnaanaaaaannnaanaannana

SEQ ID NO: 52363 - DNA, 223 bp, Triticum aestivum
  Clone ID: PAT_TA_52363
cgagcaagccagacaacaggagcgacgcgggacaacacactgtcatgcatcgatgcaagacccgcctggcgcgtcagcaggggctcgttatcggcgagggcactcagccgcttgccagacgaaggtcttgtacctgctaggtttgaagctgcagagcgtggagaagtggttcgccgagcagcactacgccgatctggccttcaagccctcattccctggggct

SEQ ID NO: 52364 - DNA, 588 bp, Triticum aestivum
  Clone ID: PAT_TA_52364
cccagcgtccgggcgctagatggacttgggaggcactgacagagaacataaagtatgctttagggattactcctataaacactggttccattaaagatgtcttgagcttacccatcagtcaacaactcaccttagtaagagctatttctgaacgtttgcttggtaaaaaatatccagtcaatgatcgaaataacacgtttgaaaccgtcatgaacatcttgggccaattaggtcctgagtatcaagaattaatcactgtcgtcacacagcctttgataactactttttacaatgatataccaaagccatatacaaactatgtaggacatcaattccgtactgccgatggctctcaaaacagtattatgtttcctgatgtcggaaaggctgggggtaattatgttaggacagtcagaagtttaagaaataacaatgtgaaccttccgtcagctaaagaagtctttgataagcttttaaaacggccagacgatgaatttactgaacacaagagtggtattaacatgttgttgctgtacttggccatcctcatcactcatgatttattccacacggatccatcaaatcctc

SEQ ID NO: 52365 - DNA, 286 bp, Triticum aestivum
  unsure (1)..(286): unsure at all n locations
  Clone ID: PAT_TA_52365
accgtccgaattcctgntcgaacacgcgtccgtttttttttttttttttttttttttttttggttttttttttttttttttttttaggaggagaagatttaaattaaatggagatttacactggcaaaaagggtaacataagtttgtgggtttaacagtgaggaacttgaaagctgtactttgggttagaaaagaaagcattattaggggtgaaatggtttgggcaaattggctgtttttgctgtttttttcttgtggtgttttttttgcgtttgagggggcgggg

SEQ ID NO: 52366 - DNA, 557 bp, Triticum aestivum
  unsure (1)..(557): unsure at all n locations
  Clone ID: PAT_TA_52366
aaattgcaataattctttcctaataaagagctaacatggttcacccattactgctaatattaattacacatgcacacatctcaatgtaatccagtggtttgtaggcaaggtgcttgggcacctaggtgtctcaacattgattgagctccatggatcgatgaaccatgtaactccatttagggttataggagatggccataggtgtcccacatgttgtcgacaatgatcttgtacgccctttgcgtgggatggaagctatcgaagaagacatgcttggatacgtcgtcgcacaccgccatgaacctcgagtcgcagagattcgtcaccttgatgagcccggtcccacagcacccgtgggtcgtctccgtgaagccccaacgctccccatcctcggcgagctcttggatgatgtcgtagatccctaggtagacaatgcgggtgttgagctcctttttcatcccgtcgatgagctcctggacccttgagttgtagagctgcgctgngtagttgcgcttgggttcacaacgacgatggaacccgccgccgaccgtccgttg

SEQ ID NO: 52367 - DNA, 492 bp, Triticum aestivum
  unsure (1)..(492): unsure at all n locations
  Clone ID: PAT_TA_52367
gaaataaaaaaagtaaatttcctttatttcgatacaatagtttatatacatgtgcatatagggagtaaaataaataaatatggtatacatttgagaaagagaaacacataatgaggaataatgttctcatgtgtttgttgatgactgagtacttagtcgaataatacgtttttttggttttttttttggcttcgactttaattcaaccttgactgtttgcggtaaggaacggtatgtgaaatgttctattgtatgtgtgaatggtgatattgggtgatggatacttgttagttgtgccaatttgggtgnaacagggttttttttaggattttatacaatgtnttnatccatggggatgattgttagtntgtttttttcctgtttaaccagtggtagtttgggccctttagtttcataccagggagcatttacatgatttggatacatttttggtggcgccattgggtttactgaagattgattataataata

SEQ ID NO: 52368 - DNA, 595 bp, Triticum aestivum
  Clone ID: PAT_TA_52368
cccagcgtccgcccacgcgtccgctagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcagctcatccatccacgtggagttgaagcgcgcagcctctatccctatgtagtatggtcactagttatgcgagtttatactgaatatgaataagaactctctccagctggcttgctggtactcctctggaggagatcagtatctgtgtac

SEQ ID NO: 52369 - DNA, 356 bp, Triticum aestivum
  unsure (1)..(356): unsure at all n locations
  Clone ID: PAT_TA_52369
ttcggnagcccaccatcacctcccgggaggagcagacctccgtccgcctcgtcctcccgggggagctcgccaagcacgccgtctccgagggcgccaaggccgtcaccaagttcacctcctcctagactgaagatgcgccgnttgttgtgccagatgtggctgtgtggtgtgtctgtgcgggggggggtggttacctgtcggtngatgtngtggttgttgttcgtgtggtggaagattgcctacgctttgttggctttttggttgtgagaactgaacgtgttgcttttgcgntttgaaatctgtctggaatgtgttgcgggtgtggttctgactggggtgtttgggggtgggtgggt

SEQ ID NO: 52370 - DNA, 546 bp, Triticum aestivum
  unsure (1)..(546): unsure at all n locations
  Clone ID: PAT_TA_52370
tcccgggtttcgacccacgtcgttccgnaccagnngccttcagncccagtaccggcgagtatgcctnncgacgccaagaatcanntcaacgannccgcgaggactngggcaggnntcccgtggcttttcggcttttcgtcanncgttcgnngcagcgagggagnntcgatgcgcnncaggccatcgagggagatgaaaacggcaaggagctttcgacgggcgcaacantcaccgtcaacgaggggccagtgcccgccggtcnccggcggtggggtgcggnggcgtgnggcttacgggcggccagcgcggcggtaggcggaggcttacggcggnggcggnggtggcttacgggggccaggggcggtggcggttacggncagggaggcggtggcggttacggncagggcggtggtggcttcggtggtcagtgcggtggcggnggttacggtggtggtggtggtggtttcgggggnggnggtggtggttacggnggtcagtgtggtggtggtgtctccggtggtcagtggaggaactgtgtggtggggc

SEQ ID NO: 52371 - DNA, 521 bp, Triticum aestivum
  unsure (1)..(521): unsure at all n locations
  Clone ID: PAT_TA_52371
accatagcaggcaaacattatgtctcctttgtgcgtttattacacaaacaaaaggaacccgtggctgaaacgatccagtcgaatacataccatgtggaaagcctatcagcagcatcctcagagggcaatcagatgtaacattgctatgacggccatggtgggcacaggggaaagaacaccgatggcgagcatggtccatctgcttcacgtttcgcatgagtttgtgacgatgcagcagctgcgatcgggacggttacaggctcagctccagtctctgcttaagtcaggaacgacttcaacgagcaactggccgaggcctgtgttcaatagttgatcaatcatccttgcaccagacgttcacttgccttatataaaacttatcccacaattgctggtacgacaagagatcgtgtgggtatgagatgatacggatattgagtttgtacatatatttgtgtgtgtgtattaaataatctcattttattatatgtcaagtttnacttnacatagaagataatgaa

SEQ ID NO: 52372 - DNA, 576 bp, Triticum aestivum
  Clone ID: PAT_TA_52372
cccacgcgtccgagaatgtggatgacgaacaagaagagatccttcgtgaaaacacaagacgtttctgtttattccctattaaataccacgagatttggcaattctataaaaaggcagaagcttccttttggaccgcagaagagattgacttgagcaaggatcagcatgactgggaaaataaaatgtctgaaaacgaacgtttctttatctctcgtgtcttggccttctttgctggctcagatggtatcgtgaatgagaacttggtacaaaacttttgtgatgaagtcaagattcccgaagccaaatgtttttatggtttccagatcatgattgaaaacattcatgctgaaacttacagtctcttgattgatacctacattaaagataaccaagaaaaggaaatgctcttttctgctatcgataccattccctgtattaagcgtaaggcagattgggccttcaaatggatctcatccaacgaatcctttgctgaacgtctggtcgcctttgccgctgtcgaaggcatcttcttttctggctcattcgcctccatcttttggttaaagaaacgtggtt

SEQ ID NO: 52373 - DNA, 589 bp, Triticum aestivum
  Clone ID: PAT_TA_52373
cccacgcgtccgcaggatttcctaacggacaatacttttttataaagtcccgtgcgaatggcaaagtattagatgtttatatgggcgagacgactgatgattcgaatattatcatttggcctcagaaacctgatgatgataatgataatcaactttggcgcgctgaagatggtttcttgatcaataagagatctcaactagtgatggatattcgtggtggtgacctcaagtctgatacatacattgttcaatatacgagaaagatgacaatggctcataaccaaagatttggttatcgcgatggttacatttactgtctggccgatcctcgtctggtgttggacattaggggtggtggtagtaaagaaggtacaaagatcattttgtacaaacgtaaagaatcagataaccagaatcaactgtggacgattattccagtcggtggaccaaacgtagccaaccagattccttattatcctcctcctgattatcctcaaccaggtcgtcaacagcaacctcagtcttatcctgcctatccttctactggctatggtccacccgataaccacccgtcttcctatggcaatca

SEQ ID NO: 52374 - DNA, 594 bp, Triticum aestivum
  Clone ID: PAT_TA_52374
gagacaggatcatatcttcacaagtctactacatcatagacctaccagggaacctggatggcgtagcacacgtgtatctagtttctgaacaccatcggtgtgtgaggaggaataacatgcacattaactgcctggggcaaggggattgcagcaaagcacagtgcttatatatactgaaatggctgcctgattacacgtgtgtgcacccaagtggatgttacccatagaccactgaattcatgtgcacggctaaaattaactgtgtcatagacacttatgtttgatagcatggatacctacaataaagtggtagcctagcatcttaattgaagacaatggcgtattctaagctatagagagctcattcttattatgacaccctgcatttgttttgcctgacaactctgaatagctaaatgagtgacgagtggaaaactttaccatgtacatttataactgttttatgcacaggctcatattgtacaatatatatcatatgttagaacgcctctgcgatatacagctctagtgttgcgtgcgcgacggcaccgaggtcgtgctctggaagtggtgcgagggcaacaaccagcgctg

SEQ ID NO: 52375 - DNA, 593 bp, Triticum aestivum
  Clone ID: PAT_TA_52375
gggattttgcctgcccgtcggcactcgccgcgcgcgccagagagagagacacagagacacaacccagccatgaacgtgcgtattagcgagcgggccaacgcgcggggcaaccggtacaaggtgacgtaggacgccacatgaggggccggatgagggccaggacaacatggaggacatcctgatgaacatccgcaagaagagcctcctgaagaagctcctcaaggggctccaggaggaggttcatatccacgctgctatcgtcgacaacaagcttgaaagcttacctgatatggtagctggtgtttattgcgaggataataacctggatatcgaggtaactacacaagtacgtacgctgttttctatataaaggagtctacaaatgaaacaagttatccaataaggcattgattctcgatttgtgcatttatttactaaagaagatattacacaacttcagtttgaactacagtgggcactaacaaacattgtgtctggcacatcatataatacctaagatgatattgatgatggggtagatcatatatttgtgaaaattcttgcgaatgtcattgatgatgttagtgagcatg

SEQ ID NO: 52376 - DNA, 178 bp, Triticum aestivum
  unsure (1)..(178): unsure at all n locations
  Clone ID: PAT_TA_52376
ggnggacgagcaggtaccggncatgggctactaccgggaggacctaggngggtacgggatggggacgcccgggtacgcggggccggtgccgtacgggatgtggtaggtgaacatgggcggagactacggagggaggacgatgccggcggagggcagggggaagatgtaatgggggggg

SEQ ID NO: 52377 - DNA, 603 bp, Triticum aestivum
  Clone ID: PAT_TA_52377
atcatcgccattactcaataaatctcctgttatcaacactgcatcagttttatcctcaactccatacgcggcatctcctactcccgttcctgccgttgctaaagtggacactgctgatctcttaaaaagcttaacttccatgggttacttggatccagcaccaagcaagccattgagcttggagagtttaggtccatttgtgttagattctaaagaccttcagattcctcggcctggtgctattgaattgctctattctgctgaacctcttcagtgcaaacagtgtggtttccgatatcctaaaactgaaaaaggtcaacaaaagatggatgcacatttagattcgcactttagacaaaacagaaagatgaaagagagagtaaaacgtggcttatctcgttcttggtttgttactgtagaagaatggattcacggcgaaggaggagagtctatgagtcaacaagtacctactttccttcatgatgggatgggacatgctgttaagcctaatgaaggtgccaattcaactgaagatgttatcaacccagatgatcatacagttattaagcaaaccgatgaaagaatacatgtcctatttgtggc

SEQ ID NO: 52378 - DNA, 309 bp, Triticum aestivum
  unsure (1)..(309): unsure at all n locations
  Clone ID: PAT_TA_52378
gcagnagtttangctctgctcccagctgcggcgccgttcaccctatgtggaccaagnaaggnntggcgacgcangagtggttttgnngtcctgcttnnctcctcctcatcgcaccaggagggcggnnggtnngccgggggcggaggggcgaagatctgcctggcggcgtcagcgccgggttcaaggggnccgtgcatgttngaataagaactgngcgcaggtntgccagnaagaagggtggggcggnggnaactgngacgggnccttnngncggtgcaagtgcattaggcagtgttgatcatatgtgct

SEQ ID NO: 52379 - DNA, 386 bp, Triticum aestivum
  Clone ID: PAT_TA_52379
aacccagacacgggcgccgacttcggggccgccccggacatcgaccacctcaacccgcgtgtgcagaaggagctcgtcgagtggctcaactggctcaggaccaacgtcggcttcgacggctggcgcttcgacttcaccaagggctactccgcggacgtcgccaagatctacatcgaccgctccggggccagcttcgccgtggccgagatatggacgtcgctggcgtacggtggggacggcaagccgaacctcaaccaggacccacaccggcaagagctggtgaactgggtgaacaaggtgggcggcttcggccccggcaccacgttcaacttcgccacccagggcatcctcaacgtggccgtggagagctagctctggcctctgcc

SEQ ID NO: 52380 - DNA, 464 bp, Triticum aestivum
  Clone ID: PAT_TA_52380
gcgtgggcttaacgcgtggggtggcatccgcggcgaccgcagaggcagaggaaccgtgcctcatacagcacgcgagcgcactgggctgaattaagaccgatgtagtgggcggattgcccaggctgtagtggagaatacatccactacagcgtattccattgaaccctaagttaaaaagcgctgtcggcgtgtggatatagccattacatacgcatggagagagtgaaatatagccagaaaaccggtcgtgctagcgaaatgggtccaccgcaacaaatgtactgctatactagtgaaacagaaatgcttaaccaagtaattatctggtgttcattatatagtgcactggggatgtggtactggctaccatacataaactcttggtcttctgatgtgaccgtaatgtcatctgtcagaactattgtaatgcatgcttacatctatatatatatgatgaacaagcg

SEQ ID NO: 52381 - DNA, 471 bp, Triticum aestivum
  unsure (1)..(471): unsure at all n locations
  Clone ID: PAT_TA_52381
tcgccccgcgtncggntttaccaggactgagtagaaaaaacctaaatncggaagtaatnttaaaaaaaaatnaattntgggaaaaaggagcaatatngtattngtnttnaagaaaaacagaaattgggttttnattatggtntgacagaacgacaattacttagatatgtacatatgggtggagaaggaaaaaggtnaanaggggaggttttactacaattacttgaaatgggtttggataatatnntttttngattgggtntggtttnaancattnntggggnnngnnaattagtnaannatagacatattttagttgatggtggtgtagtgaatataggaggttttggttggaaaggttgagatgttattagtaggaatgattattantgatgaaagggtgtggtttanaattatattggttgatgggggggggggtggttgttgaagtatttggggattgataggttg

SEQ ID NO: 52382 - DNA, 500 bp, Triticum aestivum
  unsure (1)..(500): unsure at all n locations
  Clone ID: PAT_TA_52382
cggatatactncgatganatgnnctccttgcacatgnccgcatcccagnanatttnntnaggatgggatctagngcgcgttgnatagtgttttactttaatggggtngtttggagaaaacaaaccgnggcaacctntaagaagctgagcaatttgacatcagaggaatngtaaatgagtttaagagngnagttnttggttatgcacatnggagagaaggaatggatattgaagtgtnttatgtaaaaagaaaagatatntntttgtttgttttatgtggtggggtgngnnntnntnggttttnnagataagtagttaggagcagttgtattgtttgtaggaatggtgttanaggtgatggtgaagttggaaatttattgggtgttgaaagttggagtgatntttaatgtggggtagatgattgtggtgggtatnaaagtattttgttggtggngagtgtttgaagttaagaaatgtaaagtattttgaatgggaatttaa

SEQ ID NO: 52383 - DNA, 284 bp, Triticum aestivum
  Clone ID: PAT_TA_52383
cccacgcgtccgattgaataacaaaataaaaaaaatggatgttgattacgatgttattgttttaggtaccggcttaaccgaatgtatcttgtctggtcttttgtctgttgatggaaagaaggtacttcacatggaccgtaacgactattatggtgctgaatctgcatacctcaacttgactcaatttttcaataaattgagacctgaccaaaaggcaccagaaagcttgggtcgcgatcgtaattggaatattgacttgattcctaagttcatgatggctaatg

SEQ ID NO: 52384 - DNA, 379 bp, Triticum aestivum
  Clone ID: PAT_TA_52384
cccacgcgtccgctgtcctatcggcgagaagtgggggagatcttggtgttccgtactcgcgcgcgcaagctcactcgctgcagatgttgcattactgttgtagatctaacgagcccaagccggcaagcgtggaaggaaaccctagatagcgcgagtccgtcgggtaggggaggcgatatgggcattgtgtttaggcgggttttttggtgggtatttggaaaacgtgagggccgtatattggtatttggtcttggaaatgggggaaggagtactattgtatatagggtggagatgggggaggttggtttgagattggaaggatggggttgaaaggggagatgggtattggaataacatgaagttggaagtttgggatttg

SEQ ID NO: 52385 - DNA, 590 bp, Triticum aestivum
  unsure (1)..(590): unsure at all n locations
  Clone ID: PAT_TA_52385
ccccgcgtccgccggcgcgaggagggcaaaggaagagaagaggagatcaccgagcccagcgcgcgcacaggacagcaggcgccgcgatctcgcacaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtcgaaactgtagagtacaagaacattagtttcaccgtttgggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgntgaaatcactgacaagcttggcctgcattctttgcgccagcgacactggtacatccagagcacatgtgctacctc

SEQ ID NO: 52386 - DNA, 498 bp, Triticum aestivum
  unsure (1)..(498): unsure at all n locations
  Clone ID: PAT_TA_52386
tttttnttttttttttttttttttttttttttttttttttttttttttttttttttttttttttttttttttttttttttttttttttttttttcaaaaaggaccaatggttttattccagggggggggggcggctcccccaaagggggggggggggggccccttttaaaagggggccttgggaaaaaagttgggccaaatgggaaaaacgggccccaggggtcccttaacaattccccccctggcccccaaattaaaaccccccaccttttaaagggaacccccctttttaaattggggggggggggggccccccgcaccaatccccccttaaaattttttttctcaaaacccatagcctttgggggttggcccaaccccagttggaaggggttttttgataaaaggaaaacctccacccttatggtccaaaaagaagccataaacccctttaaaaaaacccggagacccaaaaacaaaaaaatcccaaggtctttc

SEQ ID NO: 52387 - DNA, 532 bp, Triticum aestivum
  Clone ID: PAT_TA_52387
cggtggatattccaattttaaactatcgcgacgcgcatgtataccaaatctacctgaccctgcaactgcattgcttagcgttgcaagtacacttcaagcagccccattagaccttccggacggaagctgcgaacctcgtatctatcatccgcttgtttcaacaaagcctcaaattcatcccgagtgcgcaccttgccaccaaagctcaccaacatgatgaggtcaatctgacgcaggccacgctcaaagtcgcgtgttaccgaaccctgggccgggagaatcaggtcattgatgagcagtggagtgttgggctcgcagcgttcgagtccagggactagagagcgcaacatggtgacaacgtcctggtcgcaccagttgagcgcgcacgcccgcaagatgtaagcagctgcgttgcccaccggctgcggctcgaagaagctatgctgcatgaaagaaacccgcttcttggtctcatcagtgagcaaagactgacccgctaggtgcatgtcggcgaagtcttgcaccacaaaat

SEQ ID NO: 52388 - DNA, 546 bp, Triticum aestivum
  Clone ID: PAT_TA_52388
attctcatatacaataacatttgaaataaactaataattgtctactttcatgtcgttcaaacccaattcctcattcgtttcccaatcacgttcataatcttcaatcgtcatttctggatcgtcatcaggagcataaaggttttgaaggtatgagttagccaagggatcgttgatgatgagtgtaacaggaaacattttgccatcagcaaccttgtttacgctatccaaaaagttggcccatttttgtttgctttcatctgtaccagagtcaccttgaatgaagggagcacgaccttgtaattcgtcgtgaacttgtctgagcaagccttcgacggttgtaaatcgaccgcccaaggtgccctgtgtcaattcaagatcgatttctgggatgctcaaaccacaggtctctgatttgagaatatctcttgacaaatcttcagcctctgtcatgttcagcgtgatccttctacccttatccgaaatcgatccaccagcctttacttcgttactcttatagccacagtgttcacagttggttgccatgat

SEQ ID NO: 52389 - DNA, 439 bp, Triticum aestivum
  Clone ID: PAT_TA_52389
ggtggaaataatcaaagagaggcagatgaccctgttttttatttaccaaaagaagaacaattaaataaatagagaaaatgccggggggattaaaaaggaagagggggggcataaatatagctttgcactttttcaggtgggtaaaagggaagaagaggggtatacaagtcatgcccatggaatgatgaacaaggggaaaaaatgcccgaggggtgggtattttgaacgagggagggtatttggaaaacgaagggcttttttcttggcttttcacggtcttaaagaaagggtttaacttctgcttcaaaaactcgaattggaacaaaaggctcaggttcttttggaaaacatcccaatttttcaaaaaataaataaagaactgggggttgaatataaatttcttgaacaaagatacattcttcaggactcaaagggaaaa

SEQ ID NO: 52390 - DNA, 331 bp, Triticum aestivum
  Clone ID: PAT_TA_52390
gccaaaacaagaaaatactccaatgggtcaaggccgcaggctgggcaagtccagaatacagagcggtcataggaaaaccatgatggggaaacaaacagcgccacggacaatttaacacccaccaaaacaatctgatggctagccctttgacaaagagctttatttttccacaaacacccacattatctgtcaaaaatatataattcataatacgcaaaggcaaaattagtccaaatatccagcttatccaaatccataaaagcccctgccgagatgctacaagccttgaaggcaatgttgttggacaaacaatcaaggcccttgtacaacc

SEQ ID NO: 52391 - DNA, 495 bp, Triticum aestivum
  Clone ID: PAT_TA_52391
acagggaaaactgaagtatttttattatatgaagggaagagtaatgaaacaaaatataaaacaaaaaagatttctaacaattaaatatagactatataacatagttaagaggaaacttaaaacttgggttctttgggttggtcccaggggaattcttcacgaccaaagggaccgtaggcagcagtcttttggtaaatgggcttgaaaaggtcgagttccttgacaatgacaccaggacggaggttgaagttgttgcaaatgatttcaaccaattcagcttgaaacttttcaaaggtaccgtaagtatcaacaaagatggaaagagggtcagcaacaccaatagcataaaaaagctgaacaagagcacgacgacagagcttagcgttaactaatgacttggcaatccaacgagcagtgtaagcagcaaaacggtcgaccttggaccaatccttaccagagaaagcaccaccaccgtgagcaccccaaccaccataa

SEQ ID NO: 52392 - DNA, 222 bp, Triticum aestivum
  Clone ID: PAT_TA_52392
gaatgtattcattaagatttttatgttacaaagtgtgaaaattatagagaatttgcacattaaaacatgattcaattaatattgaagagatgcttattgacgagcggtaatttgcttaacaccaatgggagtacgcttagccatgttagcattggacttaggacccatgattgcaccacccgagtgacgacgggttgattcccacttttaggtaaagttggc

SEQ ID NO: 52393 - DNA, 540 bp, Triticum aestivum
  Clone ID: PAT_TA_52393
acattaaccaattttttatttgacatctaataatgtgtgttcattttgtattcatcctatatcagacatttcctttttgcttactaaaaaaccaaggaaggcgggaccttagaacgagggaaacaggactcctcaaaaaatatcaacaggctagttgttatacaggggctaaggttcacagaaacagccacagtttaggatacgggacccagcaaaccaacctgtttggcgaataaaatcggccttccgaactggcctagctgcttgcttgcccatctcggcgacgactgatgcccgggtctcctcggccacgcggggtaccagctccagcctgatcgccatcctctgcatggcctcccttctcattttctaagcacgatcctgtagcttcttcattcccgattcaagttttgttctttggcgggggtcccatgcttcgagcttcagctcttccttcttgaaccgcgctgtaagcctagaaccatcggcgtgctctaatgctgcagcacgagtagcatattgctgcttgatcctctccag

SEQ ID NO: 52394 - DNA, 556 bp, Triticum aestivum
  Clone ID: PAT_TA_52394
cacccatgaaagcacctcagtgccaacttcccgagagcaatgaagcacacatgtatattcatttatatacagctgagaaatgagtcacacacagacaagttctgttcaagacttctgggatatacatgcgggggaacagctccatatggtacacgcactagttgttattatgtaaacgaccatactggaggaggctgccatatgttctatcccacacgccgacgaaaagagcgtccatatccgggctgaaggagatcccagatatctcgccaaagaagtccagctcttgccttttggtgtagtcgctccgggcgtcgaagatctggacgaagtccgcatgttccgccatcgccaggaactgcccgtcagaagtgaagcggatcgacctaatggccccaaggttgcccttcagtacatggatggctttcgacaggtttctcacgtcccagactcggcatgtcttgtcttggttcccggtagcaaacgttcgtccatcagggctccaggccgatgcgaacgagtagtcgtgatggcctttcatggcatgaagcgtctc

SEQ ID NO: 52395 - DNA, 480 bp, Triticum aestivum
  Clone ID: PAT_TA_52395
gggggaaacaccaggagaaaacaggtaacttattaaaaccggactccaagtgggagaacgagtttaattcttacaaacagttgcattatttgcagatccacgcaactcgtaaaccggggttaatgtatggaggcctaactttaaaacaattcccgttgataccaggaccattgggctgtaaaaggcgtgctcttcattttattcctaaaaccctgggcacagaatttacacagcggattggaacaacatctcatcctgttcctgtttgacggatggaaccgttggctccccccatatcaaagacctttttttttagcgcattcaaagcctcccttcccagcccttaacatggaaccaatctgagcggcaaagctttgggagcccttgcggacaacttcttgcagagaaccatcctcaataacatggtcaacattgtggaggccacgggccatgggttccattccagagatatcagcaaaa

SEQ ID NO: 52396 - DNA, 407 bp, Triticum aestivum
  Clone ID: PAT_TA_52396
caaaaaagggggcaccacaaatttttttcccggcggcggcggccaaaaagcaacagggccggggaaaataatccccgcccccaacattttttcccccccagcataataatgggcgacccacaaaacgggaagaggcgttcagggccccaacacccccccagggggggtggctatagccggcccccctaacggggggagttagctacccaaatgccccgggggccggccggccccaaaaaggggggaacgggaaggcccaaggaggggagggggccccccccgggggggctgcgaattacccccccgaagggggggccctgggggaacgggaaaaaccacggttgctgcccccgaaggttgccgaacaaccccccggggggctgggccccgctgaggatccccacccc

SEQ ID NO: 52397 - DNA, 442 bp, Triticum aestivum
  Clone ID: PAT_TA_52397
aaaaaaatccccccaacccggaaacatggttttttcagcggcttaaaaagggggcattgggaaatttaaaggcccaaaaaaaaaaaaaataagtttctggggggaaaaaagggcccccgcccaattttccccgtttggggccccaggaaattcccaaagctgggcccattcccccagggaatgggcagtttggggaaaaattgcttttttgggccccagtttttgcctaaaaaggccagttagctccttaacccagtcttggacagaaacgggggcccttgacagtttgggcaactcaaaaaagggaaggacattgcccaaaactttcaccccttcccactttttaaggctttcaaaggcctggccggcctttgaaaaacttttaaaaaaaaaagggagcccggttttaaccccgaaacccaggttggggaaaaccaccttg

SEQ ID NO: 52398 - DNA, 532 bp, Triticum aestivum
  Clone ID: PAT_TA_52398
cggaaaaaaagaaaggacaaactgttatatgaatatcacccctttttacggttgaacaagatggccttgagtaaccagacacctgtggcttgacactgacacacatttatgaatttaaattagcaaaagtaaactaaagagttggaaaagtcttcaaaacccagatcttcacaacacttgccattctttgagaaccattggttgaacctaatgttcttgatgtaatactactgaccggagagccacttggataacccaaaacttgactgaacattcttagacaaggatatgctaaggatgcatgaacccaagcaccaccttctggtcagacccaatctaaccaatcactttaagaacactttaacaatgaaggaactgatttctgactcggaaactttaaaccatacgaatcaaaatataatgagcgctcaagaaggctttctaattcttaacctctaccatatgcatcttcaaagtgactgtaaagtggaaggaatactaggctgtctatgtaaataacaaagaattgatg

SEQ ID NO: 52399 - DNA, 551 bp, Triticum aestivum
  Clone ID: PAT_TA_52399
agtggtagttcgctaatcgcgaaagggaaatcttttcagggcttgaaacacgccgtgagcagaccgggtactgattggtttatacaggcacctcaccttctaggttagccttccgatcaggcactaagacaaacggcttcttagatcgactcctctggtgagtagtgacataaaaatttccaaatactactggccggaatccgggcagacgatgatgatagtaagaaggttgggggagctcagctcagctctcctcggaccgtgccgtgctcggctcaaccacggttcacggcgggctgaggaacagcgccggatcggtgtcggcgaacacgccggccacccagtaggaccccaggtcgcagcccgacggccactcgaacgggctcgggtccgccagctccttcccgccggcctcgtccgccacgccgagcccgagcgccaccgacgggtgatcggtgaaagccaggcccccgtttctgtcagccgcgggtggcacgtcgggctcgccggccgtgaaagcgaagcccccgtctccgtccgccgcgggtggc

SEQ ID NO: 52400 - DNA, 558 bp, Triticum aestivum
  Clone ID: PAT_TA_52400
gcagcgacggagattaattgatcgttcgacgagcggaagcgaggaaagaaaatggagtacaagagaaaccaaatgatagagcgtgtctacatgtcgagggcggccagctcccgtaggaacgcctcggcgtgctccggcgtgacgcagcgggacaagacgttgacgccgtcctcccccttgcatggcgggcacaccacgcagaagaaccccaccgccttctccggctgccacatcaccctcgccggcttcccgcgccccaagtccgtcgcctccagcccaagcttctgccagctggagacggcgatcgcgtggtacctcggggacgacatgagcctgcccaggtcgttccctgaggcgacgccggcgtccatcagcagatccagtatgtccgcgtggccctttatgagcttcaccaggtccctgatctcggcgcccgccaccgcgccgctcgtcgccaggaccagctggctgccgaagcagttgccgtagtagccgctctcggcgccgaccttctcgcgcatgtttttcgggaagaagagcatcgcggggtcggcggcg

SEQ ID NO: 52401 - DNA, 548 bp, Triticum aestivum
  Clone ID: PAT_TA_52401
caacaccaatatatattgagatctgggtaggattcttaaaacagccacgggcacgacactaggtacattcgacagagactgaattacaacatgctaaaaacgaagcaacagaagacagcggtccgagcacaggaccctacagcctacatgggactagcaacttcaccactccgatccaggataacgactagatgggactagagctaccatttctatcatcgccatcggcagcggcagcctgaaagagagggagggactaccaaggggctaaactaacagcgaacatccatcatcgatcggtgacaccagcaatgagcggcaacggccacgttccagagaccccctccccctgctgctgctgcttggcgcgccgcttcactcgtcgccctcgctgtcgtcgtcgttcacctcggacttggacttgtcagagtcgccggacgcctctcctgcctgtggattgttgtaggcgtcgatcttcttggtgtactcggccttgagcttctcggccttggcagcggaaggagccttctcagcatcactcagggact

SEQ ID NO: 52402 - DNA, 167 bp, Triticum aestivum
  Clone ID: PAT_TA_52402
agaagaaaaaacccgggtaactctactcaagatgttggaataccggagttctataatatataaataggaccctctttggcccataatataagggcatttttgacactaggggggatcatgggggagacatagatacaggagccgaacgcaatggcactccatccgtc

SEQ ID NO: 52403 - DNA, 531 bp, Triticum aestivum
  Clone ID: PAT_TA_52403
gatgaaataaataaatattttttattttcaaatttaatgatctcttcccggcagaataccacatccgtaggtatgtcgattcgcataaaattgtaaagtggccaaataatgaaaaaagataccaaaacagacaaatacatgccaaatagcatgacttgttagacctataaaatcaaatgaaccaggatacattttttcagggaatcgatttgcatagacaacaacaccaaggatatacatcagtacacttaatgcagccaaatcaaaaaagtcccaagttgatttgagtccattcaagaagatgagatggaagacaggtattgcacttgatacagccatagaaacaaatacagcaattcgaagtggtctatattcctttgtatcccaccgtttcaaaaagggagcaaatattcctatgctcccgatcaaggaggtaaataacatgtatcgatttcgcatcactggtctgcagtaatatccataatattcagaaaccaggacagaagctgtgataagaaaagcgattcccat

SEQ ID NO: 52404 - DNA, 440 bp, Triticum aestivum
  Clone ID: PAT_TA_52404
ggtgcataaaaacaactcgaaacttttaaagccatagtatgcttctgacaacagggattagggctcaagatcttggcgcgtacatacccacaaactggggttgccggcccccatagaactgggatgacattcacttgggggaggaggaaccgaaataccttgggtgtggtgataacggcccaggccatatttaagaggtccgaacagatagagcggatggggctttgggagcctggtccgattacttatgctgggtggctttttattaggctcacccttgggggtaaccccaggggtatgggatgctcgtcgcctacttgggggggtacgccatggggttcatgccgaccttgtggagctcctttgtgatgtcaaccgctatccggcggtagctcaattccacaggaagacattagacgcctgggtcggaccccctgggc

SEQ ID NO: 52405 - DNA, 411 bp, Triticum aestivum
  Clone ID: PAT_TA_52405
tttctttttctgacacgtcagacgatcctctaaaggacggacactcactttattcctgtatattgcaaacgcacgtccttgttaacaaacgcgacgtcttcctatatgtgtgaactgtatatcttgcgaataaaagaacttactccttcctttgaagagctgacactcgttcattaggaactgtgaattcaatgccgttcacttgccgagtgaaatctataagggaccttgacaccttggactttaatatcttgccttgcttttactgatgtttcttctgttgctgaacctttaaaggccatattatattttaaatcagcagctctaaaaaactaggcattcatacttttgcttatctttcctgtcaatttgtaccctaaactaccgcgatgcatatgactgacgcgtggc

SEQ ID NO: 52406 - DNA, 482 bp, Triticum aestivum
  Clone ID: PAT_TA_52406
gcaaaccggcgcgtactggggagccggcttgaattgactaacatgtctatgtacaaccgccggccatgactatcccgcaacatgaacaggggaaatttgagatcttcagatcttcatacccatattgcactgtctcttgacgtgatcaaaaaagaacctttattcaagccgtcggcctgatatacatgcatgctgacaccgagccaagaatgctgcgcgggcatggcgaagttgcttctggtactagcccttcaactcaccttctcaggctgtccaagcgtgcctggaggtcgtcgtcatcagggtcagctccgccgccgccaacagcctgcgccaccctagcttcaggtactgcgttcttctgcagtccgctgggcgtctcgccaagagcctggccaagatcgatgcctatctcatccaagacctggttgacgacgtcttcgctctcttcttcgtcttccatgccaggggcatcatcgata

SEQ ID NO: 52407 - DNA, 434 bp, Triticum aestivum
  Clone ID: PAT_TA_52407
ggaaccagggcccaaaaaaaaaaaccggggaagggccctttacactattccagggtttccaaaaaaggggacacacggggggggcccgaaagaagggtcatataaacaacaggggccggggaaagggagcccccctttaccaaaaaaaaaaactgggtacaaaaagcccggaaattaaaggagggtaacatttaaaaaagggggggccgggggttctaaatttttgaaggggggggaaaaaacgggtggaagggggcaaaaaccaccaccggggggggccccccaaatccaaaggggttaaaaaaagcaacattcacttgaggggggtttttttggggggccacgggaaaaaaaaaaacttcaggccccggggaaaaagggttaaggggggggggcccccccccagtagttatggacttgatagggggaaaagc

SEQ ID NO: 52408 - DNA, 303 bp, Triticum aestivum
  Clone ID: PAT_TA_52408
gggggcggcaagcatttgccccttggggggggggggggggggatacacatggggggcccttatgggggggggcggggggtttttttaaaaatcatgcctaggtgagccgggtgggggggggggcgggctttagggtttttccgggggcccccccgggtttgttgaagaaccccccggggttccccttttgggcccccgggttttctttgggggggtccccccccgaccccccccgggggcgggggtcctgtggtttggcttcccttccttttcctgggttcgctggcgcggcctctcgggggg

SEQ ID NO: 52409 - DNA, 428 bp, Triticum aestivum
  Clone ID: PAT_TA_52409
aaagggaacaaaaagttctttttattatatttacaggggcgaacttgaaagagataaaaataagggatttcataaaatatatggaaaaaaaaatcgggttaaaattttccaataaataacaaaaaagcgggaaacttcccgatttgaaagagaggatgaatggggaaggaaaaaatggggatggatgctttctaaacttgcatgacagagcagccattttccattctcaagggtctattcaaagcatccataccagcaaaggctttatgacagggatggcaagcatagggaccaataccccaatgcaacttttcgggtcgattacaaccatgttggcttgcaaatcttctaccacagggagagcaggcataaggaccttcggaagtgtgtgtccccctttgaaaagtcaaattataagggcgagtaaa

SEQ ID NO: 52410 - DNA, 442 bp, Triticum aestivum
  Clone ID: PAT_TA_52410
cctccaaggccggccccggtttattctagtcccagctgggaacttggggcaaaacgggaaaaacatgggggggtaccacaaaaatctggggtttaacacagggggggggccccactaaaaaaactttgaataaactagctaagccggccgaaggggcccccttaaaaaaacccggaaaaaatgggcattttcggggttaaaaatggccccgaaagccccccggggggggaaaaagggccccctttgggaagggggggggggccccccgaaaaaaaagcccccggcccaaaaaccctgatgctgcccgtagggggagggggggaaaacggggaaaaagaagggctcgaaccccaagggccccggccggttgtaatatttcgggggcccttacccttttatgaagcccccgggcaaaggccctggcctcgccaggggcggggga

SEQ ID NO: 52411 - DNA, 487 bp, Triticum aestivum
  Clone ID: PAT_TA_52411
aataacattcttttggggtgtggtttaagaatttctttcgggtaacacatttggcgcacgggcaagcagggggcggggccgggtaccaccagccgcgggggccggggaaggggggggggggggggggctgggggggggcgggggggagacagggggggggggggggcagggggaggagggggcgcccaaacccattacccaagggggaccagggggcaggaaccgggcccacggggcgctccggggaaggccgggggaccacggggtccgggccggcgggcgcccccggggcccccgggccaaaaccgccggggggggcccccgggagcgcggggacccctgggaaagggcccttcggggcgaacgggcccccgggggccaggccctggcggggccgctcgggggggggggggctcctggggcccgtagggggggggggggggggggccggcgggggttttcgggcgtcggccgggcccccgggggg

SEQ ID NO: 52412 - DNA, 359 bp, Triticum aestivum
  Clone ID: PAT_TA_52412
ccccaaaagggggggcttggcgctttttttttcacaacacaagacatcagccccaagtttcaacaaccctgccagcaataaagcaaagcaattgcctaaaccaagggtccacatctcaaaaaagtccccttttgagccccaaacgggtcaggggaatttaagccccacaaattacaagcggattgccccaaaaaggggggaaacctgccggggttgcaaacctcaaggggcaccaacccgggggggagggaaaaggggtatccccccattggcataaaccccctgcaaaagcatttcacccgcggaggggacaactttcctttttttggcggcccccaaggggccaaccaatgcttaaa

SEQ ID NO: 52413 - DNA, 461 bp, Triticum aestivum
  Clone ID: PAT_TA_52413
cccaaaaaaacattaaacggggcttttttaccccattccctattaaacccggggcccccgcccaacaaagcagggttttaaaggaaactttcttcatcataacccaaaccaaaggggtcccccccctgcccacaaaacatcccttaagggggcctttgcccccccccgttttttcccccaaggggggtttcccgaagggtcccccccccctagataaaaaattgggaaaggtcccggaattgaccccccaaaatccccctgtccccctttataaattggggccccaccaaaaagcgtgcccctctttaaaaaggggcgtttcgaaacccccccgttactttcacccacagcttttaaatcccctaccaattcaaacctaccgggataggggccttgaatttcatctaccccaaccggggggaaaaaaaacccacccccagttaaaaccccaaacataaccc

SEQ ID NO: 52414 - DNA, 376 bp, Triticum aestivum
  Clone ID: PAT_TA_52414
agcacaggaaccttacttaaaagggggcttattcatacttaacggggcaaatgtccccgcaacgggtggccccaaaccacagggcccggggggccattaaaccagacccagggcgacttacacaaacgagacagcccttgaacaaaggggcccccccagggcgacccaggggacagcagcagcagcggggcgggggatagggaaattaccggcccccacggggggggggccccaggggaaggggggaccccctctggatgttgtagccggggagggggccaccatcccccaactggttgccagaaaaaaaaagccctgctgggccgggggaaagccccccttggcttggatctgggccctgacattggcgaggggg

SEQ ID NO: 52415 - DNA, 555 bp, Triticum aestivum
  Clone ID: PAT_TA_52415
cactgttacacaatcttaacgcttatctttgataaaaaagataaatgaaacaattgtactttttttttttattattattaatggcattgacttaatctagcttataattttgcttgaccagtattaattttagcataatcttctaaagtgaaaggaacataggtttcatctttatgccaataaactggttctgactttggtatctgtgtgagatcaatgccttgattacggaaatgaaccttttgatgcttaaaggtgcctgtgatttccatagcaggtataaacctgatgaataatggaatggcatatttaggtagtctttgatgaagaaaatgataaagatttttaaagtcaatagcagctccttgtttcaacacaattgcagccataccagcacgaccatcatggttgggcacaagagttccatacacattggcttctgcaatctcaggatattcacccaaggcttgtgcaacttcggttgtagctacattttcagatttccaacggaaagtgtccccaagtcggtcactaaaatagtaaaagccatcacta

SEQ ID NO: 52416 - DNA, 439 bp, Triticum aestivum
  Clone ID: PAT_TA_52416
aaaaaaaaatttttttttaattttttaaggggaaagggggggggggatcccccaggccccccccccccggggaaaaaaaccccattacagggcccaagggcccccccagactggggggaaaaaaaacaaaaaggggggcatcttttggggggggaaaattggcccaaaaaaaaaccaaaggggttttgccccaaaacccaagcgggttttttggggggccttgacccggggttttttgccccaatttttgggcccggggaggggaaaccccccgtttttaaaccggggtttaaccttctcaaatttggggccccccgggggcgggaagccccaaaaaaaattgccgtttgtggcccccaccgggggcccctgggggtttttggcccccttttcctgggggcccccccccttaaaaaaaaaaacttttcccccccccccc

SEQ ID NO: 52417 - DNA, 294 bp, Triticum aestivum
  Clone ID: PAT_TA_52417
acttataagatcaacagcatgagcatatacataacatttggatgcattcatatactaacatgcttattcaagtgatgattgacaccatggcacatacacatcttctcatatgatgaacaaacatgaacggttgatggaaaaggaaaacccaaagcaatgctatagttgacaaaaactctaaggctcttattatgcgggccgtggtgagcgagcagtttaggccttaaaacaactcttagcaccccggtgactctaaggggatgaaattgattgagtgtacctggcacatagttg

SEQ ID NO: 52418 - DNA, 525 bp, Triticum aestivum
  Clone ID: PAT_TA_52418
aggctaagaacagactcattcaactgaaactcatggccatagtagcagcagcagcagcagcagcagcagcatatattgctgccaaaagagagctcgtagtaccaccacttctccggtacgtaattacagatatacttgaactaacactacgctactttgccaaggaaggcgaaaccacagacgatgatctggttcaaaaaccgccccccaaacgcttattacatcggagcaatcagaagcacgtgaggcggcctagttctccatgcggatgatgcagcggatgccctcgcccttcgccatgagggcgaacgccttgttgatctccgagaacggcacgctgtgtgtgatgaacttctccacctccagctcctttctcatgtacatctccacgacattgggcaggtcggtgcgcggcttgaagtttccgaagaaggtgcccttgagagtcctctcgttcaggaagttcatcgggtgggtcttgaattcggcgtccttgtgcggcacacccaccagcacagcaacacc

SEQ ID NO: 52419 - DNA, 348 bp, Triticum aestivum
  Clone ID: PAT_TA_52419
aggaaaacaggggaaattttatttagggggggcgggttacaaaaatgggaggggacccgacgggggaggcagggcaggggcaaaaaaaaaggcccccgatcagggggggggtacatgggatgggagtaggaaaacgatatgaacgaagatgcacccacgggacggggcatgcatatgggcgaagaacgaactaacaactgcaaaaggagcaacccaaactggggcccaacttgcactgggggcaaccgaaacccccgttttccgccgccattttcatgccgccggagcttgccttgggggggggggggggggaaaacaagaggggggggccggcggcctcggcctttg

SEQ ID NO: 52420 - DNA, 523 bp, Triticum aestivum
  Clone ID: PAT_TA_52420
gatgtataaacaaaaaatattttattatttctccaatgcactgattaaagcatttgtgtatttatatagctctgagtcttctttgatttgcttcaaaccattcaaggtatttgatttaattagctcaataacacttcttttttcaggtactgatctaaccgtttctaccatcttacagagtaatatgcatgcattacatttaatttggactggtatctcgctcttgttcgagcatatgtcgttggaaagaacttgtataagcgacattttcccttttccttccacatcgtaagtgtttgttgtaagaagaggaatgacttgtattatattagaactattctctttatctgagaaaatcaaagtcaaagccatgataccatcatttttaagaataggaaattgacttgtgcagatcaattcaacaataggctcaatggtgcttgtttctagcaacttgttgcgtaaattattgttatttttctcaacccaaatcgtctttatcaaatttgttatcacacgggta

SEQ ID NO: 52421 - DNA, 172 bp, Triticum aestivum
  Clone ID: PAT_TA_52421
ggcaagaagaaattcatgcatgcataaactagtcatcacgtcgccgcttctgcgtgacggctaagaagaaactttgcagggaacagctcaaccaaacgcaaccaccactccgtcccaatcaatcatggcgctgccaccagtttcggaaggaatgccaggcagggcagagacc

SEQ ID NO: 52422 - DNA, 522 bp, Triticum aestivum
  Clone ID: PAT_TA_52422
acggggaacggaatttgagaattttattcatattgatttattaaaataaacaacaacaacaacaacaacaacaacaacaaatgataatgcacgaggaacagaatatatagaaaaataagggagtactaatactcctcctctttctcctgggctgggtggtaaggtgttggcacgagcatgagtgaggtcttcttccggtaagtgagcaccccttcctcctccatgttcacaccctcccggctcaccccgttgggcagcgcccagttgaagcagtagagcaagttggcaaggatgtactcggcgtttgccacccccatggccagcccggggcagatccggcggcccgcgccgaaggggatgaactcgaagtggctgccgttgaagtccacgtcagtgtcctggaaccgctccgggttaaactcctcggggtccttccacgcggaagggtccctgctgatggcccacgcattgacaatgacctgggtcttggctgggatgtcgtagccagccacctggatcggc

SEQ ID NO: 52423 - DNA, 543 bp, Triticum aestivum
  Clone ID: PAT_TA_52423
ccaaggatagaatgttttttattaatacattaaaccttatttattaaataggtaagaatgtgtatgcatactttagtgttttatttctactccattacggtccgctgcttcttgaatagcttccgcaagtctacgtaacccttcatccatttgctcatatgaaacattactgaaagacactcgaaggtaaggtgttttgttccctgctggcatgaagactttaccaggtagagccaacaccttcttcttaggaatagctgtattcataatcaagtcactggaatccgtaattccacccagtaacttgatccaaaagaacatgccaccagtcggtacgacccattcaccatagcctttcattctcctttctaaacattcaaaaaattgctcggcctttgtgcgataaaagcctgatacagtttcaatatgtttaaagaatttatcgtacccccataagttcaaaagctcatatgtcatcaactgtgggatacctgaaggctgaaggtttgtaaccatcgtatgaaggtcaatgcgttcaactaa

SEQ ID NO: 52424 - DNA, 505 bp, Triticum aestivum
  Clone ID: PAT_TA_52424
aaactctcgaataccacacaagctctcaaatttagtttataatatccattgcaacacatgggatctgcacgtacaattttaatgaacaacggatgtgttttatactaataaacataaaaaaatttctgttgcaacgcacggacatttgtgctagtaaaatataagtttgcatctactgatttgatgagtccttccaaagctcaccggaggggaacccacaggaggcttcaagatttctttgtcatagttaactgacatgagatacaatccatgtggtggtgctgacaaggcgaccttcacaagttctttgcaggcctttgccgcaatgattgtcgggacgatttcaagaggcagtccctcccttccaacttgaattaccaaagctaccatgttcctcacttgcctgtacaaaaagccagtgccttcaacctcgagctgtgtgatagcatccattttagtaacatcaaagcgtgatatcttctttattggactgcgcacacgatca

SEQ ID NO: 52425 - DNA, 152 bp, Triticum aestivum
  Clone ID: PAT_TA_52425
accaggtctaaaatcagcagggatgggcaacacagcattggggcaacacaggggcacatccaaaggggcaaaccgggggcccacaacatgggggggccagggcccaatttgtacaacaaaggaacattggggggggggctataaagcaccgg

SEQ ID NO: 52426 - DNA, 521 bp, Triticum aestivum
  Clone ID: PAT_TA_52426
cgggggcaatcgtcagtctaattattttacaacaccgggctaaaccattacatgctacacaacaagacaagtttattgacggggcagctcgagggcaaactggaacgcttaaatccctcgtcactgcaactaatcccccctttaattttcccaggaaacagacaactccaagccaggaaaatgagcaatgtcccacgcgaagatgaatctttgggaaatccctcaagtcaccttgagcgatgagcgataagcccccttatttgccggggctggaagcgacaaaggcaacacccttctaaatgttcttcttgaggtccccgaggcaggcctcaaaaaaacccttctaaggggcatcaatctcaccaatggggtggatcttctcgacaccgttggggccgagctcgaccttaaaggcaaaaaagtcgacaccctggtccttgtaaagagggctgtcaacaaaggtaggctcaattacacccttctaaccttgcgaggcgcggaggagggactcggccatgcgg

SEQ ID NO: 52427 - DNA, 522 bp, Triticum aestivum
  Clone ID: PAT_TA_52427
agccaaggaaactcaggtccaatcacctgattgatcacaatgaacatgatgacaataaacatctccatactgaaggatgcttgcacaaactgcacctactctatctagctagaacacactgcagcatatcacattcaggctgcagaactggcattcggcaagggagttcagagatgaaacttcatctcctctggttcccagctgaggggccatggttgcctctaagaagcttcacgatcaggctagccagctccttgctcccgccctcggcgcgcccaccgccgggcacgccgccggctggctgttgttgccggtactgtttcctcatcctccgcagacgccgctgctccttcttgctcgcccccatctccagcgaccacgccgtcacgtcgtcgatgcgctccagggcctccctcgtcagcctctccgcctccctcgccagcgcggggtactcctcgcagcgcctcttcttagcaggagcaggggcaggggcagcgcgcggcaccggcgttacaggcatcc

SEQ ID NO: 52428 - DNA, 466 bp, Triticum aestivum
  Clone ID: PAT_TA_52428
acaaaatagaaaccattttcaccattcctaggaggagccaaaagggtactcaaacctaccctgcccatttgttcaaacatggcacaaaaaaaagggggggcctgatgagcaaaaacaacaggtttcaggggcccctgccaagctttggggatggaccttgggggggggcttttgatggttcgcagtaaactggggaggtcccttgttccatttgggagggtaaaaacaccgggtggagcaaaaaaaaaagccccttgggttggcttcaaaaatgcctttaggggggatatccccccgggaagccattaaagagctcttcccaggcgattcaggagggaaaaatgcattctcccaactgaatgtgccagccggggccatatgttcttgcggggaaaggggttaaaggtaatggaaaaccatttaaactatttggggaaaagttgggctgccccttggggtttttttc

SEQ ID NO: 52429 - DNA, 438 bp, Triticum aestivum
  Clone ID: PAT_TA_52429
aggaaaataattactattcattaattgcccgaacaaggggggcaggcacatcacacgtccccattttgggtagaccggggtccagcaagggactgacagttcactcacccctacgggcgggggcctacctgtcgcataaatatatatgcccccccagggggggggcaagggccagacctagacccccttctgaaataacccatgccggcaactttattttatttttttaggagcccatcagtatcggaggagccccccatcaacataaacattaagctccacacaagcgcgtccatgcatgcacgtaggaaggggtatatattgaactagttgacaggggcccaattgggggacatgctcatggggaaaggcacacttaccccccacttgccgggcaccccggagaccttgcccatgttgatggactttatgctgggg

SEQ ID NO: 52430 - DNA, 561 bp, Triticum aestivum
  Clone ID: PAT_TA_52430
aaatgggaataaaaatgggcgagacaatttatttattatcgttaattcaagctttgtgcataaattgcagcattacgaccggctgttcttccgaatacaacacactctagaagggaattaccagccaagcgattacgtccatgtacacctccagtaacttcaccagcaccgtacaaaccttgaatggttgtcttgccatcttgagccaatatagaggcattgacattcatgttgagtccacccatagtataatgtaccacaggcgtgaccaaggctacccaataggtggttggcactagcaatcgactagggaaaatctcctttccaaaatgatcaggtgttgcattatcaatatgagcatcgtattctttaaatatactctcaatctcttccttctcaacgttcaatacattctttgccaaatcttcaattccttccactcgagtgaaaaaccctttggaggcgtagaagcccaatgtgctcttcccaaagttttcaacggcctcttctgttaagactaggtaagcagctgggtatttctttggtactactttaaacatc

SEQ ID NO: 52431 - DNA, 432 bp, Triticum aestivum
  Clone ID: PAT_TA_52431
ggcaacaaattcaggggcaaaaaatattaggggggtcttcggcaaagttggggccctgccatcttcaaaagaagagaaccggggtcatgaacctaccataaccggggaataacagagaacaatttccgaaaaccaagcgtatcaaccaatgctggcagggggagccacagctcacaattctctaaacacaaaaaattggattctattgaccatttccattaacaaaacaaaaggcccctgcgacccaagggaaaacccccgggattattggacttctttggccttggcatccgggtacaaacaaaacaaaatctggtgcaatccccccggatggagctccctggcaaatattaactctgggcacccccccgactgaaaaaggacggccctatgtcccggtttctggggaacctaagggttgccccccttttt

SEQ ID NO: 52432 - DNA, 568 bp, Triticum aestivum
  unsure (1)..(568): unsure at all n locations
  Clone ID: PAT_TA_52432
gaaaattgatatttaatgtattcatatataaaaagtaaattgtgtatgcatgtcaatatatatataatagtttttatgcttattcacacaacatggcaatcaaagcaccacccacactacctccttcagaagcaacttcaagtatgatcttgctactcatctcttttccaaaccattcgtctaaagcttgtcttacacgttgatccatatgaggataaaattcataggttgatccattgatacccaccaccatatgatccgatagaccctgttgttccaataaagaaatgatggccacagctaccaaggaagcagaacgagcagcgacaatgtgacagatacgtgtgagggtattgagatcatccaacgtgggcttctcgcttgtaggaaattcggttaggattctttgtccgacctcttttgtttctgattgatcgctttcgagtgcgctcatgtaagttgttgggaacgaccagngttgattgaatcccttgggcatttcaccaccaaacaagaggcctgcctcaataaagtccacagcaatcaaccgtgtgagttcacccatgta

SEQ ID NO: 52433 - DNA, 411 bp, Triticum aestivum
  Clone ID: PAT_TA_52433
ggattcaaaaatatcgaacaaccggggggggccgggggttatttccttttaaacaacactggttgggccatttacgagggacccactcgggccgttttagccatatccattacacgggggggggggtttacttagcccccaggaaaaatcacttacttagctttattctattaaaagccgggactataataaaattccaggcctgggagttgagggaggggcccccccgtcgcctatggggggggggtgctccccacgggcttgccgccggacccctcccaaggtgggggaccactggtcgccaccgggcacgggcccgactgggacccggggcccaaatagtccgggcccgggccgaagaaaccccactgggtggagcaaatgccccccgggcagttgcagttctgcgcg

SEQ ID NO: 52434 - DNA, 544 bp, Triticum aestivum
  Clone ID: PAT_TA_52434
ggggtgtgttttttttttttttttttttttttttttttttttttttttttttttttttttttttttttttttttttttttttttttttttttttggaccgaaccaaatgcgggggattgctagatagttcccgaaaccaattcgaagggggggggggggggggcccccacccgaaaaaacctttgaataggggaaaaaagggggccgcaaaactttgttccaaaattggggcgaaaaaataaaataattccggggccttgccaccctggggagcatcccggcgacggggaagtcaaaggggtccttgaaagtctccagcttcccccggggatcgggggaaaccacccgggggaagagcctaaacaccttctcccgcatccgccccaccgtcgcccccgggatcccccggaacacggccttaatgctcgccgggcccccccggaccccggcctccgggataaacaccgagtacttggcggggcccccgggggggggccacccgttctggaggggccccccccccggggggaaaaaaaccgggatg

SEQ ID NO: 52435 - DNA, 548 bp, Triticum aestivum
  unsure (1)..(548): unsure at all n locations
  Clone ID: PAT_TA_52435
atgccagaatggcgtcaaccatacgaatatgagaacacatacaaataacctcatcaacttgttcgtcccacacctaacttatataaacacaaatgcgtaaatttccttgcaatttacacatgagaatcaaagggaagactgacttataaatagtactccccgtcctataatataagacgttttttaacattagaataatgtcaaaaaaagtcctacattacgggacggaggaagtatatcgtagtacgtgcttaattaacagagattctgaactgacaccgttgaagacagtgaaaaagggcataaaatagcacgagaggcacattaatgaggtaaacgcgtacggccacgtttcccctacagtgccagcatgtggtctaccagcttaccgatggcgaggcccgacgagccggcctcgccggtgcactccttcgccaccttcttcagctcgccggccctggcccgcatctgggcgccttcgctccccgtgacgagccgacggatggcggnctncacgccggccctctcgagcgcgccggcgacctcga

SEQ ID NO: 52436 - DNA, 527 bp, Triticum aestivum
  Clone ID: PAT_TA_52436
aacccgacctggaacgccacgctccagttcgccgtgccgcccaccgccgaggaggccacgggcggctgcctccacatcctcctccgcgtcgagcgtatcttcggcggcgaccgcgacgtcggcgaggtcatcgtgcccctctcggagatcctctccggcgtcgggcacggcgccgactacggggcacacagcatgccccagttcgcgtcctaccagatccgcaaggtacaccgcaccgaggtgcgcggcttgctctacctcacgtatcgtctcggccccatcgtcctgccggagccccatctggagatacccgtcgacgagtggccggtcgtggcgtacccggtgaagcaggtgatgccgccgccgccgcctccaccgcaggctgcctggcccgggtatgtggccgcggcaccgccggcgaaaccacctgccggctacgtggctgtgccgactgcaaaaccagccggctacttggatgtgccgatatacgctgagagagcacccgggcatacggactggactgcgcc

SEQ ID NO: 52437 - DNA, 566 bp, Triticum aestivum
  Clone ID: PAT_TA_52437
cttataaaagattattttattgaacttgaaatatgcaattccccccattacatcgcagatcgcaccccgactgtatctcccatagtctcatctctccttttctaccaagaaaggtgcaaatagttttttccaaccatacgtactaaacttcagcaaaaggcgtggaagcaactcatgttcgaactctggacttggaagtcactcacacctcggcgacggggagcaggccaagctcccggaccaccccagcctcaccccggagctgttctccgacgccgtcgacacagacggggatcttctcgaacagcgacgccggcacgtcctccgtgatgaagccggcgcggaactcgatcaccccccgctccaggtgcgcggtcatgctggtgatggagacccagatgaagagcttcttggccatgacgccggagaggttggtgatggcgccgtgggagatggtgccgctgagcttcttgtcgaagtagacgtagtggtcgccgaaccagacgtagcagctgctggcgagctcgatctggtagtcgccggtggcgttgtcgaaggtgtaggaa

SEQ ID NO: 52438 - DNA, 456 bp, Triticum aestivum
  Clone ID: PAT_TA_52438
aaaaaaaaagtttaaggggaaacggggggccgttttaaacatttaaaagggccactttttgcatggcctataaccaagggccccaaagttttttttactacaaaacacactcataaaagggggcccactaacagctaagggctatccgttatagtggctacgggggtattttcgggccctcgggttcgccgtttaaggcatagctccatgtcgggggcatccttggggactgaaaagggggcacgttccgaacgttaacgtccaggggaagaatccggtactggatggcgaggcccttgagcactttgataatttccgggagcaccagttccctcctaaaaaacctaatccccatgtcctgaaagttgagcgtgtgccggacccaaagggacacctttagctggggggggtcatctacatctggggggacaaccatcgcaccagggtaccaaggct

SEQ ID NO: 52439 - DNA, 394 bp, Triticum aestivum
  Clone ID: PAT_TA_52439
ggcccaaaaagggttttaaagggagggcttcttggggccgggaattttcaagggggggggttcccgggggggggggcccccaaaaaggccggaaatttttaaaggcgggggggggggggccaacactgggggtttttttttggaaccggggccttttttttttaaaaaaaactgggtttcccccccaaaaaggggggggccctccaaaaactcaggaaaccccttacttggtcctttgggaagccctgtccagggggcccgggaagactacagggggcgaaactggtacccccacgggattttggggagggccaacagggggtgaaacatttgtttttggaaaaggggggcccctgacccggggggggaagcccaattcaaaaaggtttttggg

SEQ ID NO: 52440 - DNA, 507 bp, Triticum aestivum
  Clone ID: PAT_TA_52440
ggaaactccgcacgcccacgtaatgaacatatcaagccgtccggacaaaagtgctgatcccaggggagggctaaaaggccagagggccaagttttagaagcaaataaagtgccaaaacagagatgatacggggcgggagatcgggcatgagagcagaactccgggcacaactaacatagcaacgattaggggccttccaaagtgggggtttcgggaataaacgagtagaccgatgagatgaatggggccgccatgccaaggaagtacatgcgtattaagccgcaccaaagacacacattgtaggctacagcacgccttcaccaccgccatcagcctactgggaacgctgcctcattttgcggcgcttccttttgagcctgctaatgcccttcttcttccagttggccctaatggtcgggcacctgctcgggggagctccttttcgcgcaggctgcttttccccctcctccagcggccaaaccggctttgtgttagggagaggggggt

SEQ ID NO: 52441 - DNA, 605 bp, Triticum aestivum
  unsure (1)..(605): unsure at all n locations
  Clone ID: PAT_TA_52441
gacgtcgcatgccacgncngctacgtaagnncttggcannncctctaaagancggccccgccctttnnttttttttttttnttttttctttttttatttttttatttttttatttttttttttttttttttttttttttttttttttttttttttttttttttttttaggggaacggggttacggacaaacaaaaaccatttggtcaaaaaaaatactttggagggggggggacaaacattcacaggggggggccccctaaattacaaaaacgggcatgcaagcaaagacccggccctgggttacacggaaatgcccttttaaccggggagagccccggggttgtaaaccaggaggacccccccccccaggaggcccgcgagggggaccgcccaaaaaaaaaacccgggcgttcccccggggtagggggcaccaaaataaaaccattcccccggggggtaaaatgggctgtaacccccaaccttggccccctacttgtaaaaaaactgggacaccccctttttggcgacctttctgccggtggggtcgatggcaactggaaaaccccccccgagtccaaggggcttgtcgaccttgatctttttg

SEQ ID NO: 52442 - DNA, 452 bp, Triticum aestivum
  Clone ID: PAT_TA_52442
aggatccacccaaaaacatgattagtattaaaccaaagctcaagcccaatggaaattggtctgggctcctattcacccatatcaacagggggaaaactggtttagcaaaaaaacataacacctttcacattttcactggaaacgggaaaggatcccccatgcccccgtttaaaaaaaaggcgcccccccgaagccaaaagatgtgcctagtagacagggggcccaactgaaacaaaaaaggggcctctcgcatacctgtagcataggggggttgggagcgtttgcaaagcgttagccctaaacttgttttcatcccacaaaacatgataacccacagggcggctcactcccttagggacagcatggcctcccaaataaaaatcaaagtcagggggatgggatacttttttatcaatcactgggccaggcaggacatttccacttccataaat

SEQ ID NO: 52443 - DNA, 464 bp, Triticum aestivum
  Clone ID: PAT_TA_52443
aaaaaataagcccgaaggacatttatttagggcccaaaaaccgggataaaccataccggcatacgggggggacatacaaaccatgggggagggcaacttggattaacccaccggggcaaattcaaatggctcgggtggaaaagggcatcaaacacagaggccccacggggctaccagcaattcaaaggggcttagatgggacaataccaaggttaccacaacttccaggctttggggacagcacacgagcatttggggggggcccaaaaaccgggaaacttgaggccctctttttttggaaggcccgcccgaactaggaaaggggcaacatttttaccctgaacaccttggaggtggatgacccggcctaattttggatcccggactacaggacccttacaggagaattcctttttgagaaccctgaaaaacttggtggagctggaaacttttttcaagccctg

SEQ ID NO: 52444 - DNA, 368 bp, Triticum aestivum
  Clone ID: PAT_TA_52444
gggaacccctacgggcccaaaattttggggattgggtttgggacccttctggtccctagggggggacaggaccttttagggcaaacgggttaacagcattgaccaggccgggggttatttacccccagggcccaaaataaagggggatccaacgcccgaacaaaaacgcaagggggttccttgggctggtgaaactgaaagcatatacccgaaccagacggggggaagaacacccccagccccggggggggtttttttttgaaccgggaccgggacgggaaaaacccgggggggggggaaaaacatttaggactgggcacccagcttaaacccgggagggaaatgcctgcccgaccccgggggccacc

SEQ ID NO: 52445 - DNA, 434 bp, Triticum aestivum
  Clone ID: PAT_TA_52445
cataagaactaatgagggactgaagcacacgctttccccgaagaaaaccatatgttaacatgatcggacatatctgaatcacttacggagtaaagttgatattgcaagtttatggtataaagaccataggcggggcttgcttaacgtggttgcaccgaatacgccggtgagcttgacaactaggacttcaaatctattcgtgcttattgttggcacatgtgtttggaccaccaggataatgacacttattgcaccatggcctaagaagaagcagctgcagtgggagactcctcaagcaggtgcttcaccttggtgatgtagtcaggcatggtctccttcttagatttcgctgcgacggacttccaggcgtgccacttgggcttgcccttgaggtcgaacattccggtgcggtctgtgttgacggggcctacggt

SEQ ID NO: 52446 - DNA, 551 bp, Triticum aestivum
  Clone ID: PAT_TA_52446
gaaacagttgtccaaaaatagcatctttaattttttaaattttaatatagcaaaataatggatttcattagtttgagtaaaagttcatcataaatgatgcagtgatcctgtttcgtcaagtccattgtagtagagccaattctttatgggtagctcattagcagaaagtgttcgcaatatgtcttgagctaagatcccacctagtattgctgctactggagatatctctgtatggaacagtgcacaaacttctttaaataaagctgcattgaataaagttgaatcagaaatgcccatactttcaaggtattcgtttattttttctcctataaaatcttcattttcttcacatggaaacgtgccataatccctttgaaacattaataaaatgtaaataacaaaagcaagaggcgatgttctttttttgagtgtctttaaggacatgcttgaccaatcttttgataatgaactctctaagcttgcatattgttctgtatatgcaattctttctgagtttttactggaagttttttctggtatgtagacatgct

SEQ ID NO: 52447 - DNA, 552 bp, Triticum aestivum
  Clone ID: PAT_TA_52447
cacctttaggtgttctatgtggtctcccttaattttgtgcttttctagtttattttcactcttattttttttttctccggtcagtgcttctgtttggtctttattaagcagagccccgacggcgcgaataccccggccgggctgatctcggcggcgatagcccacgccttaatggctgggggtgggggtgcccgagggcgccaacatcctcctgtgggcacgtgaacccggacgcgacctaaagcgccttcgtgggcggcaacatcaccctctcccggggggtggggtactgtttaaaccaacttcagagctccaccggcgactgcttgcatgtacacttatacaccggcggactccccaccaaacacgttggggcgtgaccctcatatgcaacttgggatgctaaggagctggagagggggaccaccttgggggtggggaaaaaaaaaacccctcggaaataacccccaaaaggccccccccgaggagggggccacccataaacacccagtggaaccccccactcccaacttacagggggggggcccaaaa

SEQ ID NO: 52448 - DNA, 474 bp, Triticum aestivum
  unsure (1)..(474): unsure at all n locations
  Clone ID: PAT_TA_52448
gccacgcgaacggtggtgaaggtacgtggaaagggtggtgctaagggtgacacaaagatgtctcagagatgacattcagggtatcactaagcgtgttattcatcctgttgttcgtcgtggcggtggcaagcgtgtctctgggctcatctatgaacaaacccataatgaaaccaaggttgtccttgaagatgtccttcaagatgctgttacttacactgaacactccacgagacacactgagacctatacggatgtctcttatgctgttaagagacatggccagacactctatcgttccctcggtgaaatatgatgaaaaatattatgcatcctttaaaaaaaactttaatgattaccaagtggatttaaaactggcaaaaacacgtgtagcatcaagtatatagctttgtatgctgcaacttccgctatatccaacatacttaataaaagacttattntattaaatattatatt

SEQ ID NO: 52449 - DNA, 612 bp, Triticum aestivum
  Clone ID: PAT_TA_52449
ccccgcgtccgcaaaatcctttatcaacaaacatataaaacgagtagcagtaataggggctggtcctggtggaatagctgctttaagggctctttctaaagaaggaacattcgacacaattaccgtatatgaaagaaacgcgcaaataggagggacttggatttacgattcaaaagtagaccctccaccagctgttccttcgactgatgctttagaagttgactatacccttaaagttgacaaactttgttcacctatttatgccagtttgcgtactaatttaccaaaagatctcatgtgttttagagatgccccatttagcaagagcttaccttactttccttctcatgagcaagttttggactatgtcaagtcgctagcagtttcagaaggcttgttaccaatgataaagttttcaacaagagtagataagatagaccatcaggataatagttggaaaattgtttctacaaatctagaaaccggtgagcaatttgaagataagtttgatgcggttgctgtagcaaacggtcattacaacgtaccttttattccaaacataccccgtatagagcaacttaatcaaaataaaaatattcaagttatgcattc

SEQ ID NO: 52450 - DNA, 425 bp, Triticum aestivum
  unsure (1)..(425): unsure at all n locations
  Clone ID: PAT_TA_52450
ctggaggtgttctgtccaagaaggcgaggccgaaggtgttctccttagagagggggcacccgaaggtctcgagacagccggggaaggcgttatgagtaaagccaagctgatggaggaggtcgagcagctcgccattgaataggcacctgactccctcactgaaagtgcagagggggaggtgtccgcatccctgaaagaggggaaggagatgatcatggccgaagccaaagctggcgccacagccgagtcgctagtggagaagatcaaaacactttccaaggatatgtggaacggcaagggcgcgttcgccaagaagatgggcgcttgggttgccangggtgccttctttacgatcggcttgaaggccgctgngaagatatttcgccgcgaggagccgaagagcccgacgcccgagggccagtgcc

SEQ ID NO: 52451 - DNA, 619 bp, Triticum aestivum
  unsure (1)..(619): unsure at all n locations
  Clone ID: PAT_TA_52451
cccggngtcgacccacgctgttcgaatttagtattattgccagtgccttgttagttgcttctgctgtgaatgcaagaccttttacgacgaatgaagaaggaacgattgcaccactttttgttccacccaaggttgaaactgtacaagattcttatattgtcatcctcaagaatcatttggctggacaagatattgaagaacatgctcagtggattaattcgattgtaaaagaaaatcaaaaggatgaaatgatgcttgattggttaaatcctcatatgacttcacacggtattgaacatgtttatgatacaccttttattaaaggttacgctggtcgttttgatgaaaacattttgaatgctattcgtcaatcagaagatgtggaatacattgaaaaagattctttggtttatgctagtgaattacaacgtaatgctccttggggacttgctcgtgtttctcacaaggattcattgacttttaagaattttgaaaattatgaacataatccaaatggtggtgaaggtgtgaaggtgtatgtgattgacactggtattaatgttgatcatattgactntaatggtcgtgctatttggggtcatactgtacctaatggtga

SEQ ID NO: 52452 - DNA, 661 bp, Triticum aestivum
  unsure (1)..(661): unsure at all n locations
  Clone ID: PAT_TA_52452
gcgtagcggccgcgcccttttttgtttttttttacttgaagagttcggctttattatttttaatccgtctcggtnccaccctctttgtttctgtgaangggctgtgggcgtgatcttgaacagtttggctttttttttttttantgtncatgcntggtggctggggtgtgtgggnctgnggcnnccnncgtnntgtnntgtttgtncncgcggtggtgtgtcttgtggtcggtgttgngcnngacctttttgagtttttgcctcgggggctctttgtggggttccctttggggttctttttgtctttttttttnttgttttttttttggtttgttttggtcgttttcttttttttttttttttttttttgttttttttttttttgtttttttttttgttttattgttttttttttttttttttttttttttttnttttttttgtttttntttttttttttttgctttttttttttttttttttttgttttttttttttttttttttttttttttttttttttttttttttttntgtgttttttttttgtttggttttttgtggttttttttttttttttttttttgtttttntttttttttttgtgtttgttttttgttttttgtttnnttttttttttttgtttttttttttttttatat

SEQ ID NO: 52453 - DNA, 584 bp, Triticum aestivum
  Clone ID: PAT_TA_52453
gaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaatttggattatccccaaaaa

SEQ ID NO: 52454 - DNA, 371 bp, Triticum aestivum
  unsure (1)..(371): unsure at all n locations
  Clone ID: PAT_TA_52454
gacccacgcgtcctgttgaagggcatggtgtgcctggcggggggggggctggtcgtcgccggcagcgctagcattgcggcggcgcaggcggccgggctgnngaagggcttctacatgaagagctgcccgctggcggnggacatcgcgcangaggtggtgttttttttcgtcgccggcnaccgcaagctggtgttganggggtcctnntgttcttcccnactgcttcntcngggggtggggtgcgttggtgcttntggactcgncgncctncncggtggtgaggggtgcgccgncgntcctgttgttggccgggttcgtggtctttgncgnggtgttggcggtgctggtgcgggcgggcccgggggtggttt

SEQ ID NO: 52455 - DNA, 597 bp, Triticum aestivum
  Clone ID: PAT_TA_52455
cccacgcgtccggtaaaattcttctttaatgatatcatcagatgtggaaagggtgtcctagcaaaaccaaacttggatgaaaatatttatgcaagacatctaaaattacgtgaagaagaaaagctatacccacttccaggagccactatgccatatgtggataaagtcgtgcatagtgagggtgtgggagaatataaaagaaatatgaaaaatatttcggattttgaagagaaagatgaagtagcaatggaattcgtccaagaaatattaaatgcaagctataatctatacaagacaaagcaaaatatatatgagtttgaatcaatattcaacgatttgtatatatacccttatttaaagattacagcgaatgcattgtttataactagaaaaaagccaaccggagtttacagttggtgaaataccattgaaagcaatgtcgacccaattggattctgtaggtttgaatcgagatgatgctggtcagtacaaggcagatggagtaataaaactctatggcattcattgcctagagattttattacttgaaacatcttcccattttggatgtactgaccgtttcaaaagtgtcatttt

SEQ ID NO: 52456 - DNA, 316 bp, Triticum aestivum
  unsure (1)..(316): unsure at all n locations
  Clone ID: PAT_TA_52456
gcgtccgggaggcatagccgtgggggtgggggcngacatcggcttcgcccagagcgcggtgatgaattcaccgtccgtttaatatttgccctattaatccgcgaccgatacatacatgcttggtnatanttcgcttgttcttttgcttggatggntgtggctacctattggccgccggggtgttaatccttgcctgcgtntggctggctggattatttattttctgttggnncncgnnnctggtgtttgttgtttttttttttttttttttttttttttttttttttttttttttttttggggtggccgtttcttg

SEQ ID NO: 52457 - DNA, 520 bp, Triticum aestivum
  unsure (1)..(520): unsure at all n locations
  Clone ID: PAT_TA_52457
ttcttccacgcgtccgcgcgcctccgctcccacgcggcggctcgccgccgccggggaggcccccgtcgaggcgccacccaagccggcggaggcggatccctcccccgccgcatccaacgggtccgccgctcccgctgccgctgccgttgcccttggtcgccgtcgccgctgctccagtcgtgggggggggggccgcggcggtggtgtcgcccangttccaggactcgaggtgggtcaacgggacctgggaccttagccggtttgggaacaccggtggngccgtcgattgggactccttctttgtcgccgnggtcagtaggtggaaatggtttggggattccctggtggcttgtagtattgantactccgttgtgttttntacttnnttttttcnatggtgggtttggttctggtggttttttttttttgtggtttttttgcttattggccttgctgctttggtgggtttnttnttggcttntttttttttttgttttgtttggttgtgggggtttgtttt

SEQ ID NO: 52458 - DNA, 350 bp, Triticum aestivum
  unsure (1)..(350): unsure at all n locations
  Clone ID: PAT_TA_52458
gactccaccactggtgggctggggggtggggtctccaaggatggcccgacacgtgagcatgctctccttgctttcactcttggngtgaagcagatgatctgctgctgcntcangatgggcgcctcctctccctagtctctttggctcgttncgaagaaattgttaaggaggtcgtgggggcctgnnngaggtcggctccaaccctgaaaaggttccgtttgtccccttctctgggttcgngggtgccttcttgnttgggtggtccactctccttggctggttcttgggcccttccctgcttgtggcgcttgtcctggtcttcgtgcccttgtggcccttgggcttgcccc

SEQ ID NO: 52459 - DNA, 352 bp, Triticum aestivum
  unsure (1)..(352): unsure at all n locations
  Clone ID: PAT_TA_52459
ttggagggcatcatcggctcctgctgcaggtggtcctgccgcttccaaggatgaagacgaggatgatgacatggatctgtttggcgatgagaccgnggtggacangaaagctgcagctgngcgtgnggctgcctngcctgctntgttttattttatgtggcnaatcctctgtcctcttggggggtggggggtgggacgatgngactgncttgaagaagttggngggggctgtggtgtgtgtttaaatggngggtctnttttggggtgcttntnngcttatgcntgtgggttntggnntnnngaagttttngatnttgctgncgntctttgncgncctcgtgtttgtcngctc

SEQ ID NO: 52460 - DNA, 576 bp, Triticum aestivum
  Clone ID: PAT_TA_52460
tgatgtttcctctttttgagtcaaaagatccacagctaaaattgctatggagcgactctcgcaaataaaatctcaactaaatctatcttcttcacttatgtctcgtcaggcaccaaaggacataacaagagagcgtgaagcttgtgaattcaatattaaagagctttcgaacttttgggcaggcggcgagaaacgttttgacgatttgcaaaaagcctttgacttcataaaagatgacccacaattagtcgttcaacctccacgaagctacttagagctctcaagagatgaaatgagagagttcgtaatgggtcaaatttatcgtgtagtacaaatatctaaagaaaaaaaagacaaaaagcttatttaccaaataatacatgctttatgtatttactctcaagacttttacatgcgattttttgttcatgattccctttttcgtaatgcaatcagcatgcttggaagtaaagaacagcaggataaatacgttgatgacatcaataaatgcagtatccttggctgctttgctatgacagagcttggacatagttcagctttacctgaattggaaac

SEQ ID NO: 52461 - DNA, 516 bp, Triticum aestivum
  Clone ID: PAT_TA_52461
cccacgcgtccggcctgcatgtgcttcggccggggctcgacgatgccgccatcgcggcagtcacgtcgctgcagaggcagtttctcaaggaggtggtggggttccaggtgttcgggtccaaccccaaggtcagcaagctcctcttctggagacggtaccagaggatgctgtccatgcgccggcggcaggaggaggtgttcatcccgttgatccgagcgtgccgtgcgcggcgtaacacctacggcgaaagctttgaaatggactgctacgtggactcgctcatcggcctccgcatcccggaggaagatggcggcggcagcagcaggcacctgacggacggccagatcgtggccttgtgcacggaactcttgtccggggacgactctacggtcaacgtgttgcagtgggccatggcgaaccttgccacacggccggagatccaggcgaagctccgggccgaaatacacaacttcgccgacggccaggtcgtggaggagcacctgccgcagatgccgt

SEQ ID NO: 52462 - DNA, 383 bp, Triticum aestivum
  unsure (1)..(383): unsure at all n locations
  Clone ID: PAT_TA_52462
cgaggcgtccaagatgccggggggggcgggggntctgcngaggacccccctacctcatgcagcgctggtcctgtgggtgnngtattgttcctttggctggcntctttnntgggcccttctgtccgcccatnttctgttgtttttttcctagttactttccacttgcgtgggtgttgggctttcnnacctccaaaggtggcnttccgctccagggtgtggcgtcctttcttcncccgcnncgggtgcctttgtctggtcttcctcttggccctttggtgccccgctctgtccttttcctatgtgctgttgtccttgtgctccctgctgtgtgacccttaccctgttgaccctttggtccttggtttcgcctcttgtgcttgtcg

SEQ ID NO: 52463 - DNA, 401 bp, Triticum aestivum
  unsure (1)..(401): unsure at all n locations
  Clone ID: PAT_TA_52463
aaaatgaagttgngctcatagcctaacttcaacacagaantttggttagactcatgggatgttgctctcanggggaagagannngtctggtctacgaatattttttttttaaagcttggacttcttcatctttgggttgggggggggngttctactagattgggagaagcgctttgcnntngttgtgggaatagctganggacttntttacctacataagcactctaggttgngtgtttttcattgggatcttnnnccangctttntttttttggattgtcgatgattgcctnnntttttgattttggtctttgtnttttttttattttatatactttgatggtttttttttagaaggtggttggtcttttggttcntggnntttggtttgcttnttatgg

SEQ ID NO: 52464 - DNA, 456 bp, Triticum aestivum
  unsure (1)..(456): unsure at all n locations
  Clone ID: PAT_TA_52464
ttttgcgcatgagagaccaattattacaaagggattacgcagaatgtcttagcatgttgatgagaccccacagatctcaaagcctgccacgctagtagaacaagctaaatatttgcaagacagtttgtctcaagatgcagcgttacacattcttcagcaaaatgatatccgatcaggcggggggcctcgctcttcattatatgacggtgtgatcatcaagaaccctactgcagcggatcagcagagaggacagcgaacgtttcaacacagaaattctcatgggtccaacttagacagtngcttatcacgaattacgaacaatntgatgaaaaaccctcaattcagagatttcaataaagctattgctggagtaatggagtcattccagagcantgcaaacaatattggagattattctggtggctcgngacgtccaacattttcagattttccttc

SEQ ID NO: 52465 - DNA, 568 bp, Triticum aestivum
  unsure (1)..(568): unsure at all n locations
  Clone ID: PAT_TA_52465
ttctaggaccctccctcctccccgccgacccctaccaacgtgctagggctcgattctgggcagcctacattgacaacaagctagtcgcaccatggtggaagatgtttgtgggcaagacagacaaggagaaagacgaagggacgaagcaaacgcttgcaggagtggagatgctagagggggccttgagggaatgctccaagcggaagccgttctttggaggagacaacatcggctatgttgacgctgtgttgggtggtatggtcgcatggatgcaaggaaccaaggcgctctgtggtgtggagcttcttcacaccaccaagtgttaaagtatgactttgtatagctaaacaacgcgtattcctgtttgcatacggttgtacatatacgcgtataggttcctttcttggtctccaagacttgtaatcttgttataaatatatgagccgatcgccccttgaannnnnnngntnnnntnnttntntntnttttttttttttttttttttttttttttttttaaaaaaaaaaaaaaaagggggggtcgttttttgggggattcaggtttttct

SEQ ID NO: 52466 - DNA, 610 bp, Triticum aestivum
  unsure (1)..(610): unsure at all n locations
  Clone ID: PAT_TA_52466
tncttgggcccggcgccttcgtccgtctcccgagcccgggctcggnggttgctaagccgggcgggaggaagacgctgtggnngggcgtggtggtggtcacgggcgcgtcctgcgggctgggtctggnggggggcnggcgctggtgttttttgtttgtgggncgtggttttgttgtggggggggggggttnggnctggcnggcggnctttggtgngggcttggggggggggggttttcctttntgcgtcttgtcttttttttgctttgnngnttttgggngtttgtgtnctgttttggntggtttttgttgtgtttggnggtgttggtgtttgntgttnnttgttttgngtntgtngtttttttnttgtttttnnttttcnggtgnttgttttgttgtttttgttttttttttttgnttttttttgttttttttttttttttttttggntgtttttntttttttttttttttttttggtntttttttttttttttntgtttttttgtnttttttttttttttttttttttttttgntttttttttttttttttttttttttttttttttgttttttgttgttgtttttttttttggttgtttttttttttg

SEQ ID NO: 52467 - DNA, 500 bp, Triticum aestivum
  unsure (1)..(500): unsure at all n locations
  Clone ID: PAT_TA_52467
tctgctgtgtaactttttcacataccctctatttaagaaagatctgaactgattcctggtgcttgaatgtatagtacgtatactatggtgacatgtcctctatacggtagatgctcgtgactctataacaacgtagttgggctttcgatgcatagataaccatagcaagggcacggttgaatgacactctatatgatcagatattatattgcgagatccttcactatgatgccccagtgacagggtcccttcctgactgctggccctatacacttggnaaatgcaaactcaagacaaggatgcttaatataggggcactacggttggtgaacggaacaatgcccgtgcacaattgttaaaactgcttacgactgcttatgactacatgtgcaacaatataggattgattttgtttcctggggatccggtacaacatgtctgagacgaggatttacctgtaaaacatgatgatgtattctatggccaccagactgtcttga

SEQ ID NO: 52468 - DNA, 288 bp, Triticum aestivum
  unsure (1)..(288): unsure at all n locations
  Clone ID: PAT_TA_52468
tnctgcgccgcagnagaagaagcatacccgcggtggagagcttccaggcggcgaccattggtgaacgtgtccaaagnaccaagtaagaacctacttgcaagaaacaagggagtgcttngaagcacaccctccacanggtttctcaatacatgaaaggcttggtttgtctttctgctcagggcaagctttgttgtggaggggggctgttcggatatggtggcctgtctnagcctgttttccacaggaaggtctngactcttngatgattgtgctgnngctgcngtgcct

SEQ ID NO: 52469 - DNA, 561 bp, Triticum aestivum
  Clone ID: PAT_TA_52469
gtgtgcgtgtatacaagtaacacaaaactgtgtaatttaatgtttatgaaagcaattattacaatgtccctttttaaatacgttggctgtaaattcatcacaaccacattcagtacatcttgcaaagtaatccgtcgtggccaccctgacttgtggtgtattaggtgctgtacgaatggttgtattacttttagaggattgcatcacaggacttgaactaaaaggtggtggagggggtgtgcgtgtggttggtatacggtgaggaacaggagaaggatggggtgaaggttgattaaatggatcctgtacttcttcaggttcttctacaaaagtttgaatgcgtgtgctgctagaaatagaactgaccatgggtggtcgagagggaataggagggccagagagaacaggctctgtataattcactgggaaaataccacgacgaccttctaattcacccaaccaccaaccttcatctacttcctctactacttgaatcaaatcgtttgtcttgaacgaaagttcatctggacctgttgctccaaaatcatacagtgcctttcg

SEQ ID NO: 52470 - DNA, 574 bp, Triticum aestivum
  unsure (1)..(574): unsure at all n locations
  Clone ID: PAT_TA_52470
tcccacgcgtgcgatgcagcttctgagggatggaaaccatcccatgatccatacttttgtggatcatcacacaccttgtattctccatatccacatcttgcagtcatggacacaccatagggtcctcctccaccgcagcatgctgctaaagggtgatcgatcccaaattgttccggggaacggtgtatcatccatagagacgtcaaggcgagcaacgttctcttggatgcgaatttccaagcgcgggtcgccgatttcgggtttgcgaaactcataccagatggtgcgacccatgtcactacaaaggtgaaaggcactctcggttacctcgcgccggagtatgcgatgcttggcaaggcaaaagagagctgcgatgtctacagcttcggagtgctcctgctggagcttgccagcggaaagaagccggtcgagaagataaaccctacgacgaagctcaccatcaccgagtgggcgcttccactcacccgtgagcagaagttcaaggagatggctgacccaaagctgggggatagctntgccgaggcccgagtgaagcggatggtgctcgtcgggc

SEQ ID NO: 52471 - DNA, 538 bp, Triticum aestivum
  unsure (1)..(538): unsure at all n locations
  Clone ID: PAT_TA_52471
tgtttctgtcgcgaacctgactcttagctgaagcagctgctcatcgcgcatcgatcctttccctgatctgctcctgatggccgacgctcggcgctcgccaagctccgagcctggagaagaagtcctgggctcgactgtcgagggaggaggaggaggctcaaggctcaaggctggaggctggagggccgagctcgccgccgctcgggtgctgcgcctcctcctcctccgcccccatcgagccggcggtggaggcgcaggcgaagcagatcgaggcgctctcgctctccgtgccggacgacgacggcggcggccccgagggcccgcccctgctcgacgactccgacgactcccaaatccaggccgtgacctcgggcggcacggtgtacgagtcggcctcgaccttcgnggacgtgaagctcacccccgagctgctcanggggctgcncgacgagatggggtntagncgncccngcnggatccaggccttttcgctccccatgatccttacgccgncctacngggaccttgttgcgctggc

SEQ ID NO: 52472 - DNA, 573 bp, Triticum aestivum
  unsure (1)..(573): unsure at all n locations
  Clone ID: PAT_TA_52472
tctccaccgctcagcacggaggccctcctcaagcggtcgactacctgatccgctccaagtgggtgccttgcctcgagttcagcanggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcatggcctaaacagctcactcacgactggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgtgaatgctatcggtggctatgtatatgcacggncgcataatattatacaatatgtcaactatatacgttttaat

SEQ ID NO: 52473 - DNA, 366 bp, Triticum aestivum
  Clone ID: PAT_TA_52473
tgtccacgcgtccgcccacacgtccggccacgcgtgcgcccacgcgtccgcccacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttttggccgtatttagagaaaaaaagatggtggggggggggggggccccttcatcttcttttttatagggtcgcctatgtggagtggagtgggtgtctttttcctgcgttcttgattggggaaagccgtggggttcccctctttgattggcgtggtggtgctctccccttttggccggtgggttttttcttgttttggccgggggtgatg

SEQ ID NO: 52474 - DNA, 619 bp, Triticum aestivum
  unsure (1)..(619): unsure at all n locations
  Clone ID: PAT_TA_52474
cttttcttttttcattttgcagcaagaattaaaaatggacgatataccttctgcttttgtggacgaaaatacccctttgatccatagagaccaagctgaagaaagacaagaaaccctcaaggatctcaaggggcatatcaagcctttgctgtctgcactctacatgatcgttgttgctggtcttaatgacggaacccttggcagcattattcctagagtaaagcaatattacgacataccaaatgaaacagtttcgctgctcttcttgtgtagttcaatcggattcttcacaagtgctcttatgaatggttttatcgttcatcgtattggccagttgaacacaatctatatgggttcatgcatgcagttatcagctcatattgtccttatgatgggatttcctttccctgtcatggcttctgctatggcatgtgctggaatgggaataggcttaacagatgccgcaatgaatgtgtttgtggccagtttgcctatggccactcttatgctgaatttattacatgctgtgtatggngttggcgcaatgatctctccttttagtgctacattttttgttagagcacaactttatcatgggagagggatgtacgttttttct

SEQ ID NO: 52475 - DNA, 321 bp, Triticum aestivum
  Clone ID: PAT_TA_52475
caccgctccgcttcaagaagcggtgcgtacgcatctgatgcatagccaccaggagaacggcatgatcaggatgccttccgtagatttatggatacgctgtttacgcaccgcgtccttgtggcggtgcgatggtggtcgacgtttattgttttgcatacctctaacactgaatagaaggttggggtgctgttactttggattgtctatatacatgcttgtgtgcggggactaggtattgcatgatggttattccagtattgcttcttattttgtagcctgtgattatgtgaaacttttcttggttggtgtcttttttctttg

SEQ ID NO: 52476 - DNA, 537 bp, Triticum aestivum
  Clone ID: PAT_TA_52476
cccacgcgtgcgcccactcatccgcgggcgcgtgggatcatactacagacgagctacgaattccggctgtaatgctgtacttaccccaaattacattaaagaggaattgccacttacagaaaagtccatgacgactatagcaaacgcaagaaaagaaatccaggatattatacgctaaaaaagatgatcgagtatttgctattgtcggtccttgctcaattcatgatacagatgcagctaaagaatatgctaagttactattggaagctaaacaaaagtatcaagatgagcttgttattattatgcgtgcttattttgaaaagcctataacaactgctggttggaaaggattgatcaatgatcctgatattgatggaagttgcaaaattaacaagggcttaagaatcgctcgtggcttactttgtcatcttacagatatggggataccagtgtctgtagagttgttggacactatttctcctcaatacattgctgatctaatctcttgcggcgctattggtgcacgaactactgaat

SEQ ID NO: 52477 - DNA, 210 bp, Triticum aestivum
  Clone ID: PAT_TA_52477
ccccgcgtccgaatttagataggtggaaccccccctgattggcttacatgtgtaattagttctcgtggatgagtggcaatggcacgcgcgtggtgactggtgagcgatgtgccaagagcattgcgcctgctttctgaactactgatgccaagtgttgtactccctctgttcacttatataagacgttttagcaaattcagacagtgtact

SEQ ID NO: 52478 - DNA, 608 bp, Triticum aestivum
  unsure (1)..(608): unsure at all n locations
  Clone ID: PAT_TA_52478
tgttgttattgtgagaattcttaattcaagattatagggagggacttatgtcaccacaaacagaaactaaagcaggtgttggatttcaagctggtgttaaagattataaattgacttactacaccccagagtatgaaactaaggatactgttttcttggcagcattccgagtaagtcctggggggggggttccgcccgaagaagcaggggctgcggtngctgccgaatcttctactggtacatggacaactgtttggactgatggacttaccagtcttgatcgttacaaaggacgatgctatcacatcgagcctgttgctggggaagacaaccaatggttctgttgtgtngcttatccattngacctatttgaagagggttccgttgcttncgtgtttacttcccttgttggtgacgttttttggtttcnntggcctacgtgctcttcgtttgggggggtcttctgagttccccccttctttatttcttaaatttttttccagggccncgcctttttgggttttcccctgttggggtggggcttttttttggttccttgtttttgggtcggttctttttttttggggttgggtgcttttttttgcccc

SEQ ID NO: 52479 - DNA, 608 bp, Triticum aestivum
  Clone ID: PAT_TA_52479
cccacgcgtccgcccacgcgtccgcggacgcgtgggctttttgctgtatctattcttataaacaatgtctaccaacgtgtgggatactaaaacgcaaacatttcacggaggtcaagaacatcgatttattgagaactttgttgaagactttagtgtcactacaaactatcttggtacgcccaagaaggcattagaagcagctaaagaagccataaatgacattcatcattatcctgcagcaaatcaagagcctgcaaagtcgtgtttagctcaatttctttggggttcagattatgctcaacatcatccacgtttactgatgggaaatggtgcctctgaattgattgatttagtagtcagaaaagctcttttatcttttatgcaaaaaggtatcactcaacccacttggaaaggaagtccttgggatgttcagtatagagaatatcaacgaagtgcagaaacaaatggattcaaaatcttggatccttcaaacccagaacgggctgatatgttgtgtattgtgaatccatgtaatcctacaggtgattatttctctgttgaaccattaaaaaagtggatcagagacaatgtgaaacaaggtggttgtg

SEQ ID NO: 52480 - DNA, 585 bp, Triticum aestivum
  unsure (1)..(585): unsure at all n locations
  Clone ID: PAT_TA_52480
tcgactccggnaaacaacgctctacgtctagnnggtggtnngcgtgctggnnagagacgnnttcctcatcccactgctgggctctatgctacttcctagttcaactgtnntggtaagacgagaggctctactatgnngttgtttcctttcaacagncctagaacctctttctatcgnnttttcgtgcccgctcatgcctctgtcggtgtgcggacccgccaatctcccacgctcggtgnctcactctaaggcacttaaggggtnnggaggcctggggtctgtctgaaccttcttcaaaagtcctaagttcgcttggtgnnnggtcttnaaatccctttgggagnncttgcccttgaaatnngatgagtattatannatttgatattattgcatgctctaatgagaatttaatttaattgttnncagcagaaagacactgtatttcaagtctttcttagcttaagctcgctatgccagttgtaattaagaattgaattaagttagctctttgtcggtttagctcttttaaagtccaatacttagggaattctgaagttgtacttggctttttcattttgtcgtatt

SEQ ID NO: 52481 - DNA, 480 bp, Triticum aestivum
  unsure (1)..(480): unsure at all n locations
  Clone ID: PAT_TA_52481
cgggnncgacccacgctnctgacaagacccacaatgagaggagggatcgtctgaccaagaagatcattgaagagcatgcacaggccctccaggagagaggtgccaaacagcactttgtggatgcactgttcactctcagagagaagtatgaccttagtgatgacacagttttcggacttctatgggacatgatcaccggcggagtggacacgacagtcatatcagtcgagtgggccatggcagagctggtgaggaaccccagggtgcagaagaagctgcaggaggagctggacagcgtggtcggccgcgatcgcgtcatgtccgagaccgacttcccgaacctgccctacctgatggccgtcgtgaaggagtccctccgcctgcacccgccgacgccgttcatgctgccccacaaggccagcgcgagcgtcaaggtcggcggctacagcattcccaagggcgccaacctgaatggttgaa

SEQ ID NO: 52482 - DNA, 454 bp, Triticum aestivum
  Clone ID: PAT_TA_52482
cggacgcgtgggtttttccgtaactatttcttttgataatgaatttctttcacgaagatggcagaggtgggattgtagatgagactgggagagaagcggctgcttttatggtagaacactcattttcgtttaacgaatttgaacgaatttgctgaagtacatcaaaataaaaaaaaagcagtaaaccgaaattcatgaacctgagggcagtgatatgaaggaagtatctcctaggaaagaacaaaacttagtttacaatacctattcagatgaagatcgacgaagatgcttctatttccttcaagagaaacttatgacctacctcgcaagctgctaatgtccatcacaagactggtcgaaaatggaagacagcatacaaatcaaattcataaaattcgaaattttattcttttttttaagcattaaaaaagtggtttatttttaagaaatgaga

SEQ ID NO: 52483 - DNA, 585 bp, Triticum aestivum
  unsure (1)..(585): unsure at all n locations
  Clone ID: PAT_TA_52483
cccacgcgtccgcggaggttgatagccgaaggtttcgttagtgagaagcaaggcttgtcagacgaagaagttgcagaaacatactttaatcagctgataaaaaggaagataatacgtccagtggagcacagcagcaatgggaagataaaaagctttcaagtgcatgatatggtccttgaatatattgtttcgaagtcgagcgaagagaattttattactgtggtaggtggccactggctggtgccaatgccgaccaataaaattcgccgactctctgtgcaaagcagtggttctgagcatgggaattcaacgaaacacatgaacttatcgcaagtgcgatctctgaccatgttccggagcctagaccaacttcatttccattctttcaataatggaattttacaagtcctggatcttgagggttgcaagggtttgaaagagaaacatctgaaggacatgtgtagaatgcttgcactgaagtatttgagccttaggcagacagatatttncaaaataccctctaagattgcaaaactcgagtacttagaaactcttgacctgagggaaacgaatgttagtgagcct

SEQ ID NO: 52484 - DNA, 394 bp, Triticum aestivum
  unsure (1)..(394): unsure at all n locations
  Clone ID: PAT_TA_52484
gcctggtcctttttgccggggaagggggggaaggcctggacggcgttcctgggggggtgcnnggcctactccgaggcgccccttggctcctacatgggcgacgctccccttggcgngggcgcctctgngngccttctttttttttctacangtnctgntctatctgggtttggacggtggcccgtttgggcgtcccgctntcctgtntcattggtggggtttctgtgtcctggtntgtccttggttttcgggcctcgttttttnttttgtggaacttgtgttttcttttttccgttgtggtttctttttgttgttggngttccctggttgtcgggtgctgtgtttcgttttttggnngctgttttttgttccttggtcctgtngtttttgctgt

SEQ ID NO: 52485 - DNA, 553 bp, Triticum aestivum
  unsure (1)..(553): unsure at all n locations
  Clone ID: PAT_TA_52485
cccacgcgtccgcggacgcgtggngaaaagaagaatatacaagaaaatgaatccagatgaatttcctagccttggtgaatctgtaaataacacagaaaattcaaatttgggtgcatcttgggccaaagtagctcaaccagaacaaaaagaagataaagaaaagcatcgtccgggtgcatgggagaatgagcaggatgcttcttatgcagatattgcaggacacgaaaagaaattaacagaagaatatcccagtcttcaagaggccgtgtcagattctacgcctacttcatctggtgtaagtgacttattgaacaaaagtgaatcatcagcaaccacagaatcaacgcaaccacctaaccctgataaatcatttgctgatgctacttctaataaaggttatcctttaccaaaacatgacgagtccatcaagagtgacagtttacctcctttatctgatctacctgatgtgaaagacatgttgaagcaaccttctgtcaaaccaccaccaccacctcaaagtttcgcaaagatggctgctaaagaaatacccccg

SEQ ID NO: 52486 - DNA, 595 bp, Triticum aestivum
  Clone ID: PAT_TA_52486
accgtgccgaggaagagttgtcctcctgtattcgtgtttacatgcataaatacagcctttgtctctgttcttctctccggtttctgatcgtctgcttgtttgtttggtttgcagagagagggatctacatcctgtacgacgacgtcaagtcgtgccagtgcgaggacgtgcacgtgctctggtccatcctcgtcgagtcccacggcctcccgccgcccacaccgccggtgctccggctcacgcggtgaccggaacgcgccggacggcggatcgctggcatcggcgcggcgccccccggaataaggaacggccggcgcggtgccgccgtggctggctccatgggaggtgaaccagtaatagtatagtagtagtagcatatgatttctgatgtaaagagcacataggaggagttgtttacagttcatctggccttcgtccggcgcctcttttggagctgctgctgggacgggagagcgaggctgctgcgtttgcggcttctggacgcgtgtggtgatgggctttcttcgagcgcacccctcttttgagtttttgattgattcacgcgtcgttttctgtcgagactgcacttggatgc

SEQ ID NO: 52487 - DNA, 451 bp, Triticum aestivum
  Clone ID: PAT_TA_52487
acaagattggatcagtcttgttgttacccatacggtagcacttgacgttcactgtgtatgggtaacaacaagattggatcagtctttcccattgctgagaactgaattgggtgatgactcatgacctgcttctgcaggtttgtaattcttcggattttaatttctcttcacttttgtgaaatttacactgttgtttaagaaaaagaaccactgttcgctctgttgttacaatgccacacttaataccatattacaagtatacaccaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaagaagggggggccggttttaggggatccaattttacttaccccgtgctggcaaacgaattggttttttttattgggcccctaaaatta

SEQ ID NO: 52488 - DNA, 528 bp, Triticum aestivum
  unsure (1)..(528): unsure at all n locations
  Clone ID: PAT_TA_52488
ttcttacaaacanaagaaaaaaaaaatggctgctactaattatcctcaaaatgttggtattttggccatggaaatgtactttcctcaaagatgtgttaatcaaccagagatggaaagctttgatggtgtaagtgctggaaaatataccattggtctcggtcaagaaaagatggccttcattgatgaccgtgaagatattcaatctatttgtttaactgctgtacaaaatttgatggaaaagtataacattgcttataccgacattggtagacttgaagttggcacagaaaccattattgataagtctaaggctgtcaagacctgtttaatgactctcttttccgaacatggtaacaatgagattgaaggtattgataccactaatgcttgttatggtggcttctctgccttctctaacgctgtcaactggatcgaatccagctcttgggatggtcgttacgctattgttgttgcaggtgacttggccctctatgcatctggtagcgctcgtcctacttcaggtgcagg

SEQ ID NO: 52489 - DNA, 436 bp, Triticum aestivum
  Clone ID: PAT_TA_52489
ttcgatcacaatggctggtgaatatgagctgaggcttatctgatctctgctctagctgttggaacaatcgagcagtttgttagagtctgaggaggcgaggcgaggagcacatgtagtgctgcacctgaattaccgcggcaggatagatggcgtttaccggcaggttggggctcttctccctaaagctccacccttccaccatgcagagttctcttagtggtttttacccatgtttgctgtaagttatcatccatcagtacagttgcctagttgaattcttgttttccaattctttcctggtcgatatcacatgtatcatattggtttatttgccctattgatgtcactcacaagcttgggccctgtttctaatgttactattttgcttccaagctattttgattggaggtgtattacccttaaaaaaattcttttt

SEQ ID NO: 52490 - DNA, 572 bp, Triticum aestivum
  Clone ID: PAT_TA_52490
cgcggtaacccgactgtagaagttgaaatcatcactgcaaaaggtgctttccgtgccgacgttccatctggtgcttctactggtattcatgaagcacttgaacttcgtgataagatcaaggcggactattgtggaaaaggtgtgcttcaagccattgaaaatgtaaatcaaacaattggccctgcccttgttgactcgggtcttgtggtcacagatcaaaaggcgattgataccttcctgatcgatcttgacggcacgaccaacaagagcaagttgggtgcgaatgccatcctgggtgtttccctggctgtggccaaagcaggtgcggccgaaaaggaagtgccgctctatgtacattttgccgacttggccagttccaaaaaaccatttgtcttgccagttccttcctttaatgtcatcaacggtggttctcacgctggtaacaagttggctatgcaagaatttatgattatgcctaccggagcagcctccttctctgaggcaatgaagattggtactgaggtctatcataccttgaagggtgtgatcaaggataaatatggtcaagatgc

SEQ ID NO: 52491 - DNA, 384 bp, Triticum aestivum
  unsure (1)..(384): unsure at all n locations
  Clone ID: PAT_TA_52491
tggcgctcctcacacacacgntccaaacttggcagtcctactcacacaaaccatacacaaccgcagtcatgggttacaaggaaggtgatgtcaagaagggtgccaacctcttcaagacccgctgcgcccagtgccacaccctcaaggaaggtgagggtaacaagatcggccctgctctccacggggtgtggggtcgcnngactggctccgtcgaaggctactcctacaccgatgccaacagggccaagggcattacctgggacgagaacactctgttcgnnttcctcgngaaccccatgaagtacatccctggcgccatgatggccttcggcggtctcttgaaggtcatggttcggttctgcctggtctccttcatgtnggatg

SEQ ID NO: 52492 - DNA, 546 bp, Triticum aestivum
  Clone ID: PAT_TA_52492
gtgcagttgacgctcactgtgccgggcttgcgagggtgagcgataccagctagccacagcgcacgtacgacggccatggcgagcagcggcgggctggccggtctggcggtgctgctcaccgccgtgctgtgcctgcagctgccggtccacagccgcgcgcagctgcgcgtggggttctacaacaccacctgccccaacgccgaggccatcgtccggcaggccgtcacggccgccttcgccaccaaccccggcgtcgccgccggcctcatccgcctccacttccacgactgcttcgtcgagggctgtgattcatcggtgctcctgtccgtcaaccccggcggaggcacgacggagcgcgaggcagcgccgaacaacccgagcctgcgcggcttcgcggtcgtggacgccgccagggcggcattggagcagagctgcccgcgcacggtgtcatgcgccgacatcctggccttcgccgcccgggacagcgtgaacatcaccggcagcaacgccttctaccaggtccctttccggccgccgcgacgggaa

SEQ ID NO: 52493 - DNA, 261 bp, Triticum aestivum
  unsure (1)..(261): unsure at all n locations
  Clone ID: PAT_TA_52493
cgtccgcnnagtaaagcgcgggggggagcgcagaacaatacttgatctgttgtttcctttngctcccggaggacttttagctgctccgctcgatctcgtcatgggggtgagagggcacccgtcgtccagggttgtgtggccgccgtgcnggtggtggtgacggagggggggctcctcggcttcctcctcggctgtngacggctgcggtgggcggggttgttgtggtggtgctggtcaccggcttggtgttggtctccgtgg

SEQ ID NO: 52494 - DNA, 419 bp, Triticum aestivum
  Clone ID: PAT_TA_52494
gacccagcgttttgtgtattgaaatatggtagaagagtaggatgtgctgtatccggctgtttgctgtagttttgcgacttcggcaagttagggacatatgccaggcccgtatcgcgtcgaccttcatcccacgccgtgagaatcaacaggcatggttgataataaagtctggaaagaggacggagacggggggggtgagtctatgaccacatcgacgccgcctggagtcgagaagagggatgagaatccggcttgccatactggtcccgatgcccataccaaagaaacgagcattgcgcctgcttctattgctccggatgaaccacccaatggcggatatggctgggtgtgcacgatctgctgcgctactttcaccgcacacacatgggggtctcatcagcttcttaccggcgtgttcc

SEQ ID NO: 52495 - DNA, 574 bp, Triticum aestivum
  unsure (1)..(574): unsure at all n locations
  Clone ID: PAT_TA_52495
gtagcagtaacggctttaatcttgggacattattttcttttaaggaaaagaataaagaatcgtacaaaacagctgaaacctaaaaaggaacgggtagtcattttgggatgctcttctggaattggaaaagaatgcgccttgcaatatgcatctcgtggtgcaaaacttattttatttgctcgtcgtgctgaattacttcaaaagcttcaggtcgaatgtaaagatcttggtgcttcagacgtacattttatggatggtgatgtcacaatagaaagtgatttggaaaagctggcagaatttacaaaagaaaagctacagggtgcagatacagtcatctattgtgctggaatgttatctgttcgctcctttttagaatcttgtggtattgaaattgattcaaaaacaaaggtagtcaagacaaagacaacggagaaaaacgccctaagtgaagcacttgaaacgattactaccatcaattactttgcagcggtctggacagctaaactattcttgcctatgcttatagaatcctcagtttcacctaattttttagtcntgtcttccattgcaggaa

SEQ ID NO: 52496 - DNA, 392 bp, Triticum aestivum
  unsure (1)..(392): unsure at all n locations
  Clone ID: PAT_TA_52496
gcgtccggggataacccggggggagggggtggacggattcacctagtgttantgactgtgtntatacgttcactcagagcacatatntgtgcttgtngaaatcttattggctggtngatcattattttttttgcnngacaattnatgacttctgtttgtttgggtntcgttctnaagatgggtccangaagagactggaatttttggatcttngaaancccttattttctcaattntggaacgcttcttattcnnatganttttaccttgtacangtgcaccgttcgngattttcgccctttcctgtgccttattttggaaatttatatttggattttcttttttgtcttattgttttattgttccttccttttggcttccttttgtttgct

SEQ ID NO: 52497 - DNA, 394 bp, Triticum aestivum
  unsure (1)..(394): unsure at all n locations
  Clone ID: PAT_TA_52497
tgtaaacaaaagcacctttggaagtgggacagctccagcttttggctcacctagcacattgggcgttagcagcagcgcaccagcatttggctctacaagcgcttttggagccggatcagcttttggaaagcccagcgcattaggaagcggatcagcctttgggcaaacaagctctctaggtgggggctcagcttttggacagccngctgctttgggtagtggatcagcttttggaaagccaagtgcattaggaagtggatcagcctttgggcanacaagttgttttggctgctgttctcccgcattcgggcaatctacatcgtttggaagctttgcttcctccttctgttcaacagtggcaccggcttttggttccgcctccgcattnggttct

SEQ ID NO: 52498 - DNA, 454 bp, Triticum aestivum
  Clone ID: PAT_TA_52498
gtcggcaacacagagattatgtactagccctcgattgggacggaaacgacagagagggcacacggcgtgttggacgaagggtcacggcgttgaatgcgatggccggggcacggtgactgagagggaggacactctggatgtcttgatgacgagcacttgatatagatctgtgtatgattagatgtatatagctctttgtactatatttatgcatttgtctctgccgacgctcttgggtcatggctaagaatcatttacagctgctagagaatgttagatgctgctgactcacctgattgctagcaagataaaaacaagatttgatactctgtaaacaaacccagccatatgaatgtttcaagaccaaaatacacttttactgtacgtcaagagataactttctcgtctataccatcaggttagcaaagctgatacaatcttttaaagcaatgtt

SEQ ID NO: 52499 - DNA, 331 bp, Triticum aestivum
  unsure (1)..(331): unsure at all n locations
  Clone ID: PAT_TA_52499
cactttgaaaagacccgggggggggtggcatcgaaaacgtcaagcaaaagagccaagacanggaaggtntccctcctgatcaacagcgtttgttctttgctggtcagctgcttgaagatggccgccccctttctgtcttcatcatccaaaaggaatctactctccattgggtggtggggcttcgtggtggtctgcccattttcgtnctgactctcgctggtgggaccattactttggcggtcgtgtcttctgcttgctttgtgattgtcccgcttttgattgctgatctggcgggctttcctcctgttctactgcgtttgttctttgctgg

SEQ ID NO: 52500 - DNA, 569 bp, Triticum aestivum
  Clone ID: PAT_TA_52500
tgatggctgaataccttgcaagtatttatggtactagaaaaagacaaagtcaattgttcattttatttcaagattggtgcttgtcgtcacggtgatcgctgttctagaaaacatgtgaagccaactttttcgcagactctcttgattgcaaacatgtataaaaatcctgtacatgatgctgctttccatctgactgaatctcaacttcaggaaaattttgatttattttatgaagacgtttttatggagcttgccaaatttggcgaagtagaggatatggttgtttgtgataatgtcggtgaccatcttgtaggtaatgtgtattgtcaatatcgattggaagaatctgcaggaaatgctgttgaaagtttaaataataggttttatgcaggacgccctttatatgcggagctgtcgccagttactgactttagagaggcttgttgtagacagcatgaaatagcagaatgtaatcgtggaggcttttgtaattttatgcatttaaagcaccctacactcacaatgagaccagaattatatgaagggcagagaatggatattatagaaaa

SEQ ID NO: 52501 - DNA, 309 bp, Triticum aestivum
  Clone ID: PAT_TA_52501
ataccatatctcagttggccaggaacgtgtatgcgctgctggaactttattctcagaggcttgtactttcatctgtgtagctggggattggatccggcccttgtgcttgcaggtataggaattcacctttggaactttttctacgcctccctgcacattttctgacttatttggagaatgtgctggaggacttgtggacctgtagctcgtcttgtccatgggatgactttcctctccgcgctcttcagttttttggggttttttgtgaggtgctggaggatcggttgtctttgccctgtgggggggtgt

SEQ ID NO: 52502 - DNA, 496 bp, Triticum aestivum
  unsure (1)..(496): unsure at all n locations
  Clone ID: PAT_TA_52502
ggggggggggggtgggggtgacnacngtgggggggcngacgggggcntctccggccgtggacactattactgtgtcnacnccgttggtgggggtgacnacngnggacgngcagattttttttttttancannangacggnatgatgtggttttgtntngggnctgttgaggtgatggggangggccacattgggggtggggggggggttctttncttnttnnntnctcctcnggggtccctgttttataaacctttngtttnttntttctttttttttttttttttttttttttttcttgcgctttcttcttttttntttttttttttttttctttcttgcttttttttttttcttttnttttttttttttttttcgttttttnttttgtggttttttttgtttttttttttttttntntttttttttcttcttttttttttttttttttggttggggttttgttctttttttttttttatttttgggttgtggtt

SEQ ID NO: 52503 - DNA, 707 bp, Triticum aestivum
  unsure (1)..(707): unsure at all n locations
  Clone ID: PAT_TA_52503
taggggccgcgtggactttgatgccgggggggcgggcgcccccacatccacccgcgtgcctgcgggatcggcttcggggtgaagggtgtgcttcttgtgggagtccttggctgtctcgtctccgggttctcgctcttctctttggtttttttcgccggggagacgttcctcatttggttgtcggggggctctttcngttgcncgtcngtgtgtccgtggcctgggtggtggtttccttcccggtctntacccctgctttgtctttttgcccctctctctcttttttttcttctcgttcttctcccctcctgttttttccttcgctctttctctttttggttctttgttttttctgctgtttgtttttctgttttgcctttttgtttttttttcttttttttcttctgttgttttttgttctttctttttttgctgctcttttttctttttttctcttttttcttttttttttttttttttctttgtctcctttttcttttccttttttttttgttttctttctttttctttttttctcttttttttttctctctttgtggttcttttttttttttttttttttttttttttcttttcttttttttttttttttttgtttttttttcttttttttttgtttttttcttttttttttttttttttctctgctttgcttctttttttgttttttccccctttgcgaactc

SEQ ID NO: 52504 - DNA, 565 bp, Triticum aestivum
  unsure (1)..(565): unsure at all n locations
  Clone ID: PAT_TA_52504
tctccacgcgtngcccacgcgtcgagaaaaaaaaaaaaaaaaaaaaaaaaaaaaaaaaaaaaaaaggaggaaaaaattaaaggataaaaaataaaaacaaggatgcgagatttaaatattatataagtaagtaattcattcttggccaagttttaaatgttttattggggggatgtgcgttcccacttaatagctttggagtaatcccgtttttcccagttgtttaatagtgaaaggttgcttgatgcctttccacagttttcaacctcattgcgaagggatgctccttgtaaggcctttaactgtgttttgtggttttttccttcgtgttgtttttttgtcattctttaatgcctgtttttcgtttttttgttctttttttccattttttgttttttttttaatttttattctggttttcttttttttttctttttttttttttttgggtctttgttttttctatcttgtttttgacttttnttttatcttttggtttttttttttttttttttgtttgtttttttttttcttttttttttttttgtgttttttttttttttta

SEQ ID NO: 52505 - DNA, 550 bp, Triticum aestivum
  Clone ID: PAT_TA_52505
ccacacgcaacagccgaaacgcttgaaccaggtacccggtcacttatcaagcacagatggcaaatctagcgaagcaagacagtgctacattcgtggccttcgggcagctactgcctcatcatgtccggcggtaggcccgtgaacgcgcagaactacaactggcccatgggcatgaactgtaccctgtgcttttactgtggtacgggcacctactactgacgctccggctgatattccgccacctgcacggtgacagagcaggggcgcctcagctgtgctggcgtccagggccaagcccatgaggagcggacgcaccacaacgccgacggggactgaatgctgttaactgacatgcctgaaaaggattttcctcgcgacctaaaacaactaaagaatttgctctaaataaacaaaactacggaactgctagactttgagaaatggatatctttaatacttacgcgagagagcacctatgcaacttccatagctgctcatgttgcaaacatatatgccaactataacaacttatgatatacttcttcaacat

SEQ ID NO: 52506 - DNA, 491 bp, Triticum aestivum
  Clone ID: PAT_TA_52506
gatgtcacgagcactgcatgatacacaagttattgaaaaggacggcgcaacagtacaagtctcgggtgtttatcaaaaacaaaacagaagagtaccaagtctaaggctataaagtcttacagggcgaaaccacacccgctcctaaacgcactccatcaaagttaacaaatcatcactccacgagcagacaggactgggaagagctttgctccacagtttaggaccaaccaacgatgaagagcagcacgctggtggcgatcctagtcctccaggccgtcatggtcatggggatcctctcacactcactggccgcggacgacaatttcccgaagtgctgcgacaactgcaactcctggtcaggggcccaattctgtgacgacgtgggccccaagtgccgcgacggctgcgtgaactgccacgtggtgcagacgaggcccgtgaagacgttccggtgtggggatggacgcccccccctcccagagaatccctgc

SEQ ID NO: 52507 - DNA, 415 bp, Triticum aestivum
  Clone ID: PAT_TA_52507
gagcgagggagttgtaatggagcttcggcgggggcgtcgccgctgttatggaactttgcctcgctgcgcggtgctggccatggagctgcaatggagcctcgtcgggcgtccgtcggcgctgcaatggagcgctcgccggcgctacaatggagctctcccagcggtctcacaactgctcacaggcgctgcaatggagcgcttgcctacgctgcagtggagctctcaccggcggtcatggagctgcaatggagcgctcaccggcggtctcactactgctcgctggcgctccggcgctgcaatggagcgcttcatcagaggcctggacactgctcgctggcgctgcaacgaagcatcgccggtgttgtgttgtagcattgccgagccgccggagcatcgccggagctgcaatgaagct

SEQ ID NO: 52508 - DNA, 573 bp, Triticum aestivum
  unsure (1)..(573): unsure at all n locations
  Clone ID: PAT_TA_52508
cccacgcgtccgcggacgcgtgggcgcgaccgcagtcccgcctccacttcccgcgatgttgcccgagatccgcgaagagggcggcggcgcgggcacgagcgcgaccaaggcgatgtcggtgtcgctgagcgggaagcggggccggtacgtgcggcaggtgacgggccgccacaacgacaccgacctgcacgtggcggcgcgggccggggacgccgcggcgctgcgccgcgcgctggacgaggcggcggtggtcgtggcggttggggagggaggggagcagctggaggcggtgcgccgcgccgtggccgcggaggccaacgaggccggggagacgccgctcctggccgccgcggagagggggcacctggaggtggtggtcgagctgctccggcacctcgacgcccagggcgtcgccgcgaagaacaggtcggggtacgacgcgctgcacgtcgcggccagagaagggcatcatgctgttctgcaggaaatgttacgtcacgataggatgtttgccaaaacatttggccctgcaaatactaccccgcttatttcancagctacaaggggacatgc

SEQ ID NO: 52509 - DNA, 371 bp, Triticum aestivum
  Clone ID: PAT_TA_52509
gttctggctgttgaaggagacgaagagcgtgagtggcacgaagacgatgccggtgctcaccaaggcgctccgggtagaggccggggtcgtggaacttctcaagtccaagtttgccgctgggttttaattcctgggagactgcccatgaatgatcatatatcattccgtatatgcatgctagcgaaatttaataattctcagcagaagatatctattcaagcttctggttaagctcgcatgcaggtgtaataagattgaataagttggcctcgtggttcagtcatcagagccaatacgaggaattgaaatgtactactttttattgtcttcattgttctttcattgtacggaatacataattatcatttccg

SEQ ID NO: 52510 - DNA, 564 bp, Triticum aestivum
  unsure (1)..(564): unsure at all n locations
  Clone ID: PAT_TA_52510
ccacttcattttaaccatggnaagagattgggattcaagttaaacaagaagctaaagacatcaacactactattcttcctaaagttggacagcttgaagatctatcagaaagagatttatatgttaaattaaagaaacttcaaagagatatagagtttattgaacttcaagaagagtacattaaagatgaacaaaagaatttaaagagagaactcgtccgagcgcaagaggaagtgaaacgtatcaagtcggttccacttgtgcttggtcaatttttggaacctattgatcagcataccggtattgtgggctccacaactggctccaattatgttgtccgtattctcagtacaatagaccgcgaattgttgaagccaagttcttcggttgccttgcaccgtcattcaaatgcgcttgttgatgtcttaccaccagaagctgacagcagcattgcacttttgggagcagatgagaaacctgatgtagcttattctgatgtgggtggtttggacattcaaaaacaagagattcgtgaagcagtagaattacctctgactcactttg

SEQ ID NO: 52511 - DNA, 597 bp, Triticum aestivum
  Clone ID: PAT_TA_52511
aagagttttctttggtcgaggtctatgtagatgagtcttctgctgataaggccaccgagattgcaccttttgatccaaccaagaagaagaagaagaagaaggtcgtcatccaagatcctgttgatgaggttgataagctggcagagaagacggagggcttgtcagtcactgagtctggcgaggcaagcttcgtgggattgaaaaagaaaaagaagaaacttgtggaacttgatccatcacttgttgaggctggagatggtgaagacactcttgatgatcaagttggagaggatgaacaaggagaggggattgtgctgggtggagcaacccagtacccatgggaaggaactgatagagattacaaatatgatgagctgcttggcagagtcttcaatatcctgcgtgagaataatccagatcttgctggtgatagacgaagaacagttatgcggcctcctcaagttcttagggaaggcacaaagaagacagtttttgtgaacttcatggacttgtgcaaaacaatgcataggcaacctgaacatgtgatgatgtttttacttgctgagatgggaacaagtggatcccttgatgggcaac

SEQ ID NO: 52512 - DNA, 540 bp, Triticum aestivum
  Clone ID: PAT_TA_52512
gtctatacctacgatgcaagcgggcgccctaattaaatttgcgctacctgacacaacgtgcgcacttgctgcattatcctatcaacagggtggctgcggcaagcctagtgggagaccagccgggaagcaagggacactctccccggacggaacgccccaggcatccaacgggctacaccggtggctatgttcaaggaagcgaaattaatggctcggctttctgcgcgggggaacggtaacggaatcgtggctagagcatattggctcacactctaagatgaactgatctttcctcctccttagaaaaaaaaaaaggagcaccatctaaagaagccaatctttcgccctccaacaggcaaccaactgcttcttttatagtgggccctagatcaaaaatattcaacttagtcaaacagcagctagagtgtccaaagcccatggttgcccaacttacaaccacttagcatccaacccaccacttcgacacttacgaccagaactaacaccaatttcaaagccgacctttccaaggtgttcacc

SEQ ID NO: 52513 - DNA, 534 bp, Triticum aestivum
  unsure (1)..(534): unsure at all n locations
  Clone ID: PAT_TA_52513
gtatacaagcaataagcgacatttttatttttttataaaaaaaaaaagaaacacaatggaatgagtagaaaaacaaatcctgctttattttgtctccgacgctttatgcatttttaataggcacttgttcaagctgccaaaccttctcagcatattctctggtggcccgatcggccgagaagaaacccatgccggccgtacagagaatggatttcttggcccaggcctgtctgtccttgtagaccgtctcgacctgatcatgcgcatccaaatatttttcgaaatcggccgagatcaaataataatcaccgccataggtcaaggtgttgatcaagggaccaaagaccgaggccgactcaccgaattcacccgactgaatggcttgcaagacgacttgaaggttaggatcgatcaagaccccgtggtacttttgacggtgacggatgtcggcgacttgatcagccaaggtgccaaacagaaagatgttttcctcaccgatctcatcacnaatttcaatgttcgcaccatcnaccg

SEQ ID NO: 52514 - DNA, 606 bp, Triticum aestivum
  Clone ID: PAT_TA_52514
cccacgcgtccggtgcgccgtgtgcctcgccgagctgtccgacggcgaggcggccaggttcctgcccaagtgcgggcacgggttccacgccgagtgcgtcgacctgtggctgcattcccaccccacctgcccgctctgccgcgtcgacgtcgacaagccggacgccttgccgctggctctacctcctctgcgccccgaaccggcgaattacgccacaaacctgccgaccaacgtgctgttctggggatccccggacgcggtcacgactggaagaacagtcggcggcccgagctcgtccgttggagcagcagcgttgattgtcatcgaagtcccggaggccgcggaatcggcgttggcgccgcgtgatggtgatgccgggaagtcgcacggtttggcgaggatgaggtcgattaagaggctgtggagcagagggattcaagaggtgggcgctagtagcactgctacctcttgccaccaagccactgctggtgctcacactgaggacactcttggtgttgccgctcgcaatttcgacccgtagggaccgaagatatgttggtctttccacatgaaacatcaatttaatatcggggacttgagtttgac

SEQ ID NO: 52515 - DNA, 348 bp, Triticum aestivum
  Clone ID: PAT_TA_52515
agcaaatactccctcaaacttggaaaacttggaccatcctcctgctaaagtggccggtggtatgagagtgaagcaacctgacccacaccgaactccattaaaagcacaaaaacacgatgaggatgaagagaagaaggacaaggatcgtcttgacaagttagatcttgaagaaagacgtgctcaagatatgcaaaatcatactgcttcctttcaagctaatgtcacaagaaatgctggtaaaaatgtccacagacaatacaataatccagaaacccaaccaagatctctcaaccattaatttgtggtgaggtttttttttttttgtaaattaaataaaccatatatttt

SEQ ID NO: 52516 - DNA, 550 bp, Triticum aestivum
  Clone ID: PAT_TA_52516
gttgcttctcctattgaccaatccattgcatatgaagtcagctgtcttactcaggatcaagtcagcgatgctgtcgaaagatcccaaaaggccttcttgtcttggaaaaaggtacctgtctcggatcgtgtggccattatggaaaagttttgtacactttttgagcaaaagaaggatgaggtagctaaatccatcacgtatcagatgggacgcccaattcgttatggacacggtgaagtcaagggagttttggaaagagcaagatacatgatatccgtagctgaagagtgtatgaaagatactgtagttgaacatacgccgggtgttgttaaaagatttttacgcaaggaacctttgggtcctgtctttattatcgcttcttggaattacccttatctgacaacagtcaataacgtgattcctgctcttttggctggcaacactgtcttattgaagcagtcccctcaaactccccagtgtgctgatatctttgtggataccttgagagaggctggtgtgcccaaggatgtcattcaggctattcacgttc

SEQ ID NO: 52517 - DNA, 599 bp, Triticum aestivum
  Clone ID: PAT_TA_52517
gccggcgcctccacttctctgctccctcgtctcctctcgcgcagggcccggcgaaagggaagcaagatgtacaccgccaggaagaagatccagaaggacaagggcgtcgagccctccgagttcgaggacaccgtcgcgcaggctttctttgacctggagaacggcaaccaggagctcaagagcgacctcaaggacctgtacatcaacactgcaatccagatggatgttgttgggaacaggaaggccgtggtgatccatgtgccataccgtctgcgcaagcccttcaggaagatccatgtcaggctcgtcagggagctcgagaagaagtttagcggcaaggatgttgtctttgttgcaacaagaaggatcgtgaggccacccaagaagggttctgctgttcagcgccctcgcaccaggaccctgacagctgttcatgatggtatcttggaggatgttgtgtacccagctgagattgtggggaagcgtgtcaggtaccgtttggatggtgccaaggtcatcaagatctacttggacccgaaggagcgcaacaacactgagtacaagctggagaccttctctgcagtctaccgcaggctttg

SEQ ID NO: 52518 - DNA, 358 bp, Triticum aestivum
  Clone ID: PAT_TA_52518
caaaaaaaaagaagatttttttaatcggggggaccccccagccctcagggttcatttcacgcccggggaattccgcccccccctgttttacccccggggtttatcttacgggccaaaaggggaattcggggacctttttacttggccaaatcccccctcgggcaattcattcgggcccaaacaaatcggagtatctggccctgtcaatgcctgcctgaaaaggggataaaatgaaatcacccccatcccgttgcaaagagagatagggatagccccttatgcggggagccccccccccctggggggccccatgaccaagccccccttgggggaggccgggcaggggagcccccccccc

SEQ ID NO: 52519 - DNA, 342 bp, Triticum aestivum
  Clone ID: PAT_TA_52519
acaaaaagaacattgcgcgcgtcggtgctaggggccttgacgccacacttactatacggcatagaggagtgccagctccctgaggagaacggcggcacgctcaagctgtaagcctacaacaggtcaccatcgttcacccacatctgctgatcaattgatagcgatgaccatgtgacatagtgcaatatagaggttgcggtacttccactaggcattgccgagagaggcgacgatccttgcaagcgcggcttatcggctaaccactcagctacttattgtaatttttttttacaaaaaaattgccgactcatatgtgccccgttatatatggcatgcttcctg

SEQ ID NO: 52520 - DNA, 570 bp, Triticum aestivum
  Clone ID: PAT_TA_52520
cccagcgtccgattcaatttaacatggttaaaatcggaattaacggatttggtcgtattggccgtattgtatttcgcgcaagtcaagaaaagaaaggtgtcgatgtggtctccatcaacgatccatttatttctttagattacatggtttacatgctcaagtatgataccgtccatggtcgattcaagggcacagtcgaggccaaggatggcttcttggtcgtcaatggccaaaagattcacgttcacaatgaaaaagaacctgccaatatcccttggggtaaagacggtgcacaggtcgtggtcgaatccaccggtgtcttcctttcggtcgaagcagccagtggtcacttgaagggcggtgccaagaaggtggtcatcaccgctccctctcctgatgcacccatgtacgtctgcggtgtcaatttggaaaagtacaagccagaggaaaacattgtgtctaatgcgtcttgtactaccaattgtttagcccctctggccaggtgattcacgaaaagtttggtatcaaagaaagtttgatgaccactgtgcatgctgccactgccactca

SEQ ID NO: 52521 - DNA, 600 bp, Triticum aestivum
  Clone ID: PAT_TA_52521
gccgaattgcctccgcacctctaataggttaaatgaaagaatgaacatttggggtccatcgcacatcataatcggtgtatggaaatggtggtttcatgatttagagatctatacgagcgacctcactagttatgatatttgctctgacaacgtttgatagactcacaagatgtcagccttttgaaaaatttctcggtgccactcaaaaccactgactggaaccaacttactatcgttgcttcaattgccaacaacctgacgtcatagctgttgtgaaatcctttatcatctatggtgtctaacaccacacgttgcacacaagccttatcatgaggatctgactatatagatgataacacatgtgcgagttgtacaatgacagactatgctttggaagaaaggctcttgatgtccaccatatagactgggctgcttaaatacaccaaagccttgcggatgctccacttaatgtgagagcatatagaatgcttgtcttactaagccttctcttccgagtgaccacgacttcgcgttcactgggcgaagaaaggagaatctactatttacagaatgttcgaggttgtgaaacatggcgaacaa

SEQ ID NO: 52522 - DNA, 208 bp, Triticum aestivum
  unsure (1)..(208): unsure at all n locations
  Clone ID: PAT_TA_52522
tanaatggcggtngaggcgttggcttggtggatgggcacatgattctgccaagaaggggctgcttgtctcgcctggtcagtagtgacttgcgagcattagctggaggacgtcttgtactttccattttcccttttgtattgcgtgtgccaatgtttgctgagctgagctgagctgtatatagtatctcggcgcgaatgaagaggattg

SEQ ID NO: 52523 - DNA, 497 bp, Triticum aestivum
  Clone ID: PAT_TA_52523
accccgcctctgaccgcggcgttgacgggtgcgggtactcgtacgggtacttggccaccaccgtcgtgaccgacgccgagtacgagcgggtcaccaagggggtcacccacgacgagcacacacgcagcacctcagggagcaggtcgccgagatgggcgccgccttcgccctatacttgaagctctacgagaagaacgacccgaagaacgcccacaagcacacgatcaagcacgagatggacgacgatgtagccgtcggtgcaggcggcttcgccttccacttcctcttccacaagcaccacgaccacaaggaggaccacgaggacgccggcgaggacaaccaccaccaattgcactaccatcttcgtttacatcacctgtgacgtctggtggccggccttgcctgcgcttacgctactgctgtcctatcgtgtgatacgttgtgacataggcttggactcgtgcttggctttgcgctagtctgtgtgcgatcttatc

SEQ ID NO: 52524 - DNA, 420 bp, Triticum aestivum
  Clone ID: PAT_TA_52524
tataggcgactacctcacatgtgcttattaagagaattatgctccacatgcttgctatctcatggaagacttcttgcctcacaaacgtatgcaccagacatctaatgacgctcttgacgttgcttcaatgggaggaacctcctcatcattagtacaccttgaaccttgtgagtctcaatttggtggccgtgcaaatgaacctctctcgagcgctaccgctcgcgttcatcaggaaactgctcctgctcctcatgggaaggaaccatgcacggatgccattagctccactgacaaaacgaagagggctagccttgatgagtgaacaagacactctggtcctgatcaacatctacgaaccaggccgtgaaggtgctattgttaataactccaccggagacgcacatcctgtactttatgatg

SEQ ID NO: 52525 - DNA, 573 bp, Triticum aestivum
  unsure (1)..(573): unsure at all n locations
  Clone ID: PAT_TA_52525
gtggaagatctagaggcccgcttgttgctctctaacaaacgtgcagatcttgcgctcttagaagttctgatgccaactccaagtgttgagcctctgacgtttgctcctatcagttttgtgccaaaggatggcacaacaatagctgttggttattgcagcccagaggatgctgcaggcccccctagggccccgtcagtttctccaggaaagctgctgtcaaaaccaaaagacactgtaaacattggcgcacgagctacagtgagttgtgtcgctgtacatggcatgtcaggctcccccgtcattagcaagtatggcgtgatgggggtactcattcgcggagtggtngacgaagccagccggaccgtgaggacgaccacagtttgtagcgagactcttggcctagtactcgcaaaatggttggggttaccattaattcatacaaagtcactaaaggagatgattgccatgatttgatgaataccctgcaattttttgtgacgagaccagagcgacgcctgccacatgacgactggagacatggtcgaagctgtgaccggtgtgaatctatgaatg

SEQ ID NO: 52526 - DNA, 590 bp, Triticum aestivum
  Clone ID: PAT_TA_52526
gccacgacgtccggaagatttcgccaggagacacataggtccttttcatcttccgcacgcacccataggaaaaaggacgaccgatttttttttattttgcttccctctatttgtaaatcggggaagaagatagcttaggccacacacagatgtctaggcacagaaaacttaacctatgggggattctttttttgggtcaaataccaggttgccgactttgtgcgaagaacaattacgtgggctggctgctaagaacaaacccacaccatgtcaacttatgatcatgctgacatgtattacttggccacacttggtgaccaattacgagctcatgaggaagaatcacttgaagagggtgatcacctggctgatcaactgattgaagactgtgataataataacgatatcacctttgcagatgctgcatgggacaaagactttgatttctctggtaatactcaaagattttctgctaattacaaagacccttcatcttttactgaagaagaagccttttgtgctaatcgaagacttaaggatgattctgtaaacagaggcagatatcgaaacatttgggctagtcattcaac

SEQ ID NO: 52527 - DNA, 487 bp, Triticum aestivum
  Clone ID: PAT_TA_52527
cccacgcgtccgcccacgcgtccgggctccaaagctgtgaagcaagcatcacagcagcttctgcctttggctgtgaaggcaatgcaagaaaataatgcagagcttgccaaggaggccaccgatgtgttcatctggtgcctgactcagagtccagagtcctacaagctgtgggacaagcttcatgcagagaatatccaagccagtgttgcggtcttgcgcaaaatcactgcagactggaagacactctctcccaagctcaactctgaagctcttaaagcaactctgaagagcctcaaggctaagaatgaggctgctctggaggaagcagaggactctggggagaaggcgtccatcaaggaggcagacaagtactgcaaggccatcatcgggaggctgtcgcgcggcgccacctgcctgaagggcagcctgctggtgatcgcgctcgcggcccgggccgggcttcatgctctcccccaacctcgacctc

SEQ ID NO: 52528 - DNA, 168 bp, Triticum aestivum
  unsure (1)..(168): unsure at all n locations
  Clone ID: PAT_TA_52528
cccgggtccgcacccaccgcgtccgngnaacacgnaacgccctggtgtgctgcagcttcggggccgccctcatggtggtcatggctaccaccctcctcagctcctgatgcgatgcccacaaagagaggctgatcttgctggttcttttgtgcccgagcggcgctactc

SEQ ID NO: 52529 - DNA, 483 bp, Triticum aestivum
  Clone ID: PAT_TA_52529
cccacgcgttcgccgcacctatggtaagacatgcaagacaccaaagagtgcttatgagaaggagcgtcttgatgcagaactaaagctgggcctggagtatggactgaagcgcaagcgggagctctggacggtgcacaatgcactgagcacgattcgaaatgctgtaagacactagctcacactggatgagaaaaattcccacggcatctttgagggcgcgggccttatccgttgtatgaaccgttatggtctccttgctgagggccattataagcttgattacattcttgacatgactgttgaaaacttccttgcaaggctcctttagactgttgtcttgaaggctggcatggaaaaatccatccaccatgccagtgtcttgatcatgcaacgccacatgaaggttggcaggcagatcgtcaatgtgccctcggtcatggcgaggaatgaatctgacaagcacatgaacttctcactgacaag

SEQ ID NO: 52530 - DNA, 582 bp, Triticum aestivum
  Clone ID: PAT_TA_52530
gggtgacacctccaaaggccccatgccgaacgaccactactgctggatgagaccagaggacattgattacaagaggcctgtcatcgagtgccactcttgctcggatcttgccgctgaaatggctgccgcccttgccgcagcttccatagtgttcaaggacagcaagacgtactctgacaagctcgtccacggtgccaaggcgctgtacaagttcggtaggctgcagcgcggccgatacagccccaatggctctgatcagtcgctgttctacaattccaccagctactgggatgagtttgtgtggggcggtgcgtggatgtacttcgccacggggaacacatcatacctcaccatcgccacagctccagggatggcgaagcacgcgggagcgttctggattggtagcccaaactatggagtgtttacctgggatgacaagcttccaggatctcaggttcttctcagcaggttgcggctcttcctaagtccagggtatccttatgaagaaatattaaggacattccacaaccaaactgacaatgtcatgtgctcctatttaccagtattcaattcattcaactt

SEQ ID NO: 52531 - DNA, 602 bp, Triticum aestivum
  unsure (1)..(602): unsure at all n locations
  Clone ID: PAT_TA_52531
acagccatgtctggcgttttccgtgcctctaccatgaatcctgcttaccgccttgcttccaagaatatggtccttggcagcacacgtcactttgctactcaagctcccaagaaaggtggaagtaagctcttgttggctaccttgttaggtgttggtgctgttgctggtcttacatttaaccaaaccaaagctactgtaagacctgctcttgatgaagccaaggctgaagccaaaccagaaacaactcaattcaatgctcctgattttacacctctcaagttggtcagcgttcaaaagatttctcatgacacaagcgttttccgttttgcacttcccgaaaaccaaaatgctggtcttcctgttgcctcctgtgtcattgctcgtcaccaagttgaaggtgataagccaatcattcgtccttatactcctatttcatacgaagataacattgaccaccttgatttcgtcatcaagagatacagcactggaaagctgactcctatcatccatgacatgaagcctggagatacactcgaattcaagggccccatccccaaatatgactgngagaaggatcaaaaggcaatgtgggtatgattgct

SEQ ID NO: 52532 - DNA, 459 bp, Triticum aestivum
  unsure (1)..(459): unsure at all n locations
  Clone ID: PAT_TA_52532
agagtctagacaaggccatcgcacattactgcagcaagggcaacttccgccgcgcagccactcacaagcagaacctcgccgagctcttcgaagtcgaactcggcgacaacacccgtgctgctgcagcctatgaagaagcagctggttggtacgaaagcgacaacgccgaagccctcgccaacaaactctggctcaaaaccgccgacctcgtagcccttgaaggcaaagactactacaaggccattgagctctacgagaaggtcgcaaagacatccatttctaacaacctcatgcgctggtctgtcaaagagtacttgctcaaagcaggtatctgccagctctgcactggcgaccaggtcggtgtcactactgcccttgaaaggtacagggagctagaccccagcttccagcaacagagggaantacgcgctactcgttgacttggccgcggctgtcacg

SEQ ID NO: 52533 - DNA, 137 bp, Triticum aestivum
  Clone ID: PAT_TA_52533
gatcgattatgcacgatctctggaaggtgaaggtggtgccgtttatacatggactagaccatggtagctcatcgtgcataatcgatctctggaagaagcggcgaggctgatgcgcgagcagtcaccaccagcaactg

SEQ ID NO: 52534 - DNA, 192 bp, Triticum aestivum
  Clone ID: PAT_TA_52534
tacttgatctgttgtttcctttagctcccgtaagacttttagctgcgccgatcgcatctctatcatggtggatgagaggagcacccattcgtactcatggaggtgaggccggcgagctggtggtgggacgacaggggcctcttcacctcttgtagagaagcttggaggacatgtaagagaggagctgtcacc

SEQ ID NO: 52535 - DNA, 332 bp, Triticum aestivum
  Clone ID: PAT_TA_52535
ggctagagcaagcgagcgagcgagagagactgagagaattgagagaagatgaagatggcttgccctgcccaatccatgctctccgcaagcagctgcgtgctcctcaggagcagcaagccccagcaggccacgattccgcgaggaggagggggcattctcggtccagtcgagcccccccgttgtggaaccggccgcgcccgaggaggcgccttctgattcacccaccttagaggctgaaccttcggcaaccgcggagcagccgtcgtcgtgagctgataatgatatacacggtgagcgtgagacggaaataatcgaaacataaaattgatgtg

SEQ ID NO: 52536 - DNA, 558 bp, Triticum aestivum
  Clone ID: PAT_TA_52536
cccactcgtgcggacttataattctacttggatccctgaggttacttgatgaacgccattaacggatttgtcgtttataccatccatgtgaccccaggagacggctacagctacgcgagctaccatgtcatggacatggacgctctgcgacctggtctacggtgacatccacaataggtgtcctccggtgctttggcccttcagaggtactctgtggctgtcaccatcttcggtgggccgaggaccacaccgtcaactgcggcaagaagctcgaagctgaggcatacgactgcaacaacggtctgcagcatgaactcccctgcggtggcatgctcatttaccagagctttgccgacaaccaagaggtgtgatgtctgtaccggataacgcagacccgacttccactgctatgagggccacagtgctcacagccaccctgtgtgaaaggaatgcaagctttgcaaacttctataatggagggcgcaggaggatttcctgctagagggcgcggtgcttagctcattaatgtctttcgcttgtccctctacacactttgga

SEQ ID NO: 52537 - DNA, 483 bp, Triticum aestivum
  Clone ID: PAT_TA_52537
attaaaatgagtttccttcgatctgctatcaaaacttctactttcttaagacctactgtcaactggtatactccttcttttgctcgttggatttccacagaaatgaagactcgtctggataaggatgttaagtccaacgatgttgtcttgttcatgaaaggtactcctgatgaacccatgtgtggtttcagtcgtgccgcagttcaaattatgcaagtacaaggtgttgattttaacaaggtcaatgcttacaacgtattggaagatcccgaattaagagaatccattaaggaatattctgaatggccaaccattcctcaaatttatatcaaaggagaatttgttggtggctgcgacattttattaaacatgcaccaatctggcgatcttgaggatttattagttaaagaacaaatcgttcctcctgtcattgaagaagaagaaacaaaataaaaaagatgtcagcaaatcgtgtgttttatt

SEQ ID NO: 52538 - DNA, 554 bp, Triticum aestivum
  Clone ID: PAT_TA_52538
ctaacatggactgtgaatttaataatacaagtgacattcttttcccatcagatactggtttacccaagttagcatcacctctggattataaagtacctgaagcaattgattgggcttctcaagacttcatgtttacttttcatgacaaatcaacgaatgaattaaacaatttcctttgctttaaacaatatatacctgttcaaccacaagaacaagaacaacaagaagaaaagcaaatattatcacaaatgaatcagcgtttagctgtcggaaacacggaattacacgacagcctaaaagctttctttcattcgattcaaagttcaatgcaacttcattcacaaccagaactcgctttacctggtctctcttgggctgaagaagccaatgaatattacggcggtaatgatattggtaatttggattcagtacaagaattagaaggcaaaagaacccttgttgcaccagtcgtcgatgatgacgatgacgtgcaaattgatttatctactcaatcgtcattatccgatattattatgataccaagataaccacta

SEQ ID NO: 52539 - DNA, 483 bp, Triticum aestivum
  Clone ID: PAT_TA_52539
gctcgctacccagacctaaaacagttactattggtcagttcaagctagggctatgccatggccatcaggttgttccatggggcgacctggactccctagcgatgctccagaggcagctggatgtggacatcctcgtcaccgggcacacccatcagttcaaggcctacaagcacgaggggggtgtcgtcatcaaccctggctcaggcacgggcgcccacagcagcatcacatatgacgtcaacccgagctttgtgctcatggacatcgatggcctccgtgttgttgtctacgtgtacgagctcattgacggcgaggtgaaggttgacaagatcgacttcaagaagaccgccacgatgcatggctgatggtgcttacgcatgacagaaatctgatcctgtttgttcttaccccccacccccactccacaccacaccaccaccaccacaatttccccgacctggagctctttttcctttgtaccct

SEQ ID NO: 52540 - DNA, 569 bp, Triticum aestivum
  unsure (1)..(569): unsure at all n locations
  Clone ID: PAT_TA_52540
cataatgcaattcagcaatgttttatctatattctatcttgaacacttctttaaatctaaagcttctgtgacaatcaaggaactgacaggtcgctctaggttctttgaaagagaaacttttgttcatgccttatcttcacaagggttcatatgggacaatatggatcttaacaatctttatttggacttgggcatcaactttgcaagccctcaacgtgggcttacaggattatggtccactggagaagaaaaagattctcaacctatattggaattgctttttgacgacacaagctttcataaaagcatgtaccgtcatgatcctttttgcggccacttaggcattggagggttcaagtatgggaaccgcaagtctggtttgatccgggtctctgcgtactcccattgcaaacagccattctacagtcgcagcagctatggtgagagacatggcaaagattntaatgctgacgaggtatttaaagtatctcctggatttatgaagcatgtaagcaaaataaaacactgcttatcattaatgaagtcaaagtcctatggagtgcgactcg

SEQ ID NO: 52541 - DNA, 231 bp, Triticum aestivum
  Clone ID: PAT_TA_52541
ggtccctggcggacaacttcaagagacaggttgccacactatctatgaaacactaatgctgttatggccaaccaatgccagtcacttgatcacacattaacgaggctgtgaactgggaagacactaaggattcccaagttagggcgattaacttaaacatccctttggatgatgggtgcattaccagactggcctttgctgaggagtttattcatgccattgaaacccaac

SEQ ID NO: 52542 - DNA, 222 bp, Triticum aestivum
  Clone ID: PAT_TA_52542
tccgggaagcgtgggggaagatagcgtgggcgtgactttggccagatacgacttaactttaacagtgcgctctagtcgacggcttaggtatggacggcggacatcgatggtgtccgtggccgcggacatggacgcgtgagaagagaatgcgagtgccattgcattagaagaatatacccccgaccgagaaatgtagaagaaagaccatttcaggagaatggc

SEQ ID NO: 52543 - DNA, 548 bp, Triticum aestivum
  unsure (1)..(548): unsure at all n locations
  Clone ID: PAT_TA_52543
cccacgcgtccgagctcttattctgacggttatgtagctccactttatgctcctgctgaaactgaaacagtcagtggttcctatattattatgctcaaaaatgacctctctgtcgaacaaattcaagatcatgccgagtgggttagttctatggtagcctctcatgctttcaatacaggagaattattagatagttcttttactgcgggtattaaacatgtttatgaaattcctaatctcaaaggttatgctggtcattttgacaagaaagttttggacgccattcgtcgttctgaagaagttgaattcgttgaagaagattccattgtttacgctagtgaattacaacgaagtgctccttggggacttgctcgtatctctactcgtaatgcactcacactccgaaactataataaatacaactatgacgaaaaaacagctggtgaaggcatcaaggtctatgtgattgatacgggtatcaatgttgatcatgtggactttgaaggaagagctanctggggaaagacaattnctacanacgataatga

SEQ ID NO: 52544 - DNA, 335 bp, Triticum aestivum
  Clone ID: PAT_TA_52544
ctaacgaacactgtcatcttacttagcgatcgaggcgagtcgatgaggagtctgctggtgctttctctggtggtcgtggccgcggcgtgcctcgcggctccgcggggcgcgcacggggccggcgagtgcgggaggacgccggcggacgagatggcgctgaagctggcgccgtgcgcgtcggcggagcaggaccccaactcggcgccgtcaagcgggtgctgcacagcggtgcgcaccatcggcaagcagagccccaagtgcctctgcaccagaatgctctccaacaccaacaagagcgccgcaataaaaccggaggccgtcttatgcatacccaa

SEQ ID NO: 52545 - DNA, 157 bp, Triticum aestivum
  Clone ID: PAT_TA_52545
acgggtttggtgcctctttctggcctatgggtgttgctgcctggccggttgaagctgccgctttgctgtcgccctgaacctgttttttttgtttctctccggaaaatctgtgccaagagcctgtgaaaagctttgtgtgtctgagagacgtatgagc

SEQ ID NO: 52546 - DNA, 538 bp, Triticum aestivum
  Clone ID: PAT_TA_52546
cggccgcgtgggttataacactattgagaccaatcaacatcattataaccattcaaggttacctcctactccatcagttcctatttggagcattcaaaatttatctcaatcttttttacagttgcaaactccaatgtcgcatcaaaaggctccttctaccaatcctcggatttcactgaagtttaaacagaaagaagctgcattatacaagacagaattttgccgaaattgggttgaactaggacaatgcagatatggtagcaagtgtcgttacgcccacggcgaggaagagatccgtattgtgcctagacatgctcgatataaaacacagatttgtcgtgcttatcactcggatggttcctgcccttatggtactcgctgcacattcatacatgattcagactcacccatagacagaaaggaggccaatccatctttaatgacagctagtaacactaatggatctactgataacattgactttatttggaatggcaaactcacttttaagtcaaacagcatgaaacaaacatttcct

SEQ ID NO: 52547 - DNA, 498 bp, Triticum aestivum
  Clone ID: PAT_TA_52547
ctaccacctccggaactcaaaccccactcctcccgtcggcggccaaccacctcaaattctccacctccgtccccaaatctcaagtgcttgctgattcttttgtgaagcgcgcggcggcgatatcttgggatttcggcgcggtccttcctgagtcgcccgtgagctgcaggcggggcggggtccgccttcttccccgccgccgccatcgccgttcccgtcctacaaaccaacctccgaattttctgggtgtgcaccggcacgccaggcacatcatctggatccgcctctgcgtgccattcagctcgctgggatggcgacgcagctgccatgcttcacgcagctcaccccgccgtcacctggttggagaaacgaagcggggagcctcggggctacatctgggagggcgttggtcagaagcgttccattttcaggtcactcgcacatcaggtgtcgcgcaaccccacgcagcgcttacttgttttagaagaaagactcctt

SEQ ID NO: 52548 - DNA, 146 bp, Triticum aestivum
  unsure (1)..(146): unsure at all n locations
  Clone ID: PAT_TA_52548
nnctgtcctgttttgcctttttgcgtccagctttcaaggggcaagaatgccggaggttaacactcattattctggctagggtctcttctgggggctagcagtagcttgctcaagggcaatgtgggatggctattgtactataagag

SEQ ID NO: 52549 - DNA, 355 bp, Triticum aestivum
  unsure (1)..(355): unsure at all n locations
  Clone ID: PAT_TA_52549
tcggncgcgtgggcggacgcgtgggtggcgggggtgctgcccagctcggtttttgggccgttgtaagccaccatgcctgcctccatcgccttcggtcggttcgatgactccttcagcttggcctctttcaaggcctacatcgccgagttcatctccaccctcatcttcntcttcggcgggggggggtctgccatcgcctactccaaggtgagcggtggcgcgccgtttgacccatccgggctgatcgccgtggtgatctgccacgggttaggtctgttcgttgnggtcgtcgttggtgccgacatttgcggtgggcatgtgaaccctgtcgtgaccttaggtctgggcgtgggcg

SEQ ID NO: 52550 - DNA, 431 bp, Triticum aestivum
  Clone ID: PAT_TA_52550
cccagcgtccggaaaatagacgatgctttatgtacggatacgtttttagggaatcttataaactttcttcctactaaagacgataatttgactttgatgcaaaaatttttggaaggaccgcctgaagcctgtgacgagcttgatattcctgagcaattcactattgagatgtttagaatgtatcgttatgaacagcgtatacactttatgttatttagagttcagttttgggaaaggattgatcaattggaaaatagcatgtcagttgcaatagaagcttgatacgcgctaaaaaattcaaaaagtctaaagaatgtactttgggttatactgctaattggggactacataaacgcgcagggtctttgtggagcgacgtggacatgtgcacgtttggagagttgcattgccatcctgcatccggggctggg

SEQ ID NO: 52551 - DNA, 369 bp, Triticum aestivum
  unsure (1)..(369): unsure at all n locations
  Clone ID: PAT_TA_52551
ccccaatgatggaaacgaatactgcagatgatggcctgacatggaacacaacaagggaatatcataaagagccatcggctacttattggttaccaaaggatgaagaagaacagatgcgattgacaggactacaatttgcagtcaaggagggatttaaaggcaatattctaccaagtgtagcaaaatcactcaattttgaagataatcttgccatactcgatattggatgtggtcctggagcatggattatggacatgagcacagattaccccaactgtacatacgcaggtngngatatagcagacatgatacatgacaaaatnaagcccagcctattgacattgggacttcgnggatatgacgcgaacg

SEQ ID NO: 52552 - DNA, 215 bp, Triticum aestivum
  unsure (1)..(215): unsure at all n locations
  Clone ID: PAT_TA_52552
tcttctgctcttcacgctccctcggctgcgcgggggcatccggtccgtgccgtcgtggcatgtcggcgccgaccagttcgaccagtaggaggagcaggaggaggaggagcaccgtggcggtggngggggcacggaggcggtggctggnaagaagcggcagnacttcaacctctacttcttcaccatgggggggggccgtgctgctggcgctgacg

SEQ ID NO: 52553 - DNA, 252 bp, Triticum aestivum
  Clone ID: PAT_TA_52553
tcccgcgtccgtctccacccgctgggtgggtggtcggtgacctccccgattccccacccgtccaccgagccctaactctaaccccggctgccgacggtgccggccctgcggtgcccgttcgcatgccggcgaacagccgcgtgcccagtccgcgcggcgctgctcacgcacggcgtgggggggagcgccctctgctcccgcccctacgccccgcggttcgccccgctgtgcgcccggtgctcctccgcctgc

SEQ ID NO: 52554 - DNA, 337 bp, Triticum aestivum
  unsure (1)..(337): unsure at all n locations
  Clone ID: PAT_TA_52554
tcgtttacaggacaaccgcaaaagcaaggagcgcaccagggagagaatcaatgcgttcccctgcctgcctcgccgccgccctcctcctgctcgcgttccggctgccggcccccgccgtcgccggccgccccctcgtcgcccgcgaccgcaagcccgccccgtccgaggccgcggccaccgtcaggtgggtggccgcgcaaaacacctggggcgtcctcagcacaatatcaagtgatctaagtggcgctccatttggcaatgtagtttcatatagtgatggggtaccaggtgagagccatggaattccctacttttatctgactactctnnatcccac

SEQ ID NO: 52555 - DNA, 429 bp, Triticum aestivum
  unsure (1)..(429): unsure at all n locations
  Clone ID: PAT_TA_52555
cgtcctttggtaagctgctgcattccaccgcggcggcgttcaggaggagagacctaatgcgattgagttcttcaagaatggaaagaacgatgttttggtggctactgatgttgcctcaaagggtcttggcttccctgatgtccagcacgtgtttaactctgacatgcctgccgaattagagaactgtgtccgcgggattggtcgaaccggtcgatgcgcgaaaacgggaatagtctcttcgttcatcagcatgtaaccccactgagactacgcttcttgacctcactcacctgctctcgggagcttggcatgcactaccacctgtgcttgctgngctcgttgacccgctggaggttgctgccgctattgcccttttgagcggggtcctaggctgctcattgtgtggggggcttggtcttcgtttgctga

SEQ ID NO: 52556 - DNA, 380 bp, Triticum aestivum
  Clone ID: PAT_TA_52556
gcagcattggcacctcgctgaggtaaagcgcctggtgttgacgtaaaacctttgttgatgaatagcgggttacccactgatcagctggctcaagtctggagattggctgattttgataacgacggatatatggacattgatgaattttgtattgccatgcatttgatcagtgcggctcaaaatggtgctcacctaccagagaaattacctgctactttgctgccaaataggaaattctaaataagtgcatatcatactttaataataaactaatttttatgagacggcaaccaaccatgctataatgagataaaacaaaaagagtggatataccttttttaaaaagaattgttggttgaatgtactttttttttcccttt

SEQ ID NO: 52557 - DNA, 447 bp, Triticum aestivum
  Clone ID: PAT_TA_52557
cccacgcgtccgaaaaaatgagtgaaaataatactgaagagatttcatctgtttcaactacagattgggataaagatactcaagtcctccctcgccttcaaattattgacgagaaccaaaagtttactgaagaacttccaacttacttggaaaagtgggatttacaagatgctggtttcaaatataacgttgtagctgtttttggatcacaaagtacaggcaaaagtacgttgcttaacggtttgtttggtacttcttttgatgtcatgagcgaaacgcaaagaagtcaaaccaccaagggtatctggatgtcacgtggaagaggcatgcatgtgcttgtgatggacgttgaaggtacatatggtcttgagcgtggagaggatcaagattttgaacgtaaatctgacttgaacactatggctacaaaagaagaaataattataaata

SEQ ID NO: 52558 - DNA, 558 bp, Triticum aestivum
  unsure (1)..(558): unsure at all n locations
  Clone ID: PAT_TA_52558
cccgggttcgacccacgccgtccgtctggcggcggcgcgttgcacaggagagggagcgggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccggcggggggggggtcctcacaaggccagggagtgcctgcctctgatcctcatcctgaggaacagactgaaatatgctctcacctaccgtgaagtgcaatctatccttatgcagcgtcttattatggttgatggaaaggtccgcactgacaagacctaccctgctggtttcatggacatcatttccattcccaagactggtgagaactacaggcttctgtgtgacaccaagggtcgcttccgccttcactctgtcnggggcgaggatgctgggttcaagctctgcgtggtcaggtctgtcccgttttggcccggaagggcttcccccttcccttagccccctattgatgggcccgtac

SEQ ID NO: 52559 - DNA, 544 bp, Triticum aestivum
  Clone ID: PAT_TA_52559
ctcaagtccagctcctatcctttactaaatcaacaacacgaaatcaacaacatgcgctactcgaccgccttctccgccgccattctggctggctctgcgctcgccgctccctcctacggtggttacggcagccagcacaagcacgtcaagaacgtccacgtcgacgttgagactgtcgtaaagactgcctacgtcaccgagggctacgagatccccaagcctaccagctcttccgtcagcgctgcgtacgaggccccggccaagaacaccatgcccgcctacgctcccgtcaagcccaccagcactgccgtctacgctcctccccctccccctgcgcccaccagagaggcgcccaagcccaccaccaccatggtctaccagcccgctccccagaagcccaccacctacgacgctcctcctccccctgctcccaccagcgaggctcccaagccaaccaccacccccgctgctcccgctcccgctccttccagcggaggatacatgagcattgacgaggaggcgcgtgccaagctccgcgtgaact

SEQ ID NO: 52560 - DNA, 597 bp, Triticum aestivum
  Clone ID: PAT_TA_52560
agccaagcacgtctcctgtcgtctcgtcctcgtcttccttcctcctcctccccaatcggcaacgtagattccggactatgtgggagcgctactgtcgtggagttactgctattttatacgttgtcgatgctgctgaccgggatagcgttccgattgccaaaagtgaattgcatgacctgctgacaaaacagtctttatctgggatccccttacttatccttggcaacaaaattgacaagtcagaggcactttctaagccggcattagttgatcaactaggcctggaatctataaaggaccgcgaagtttgctgctacatgatctcttgcaaggactcggtgaacatagatgttgtcattgattggctcatcaagcattccaagactgcaaattaaggtcgctgtgtgtttttgccccttcacttgtgccgagatgaatttagtttgcacatcttcgttctcatgatctggaaggagaaggtaaaaggtgacagccttgtaatctatgttacatcttgggtgtcactgagttacagtatggagtttgacacttgggcgtcaaaatctgtaatgctctgtaaattccttaaatctttga

SEQ ID NO: 52561 - DNA, 398 bp, Triticum aestivum
  Clone ID: PAT_TA_52561
cccagcgtccgggtcgacggggagccgaggcacgtcctgtgcaacgccgtcgagaagcaccacgccgatctgctcgtcgtcggcagccatggctacggcgccatcaagagggcattgctcgggagcgtgagcgactactgcgcccaccatgcgcactgctcagtgatgatagtcaagcagcccaagtccaagaactgatcgccatttccggtgttagatctatcgatcgtgcccagttccagtgctgggattgtgcgatttgcgtgcctacactatgtatccccactgagttatttctactccaatgtttgtactccctttcatatctactctgcatattggcagtcaagctatgtaaacatttgagcaaatttatagaaaaacttattaacatacgc

SEQ ID NO: 52562 - DNA, 628 bp, Triticum aestivum
  Clone ID: PAT_TA_52562
caaataatcgatgagtctcttgaacttctttattgagtaaggacgagagagagagcccattcaatacaaactatgtcttagaatataacaatatggtttagggttcgagaaattattagagtaaatacgacaaaaatgcataatcttgcagtgttaagtggttcgttcgtggcaatgatgttagtaaagagttgttgcaatttagggagatatgtaaagaagaaagaacaaagggagaaaaactacgaagcagtattgatgaattggcattaaacagtgttttcttcatatcttctaaacacaataagtatactggcatttcagaaagtacgtataaagcaatgattcaagagcttgaagaaaagtatgatgttggagaagaagtcgatttagatgaacttgatcagcttgaagttgaagagttaaggaaaatatacaagcttgcaaagaaagacatcgaaaaagcaaaaagaggggcaaataatttgatgtttgatgtagaaggaatgaaagaaaaaatgtgccaatccattgtaaactttttaaatgaacacggttcgcctctctcctctcgttacaatgaggatatcttcaccaagaaatttgttacttcattgtgatcaccttt

SEQ ID NO: 52563 - DNA, 540 bp, Triticum aestivum
  unsure (1)..(540): unsure at all n locations
  Clone ID: PAT_TA_52563
cccagcgtccgcccacgcgtccgcccacgcgtccgcccacgcgtccgcccacgcgtccgaggctacagaatgactataatgttgacgaggcatgcctagtgctaaagctaggactactatgtgcacacccgtttaccaatgcaaggcccaacatgcagagtatcatgcggtacctcgatggcgatttgcaactcccagacttgacagatacagacatgagcttcagcctgctctctcaaatgcagggtcaagggtttgaccgttacgcattgtcatatctttcagtaaacacgagcattggcacaatatctggtctttcaggaggaagatgataccaatgttggctgatgttatcatatatgtgagcttgcatgccacattttgtttactaccaagtcatgtaatgtttggggctaggttagacttctcagaggcttttcttattgtgagagtagtgcgtaattgcttttcgaatagggtttacagctcataattttaatatctaaatgaagaagctaccagcgtacttgtgggttgntt

SEQ ID NO: 52564 - DNA, 608 bp, Triticum aestivum
  unsure (1)..(608): unsure at all n locations
  Clone ID: PAT_TA_52564
cccagcgtccgggctgatacttanaagattcaaaaacttcccttccacatgaatgaacagttgaaacaatccatacgattcgaaagacaaacgaatgactcttcacttgatgggctatccattcaattcagtcatctcttcagtggtcaaaatgattttgccgcaattgacaagatgtttcttgatgccgaaggtgccatgaagacaaaggaagatcaacaagtcttgtctgacctaaagcatcaaatcacccgtctgattcgtcccgcatcaaacctggcgtcccctccacagtcacctgagcgtgagatcaaaagggcttcttggtcctcagtggtgatgagtgagcctgcaaagaaaaacagtggttgggaagagacaagagagttttatcgtcagataaagagtagtcatcatggtgctcctgaacgtgtagaacatgaaaagttccgtcaagtggtcaatggccgtgagcaggcagtagaaagaacgagtcagacaagaagaggtcatccgagtgaatctcagcagactcgccctcactctcaactgcagccaaaaaaagacaccaaacacagggagtgtggacccacaacagcaagcgccac

SEQ ID NO: 52565 - DNA, 608 bp, Triticum aestivum
  Clone ID: PAT_TA_52565
ctcccctgcctcccccaaagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggtcaagtgctaatcgcactgtatgctaaaatctatgcggtcg

SEQ ID NO: 52566 - DNA, 608 bp, Triticum aestivum
  Clone ID: PAT_TA_52566
gttattgtgagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcg

SEQ ID NO: 52567 - DNA, 252 bp, Triticum aestivum
  Clone ID: PAT_TA_52567
tggtaagtgtttatttacgaaacttgctattaacactttcatcacgaagttgagttactagttcttgtaattccttattctttctttctgaaaagtctgattcttcttctaattcttgaacccaccttttcttcttttgtctacatctataagcagcctgtcgattcttttccgacaggggagggcgttcatttgttttcgtgattttggctgatcttgcttgttgtggacgtgtccgtggcgtgttgggtg

SEQ ID NO: 52568 - DNA, 411 bp, Triticum aestivum
  Clone ID: PAT_TA_52568
ggccgccctttttttttttttttttttttttttttttttttttttttttttttttttttttttttttttctttttttttttttttttttttttttgggccccaacggctcatgaatataacaaatgttttacatggtgaaaacaatttatcggggggcaaactgagcccagggggcgtacaagattccccccaaaattacctgctaacccggcgggggccccgacaaccatatctcgttccatcaagggatgcagcagctcaaaaacacaaggatgttggttctccgggggcccgtctttttgcgggcttggagcttcatcaggcactgggggtagtctgggtccaaacaacatcagcttggtagggggaaggaaccaatctggcatgcccccctacttatgtgccaaaaa

SEQ ID NO: 52569 - DNA, 596 bp, Triticum aestivum
  Clone ID: PAT_TA_52569
aacattatataaagtaactttatttattaaatttgattttctcttacttttcaaatggtctataaatcaaagcttaaatcgattgaagaaccaaagattggtatcattcaattcatcttttctaataaatacaatactcctgagagtaaacctatattgattgatgcccttaacccaaagcgtcatattacttatggacagcttaaagaattagtacttcaatttgctgcaggtttacaagatgtatgcggattcaccagtaatgatgtacttgctttatatgcacccaatcagtacaattattctgttcctctccttggtggcgttgcagctaatggtgcagtaaccacggctaatcctaattataacgtgcaagaattgacataccaattggagcaaacaaatgctaaagttatcatttgtcacgaagaaaaccttgatacggcattagccgctgcacaaaaagtcaacattcccaagaaaaacatctttatctttggcgataaacctattaaaggcgttcagccattccaaactgctcttattaaacaacgcaaagccacacttgtcgatctcagttacaaagagactaaaga

SEQ ID NO: 52570 - DNA, 550 bp, Triticum aestivum
  Clone ID: PAT_TA_52570
cccatgcttacggtacatgttacgctagtacaagcagagcgaaaaggaccatgctggggaaagcaacctcaaggaggcggaattggtggttcgtatagacagaagtggacgcgcacacctcacaactcgtccatcttgtcgatcgtgtacaagtgcctgataaaccaggtcatgcgcggtctgaggaccaaacattccgtgctggaccatagcctggagaagctcatgaatgtggtgaacgtatacgaagcgagcgtgtgcaagcacgaatacctgggagtggacttactcagcttctaggaaattaaacactttcgctacacattctactttatggccactggcgtacgtggccaatattcgactagtacccgcacgtcaaagcctggtggcagacgatcatggcaatggcacccgccatgaatctctgcgttcatatgcgttcccaagaagtcgttattcgctaggcggcatctcgcatcgcaggatcctattccgatcactgttctgtgtggcagccttcttttcttgccggtgtcgcgaattttgc

SEQ ID NO: 52571 - DNA, 583 bp, Triticum aestivum
  Clone ID: PAT_TA_52571
cggacgcgtgggatccgttactcgtgcctcaatcaaacccactcgtatagcctctcgtgcatttgtctctacttggaattcggttccccaaggtcctcctgatgctatcttgggtgttactgaagcttacaagagagatacttctcccaacaagatgaacttgggtgttggtgcttatcgtgatgatggaggaaagccttatgtgttgacttctgttaaaaaggctgaaaaagtaatgatggaaaagaacttggataaggaatatgctggtattactggtgtacctgctttcacaaaggcagctggtgaactcgcttatggtgaagacagttctgtgatcaaagataacagacttgttatcagtcaatctatttctggaactggtgcccttcgtattggcgctgaattccttaaagcttggtatcctcatgcaaagaacattattgttcctaaccctacttggggtaaccatattcctatcatgaaaaatgctggtctttccttggaaaagtatacttattttgacaagaacacgaatggactcaacattgatggtatgttggaggaccttcataaagcaccc

SEQ ID NO: 52572 - DNA, 544 bp, Triticum aestivum
  Clone ID: PAT_TA_52572
gaagaccgcacgctcttcatgtgagatagctgctactccaaccaagtccccgccttgtcttgatgaatcgcactgtataatccctcctatggcctacgcctgaacagtgtacagctactgggtccgtaagcagcccccagggaacacactatgcatgcccgaacggagctgcctgcatggacatcggtcggtcaaccctccgaacacattcgagagcgctataggagatcctagcaccctctatgatgtctaaaaggagaaagctgaagcacctgtggctcagctctctgctgatgccgctcgcatcgatgtaaaggggcactactgaagtctgctgcagccaaactaaagacagattccctgatgccttgtgtgccactctcgctgacgttgaataatgcctcgtcactgacgacggtcttgatctgctcaaggtcgtcatcagtcttcataccttgcagggtgctaaccatgaccaacaactcgctctcaacatctatccatggaagccattcaagaccatcctcaccaccatccggtgata

SEQ ID NO: 52573 - DNA, 599 bp, Triticum aestivum
  Clone ID: PAT_TA_52573
cccagcgtccggcccatttggcactgccatagccatcatggggtgcaccacctcgaggcaagctcggcatgacctccggtactgcccgtagccgctcccgctaccgcgctgccagtcgttccccgcccgcttcgacgccggcgtccacctcgtgcggctcacgtcgtccacgctcgggtcccttgaggtcgacaaggccgccggaccgcgtgcgcccgaggtcgctgatgccggcgcgcgcgcgcccaggaagatggtgccgcgcacaccgaccatgacgccgcccaacgagcccgaggacatcgacgcgtgggcgctcatggccggcctggaggagcactcgccgttgctggccgcgccgttcgggcgccactccttctcgttcccgattgccgccacggcacagcaggagttcgccgcgtcatccaaggtcacgccgctgcccatgaggatgccttccgtgaacgacgaggagatggcgagcaaggccaaggcgccgccgcgcaaagccgtgctctacttcacgtcgctgctcagcgtgcgcgccacgcacgacgactgcagtctggcgcgcgccattctcaaggctacagggtgcg

SEQ ID NO: 52574 - DNA, 560 bp, Triticum aestivum
  Clone ID: PAT_TA_52574
caaaaaggttttagctaacaaattgaacacttggagcaaacttcaagaacactatgatgctgaaggaaagaacttggttatcaaggagttattcgaaaaggatcctcaacgtttcgaaaagtatcatcgcgtcttcaagggctctgacaagactaagagttctattcttttcgatttctccaagaatcgcgtcactgacgaaaccctcaagctcttgttggaattggccaaagaggctaaggtagaagagatgcgctcaaagatgttcactggtgaacatatcaacttcaccgaagaccgtgccgttcttcatattgctcttcgtaacctctctgacagacccatatatgacaacggtgctgatgtgatgcccgaagttcgtgaagttttggctcatatgaaacaattttctgaggctgttcgctcaggtgaatggaagggttacactggtaagacaatcactgatattgtcaatatcggtatcggtggttcagaccttggtcctgttatggttacttgaagcattgaaaccttatgcccaagaaggtttaaaaggctca

SEQ ID NO: 52575 - DNA, 599 bp, Triticum aestivum
  Clone ID: PAT_TA_52575
aaagtttgctgttcgttctgttggtcgcaagtctcttttgaatgcttcttatgttgcacgagcacactactctagtcaatcacgtattactgtcaacaatcctgttgttgacttggatggtgatgaaatgactcgtattatttgggctgatatcaaagacaaattgattttcccttatttgaagttggatacaaagtactttgatcttggtatggaacaccgtgatgctactgatgatcaagttactgttcaagctgctgaagctatcaaactgtacaatgtaggtataaagtgtgctactattacacctgatgaagctcgtgtcaaagaattcaacttgaagaagatgtggaaatcccccaatggaacaattcgtaacattttgaacggtactgtattccgtgaacctatcattatggataacatccctcgtattgtccctggttggactgagcctattgtgattggacgtcatgcttttggtgatcagtatcgttctactgactttgttacagacaaagctggtaaattcgaaatgacatttccccctccagatggatctgaagcccaaaaatgaccatctttgatttccctgaaaa

SEQ ID NO: 52576 - DNA, 555 bp, Triticum aestivum
  unsure (1)..(555): unsure at all n locations
  Clone ID: PAT_TA_52576
gcaagnaacgttccttgctgagaggccggnagtacattaggacgcagcgacatgtatcatgctcatgcccagcaggaaggaccctagacgctggcagacgaatgctaggatgagggccagtcgcaggcaggttcagtgagacgaacgtccgtagatgaaacgaggagagagagagtagctcacaggcagagagaggtaccgggcgcggtagaggccgcagtgtacccgtcgtcgccagagggaggatcgcctcgtgagtcgcnnccgagttccagcagagcggatgggcgtcgtaggaacccccgagcgcggagggtgcggggagctccaggggagccgatcacatgcccatgttctccaagcccagggagctctcagatctcctcgtggagatagccgacaagtacatgtgaaattctgaatcagcaaacttcatcttcagttatgaattctgaataattccttgagaggaatcgagatggattgcttgggtcaaaattcaaacttcagacatggatgtcacaaagaacattatggtacagaaatttaccactt

SEQ ID NO: 52577 - DNA, 423 bp, Triticum aestivum
  Clone ID: PAT_TA_52577
cggtcgctttgtcctcgggtaaaagtacagcgtcgcttatcgtacgaaacacggtgaggccgtctattgatgtcaagcgccggcgttttgtggggaaggtggtcgttgttactgttgccactcttgtgcattggtcttttcatttccttgcttctttgtctgtagggctctgtggttctttttgtcttcttttgtgcttatttttttttcgatttgtttctcttttgttctttgtttcttggtgttcttccttccttggcttttgtttgtttcctttttcttttttttttgtttgtctgctttcttttttttttttcttctttttcttttttttttcttttcccttctttttttgttttttttttctgtctctctttttttttttttttttttttttcttttttttttgttccgttttttttt

SEQ ID NO: 52578 - DNA, 474 bp, Triticum aestivum
  Clone ID: PAT_TA_52578
gcgcacagagctgttaaggtcacggaggtcctaaccagcgtcaagctcagcgccctccaagccaactactacaagaagacagagtgctacatgatcttactatgctctcaccatcatcgagtacatcgatgctgtgaatgggctcgttcattgtgatacaggcccgtccttggtctcaaggtgcagattataccccgactgcttccccgactataagatcacgcctaccaccttggtgtcttacctagaggccctacacccgcctaaggatgatgtccagctccgccttactcatatcatttgagactgaattgccgacagagcaagccaaccattatttactgcaacattgttgccctaaatcttgctttatccgtgagatatgccagggctgtgcatcacttaaatgcctatcttaatctgtcctggacaaaagtttctgtgtaatgctgctatggtcattccgtctaaact

SEQ ID NO: 52579 - DNA, 504 bp, Triticum aestivum
  unsure (1)..(504): unsure at all n locations
  Clone ID: PAT_TA_52579
cacaaagacaggtcaacctcaccgaggagaagaagggagaagcgagaagatgtcgggccgcggcaagggaggaaaggggctcggcaagggcggcgccaagcgccaccggaaggtcctccgcgacaacatccagggcatcaccaagccggcgatccgtcgtctggctcgcaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgccctcaagcgccagggacgcaccctctacggattcggcggctaggcctccgccagattagagtgtctagggttcgtggtcgttgatgtaatcgcagtatctcgctgttgtttgctatcttctgtagaatcgaatggaatggaaattggagtagtttgtctttgaaaaaaaanncnnnnntaannncc

SEQ ID NO: 52580 - DNA, 549 bp, Triticum aestivum
  Clone ID: PAT_TA_52580
atcgccatcaagcaaagttagcgttaattgataaagcatcaaacaagggaaaatcgaatgctattggatttgattatggaacaaccaaagtagtaactgaagatgacaatacaaagcaaaatgaaacaatacttgcatatgatatcctttttgctgttattattactgactaataacccatcattccttattttccttaactgatatgtttacagacagacattttagagtatgtagatgatttaacagaaagagacaaggagatattaaacaacatgtcagcaaagtacggtgtcaagagctatgctcgtttacttcgtgtagccaaaaaagatcgtgatgctgaattgaaggcactcaagaaaaagcaggatgaaagcaaaccaaaagagccaaagaagggaagaagaaaaagatagagaagaagaagacgtgatgatgatttgaatggcagagatcggtccaggcgtagatacagtccaagctatgaaccttatcggaatgatgatgaaggctctgtgactgacagtgggaggagggtgactgaag

SEQ ID NO: 52581 - DNA, 525 bp, Triticum aestivum
  Clone ID: PAT_TA_52581
cccacgcgtccgcccacgcgtccgcccacgcgtccgcccacgcgtccggtaatcaatgcagatgacacataaagtagaaacgcgttcaaaggaagaaattttattagaaccttataactatttaatatctcatcccggaaaagacattcgatcaaagctaattgctgctttcgattattggcttaatgtaccaaaagacgctctaaagattattacaaagacaattgaaatgcttcatacagcaagcttaatgattgatgatgttcaagatgattctgatttaagaagaggtgttcccgttgctcaccatatctatggtgtgcctcaaacaatcaatacagcaaactatgtttactttcttgctctacaggacattctcaaattaaatattcctgaaatggtagctgcttatacagaagaattaatccatcttcatcaaggtcaaggaattgaattatattggagagatagcttgacttgtccaagtgagggaagatacattgacatggttaacaataaaacaag

SEQ ID NO: 52582 - DNA, 470 bp, Triticum aestivum
  unsure (1)..(470): unsure at all n locations
  Clone ID: PAT_TA_52582
cgacccagcgtttgtgtttctttatcgattgttgactagctttgttatttttggatcttgtttgatttatgctgcacccgtattttcaacattcaagagagttgaaactggagttgtgttgacagaaagtttgtctgaattttatgaagatattatagatcaagtgatgcttgatgtctctgaggatatatgggagatacattccagattcaataagtcatgatgatattgaagctcgtcattccatcataaagtcaatggatcgtaatcttaattttatgcgtgctagtctattagcctctgtgagtccactggnagctactgacattccacaaataacagaactggatatgcttgaagaggaacaagnnnnaaagnnnacactgcatctactgactggcctggcacgnnggaatnaaaagatcagggatgngcgggggggggatcatggacgctgaacgggggctggg

SEQ ID NO: 52583 - DNA, 187 bp, Triticum aestivum
  Clone ID: PAT_TA_52583
gaaatatctaaagggttttatgtttatatatagtctatcaaatgtaaaatgtgcacatgtaccggggtagaaaagggatgggagataacaaatggataaattattgattcttgttcgccaattcagtatgggattcgatatccacagcatcccaaggatacactaaccattgatcaggcatctcaac

SEQ ID NO: 52584 - DNA, 310 bp, Triticum aestivum
  Clone ID: PAT_TA_52584
ggggaaagggggaaaaaattttggggtaaaaaaattaaaaaaaccggggggggcggggggttttttttttttaaaaaaaacgggttggggcatttaagggggacccactgggggcgttttaaccaaattcattaaagggggggggtgttttttttagctcccagaaattaacttacttagcttttttttatggggggggggggaccaaaaaatttaaggcctgggagggggggggggggcccccacgaaaactaggggggggccccgttccccaaggggttggcggggggacccctccgaagtggggggc

SEQ ID NO: 52585 - DNA, 389 bp, Triticum aestivum
  Clone ID: PAT_TA_52585
gggttttgagcaacatacacaaactgccccacggtttaactttcggaacgtaatgagcaagatacaagagtgttgaggcgcaccacaaagaactgcgtccgggtcatgaagcaactagaaagaaagcgctcggctgcgctgtattgggctacattatggtaacacacgatcggggtctcacagcccttactgcagcaagaccaagtcggaccatcacggcgctacagtgcagctgctaggcgcactgcattaagtcgggcgcggagcgtggttgccttagtgtcgcatgacgtgcgccggtcatgggtaggatgaacaccgaggtggtctgcgaatacgaccccgagcgtccttgacggtgagctacgtactggttgaccatgatcagg

SEQ ID NO: 52586 - DNA, 352 bp, Triticum aestivum
  Clone ID: PAT_TA_52586
gaattaataaaattactttttttttataattgtctgttcttaacccaaatgtaaaactctaatgcttttttcaagttgacgattattgtttattttttttttggtgacaccgacggaacgtccacaacgaccggtttttttggtgtggtgaccacggacacgggcaccccagtagtgactgataccacggagagcacagagcttttttgggacgcgtgggccggggcctttttttccaaaccgggacttgcccgcgtaaaggctttccctatggggggcccaaggatagctgggcgtcccatggccatagataaaaaatgagtgaaattgttatacacccacaatggcacac

SEQ ID NO: 52587 - DNA, 563 bp, Triticum aestivum
  Clone ID: PAT_TA_52587
aaagatgaattattttattcaacttgacacagaatatagtttttgtccaaaatgtggaatagacactacacaattctcacacgaagatcactgtccacatgcttcaagataataatgtttgttttgctggtgctttttaattgtatcaaaccataattttctagttgaatctgtcatagtaaataaagtgagatgttgatcatttgtacaagtatttttaaatgtgattggaaaagattcattgtattgatgtgtgttgggtatagaaacttgtaaatcttctagcggaataggcttttgatataatttgtaatattctaattgttgaacaagtttaactttacaaacaacaaggtagttatcaaataaaaatagttgtaagcttgtactctttgtacgcttcattttgcctctcattacaagttggcgtttaggatttaataactctagttcaggtcctttaaatggtaatattctattggataattgctgtaaatgaaaagtattgtctgataaacctacttgatgattcaattgaatcaagaattgtgtgattagatcca

SEQ ID NO: 52588 - DNA, 505 bp, Triticum aestivum
  Clone ID: PAT_TA_52588
tcgcgatctagaactagtgaagactggaaatttattatgcactttataaaagaataagaatagaatacaagcgtaaaataataaagacaattaaaaataaaaacgtaaacaactataaccattaaaatcaaagttttgctctggtcggcaagtgcattttgcataatctgttggacaatgggtgaagaagttggctactcgatatccaactgtatcccaaaaatggatatctgatttagttaaaaataatgttgcacctaaagactgaattactggatcgccccatcgttcataaaatatgccgtttgactcatccaaataattgaagaatgcctgatacttttctcctctataaaagccaacattagcaatctgaagattattccataaatgacaaccattaaaagtttttgtaaagggatcctgaacaaaactccaaagtgaagatgaatcctgatctgatttgatccactcaggatgttttgcagcaaagtcgagtacagtt

SEQ ID NO: 52589 - DNA, 352 bp, Triticum aestivum
  Clone ID: PAT_TA_52589
agtattgaaaacaccttattgattattatttatgaaaaatacacttgctgtccctcatgctcacttttacatgggaggaagagctaaaatcgtgctatgtggacaccatgactaattggccgagtagctccggcaattgttttatattaggtgccatacggtatagtctttgccgtgtgcggccaccttgaagccttcgggaatgaggtgccccacattgtatcttggcccgagcttgatgatgaccttgccgtcaatctcggcacgggaaaggtcgaagtcagcctgtatgatatgcagctcgctctcactgagcatgccctgacggatcctgattgacactacgctaacg

SEQ ID NO: 52590 - DNA, 334 bp, Triticum aestivum
  Clone ID: PAT_TA_52590
caacccaggggcattattattttttcaaaacaagatataaaagccgggaagagggtagaaatggttaaaaaaacaaatggggcaacgggaaataatccacacacgtggggcaatcccgggcagttacaagttaaaacggggttaagcttttgggggaggccgggaaagaacttccctgggggccccgccaaggcaagctcggggtcgttgggcgtcctgcccccttttttgccggaaaaggggccgaatccgaacgggctgccccccttgacctcgtttatggaaaacatgccggccccgggcgtgtagcccacgggcacaaaaagcatgcccg

SEQ ID NO: 52591 - DNA, 257 bp, Triticum aestivum
  unsure (1)..(257): unsure at all n locations
  Clone ID: PAT_TA_52591
accacaccaatttcaggattgccattacaaaggaaatcccaaaattataagaaaggttttaagaaatttaaaatttgaaaggtggggggaccaacattggggaggtgggtggcaacctttggtaagagcaaaaattttggagagggggtagattttagcntaaagggggattggggtttgaccttttttaggccatgtgcagggggcaggaaagtggggtagggggtttcctttttggggggggggaggaggagggg

SEQ ID NO: 52592 - DNA, 227 bp, Triticum aestivum
  Clone ID: PAT_TA_52592
agcagccgccctccttttttttttttttttttttttacatggtcaaactttttccagtgagtactccttttttgaagaacatatagcggatttgagagcaacgatagcacatgaactctcaaagtttaatcagccagctaggggaggacgaacatttcacagaagcctactgctgggaacctaggggccaaaaatctccaccagccaagggaagaatatcacaacaa

SEQ ID NO: 52593 - DNA, 348 bp, Triticum aestivum
  Clone ID: PAT_TA_52593
aagaaccaaactccaaaggcgctcaaacatgtgatataatgagattaaggggaagttatatgttctaacacatgaggggtctcaggctttcgcaagggtgcgacggaaatacaaagagtcccttccttgtgatgaagtttctaatactagcattctttgcaagtgtacgacgggaggtgtaagttggattgttaggtacttaaattccgcgacgtaacgcagtaacgaatattggcgaacccacctaactgtaagctttctctgacgaattagggatgctctacactaaacgtggggagggagattatgccttgattgagttgtgcactggctaactgaaagtgaaat

SEQ ID NO: 52594 - DNA, 602 bp, Triticum aestivum
  unsure (1)..(602): unsure at all n locations
  Clone ID: PAT_TA_52594
attgtataaaaacttagttttattataaaattagagtaacacgtcaagtgtttttacaaacagcttccttcgttgatatcaaagtaactcaagtgatcaaggagagaggtgaaaggaacgatagagttactgcaatccttggtttcaatttcagaagtacagatttgaacgttggaggtaccagacttaatccaagattcaacaccgggatgaaggaatccgaaggattgaggaggaacgtgaggaacgatatctctcttgtgaacggtacgttggaaaggaataccggtagattcaacatagtaagcaaaggtggggttaccaacacgaggaccaccaacagtgaagatgctcaaattcttgggagacagtcttggttcacgttggtagagatccataccggcaagcaaagcttgtgcaccaccgagtgagtgaccggtaacgatgaccttgtaagtagggttggcggtcagttgttcttggacgacagggaaatagtcattgacaacttgctcataagaggaaaggaaaccagcatgaaccttggcgcccttgacaggcttgtagtcngaaaagttgaagacaatatcagtgatggcact

SEQ ID NO: 52595 - DNA, 647 bp, Triticum aestivum
  Clone ID: PAT_TA_52595
gggttacaaatatcgcattcaactatgaacctgtcaggacagaacaccctgctaggaaaccatacacattccaagcgaccggactccatgcgtgctacttaggaagaagaaccaacgccccagtccgccatgcagaactcccgaggaaaagagaaactcggaccacatactgtgttgtagcgacagacaccaagaaccctaatcacgttccatcttctcagcacgtttatatttccatatccatgaacaaccatttcttgcttgtcaactcttcgccctggctgaactcgtcgagcgttgtgaggccgaagccgatccagcccagatccttcgttacgttggccagagcggcttggtcgacgtcgcggtcgatgcacaggacgagacgatcgcaggagaagtagtcgacttcgcagagttcgaggagggccatgagaccagccttcaaatctccgttgatgacagattcatcgaagaagatgaacatggccctctcgtcttccttctgagcaacgaaaccccggaacctaatgccaccaacgtagtcccacatctcaatgtagtcggctatcgcacccttctcctcctcgaaccgcaccattttaggcgcagcagagtcagtcgaagagtccgagtagcgacgagca

SEQ ID NO: 52596 - DNA, 455 bp, Triticum aestivum
  Clone ID: PAT_TA_52596
attgaaaaaaaaagtttcgtatgtgatatctacaatgaaataaagatgaacaattaaacgtcaggcataaatgttgattcaacaatgatgctagtgactttgtaaggatcaatgttggaggcggggggggggtcttccaagtaacccattccttcaataccgacatgacgaggaatacggatagaggcgccacgattagcaacaccatagctgaattggctaatgtgtccagtttcatgtctacccgtcaaacgttgatcgttatcttcaccataaacagcaatatgttcattgtgacgcaagcccatcttgttgatagccttttcaatggcaacaatttcacctttttggcgcatctccaaggtagaaaagttggtatgggaaccaggaccgttccaatcacccttgataggcttagggggaattgagaacatgataccaaaatttttcagaga

SEQ ID NO: 52597 - DNA, 408 bp, Triticum aestivum
  Clone ID: PAT_TA_52597
aagaaaaaaacttttccatggggaaataactcatggtcaacaattacattattcagtttccatcaaaacataaagcccctttggggggacagagcaaacattactgggattggaattaagccttctattaagggctccattcctttaaccctgatcagcattacttcaggggggcaggaccaggggaattaacgggacttgatgaagccaatggccttggggttggtggggaaacactggctggagcacataaacccatactttctgatcaggccatgggaggtcccacaaacccggcaaacccgggagccgggcccgtagtttttggggggggaggtccaaacgttggagggccccatttttttgtttgccttccccctgccccccccggttgctaggaagcccgtg

SEQ ID NO: 52598 - DNA, 450 bp, Triticum aestivum
  Clone ID: PAT_TA_52598
gggggccggggggggtcccggggaaatccggacgggggcggggggggggcccaattttccttatggggggcgggattaaagggggggccaggcttgaaaaaagggggccccggggggaaatgggaatcccttgccgaacccaaaaaaagtgggggccgggggcctaaaggggaaagcccgggggcctaaaggggggggggaaaaaaaataaatggggggggggcaaaggggggtttccaaatgaaaaaaaaggggggcccacctggtttaaaaaaccggccaaaacccggggaggggggggtttttttttttccccaaggggggggtttattggaaaatggggaacggggcccgggggtgggcctttttcccccggggcctaagggggtttagccaaggggcccaccctggtttccccaagaagggaaaaacccgggttaagggggggta

SEQ ID NO: 52599 - DNA, 175 bp, Triticum aestivum
  Clone ID: PAT_TA_52599
ggggaaaaccacgggagattttatttagggggggggttacatgcatgggagggcacctggtttggtcatgggggggggggcttacatacatacaaagacccttgatcaggggggggtacatgggcctagaggggggggttttttgaccatagatatgaagcatgcccccggggca

SEQ ID NO: 52600 - DNA, 313 bp, Triticum aestivum
  Clone ID: PAT_TA_52600
caacaaccaaatacccccaaaaaaaaaaaagtccttccttcctaccaccagtgataaaggcccaaaaggccaaggggataccccataaaagtttcagccctttaagttaaagtcctcaaaaccccaacttttgaaaaaaaaaaggggaaagcaacaagttcctaattccttttcctaaaaacccccggggtgcccccccccattggccttttttgggttttttttttaacccctccctgaaggccatcccccaaatgaacttgtaagaaaaaagtcaatgtttttttaaaattcacccctacccataaacaac

SEQ ID NO: 52601 - DNA, 403 bp, Triticum aestivum
  Clone ID: PAT_TA_52601
attaatagtttttaccggttctaacttttaatttgattcgtctttatactttacaagcttgcggttagaaaaagaccccctttggaggggggggggataaaaaaaaaaacatagcgagccggggcgcaccctaaattaggagcctgtacacaagcaaaaaaggggggtgggttaggggccgcaccaggagcgggtccccaaagagatcctaccttccggcaccaaaacgcccccctgaaaagggcccgaaaaacggggttaaaaacggcctatggcaaacgggaaccccagcggaatcccccggggggaccccaggcatgcccacccaaatctgaaaaaaaaaaatcccccaagaactaggcgttgggggggaatccccccacaataaaacaccccagcctac

SEQ ID NO: 52602 - DNA, 408 bp, Triticum aestivum
  Clone ID: PAT_TA_52602
aaagaacaaaccatccttaatggaaaggaaaaattggcacgggtttggacaaaaaaaagccaggttttaaagggaaaaaaaaccaaggccggattccaaaacgggtccggagggaaaaattaaaagggggaattttatggggcagctccagatgggaactagctaaaatgggaagggatattttggggggttccaggatagttccaggggggaaatattatgggaacaactaaagagtaaaaactgggttaaaacggattcggcggccggcaaaaggaaaaaaacagggatgtccccaaattgggccgggcccttaaacttgggcggttaaaaaaaaaaggcacactaaaccaccttggttcaaacacgttaaaaaagttgggcaggggaaaaaagggttcctccggg

SEQ ID NO: 52603 - DNA, 377 bp, Triticum aestivum
  Clone ID: PAT_TA_52603
gggcaaaatcttttgtttcaactattgggtaaaagccgggggtttggccgaaacacaacccccccaattttacgaaccccattacaaagccaaaaccacggggggtgaaaaagttttcgagacacttaacaaaggaccgggacgggcaccaaaatgggagaggcttctggcccccattctttgcgcggaccaaaaataccgcccaccccaaagaacttagcataactgggccatgggcacgggaaccccttcagcccatgggcaaagaacaagaaaggggggccaacaaatcccgccccggggggggggaacaccaagccgccatcatgatgcctgctctccccaacaaagaactgaagggacttgagcccgctaaa

SEQ ID NO: 52604 - DNA, 601 bp, Triticum aestivum
  Clone ID: PAT_TA_52604
gtagctgatgtaataataattgatgagtaccgaatgcgattccataacaatgcacggtagcgtatgcgactgtgcatcacacacgtacggtacagccggcgacaaaagaaaggactgattcacaagaggatacatgtacgatttgcacgactagctcgattagcacatgcacgaacgtacgaaaagaaagctcaatctaaatcgagaaccgcgaactacagtgtggccgatcgatcgatcatccatcgcactcacgcacgccgttatttgcttataatgaaaaaaaaacagaaggaatgcgcgcgtctgtggatggatcaccagccggtccgacggacctagcaccggctgggcacgttgccgatgccgcacttggaggggatctgcatggcgcggcgggcgtcgatgttgcccgcggacgcgagcaggcccttcttctgcacacgcaccggaggttggctcccctcagcgcggcgcagcactgcccgctcggcgtagcctcccggctgcctctcgcgcagtacgacctgcacgcgccgatcatgcggtacacgttcacattggacatgatgaggcgggccgggcgccgggccccggcccg

SEQ ID NO: 52605 - DNA, 384 bp, Triticum aestivum
  Clone ID: PAT_TA_52605
caccggaaaaaccatgctttgcatactttaaaggggaccaaaccgaataatccaagaggcccctttggttaaccaccaacataccagaccaaccacgggttgaaaaaacaacttgcgctacagaccaccaccatcatcatcatcatcatctaaggtctaaaattttggggaagcagttaacagggcaaaggaaaggttgttcggcgacatcggaaacttattatcatcatcatcatcatcgcgcaggtccttgtgcagtagggaagtaaaaaaccagggcaggacaggccaatcagtcgacgacctcttccgtttttttgggcttggacgggaggtaccagcccagggcactcaggccggcgagggtgccagccagcacggggt

SEQ ID NO: 52606 - DNA, 344 bp, Triticum aestivum
  Clone ID: PAT_TA_52606
aaaaaaggcccattttttattatagcccaggggggacaatacatgcttggtacgggattccttttattatagcccctttagctagttccaggaaataggaacgggcatgaatccttgcaggggggctgccatgcaaggaacgggggactactggactttttgtcctgggaaacaatcccagttagtatggtttttgtccaacaacattcccggggggcttgtatttgcaggggaaaaaaaccccccggttgttgttgcaaacaacccgagcccaaccgatgttggtcaaccccccccacaccacctggggggtagggcccgaacaccttccccgacgcgcaggg

SEQ ID NO: 52607 - DNA, 526 bp, Triticum aestivum
  Clone ID: PAT_TA_52607
aaaaaggcacaaaccatcggtgcccaaaaatggaacgaacctcacagggtccccaaacatccgagtgaatcatttcaaatggtttggcactttttaaacctatactaggataggaaccccttgtatgtttagctaactcacaagcatcacatacaaggagctccttgggacacaacttgaaaagagaggggtaaatacgtaataatgcagcaaaaaatagatggccaagcctgcgatgatggagtagcagttcttggctaggagacaagcatgaggcaaaagcaacttcatcacttccttcatcaagatagtagagtccatcatgcacggtcccagtccccaacagtctccctgtcgctagctccttggtgtgaattgatataaaaactagattcagctttagaggaatcctgggaagtagatgagccttctgagagcctaagcttggaagtaaaatcctcaagagctcgcacatcgaccactggtagcttccccttggatgtagtgaggttagcttgttttttgt

SEQ ID NO: 52608 - DNA, 379 bp, Triticum aestivum
  Clone ID: PAT_TA_52608
acatgggagtttttttattaaaaaacatataaaattttcgttttttttaaaatagccttttataaagccataataactgtcatagccaaagtcaatgcaaatccaaaaaaggggcctgcgattttaacagcctcactactcctttcaaaggaagccttttgaaaaataaaaaaaaaaaaaaaaactcctttcgatgtttggttattggatgaaaaaacgttggtatttacgggaacagctgtattttgataaacacaaatcctgtttgagcaaagacattgtccacccacaggatcccaccagattctatcacaattgttgggtactaaatgacgatatttggcatccgtactggctacagcacttgccgggtgtagga

SEQ ID NO: 52609 - DNA, 290 bp, Triticum aestivum
  Clone ID: PAT_TA_52609
atagaatgattaccccggtatctgcttcaatacgatgcatgcatacttattattatacaatgtcgccatataatacattgttggatacatgtttgcatagcgagccaaaataatataaaaatttccacaacagccgattaagctcgcactatatgcactgattaagcacacatgacctgcatacttctttatttctccttattcatgcattcgtgagccagcatctatgtgtgcaggccatagcaagccaggaagagctatccatctattcaacatggggggtctcggcc

SEQ ID NO: 52610 - DNA, 289 bp, Triticum aestivum
  Clone ID: PAT_TA_52610
gcatattcctggtcgcgtgattttattaaacaagattagaacagcaggtcaaggatctatctgccttaataaattcgctcatatttaatgattttagttttacatttcttttttctttcaactccttcattagtgcattttctgattctgaaaggccttgttggtaaataacaaccttccctctagacaggctgaggatttttggggggatttgttcagggatcttgataatattgtcccagccctttgtgtggccttcgagctcacttagtagatccaagcctgcctt

SEQ ID NO: 52611 - DNA, 190 bp, Triticum aestivum
  Clone ID: PAT_TA_52611
ccagggctcacttattttttaaagttcatccaaatttgctgcccaacagcagcaagttcaaacccaaccagacataacgctagaccacagcccggtaccaacaaaaaacagaccaaacgaggcccccctgacaatcccatcgaaggacacaaaaagacaactgacttgggaccccaaaaacataagcagt

SEQ ID NO: 52612 - DNA, 546 bp, Triticum aestivum
  Clone ID: PAT_TA_52612
attaaggcgaatgatacaagtaaatcactcttccaaattaactaaaaagagtaaaacgggatttagccaaaggtaacaacccacatactgttttcggcattctccttatagccagacacttcattagcaccttcttccaaaagcatttcgtgagagtgaagaagtctgtctgtttcaacatggagaaggacaaaagggtgaccaacacgccaaaactattttcaaacaaaataagtttctctttatcctcgaagctcttttctacttacatcatcgtattgcccatcgactccattgaattgttgaaccttccagacatcattttcatctgaagtctcatcatcaccaaaaccagagacctcttgctgacctgaaacggcactttgaataccatgtgtatgtaaattgacacgtgtaggaacgtgcttgagacgaacagggtcatcccagactacttcgtaaccgagctcttcttctgtttcagcaggaggaagaacaatccacgtactttcttcttcaggagaacattccacagtgaaaatcttt

SEQ ID NO: 52613 - DNA, 108 bp, Triticum aestivum
  Clone ID: PAT_TA_52613
aagtacgaacacacaatggcacgctcattgagatagtcgaatcatggaagtccatatgctgaaacttaaggagcacaggcccccctcagagcgatggtaatacaaaca

SEQ ID NO: 52614 - DNA, 627 bp, Triticum aestivum
  Clone ID: PAT_TA_52614
agtcacgtacaaagtagatgaacatataccaacaagcaaataataagtacagagtactcatactcatcacacatgcatggaacaataaaaataaatggaaccacttattctagaaatagcacagtgtggcgccgtatggggtgtcctccattatggggtctcctccatcaactgtcatatacaagtatcccatcaattgtgagccgtcggtggtttgcacttaggaggcggcttcggtttcggttcattaggcttgggctccggctttggttcgggtttcggcattggctcgggcttaggaagtggctttggtttggagcagggcttgggctttggttttggcatcggcttgggcttgggcttttgtccgggttttggttcgggctttggtttgggtttgggcatcggttcaggttcgcatggctctggctctgggtgtggcgtaggtttgggcattggctctggtttggtttctggctttggctctagctctgcaaacttctcgatggcggcaaggcctcggccagcggcagctgcttggttgaaggcagaggctgcaactaccccgatgaggagcaacgcgaaggaggcgatgcctcaccattgctgcctacttcttgtgcttgc

SEQ ID NO: 52615 - DNA, 481 bp, Triticum aestivum
  Clone ID: PAT_TA_52615
aaaaaaaaataaaacttttttatttgtatttatcaaaaaagttgatttatgtagcacaaaagggcaacgtttgccagttgatatccaatcaattgggggggcaatgcgtcttattggccctgattggctcttggctttgggtgggggaagcccatggaaaaaggatttttatgacttggtgatagggcttgaaattttaaaaaggctgggggtggtaaaaaaaaaacacttggtcgaatactggtcacttcctcttggtcatttaacaaagcatactttgagaacttttcattatcaccaaaaaatttcataatcttggcgggttcctttttcgattgggatttgtgcaaaatccaaagcaaaccaagggctaaaaggacaaagactaccacaggtgtgcctaaaacaccccaaagccaggccttgatgacatgaaaaacatcaggtccctgaaacagagaccatcattggagcaagagcc

SEQ ID NO: 52616 - DNA, 239 bp, Triticum aestivum
  Clone ID: PAT_TA_52616
gagatgcaacttgagctgagcacaaactcgactattcataaacagacatatgaccaccactctactgatggaaatcatcaattgggaaccaatgataatgtcgagaaaaatacaatcaaagcagaaaaaaaaacgcacaatctcgaatcctagccaatcacaaaactccaatcctagccaaccacagcaacctagttcagtttcagaaatggccccagttcaacagaccagcagcaacg

SEQ ID NO: 52617 - DNA, 537 bp, Triticum aestivum
  unsure (1)..(537): unsure at all n locations
  Clone ID: PAT_TA_52617
aacaagtcaacgatatgttttatttgttgtagaaaaaacttaaggagatgttattattactccttaaatgagaaagagaggcaactttttcttttattagtcactgtctgaatcatgatcattatcttgaatatgttcaaattttccttctctctttgctttagtaattggattttcaacatcaacaacgccagtcttttttaacctttcaaaaagtacaaataacttttcggcttctcgttccttttcctcatctgtcatgtcggctaaggatggtcctgcatcttctgcggatatatactggccagtgataggattgatattttcatctgcttgttgttgttcatcatttggtagttccactgggatacctttatttactaaatatccaatagcgttaccataacctacttgttttgtaaagttgtttgcatcttcatcacataatataaaatatgtttcacaaacagcagcnnttgtgtttgcggtagcatttgtacttgtccataagtttgattaaatatgcagacaaactgt

SEQ ID NO: 52618 - DNA, 483 bp, Triticum aestivum
  unsure (1)..(483): unsure at all n locations
  Clone ID: PAT_TA_52618
acaaaattaacgcaagaagtattaattctcatcatgtcacaacatttatatatttttcaaggaatcacattactaatattaactgctgctgtagctgtagctgtagtatgaacagatcaagagagctgatgcatgagacgatggacgtgcggcgcagatcacagcccgatggagcgcagcacggcggggttgacggcggtggtgttgccgtcgacgacgaggttgtggccgctgatgaagcccgcctggtcagacgcgaggaacagcgccgcctccgccacgtcggccgcgcgcagcaccttcccgcgcagcacgttgtgggcctccgtcatggcctccatctcctcggggcccacgcccaccaccgngcagctgagcggcgtggtcacgccgccgggggacacgaggttgacgcgcacgccgtgccgcccgagctcgcccgccgcggtgcgcaccaggcccatcggcgcttgcttggacgcc

SEQ ID NO: 52619 - DNA, 253 bp, Triticum aestivum
  unsure (1)..(253): unsure at all n locations
  Clone ID: PAT_TA_52619
ggagcgggtgggtttccaatccatttttcaaaagtccacaggggccaaagtacagcaaactcggggggggggggaacaaccaaacatggatacaacggggggggcggccttacagagctggttgggcgggcgttctcctttttttttcccgcgggggggttttttgggagcgtttnttcatttgtttggggggggggggggggggggccttaacgtgctaaggggtgatcctggaacggtggggttggggacg

SEQ ID NO: 52620 - DNA, 331 bp, Triticum aestivum
  Clone ID: PAT_TA_52620
attcatgcacgattttattacgcacgttgatcgaatacatacattttcggcttacatgtgcgtacgaatgtatgcaaacagaagcacgtattttgatatatttgaacggacaaacacacacttattcacgactatgggcccaagacccaggcatggtcacgcacgggcagaagatgacctgttggtaagtgccggcggcgcgggtgaacatgctggtggcgaggggctaggggtagctgtaagcaggggtacactagccgtggaagaaactggactagaccgtcggcccggagatgttggccggccaacatgtgcagcataaccggggcgg

SEQ ID NO: 52621 - DNA, 298 bp, Triticum aestivum
  Clone ID: PAT_TA_52621
ggaaaaagcgaggaggagcactggtttacattcaaggatcacaaagatatctcataaattggttctgtatggaccggcacttgattcaccaccggggggggttctgctcatacccctatatattctaaaaaaagattattttattgaacttgaaatatgcaattccccccattacatcgcaaatcgcaccccggcgtggtctcccataggctcatttttccttttttaccaagaaaggggcaaatagttttttccaaccttccgtactaaactttaacaaaaggggtggaagcaactt

SEQ ID NO: 52622 - DNA, 541 bp, Triticum aestivum
  unsure (1)..(541): unsure at all n locations
  Clone ID: PAT_TA_52622
gacatatgaaacccttcttttttattctaaataaagaaaggggtattcattctacttgattcatgaattggcatttcataaagtttaaaatgattcaattcctgtttgatttcttgggcaatcatcggtgtcaatcgagtacagacagcctcagcatccgaactacgatcatattcttgccttgaataagtttcatagacagaaatatgactatcaaaatgtaactgagctaatttcttttgaagtgtacaagtcgaccatcttttgcgattcggtttttttaatatactttttaatactggctgtcttgacttgntacgaaatgagcaaatgggtacaccacaaaggggaagacgtgaataaagcatggattcatcctgattgttgacagttgctgtggtggaccttcaaccctgaatcattggacatttgcccattttttgggttttttttttccaaaccccgccttaaatttaaattccatttttttggaagtttttttttttttggggaaatgggggagggggggaacccggggggg

SEQ ID NO: 52623 - DNA, 133 bp, Triticum aestivum
  Clone ID: PAT_TA_52623
actactccgtgagctgtgacctctgcatgggtgcctccctgatcaggctgcacttgcacgactgctttactccacggctgcgatgcatctgttatgctgtctggcatggaacactagcgcggctccgaacgtg

SEQ ID NO: 52624 - DNA, 243 bp, Triticum aestivum
  Clone ID: PAT_TA_52624
gggcgggcgaatttacagttttacagaagcaaatttactgggtgcggtcttcccagatcgggatcatacacgcttttacagctcgacgcacgcaccacaaactgaattgagtgaccgaccgatcgacggatcccaggactgattgattcaaagcaaaccaggggagctccgcatacatgcctcatggtatgcggcgaccgggcgcgaaactaaaacgactgatgacgctaaggaagggggaaa

SEQ ID NO: 52625 - DNA, 358 bp, Triticum aestivum
  Clone ID: PAT_TA_52625
gagaaaagaactttatttgtttattaagagggcattgggcccgagacgacacacaccaccccaacgccttattacaggggggggcgcccggccgtaaacctgccgttctggagatggggaggttttggggggccttaattttaggggcttccctcatttttgaagggctggggatggggggggggattcctcccccccatttttggggcaggccttatcttaggtatttaacccatgaggggtgggctatttcgaggtgggggaggattagcccgttactaaaaggtggttggggattggaggagggacaagggacgatgaacccacgcccgggttctccttggggaaggggtcccag

SEQ ID NO: 52626 - DNA, 331 bp, Triticum aestivum
  unsure (1)..(331): unsure at all n locations
  Clone ID: PAT_TA_52626
caatcacagtttgtaattcttcttctgaataaattctaaagttgttttcgggtgtaactgatgcaatttgaacattagtcttgttcaatttctcttccatcactgactttaatacacttaatgcaagtttctctgcttcctttaatgtcatagatttatgatattctttttgaagttntgtttgagctccttnagatccagatccaattgcttttgcttggtatttcataaatgtaccagaagggtcagtatgaaaaagctgtggtccattttcatctactccagcaataagtaatgcaacacctaaaggacgactcataattgacttttg

SEQ ID NO: 52627 - DNA, 578 bp, Triticum aestivum
  unsure (1)..(578): unsure at all n locations
  Clone ID: PAT_TA_52627
caaatgttaaaaattatatntattggcttttttatttcatcaccactttgattttccttttcccttcttctttttactgcttgatttattggtactgactgttgtgggtttaggaatagattctactacagcagcggcgggttgctctgtagaatttgattttttcacaccactgatattggcactgcctgttccaccaatacctccaccttcaacagcagcgccttgaggccccttattagctgctttcttgttcttgcccttcatacggaaagtagatcgttcttgcttgggtaaccaacgttctgggtcaggctggacattagggtccatgtttttaggcaataaaggagttctctttttcttttcctttggtttctttacatgaacgctgttgggatctttcttaacatatccacgctttactcctggtacaaccttctcaagagtatcaatatccaaatgattgagcgcaatctcaggcaatgcatttccatattgttcagccttggcgggatccacttgagcataagcagcaataagaccagcgacagcttgagcatcagttggatcttctt

SEQ ID NO: 52628 - DNA, 240 bp, Triticum aestivum
  Clone ID: PAT_TA_52628
aggctgggcatccatgaatatctactaatatgaaatgggcagcttggactgctctacaccaacattccagtggacaattgttatcagaacagccacatcaatcatgattggctcaatgattgctaggatacatcatagatgaaagcaaatcaaatgcactgttcttcagatgggccgccctagcaacatcaccttcgacagctggcgccagggcagaatgatccaagataccttgagtat

SEQ ID NO: 52629 - DNA, 512 bp, Triticum aestivum
  Clone ID: PAT_TA_52629
aaacaaacttttttattcatcgggaaaacactcgggggcatttggaacatgaatagatatatcactaccgcttaacagcgacaagctcaagggcaacctttttgcggaaaacaagctgccctgtttcctccatatcgatgtcgtcctccttcatcccctcgggaagctcccagtcgaagcagtacaacagattggccagcacgacctccacattggccacgcccatggcgatggcagggcaagcccttcgccccgacccaaacggaaggagctcgaagtgcagtcccctgaaatcaacgtgcgcctcctcaaacctctcggggaagaactcctccggcctgtcccatatgtccgggtctctccccatggcccaaacgttcacgtgtatcctggtgcccgcaggcacgctgtagcctgcgatctcgcagctctgcatggtttcccttggatcagcagagtcctcggtgggtgcaacctgaagttctccttactaccatcttgaggtacttgag

SEQ ID NO: 52630 - DNA, 290 bp, Triticum aestivum
  Clone ID: PAT_TA_52630
aaaaagagcgataaaaaggtttttcgggatctgataagcccgagcacttggggctagacccttcctttccaccgtcccaaaaaagcaaaaagggggttcgattaaacatccccagacccccccgatggccatgggggggccaggacgggccgaaccccccgtaaccttcaaaacttccgttcgccgccgggtttaatgacggggtttgccccccccattaaacccttgttagggccgccttttgggcctctcccagtatcgggaaaatcctccgtggggtcgttccaggg

SEQ ID NO: 52631 - DNA, 207 bp, Triticum aestivum
  Clone ID: PAT_TA_52631
cgcagctatcacttgcattttcttcatccatttaaactgagttcaaacataggattccaacattacatcccactccatgacagaagggattgctgcatcaccgacgaacacgaccgaccgaccgactgaaagataacacatgctgtctcttcctcgcataacccgctctagattatccccggaccgagcgacgctcgagcccccgat

SEQ ID NO: 52632 - DNA, 442 bp, Triticum aestivum
  unsure (1)..(442): unsure at all n locations
  Clone ID: PAT_TA_52632
cgtcgtcgtcctccacgtccagcgccacggcggggaggaggccaagcacgccgtctgggccaagtccggatccccgctgatccctctgtccgagtaccgggagccggaggtgatgaagaactacggcgtcacctgcgacgccgaggtgctcgacatgctcgacaccgccgcgcgccagctcgagctgaaggtggtggccaaggtgtactggggcgacgccagggagaagctctgcggcatacagaaaacacaataggctccatactttattcggacgcagcaacggagcagaaaacgatgaagcacatcccgatgcacgccgatggcgaacctaacggtctcccttgacgactgtcacagggcacgacgcgttcgacagcacgtagttcgtnacgcttcccataagaatcctctggatggtgccgaggccgcggctgcccca

SEQ ID NO: 52633 - DNA, 628 bp, Triticum aestivum
  Clone ID: PAT_TA_52633
cataatgggaaagacttcaacgtttatttggatctgccgcagctggcttaggacagggaatgcaacctggcatggatacacctactgttgacaatgctgaaatggtttatatttcgtcattagctcttttaaagatgttgaaacacggtcgtgcgggtgttcctatggaagttatgggattaatgttaggagaatttgtagatgactatactgttcgtgttattgatgtattcgctatgccgcaaagcggtaccggtgtttcagtagaagccgtcgatcccgtctttcaaactaaaatgttggatatgttaaagcagacaggaagaccagaaatggttgttggatggtatcactctcaccctggttttggttgctggctatccagtgttgatattaatacacaacagagttttgaacaattaaatcctagagcagttgcagtagttgtggatcctattcaatcagtcaagggtaaagtagtcattgacgcattccgtctaatcaaccctcaaactgttatgcttggtcaagaaccacgtcagacaacctcaaacattggtcatttgaacaaaccatctatccaagcattgattcacgggttaaatagacattattattcaattgctat

SEQ ID NO: 52634 - DNA, 584 bp, Triticum aestivum
  Clone ID: PAT_TA_52634
cccagcgtccgtttttttttttgaaagtataatattcataaacaaaaacataatatatactttattagtacattaaaagaaaactctgtacattgaaataaaaaattaaatgaaattttaataattatcgccaacccaagtacgggcattacggaacatcttcagccaaggacctacttgtccccaattttgatcagtaggataccaagaattactttcctttaagacaactctttcaggatgaggcatcatggccaatacacgaccgttaggtgtaccaatggcagcaatggctcctgttgaaccgttaggattgaaaggatattgttgtgttgttttgccatagttgtcaacataagtactgagagaaagtccttgagcttggaattggttgtattcttcatccgatttgaaggtagcctttccttcaccatgagcaacagcaattggcagaatagatccttccatgccattaaagaagatggactttgtattgtcttcaattttgaccaaagtagtacggccttcgaattgttcagattcgttacgagcaaagcgtggccagttttgggcaccgggtataa

SEQ ID NO: 52635 - DNA, 526 bp, Triticum aestivum
  Clone ID: PAT_TA_52635
gccacacctacgtccaaactgaagctctagcatattctcaccggagttctcacagctctactcaaaactcttcaccaatggccgacgtccaagtccaagccgtaacccacgccatgcctgtcgaggaggctccggcgccggctgcggagaaggctgtcgagacggccgaggctgcggaggaggctgtcgagcctgccgacgacactaccgaggagactacggagatagcggaggagattgtcgacccggctgtcgccacagtcgaggaggctgcggaggaggctgttgagcctgccgatgacgctccccaggaggacgctaatgaggaagctgctacaccgctcgtgaccgagctggagaaagatccagcagcaactacagaagacaccaaagaggccgagcacgaggcagtccacgctgacgacgccgctgatgaggcccctgctgcgccgacagtagacgagaccaatgagcctgaagctgccactgacaacggaacagagacccaagaggtggaacctgatgc

SEQ ID NO: 52636 - DNA, 388 bp, Triticum aestivum
  Clone ID: PAT_TA_52636
ggggttgggccatctttcattttattaaaaaccggccctttcaatcattggtcctaaggccctaacaattttcttgcccataactggttcaactttatcttccaagggacgtttaggggcttgtttacccacatgtcttggtttaaggtggtcagggggcattggtaattcttcttggacaaatttggtggatgcttctgccaggggcaacatgcttgcaacacttttttcatttaccccaggggggtcagaaaagttttctaatggaagaccggggggcccgccctttttgggtaaggggagcaacatcttttcttctaaatcattctttctggaggggatagcaattgaataataatggctatttaaaccgggaatcaatgcttgg

SEQ ID NO: 52637 - DNA, 509 bp, Triticum aestivum
  Clone ID: PAT_TA_52637
gtcacaaccgaaccagtttatttgtggagaaattaaccacttcctcccatccaaaatatatgccgcagttttgaactaggggagtagttatattcttgtgaactcgaatagaatgaaataaaatctcgcagtgaacctctgacgcagttcagttcagttcagagtgaactacgcctagtcaccaggtcagagcgagctaagcttaggtaccgatggtatgattttcagttcagtcggagcttagctatgacctgggcatcaacgtcagcttcaaccgcagcaaccgtagtttgatcttcttgggcttgagcagctgcgccgtgccatctctgcaggcccttccggacgttctcgccgtcgtccgcgcggtcgcggaaggtctccatgtcgttgtccatgttggcgatgatggacacgagcagctccctcttccaatcctcgatacgcgcgaaatcgcagtacttttccccgaactcgtacattttctcaggatccacgccggcgatgtc

SEQ ID NO: 52638 - DNA, 415 bp, Triticum aestivum
  Clone ID: PAT_TA_52638
actacaataatattccattcatttcatcatcacttaccacagcacaagcgacacgtacatctagcattattcatatgcctcaagaacatgcaccactactacagataaccaagaacttaacacgaacgagcgatagagattgacctaacgacgtaattaagcgacaaacacaacaaacaaatcgagttctccaaacgtacgtacgcgcggcgtatagcgcccacagaaccatgcatgcacgctacgagtagcactaccgaaccatcaaccatccgccccgtcagtgcttgccacaccaagcaagagcataattaatcaaccacaagtccatttgcgaagcactctcgctccgatcacaacccaagaccaccatggctgacaagtgcggcaactgcgactgcgccgacaagaccca

SEQ ID NO: 52639 - DNA, 407 bp, Triticum aestivum
  Clone ID: PAT_TA_52639
gtattctatgttttattttattaaaggttacactgtttttgttgcggttccagaggacggcattaaggagccgcaggccacattatcggacggctggagcgcgggctggataaggcaccacccgaccaagaacgccgccgggcacgccgagaaaacgccaacccaaagggcaaccggggggcccgccaacaccgggaggccaagcgaaaagcacgggggccccaaggggaccaagcggccggacaccagaaaaaacagcgacgccaacaaaacaggagagctccccaccggcaactacaaagaaaaccggagggattgggccactgagatccccaccgcgatcagagggcagaacccggccggagaccctcgcacccgaccaaacacctgaacggaacaaggccggg

SEQ ID NO: 52640 - DNA, 337 bp, Triticum aestivum
  Clone ID: PAT_TA_52640
ggaagccaaagggtttctatcccgcaaatatacgggcacaaaagtctttatgaaactttaacggaaccctatacaagcccctggcacatttaaaaggttcaacagagtaatatcaaaaataatcaaccctggccttaagccctaacataaaaaaattataaaattttacccatgacccccccccttattgacatgctaaaacaggcaaatcaaaaaaggggcctcaaaggctttcaaatcccaagaaacaaaggccgctaaaatcttaaactagccctaaaaccctttaagggggccattcacaaatgaaaaacccccgcaaacctcggggtcaacc

SEQ ID NO: 52641 - DNA, 407 bp, Triticum aestivum
  Clone ID: PAT_TA_52641
accgcagaaggaaaatgccatcatcatttagccagctgcatctctacccttggaatttctaggcttaatcttgcaatgctggtctggcctttaaattaatataagggtaccttaacaacaaacccacaaagcttaacaaaaacataaactgtgcaggacacacctcaattcccagtttggaagaaatgatggattcatttggaaccacgtttcccaaatgttcagataataaaacaacaaatgttgaatgtacatttatacggaaacagcggcggtgaagttttatcatgttttctcaagccaagagaagatttgaatacagccctcagctcggtgttcagctttcttgagcggtttcggtcttcccaaggtgctcatactggctgcagtctgctcctatgtccttc

SEQ ID NO: 52642 - DNA, 531 bp, Triticum aestivum
  Clone ID: PAT_TA_52642
agcgaccaccgagcaatcaagcaagcccagctcataggcggccagaggcacaaaacaagccgggagcgacgacgatggctgcggcggcggggagcggcggtggcggcgtggtgaagcacctcgtcatcgtgcagttcaaggaggacgtgacgccggagcggctggacgggctcatccgcggctacgccggcctcgtcgacaaggtcccctccatgaaggccttccactggggaaccgatgtgagcatagagaacatgcatgacgggttcacgcacgtcttcgagtccaccttcgagagcacggagggagtcaaggagtacgtttaccacccaacgcacgtcgagtttgcaactgatttcttgggttcaacggagaaagtcctcataatcgacttcaagccggcagctggcaactaatggtttctgccaagtgagactcacagagcttatgttgccgcctgccttatcggggttgcttgtttgtgtttatgttccaatttcatctgggattcacaagttatgcaccttgtgc

SEQ ID NO: 52643 - DNA, 564 bp, Triticum aestivum
  Clone ID: PAT_TA_52643
cccacgcgtccgcccacgcgtccgcccacgcgtccggacaggtgttctgatttggggccggcggccgggatgggctgcttcggatgcttcgccccggcggcgcgccgaggggccggcgacctcaagccctccaagctcgcccaccactgcaccgacgacgactcagtcgcggacgcgcagaggaaggtggcgccggacgtggggagcggctgcgcgcacagcttcaccttcaaggatctgctcgtcgccaccggctacttcaacgaggccaatttcatcggcgagggcggcttcggcaaggtgtacaagggcaagatctccaagaccaactcgcagatggtggcggtgaagcagctggcccgggagagcgtgcaggggaggaaggagttcctggtggaggtgctgatgctcaccgtgctcagccaccccaacctcgtcagcctcgtcggcttctgcgcgcagggggacgagcgcctgctggtctacgagtacatgcccttcggcagcctcgagagccacctttttgatgtgcctcatggcaagccaccactcgactgggataca

SEQ ID NO: 52644 - DNA, 575 bp, Triticum aestivum
  unsure (1)..(575): unsure at all n locations
  Clone ID: PAT_TA_52644
agaagagaccgtcgagcttcttcttgcagatatcgttccccttgtggacctcggagccggcacggtggctctcaaccagctgggacgatatctgcaagaagaagaccgtcgagcttctcgaagtgcttggcctcccgaaaggcctctttcctatggatgacatcgaggaggtcgggcacaactgtgagagtgggttcgtgtggatacttanaaagaataagaaaaagcacatgttcaacaagctcaaccagaccgtcttctacgacactgaggtgaccgcttttgtggaaaagggcaagatgaagaaggtcaccggggtcaaggtcgaggagttttctttggtcgaggtctatgtggatgagtcttctgctgataaggtcatcatcaagaccgacaccggtctggctgacacccatgatgcggtcgtgttcgctctgggagaataggaagctactagttaagaaagccagaggaataaagtcagtgaatagtttggcactacagttcacatgttatgcagaagtatatgtttccgttttctttataatccaataaagaatgttgcatgaatgttg

SEQ ID NO: 52645 - DNA, 543 bp, Triticum aestivum
  Clone ID: PAT_TA_52645
gtgatacattaaagagattggtttttatttttataaagacatgatattaagtgttacacctcaaggtattaattaacttgaaagcgaattaagctgctaagattaagaatctgaaggttaaagagaaaactagtgattatcattgcctattttgttatcctttacagtaacagtggtatcggcatccttgagaatagtaacatcattatctctaaccaaagggtcgaaaataaggcctcttttgcggaggtctactttgtttccattcaatagtttgttatgatctatgttgaccttagtcttggcatcatcagctacactaacagcattatctctaaccaaagggtcgaaaataaggtctcttttgcggaggtctactttgtttccattcaatagtttgttatgatctatgttgaccttagtcttggcatcatcagctacactaacagcattatctctaaccaaagggtcgaaaataaggtctcttttgcggaggtctactttgtttccattcaatagtttgttatgatctatgttgacatc

SEQ ID NO: 52646 - DNA, 205 bp, Triticum aestivum
  Clone ID: PAT_TA_52646
aaaacatggcaatcagttatctgactaaaaaaaaaggtatatctcaagggtcctgaatctgcaaaaattattgaagatggattgaagtaaagcagaaatgctttcatctgcccaagtgacagggacagaacgaacattacacaagcaaaataaaagttgttgttcccactgcgccgggcggttcttcgtctactggtcgtgcgtt

SEQ ID NO: 52647 - DNA, 300 bp, Triticum aestivum
  Clone ID: PAT_TA_52647
caatcaacatttattaaatgtctttaaacagaaacattacgaacgacatcatcaatagcctttgcaaagtactcgacgttctttgatgaaagaccagccatggacacacgaccattgtctgtgaggtaaatagaatatttttccttgaggaccttgacttgaggagccttgagaccggtgaaggaaaacatgccgatctggacagtgatgtggtgccaggtaccaggagtttgaagttgtgcgagatgatcaaagagagcctttctcattgcggtgatgcgatgagacatgtatgggaag

SEQ ID NO: 52648 - DNA, 319 bp, Triticum aestivum
  Clone ID: PAT_TA_52648
ggggccaaaaatccaaaaaggaaatccctgggggggcccctataatcccagggggggccaatccggaggaggggtaatttggcaaaaatcgccaaaaaatttaggaagggggtggaaccaaccaacaacaggaaaaaaccaaaggggaaaaaaaaaaaaaaaaacaaaaaggggggggggaaactttatgaaatttggaaggggttttttcaaaacagccttttggcgggactttaaaaaatttaaaaaggttcagggtggtaaaaaaccaacggaccgggctaatttttttgggcgggccaaagggggcctaaaggag

SEQ ID NO: 52649 - DNA, 397 bp, Triticum aestivum
  Clone ID: PAT_TA_52649
caaggaaaaaaaccgggcataaatctacttaaaaagagggcggaatcccatacaagtaaaggcgcaggctttagtcccgttggcccttgtttggccccaaaaaactttaatataacgaaccgggttcactttaaacagccactttaccagggcataagttttttccttgggggggggcttcacattttgggctttttttctaccttggcctttaaatctttggaccggagattctggagttttttttcacattaaacttaatcggaaacttgcccttggcagtttccaaaaatgtttaagaaaacaccatgtcgacgtcccccatgtggttttccagcgccttaaccataacagtcttttattaaaaaaaggcccccctcccaaaaatcggggtttg

SEQ ID NO: 52650 - DNA, 149 bp, Triticum aestivum
  Clone ID: PAT_TA_52650
cgggatgacacaaggaaattccacccacatttatttctggtacaaactaaaaagactcaacgtggccggcgtaaaaaaagaacacactgacaccacacacacacacacacacatgcaaataaaagcaagcaaggcgcatgtgaacatca

SEQ ID NO: 52651 - DNA, 500 bp, Triticum aestivum
  Clone ID: PAT_TA_52651
gtaaacaaatttattcgctatttttaaaaaggtgaacgcgtcctacatcatcattcgcagcaataatgttagataatggatgatgtgaaataccaatgatttctgaattttgacttaattttgtttcacctataatctctgctgttttagtactaaagcaatacatggtgcaatcttcagaaactgcgtataaaagagagccttgatgagaaactgttccagcaataaaatctttggtgttgttgttatgtttatatgacttgataatttcccctcgaccgttcatcaaatgtagttgattacttttgttgacaaggattacatggttaggatcatctggtatacttagtaatgcatgaattgtgatgttgtctttagggtagcaagagatgcaaccaccactgctgatatcccatatcctgacttcaccatcactgcttgcactgattgctcgtgtatactctgaagtataaacaactgaattcacaaatgcattatga

SEQ ID NO: 52652 - DNA, 351 bp, Triticum aestivum
  Clone ID: PAT_TA_52652
ggcaaacaaaacacgcataaaattttttattattcgaaccaaacaaaggggactacgtacgggggtccgtagttacatacggtcatccgggcccatacaaagatcacatgaactaaaccggggatttattttattcgaaaaggaccccggaaaaagctagcttccaaaacatgggtcctggttgctagccaagccatagccagatagttaggtagttgggcacctaagggcgggccatggcctccgggacatccttgggggcccggcaaaaccggatgcaatccccgggggacccacggggggaggagccccaccgacaacacgggccgtagcccccccccccccgacccg

SEQ ID NO: 52653 - DNA, 452 bp, Triticum aestivum
  Clone ID: PAT_TA_52653
acctcaaacagtttatactaaagaccctcctttcttctcacgaagtcgatcatgaagcagacaacaccggtatatactcgccgtaatggtagatttatctttcacatatgatttcatcaaaatagagacatgcactcaccgggacagtagatttattcttctgtcttataagggcagattaatttatttctgatgtttctagggctggtttagtgaggcgtactcggcagggtgcgcgacgaggtaagcctcgaccatcttgagcaggtcgaggtaccccgcgacgagcgccgcctggtcctccgccgacagcgccccgctgccgtcgagcctctcgtactccaccctgagcttcgccacgcaagcaccctccccggccgcctcgagcttcacctcggccacctgcgacttgagctggccgctcaccttgctgtcctccagcacctgcgagt

SEQ ID NO: 52654 - DNA, 300 bp, Triticum aestivum
  Clone ID: PAT_TA_52654
aaaaagggccaggccaccattaacaggaggattattaaattttattacagggcacagggccttcataatacatcaacattatgggccctctcccaccagaggcaagcaagacaagaatacatttaaaaactttaaaccagatcctttgaacttttcctccacgaggggacccattttttctcccatttttttgctcataggggtcacccagccccaaaccttccttttcctaaacagggaggagggctggataaaaattttacctcctgcacgctaagcaccgtctgttttgttgacccc

SEQ ID NO: 52655 - DNA, 412 bp, Triticum aestivum
  Clone ID: PAT_TA_52655
aaaaaaaaaaaaaaaaaacttttttaagacagaatgaaatatttgcccaaaaatgttacaaacgacctttttaccacttcctattcacttagtttttgcgggaaagagcagtaaccccaggaagctccttaccctcaagaagttcaagaggggccccgcccccagtagaaatatgaaaaacttggccttcagcaccccatttgagagcagcagtagcagggtcacctccaccgataatagtagtagcaccttacttggtggcttcgataacagcatcaaggacagccttggtcccgttagagaatgcctcgaattcaaatacaccagaagggccgttccaaacaattggctttgactttaaaatttcctcacggaataatttggttgattgctcaccacagtcaaggccttg

SEQ ID NO: 52656 - DNA, 423 bp, Triticum aestivum
  Clone ID: PAT_TA_52656
tttttttttttttttttttttttttttttttttttttttttttttttttttttttttttttttttttttttttttttttttttttttaacggaaggaaacaaaatttccccaagggctataaatttctggcacccaaacagggatgtttggcaacaaaaaaggggccggggggggatctagggaatgataaaaaaaaccccgggggggaggggcggcatatgaggaaaagggccaatacttttcctttttttgggggaaaccacattcactatgaaccgacactggttgctcaaagatggcataaaaaaaaaagaaagggcaaaaaaaaacaaaaatttattcaggggaacacacttttcaaaaaacccagggaaacactgcccaacaaagagctgaacacatgggtcctgagggccatgaag

SEQ ID NO: 52657 - DNA, 534 bp, Triticum aestivum
  Clone ID: PAT_TA_52657
ggtatcaaagtagtacagacagagttgctcttacaatggaccatcggttcaatacaattgacaccgcgacgaccaagtccctgtttgttcatggggttggccaagatgccgctatcaatccacatctggtcaaaccagcggcacattacatgcatggcgtcttctcatggataagttacctggaatctgctcacaaggccccctcccggtgtttgctatcatctcatggcaaggaaacatcatgcttcatcatcgctgtcgtttccgaagacggaagggactttcgtggccatctttggcttcttgctcatgctgccaacaggtgccttggaaggggtcattttggagaagccaaacttcaatgttcggcgctgatcctgattgcccggggtaggcaagttctttggcgtagcttgctctcctgagatctctggttggtcttgcttctctttctgctgctttctatgagcatctgccagttgggcaaattttgccagctccttctcttctcgctgttgctcacgttttctgcct

SEQ ID NO: 52658 - DNA, 541 bp, Triticum aestivum
  Clone ID: PAT_TA_52658
agttaaaaaaaaagagttgaagaatatgatacaaatgcaaaaaaaagtaataaaatactagtgagtatgaaaccagttcataagaaatataacaagaaattagtccaatgaaagtgtacgctcgttaaattcttcaggggttgatgatttagaatattgagcagttaagtgtggttttaagccttttccaaaatttgataagcaaaatgcagcatttataattgttaaaacaaccagtactaaagatacgcttgcaaaaaacgtgaggaattcgctcacatatttatatttgtacgcctgtgttgcatcgtaaattcgataaagtttgaaaatgaaataggcaacaccagcacataaacccaaaaagaaaagactaattaaccattttgattcatgtcttacggcgtaaacagctaataacaagatcagacaagtcacaggcagtgcaacaatagttaaaggaaattcataatcatggggtttaagaaccaatacaagatattgtatggaataacccaagaagaagaagaaatccaatttt

SEQ ID NO: 52659 - DNA, 436 bp, Triticum aestivum
  Clone ID: PAT_TA_52659
ggtgaacggggaagaaaaagctttgttttttgcattggaggtgtctctgagattaataatcatgagcaacaatggacaaagaaagatcttccttgctgttttaacgatgccgttttttcggaatttgctttagaggaaaaaaagtttgggcaactgataaggggggtgaataatatttattatcataagccgttggggcccaaagggtatgaatgggtgggaatctttggaaatttggggcaatagtttattggtttggagaaagagctggcaacatatcttctatattttttaatctttcttcaaccgattctaaagcaacttttggtaacccatttcgtttttcatcgttctgcaaggctgtaggataaatacagttccgtgctgatttttgacaattgcgggaaggttggtctccattgcattttggtttttt

SEQ ID NO: 52660 - DNA, 395 bp, Triticum aestivum
  Clone ID: PAT_TA_52660
gggggaaaaacgatgatttattcaacataaaccggatgggttttcaccaacctgttgcaaaaagatggggattacagctttttttggcagaagcccaagatacctgtcccaacaaatctggggaagtaatagtgtgctagggcattaggccataaatccttccagcttacaagaatagtccccataataggggactcccgaatggggcccccaattgcacttgcggacaatcgggaggactgggctcttgtttcacttccaaacagcacaagtcgacgggcagatcaaatccaacgttaccttcaaacaatagtttttttgcttgctacatcagggaaaaaatgtccgactgcgcctttgaacattaaactcggcctcgatgaggccagttttac

SEQ ID NO: 52661 - DNA, 545 bp, Triticum aestivum
  Clone ID: PAT_TA_52661
cctcacaaacaaaagggagtgatttattatttatttacaaaacaattaaaaagaaaaataatcatatttactcgctttcaaagacagcggccatacccatgccagtaccaatacacatggaagtgacacccaccttcttattctgacgcttcaattcagggagaagggtggcaatttgacgagcaccagtacatcccaagggatgaccaaaggcaatagcacctcccttagggttaaccttttcaaaaggaatacctaatttttcgacagagtaaacagattgagaagcaaaggcttcgttaatttcataaatatcaacatcctcaatcttcaatccagcacgttcaacggcaacaggaatagcataagcaggtccaacacccataatcttgggaggaacaccaacgacagcagaagtaatgtatttaccaataataggcaaaccgtacttttgagcaggcttacgcttgatcaagagaacaggaggaggaccatgggatacttgagaggcgtaaccaggcggggaactacccgggagatgaaaa

SEQ ID NO: 52662 - DNA, 465 bp, Triticum aestivum
  Clone ID: PAT_TA_52662
aacaacgtgctatgaatatagtgtatcaatagtgagggaaaagatggcacaattgctttgatgagagtagttggcagctcgaagctgaatgagatgctgaggctacttgggctagtcccatagacgcttgaagaccgcaccactagaggtcgcgagcctgataaacgaagacagcatgaacatgaagcgacttccaagtaacgtggaatgcgtcaaggactggtaccgcgatggggtgttcacactgtacattctgtacaacgtgaccgtagacaccctctactactgtagagcagtacgactgggttagatagatatggcgcacaccctaccacgtctagattacaagcggagattactccacactttcttcacacacataataatgcaccaggtgactctactatggggcatggaaggaccggggaatgaacatatatggcaaagaccggcactaactacttg

SEQ ID NO: 52663 - DNA, 289 bp, Triticum aestivum
  Clone ID: PAT_TA_52663
tcgcacccaagttcgctggccaaaagctcgcctccagtgctattcagcccaaggccatccacacactcgagctctacctcgactatgtgtgccccttctcggccaagatgttcaaaacgatctacgagacctctctccgcaagacaattctcgagaaatactccgaccgcgtcgtaaccatcttccggcaacaaatccaaccctggcacccgtcctccaccctcgtccacgaagccgcctacgccgtacaaaagggtcgacaggttcccaaattctgggactttttcac

SEQ ID NO: 52664 - DNA, 257 bp, Triticum aestivum
  unsure (1)..(257): unsure at all n locations
  Clone ID: PAT_TA_52664
gctagcagctatgagcgtcagcaagtttattcctctcatacctattcttatacctcaagccaaaagggaaactcttactcctacacatcctcatcctatgatgatagttctgatcctacttttacccaagaggattactctgnacnnccaaaccctaactacccccnatgccacctgnatnaccaannaacacaaaattccccccaaaaagggggggggngnnnnnnnnnncncncncccccccccccccccnnnac

SEQ ID NO: 52665 - DNA, 408 bp, Triticum aestivum
  unsure (1)..(408): unsure at all n locations
  Clone ID: PAT_TA_52665
cccacgcgtccgattctttctcaaagacacctccaacagaagaacaaccctatccatcaccttttccaacctcactggctccaaggccttatacatctcaaagcaaggagacctctaccacatccgcatcctttataaatgaaacctttttgatgactaatttcgtaaaagataaaagcctctttccaccgagaataacaggatcagaaaacagttctagcagtagtcattcgtcaaggagaatcgaccgattcaatcctatttaatttgcataaacaaacttacaactgtaccgctttttataataatttatttgaaataataataaaacaacattgaacagtnaaaaaaaaccacaatacaatacatacacccaaaaaaacttataaaatcaatgaaaaaaagaat

SEQ ID NO: 52666 - DNA, 397 bp, Triticum aestivum
  Clone ID: PAT_TA_52666
ggcatcaacagcacaatgggattgattaaatggctacagttcaggacgtacacttagttcgtagacatcaatgacaagtttacagcactcatgctgagtggacaaggaccctccaagatgcgggtagggcgggtcacattcttggggatgccgacacagaccgggcgttcttaacataagtaggtgctcatggtgcaaacggagccatgattatggctgaggaacatgggactaccacccgtggcagtattgagcttgaatctcatacccgttggacttgtggttgcaagagtactctaccttgtacattttaccggttacatgaccccaactatcgtacaagaagttgacgccaccaatctagcattaagccttggtgctgaaccaagaaccaaat

SEQ ID NO: 52667 - DNA, 302 bp, Triticum aestivum
  Clone ID: PAT_TA_52667
atagataatagaaatatgtaatttattcaataaatttaggtccgtttttaaaatgaatcgatccttagttcttttggaatatggcagggtttccattctgcaattggaatgtgatctgattattttgaacagtaacagatttgttggagaacacatcagtcaaagtatctccattagagaacgagccagcctttacagtaattgtgtttgttgatccttgaccatagttgttgacaacaaccagagagccgcctgtttggaacacatagacgttgtcgggtggagcaatggccatgtggact

SEQ ID NO: 52668 - DNA, 538 bp, Triticum aestivum
  Clone ID: PAT_TA_52668
atataataattttaatttttattatttttcaaccaaatcacaacaagttgtgtttttttttcaaagtgggtaaacagaattaagcaatttatttcttaccggccttggcagcggccttggtgaccttaccggccttgtcgaccttttcaacggacttgatgacaccaacagcaacggtttgacgcatgtcacgaacagcgaaacgaccaagaggagggtagtcagtgtaagcttcaacacacatgggcttggaggggatcatcttgacgatggcagagtcaccagacttgacgaacttgggagtagcttccaaggacttaccggaacgtctgtcgatcttttcgatcaattcagcaaacttacaggcaatgtgagcagtgtgacaatccaaaacgggagcgtaaccagcaccaatttgaccggggtggttcaagataatgacttgagcggtgaaggaaccggcttccttggcggggtcgttcttggagtcagaacagacgttaccacgacggatatccttgacggagacgttcttgac

SEQ ID NO: 52669 - DNA, 445 bp, Triticum aestivum
  Clone ID: PAT_TA_52669
ctagggtcactcataaccttccttgcgcaactgccctactactaccgtcatgtagtcacttgacattcttctccaaccactcttcccactgctccgccgtccacgaactgctgatctcattgttcacaaccccatcgaacacaactgtaggggtaacatgcacacccgtcagtcgattcgctttcacctgcaccttaacatcatccgtgaccccgtttcctgagttcaacgctccgtcctcaccaggcttatcacttatctccaacagtccataaaccttggcttcatcaacacccacagacccggcgatcttggccagtcgcttgtacgtcgcgttcctcgtctcgttgaccaggcttacatcgaagaagtctttctgctctgcaaacagcttctgtgaaaagtcccagaatttggaactgtcgaccttttgtacggcgtaggc

SEQ ID NO: 52670 - DNA, 524 bp, Triticum aestivum
  Clone ID: PAT_TA_52670
attaccaacaaatcaaaacagtagttatttaacatttaaatgggagattgacatcaataggatgagatgcactcatctgtggacgttgagaatatttatcacgtaagatttgacgaaggctatttaagagctgatgataagactgatatggatcttgacgaagtgatgtggtaagagcatagctcatagctcctgtagcacgaccagcttctttagcatctgccgaagtttgatcatctttacatccagaaaacataattacatcggccaaagttgtatttctttctcgtacaccatcagaaatctggcgagattccagtagttgtttaccaagtgacatgattgagctcaacgcgccatccttatctcctcgagcgtattgaataccagctgataaaatacccataccggcatgtttgaacaaattattttccttgatctctccttttgttgaataaacatagggtaaatcgagaacagtccctgaatggcaactgtcaaagatagccgtcaaacgacatcct

SEQ ID NO: 52671 - DNA, 311 bp, Triticum aestivum
  Clone ID: PAT_TA_52671
accgaaaaaaggcacacttggttcaccattatccataaaccaacaaggaacaagcaggccacaggatataaggggccattagaggccctacttggggggggggaattttatttaggggaaaactaccccggggggggattacggggccgggggaaccccaaccttgggcggaagttcctccttgatagctccgacaaccctggccttgaaatttcctttctttaaaaaaaggaaggggggcatggcccccacgctgaattgctaaaaaatgggcttaaattcatcaacggccaccttgaggaaaaaaggag

SEQ ID NO: 52672 - DNA, 246 bp, Triticum aestivum
  unsure (1)..(246): unsure at all n locations
  Clone ID: PAT_TA_52672
gattcggaaacaacattaattgcaattaatcttggaatcaacactaattgcagcacgattactgttagatgtacaaggttatgagaagatgcacaagttaaagacaaggttacaagaaggcacaaggaatcacaaggagaccccccaagtccccaatccaaactcaagcccagtgtgctgcagctacagctccacaaggcccttgatgcagtangtgcccacgaggaaccacccngtcatgacggc

SEQ ID NO: 52673 - DNA, 549 bp, Triticum aestivum
  Clone ID: PAT_TA_52673
aacaaatgaaagaattttatattcataataatctcgtatcaagattacatcgcaatgtcgtgtgtaatctttcctccgtctataacgaagaaatctcagaaagaatgaaattgtatagacaacagcgaacagagtccccccgctaaaaaaatcgtcgatccatctagaacacgatggcggcggcgaccgctccgacgactgcgacgaagctggcggccgatgagtaaacggcggagctcgcgggggtgccggtgggggcgccgatgggtgcgccggtgggtgtggcagagaccgcggacggcgtcatcgcggagggagcgtcggtggtcggggcagggggagatgccatcggggacggcgacgcggcggttggaggggtggcgaccggcgcgggggcggtggccggggacctcgccggtggcgccggaagcggggccatccggggcgccggcatggggccctgcgcggcggcgccgacggcgaggagggcgaggatggcggcgacgaccgcgaagcgagccatccggttcttgtcgacggtgaaagcct

SEQ ID NO: 52674 - DNA, 355 bp, Triticum aestivum
  Clone ID: PAT_TA_52674
aaccggacaacggtgtttgtattattatttcaaataaattattctaaaaaacggaccagttgtaagtttgtttatgcaaattaaatagggtggaatcggtcaatcctccttggcgaaggactactgctagaactggtttcggaacctgttattctcgggggaaaaaggtttttattttttacgaaattattccttaaaaaggtttcatttataaaggatgcggatgtgctaaaagactccttgctttaagaactataaggccttggatccagtgagggggaaaaaggagaagaatagggatggttttttgaaggaggtgaattttaaaaaaaaatagaacccgtgggacgaccca

SEQ ID NO: 52675 - DNA, 561 bp, Triticum aestivum
  Clone ID: PAT_TA_52675
ggacagattaacatgctctttatttccggactagaatgatattcattcttaacaggaggcaaaatgccgaagcacatagcttaagcctttcttatgtgtgcacatgaaagatacagtagtgaacaatgctcaacacaggcaatagtactcccgtacaaagttgagtcacttattttgggacggagggagtaaatgatagggggagtcaacgatggttgtgcgagtaatcttgatcgccccgtattcaaatgctaacaaaaacaaggttataatccatggaagatgctgcttgtctaatcagtggcatgtctcttggtgaattgagtttattccatggaggggcccaggagcgattctatggcaaaattcagacgcgaacaccatattcagatatacggttcaccctttcttccaggacatgtctccggtttttcaaatcagaggccatggaagccacctctgctcgtaattcaagagactgtcttgtaggaataattcttagttgatccatcaaacctgcagctgtggattctgctttgtaaatagatcttataacggact

SEQ ID NO: 52676 - DNA, 560 bp, Triticum aestivum
  Clone ID: PAT_TA_52676
gttctcagtgtcgccatagagatggccaatgttcacaacgtcttgctccgcgctctaaatgctatatatcaccaagcgcccttcattcaactcgcgggcgatgttgcggatctcatgttgtacgtcaccgcatgggcggataccgtgcaccaccatcactcccttgaagagaccatgttctttccaaagatagagcagatcgcaagagaggcaggcatagatggctgggaaggcatgatgggaggaaacgtggaccagcatcatgagtttgagccgaagattacagggctggtgaagtgggccgaagaagttgggactggagagagaacgtatgacgcggcggagctgaagagcctgatcgatgaattcgcacccatcctcactcagcatctgcatgacgagatcgataccttgatacgactcgaaaagtgtgatggagaaaagatcaagcaggcgatgaaagaagtagccgacgaaggagcaaaaactgctgatccgaatctcgtcatcccgttggtactcggatgtgtcgacagaagctatcccggtagtggtagttt

SEQ ID NO: 52677 - DNA, 584 bp, Triticum aestivum
  unsure (1)..(584): unsure at all n locations
  Clone ID: PAT_TA_52677
agctcataatcggctccactcaggtctacagaccgagcccgcctcgcctcgcagaggcttactggacctctccttcaagcaggggcacaccggagcctacgcggggcttcacgccaggagctggctaaccatcaacagacccttgcggcggcgccggcgcccgacgcagagctggacggagagacaggagagcagcacggaaagctcctcgcgctgcgcctctacaaggcgctcaacgcccggcacgcgcgccgggcgcaggagctgcatcgccccggacctacagtggtggtaccatggcccgccggcgcaccaagacatgatgcgactgctcaccggtacagggaccaacgccgagtgcaagctctgccaccgctccggcgacgccttctgcttcaccgttatttacgaggggagcacagactgcgcctgcccatttctatactcgaaccacgcttgaaccagcaggctccgatggggtgtgcactcagctcagggagtacttcaacaccgacctcaccgtcacccgcctctccgccgcggnggccaccaacaacgccagcgcgggctcccctagccactcc

SEQ ID NO: 52678 - DNA, 575 bp, Triticum aestivum
  Clone ID: PAT_TA_52678
gagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggatt

SEQ ID NO: 52679 - DNA, 293 bp, Triticum aestivum
  Clone ID: PAT_TA_52679
taataaaaaaaaaaaaaaaaagaaaaacgagatatagaagaaaaaaaaaaaaaaaaaaataaaaaaaaaagaaaaaaaactaaatataaaaattaatataaagataacgaaaccatgcatacataatacaaagtcatactgggagtgggactggaaaagtacgctttttggttggaacgttttcaaaatggcttggcgggggggcctttttggcacctcgtgcccggggtttcttggtggttttgtaggccgggtggccttgcttttattgagaagttgaggccagttttttt

SEQ ID NO: 52680 - DNA, 333 bp, Triticum aestivum
  Clone ID: PAT_TA_52680
gcttcgatgtgaatgcattcgactaccataatctaccgaggcagatgttgcggcttcgagttacctcaatgaatacatcgggtagagtgaaacaatgtagtcagataagaggaagccggaatgtatacaaagcgtgcctgggcctctattgtcgaggtaaattgcaactgcagaagctacatgaaccccaatagtcttcattcatcacacagaaaacctgtgaacacatagaagcttcagcgaccaccatgatgtgtcagttgttggactttatttagacctgtgacgagggcatgggagaaactggggcggactcggatgggcccattgatc

SEQ ID NO: 52681 - DNA, 223 bp, Triticum aestivum
  Clone ID: PAT_TA_52681
aaaacagaacatcgggggaaattttggaattggaaacataacggaacaaacccagacttagatgaacaattcgcccctcagtttacaatacacaccggcaaccgccttaaaaacccccaaatcaaggggtgagcccatcgcccccccccgggaaacaaactagcctaaccaacaggggggtgcggggccccggttgttgaaaagggtaacccgggggtggggg

SEQ ID NO: 52682 - DNA, 99 bp, Triticum aestivum
  Clone ID: PAT_TA_52682
cccctcttgcaaactaaacacgcatcacatttcttattattcgaaccaaacaaagaggactacgtacgtgcgtacgtagctacataccggacgcgtggg

SEQ ID NO: 52683 - DNA, 314 bp, Triticum aestivum
  Clone ID: PAT_TA_52683
cgtatcgtatcgcgtaacattccgtaatatgtactcgagcaagaagaagaggagcaggagagcgacgttacactcatcaatcagagtgccagtcactcgcctggctctctccaaactcgctcctatagcgcctacacaaccaaaaagtcaacacaccagcactcgaacaagatagaaacagcggcaacagaaagagcactggtgacagcgagacacaaagcaaatcgcacttactcatcccttccgcccccgtttacgctgctctcgccctgcatgcctagtttgcttgcgtgcagctttggcaatgcactctc

SEQ ID NO: 52684 - DNA, 453 bp, Triticum aestivum
  Clone ID: PAT_TA_52684
atggcaagcttttttatgttactttatttggctctctaaagtacactggtggcaaaggagctgctgttgattcacttgtcattttagatcgtctactctttaatgaagaggtggaacaatcctcagacttgcccttcgttctaaatctttctgatgactcccaaggatattgcatgaactcttgcaataatcggtttctatctactaaatccacccaatagagtgattcatcataccatggctgttcatcctccgtacgcaaatagcacaatttgagtctatcaacgttgtagtgagtgggaagttgttgcagatcataatcatgcttgagtaactcgttgtgtcccaaccaaagccacatggcatagtacaattgttgaaatcgctcggcaatatcaggagccacgatcattcttttgtccaaaataatgtttgaacgttggcaaatatagt

SEQ ID NO: 52685 - DNA, 367 bp, Triticum aestivum
  Clone ID: PAT_TA_52685
aaggcaacaatcatttttatgtatatatattagtggcaaaagacaaatttgcatgcatgatcactgtgcacggaaagctacttgattacctattacagtatcatttttttttgcgagggctattacattatcattttgcccccgtatttggagctgggtagctaacaaaacctgcttagccgtgttgcgatcaacgtgcatagacatgtactccctctgtttcaaattacaatttgaacaaaaaccacgaagagtacgtaatttggaacggagggagtatgtgggtaggtatatgtatattatgattatgatggatccagagcaatttatggtgcgacgagctgatgtgcacgcgtcaccgtgatct

SEQ ID NO: 52686 - DNA, 255 bp, Triticum aestivum
  Clone ID: PAT_TA_52686
ggatacatcgccgtcaccacatatatatgtgaccgacgacaaccaacagcggaataatgcagcaacaagcaatgtgctgacggtcggagttcaagctagtagcaattttacacaggccaaagattacattttagacacggcgagatacatcgtcgtcagttcgtcaccacatgtgactcacgggaaccaaccagtcaacagaaaatgaatgcagaggtaacaatcaatcatgtgacgacggagctgaagccctga

SEQ ID NO: 52687 - DNA, 336 bp, Triticum aestivum
  Clone ID: PAT_TA_52687
gaaatcagaacggacatgaggcttctgcccttgataaaacacacgcgcggaacattcgtactctaaaacttttcccggacaaaaacacacagcacatgctgctgcatagagcgcacgcttgtgagcataaaacaccgacggaggaggacgggcattaaacggacacctacaggctgagcaccctatctgtgggggcggatatgacttggaccagggggtctccagaaggggtcttcacaagtgcgcgcacatgcccaaaagggccttgagcagctacccatgcctgcatgaacaagcccaaacacgcaccaatcatggacgagcccaccacgttct

SEQ ID NO: 52688 - DNA, 117 bp, Triticum aestivum
  Clone ID: PAT_TA_52688
agggcaagaaaatagcagtaaataatcaggcggagcaggatctaacacaaacaacgaactgccaggggatagcaggtgtggtaatgtaggggtgaacatgggggggcatcgaaacaa

SEQ ID NO: 52689 - DNA, 336 bp, Triticum aestivum
  Clone ID: PAT_TA_52689
tctcttttatttctatttattatttttttttgttgttttgttttttcctttctttttttttttttccagcaggaagataaagagatcacttaaaataaccgaggagaaaaacagaaagtgttcaccatccccaaaaaaaaatacctcgaacttaacctctgagctgaaaacatcacggggcaaaggctttcccgggtggccgtgcttaaaaaatccaaaaattgaccctttgcctatgaaatacgaaggcccccgacggaccctataaatcattactccgcacccggaaggccaacacaataggcccggaatcctaggatgtctatcccatgccta

SEQ ID NO: 52690 - DNA, 261 bp, Triticum aestivum
  Clone ID: PAT_TA_52690
aagtaataaaaaaacacttttattattatgcaatgcctgcttctttagcaaacctggcttgggctttgttgaccttttctttaaaagtgctaataacttcatcaggtttttctgctttgaaaataccagtaccagcaacaatcacattagcacctgcctcggcagaggcatcaattgttactaaagataatccaccatctactagaatatgtaaatgggggtattgacgacgcagtgaaagggcctttggggtgcatggcg

SEQ ID NO: 52691 - DNA, 366 bp, Triticum aestivum
  Clone ID: PAT_TA_52691
cctatcaatgaaatgatacacaatgttgcgtattaaacctttcgctgcgatttacatcatgatcttcttttcccgaagggtcagtggtctaccagcacgcgtgccttgcggtagtgcgctagtgtgtgctctaccaaaagggggatctttcacatatacaccagcttcaggccaacaccatattttgattgtaattggaaagggaactacgtattttggtgcagaacaccaagatctgaagtcctaacctaggagccgcattgctttaggatcgatgacttcagtccactttgttgagtcacaccaagaaaagttaaaaaaagattagccgatcgatctcatgatccactctacattctgaaatct

SEQ ID NO: 52692 - DNA, 372 bp, Triticum aestivum
  Clone ID: PAT_TA_52692
ggcggagaacatctgcattcagtagcgcatttttttaggggagaccagcacataaatacagctgttacaatgtacaggtcaaattctacagaaacaataatctattctgcataaccactaactgaactaatatatgtacacaaagctgaaatggctacaaaatttcctggccctcctttgaggcgctccaaccaaattcactcctggctcctggcagatcatttggtagaagcagcaatagctaatgaggaaactgccccagtgtttgttcagaatcatgtgcgatcattggtggattacggcggtgggggcaacggggttgggattggcgtgatggattaccattggctgctggggatctgggtggtggtt

SEQ ID NO: 52693 - DNA, 334 bp, Triticum aestivum
  Clone ID: PAT_TA_52693
gggggattaaaatcgctccctatttcattttcatttaatataaatccatatttacacgcgagggcgactttgtgtgggaacaactttagaaagggctgggtgaaacaagatgggcccaatgattggtaagcgtagcaaaaatccaaagacgacggggaagaaatccccaaataaattcaagaaaccaaatttttttactgggaatccaaggaatggatattggctcaacaccaagaatatcccacccaagaaacaaagagagccttttatttgcctctttggggtaaagaatgtgaaagtccttctaggaccaatgatggctggggtgccccca

SEQ ID NO: 52694 - DNA, 204 bp, Triticum aestivum
  Clone ID: PAT_TA_52694
ggaaaaacgcccaagtttattcagggggggggaaccaaacaacttttaaggggaacccccgggtttacagtcttacaggggggcgggtgccccagctaaaccctgaaccagaaaagggggggccaggtccccctaccctaccccaaagctggcggggatagaaaaatggacgccccccccctgccgggaagaaataccgggggg

SEQ ID NO: 52695 - DNA, 268 bp, Triticum aestivum
  Clone ID: PAT_TA_52695
aacaggaaccttcagatggattagcaacttcagttctggcaaccaactagccaacgaagcgggggcccacagacgaccactcctaccacggggggggggtccctaagcgggggcgggggctaacaggggccaactacatttgtcacaacagggggggcgtcgtcggtctagggggatgggaacttggggacggccttggggccctcggggacagggggcttggcgggctccccgggggggccctggcggtcgggggtctggttccccc

SEQ ID NO: 52696 - DNA, 225 bp, Triticum aestivum
  Clone ID: PAT_TA_52696
ggccgtggtagaattttttgtttgttttttttcccgagtagagtagagttcgtacatttgacaagacgacacccaaacggtcgtaaaaaataaagcaaacgccagaaaaacgctaactaattcatcaacgatcgttggctccgttacacccggaccaccggttcgaacggtggaatatgcggcgctgctaggggaaacggtggctgccacgaggggcgggttact

SEQ ID NO: 52697 - DNA, 424 bp, Triticum aestivum
  Clone ID: PAT_TA_52697
gggaataatcaaattgctataagctcattggatacaaagaaaacattcttttacaatcctcaaaacggcacaaggattgaggaacatgtatgatctacagacggcagtgcaagaatgaacaactgaaagcaaagataccaacacaacccaattttatgcctgacagaaaatgccgcgcctccgcaaaagtttgttgaattcctgaagctcctgtggagaggaattaggcgattgcgggcatgtccttgagccacccatcgagcggcttgccgatggagtagacgatgaagccgatctccctgagcttctcggcgtcgaccacgttgcgcccgtcgaagacaaaggccggcttctgcatgatggcgaagatcttgtgggagagcgagtacttgaactggaggcgctgcggggaggatgcccacgg

SEQ ID NO: 52698 - DNA, 464 bp, Triticum aestivum
  Clone ID: PAT_TA_52698
gaaattacactatatgcttattcttgcataatataataaattttaatttgtgttgaagttaagtgcaaattttgtccttatttgtttccttttccattttcttcctctggaagggtaataccaatgctaccaattcattttttcttagaaagcttcattattttgactttgtttttaatttttaattttcttcttctttcttctttaaggctaataccaatgccactaaatcatttttttcttacaaagcttcattattttgagctccgcccgcctagccgttggaagcagcactaatggtcacattagtgccggttcagattacaaaccgggactaatgagcttcacattaggccctttttctactagtggagtgcaccacaaatatagtaaaggaagataatagccccaaacgtcctcgccacaaaagactttgaagaccacaataacccctcgatgctggc

SEQ ID NO: 52699 - DNA, 581 bp, Triticum aestivum
  Clone ID: PAT_TA_52699
actacttgagccaaatataaaaggtttattggtttctagcattttttttttgaatttaaaaaagagaaaaaaagggaaaataaaagagcgggcgtataagtggtgtacttgtgtgtatgtgtatgtgtaaaacagatttatattgggtgtgggtcgggaatcaagtcaataagccacccatttttatcgtacaggagttgcatcaatttgtttaatgttggataaagccaatctgatcttgttacgataagttgctttatttttttgttgcattggatttccttccaaataaactgtctccagcgtcttaattttgcccaattcctcttctacttgttgataacattcattatcaaattgattattattcgcccaaaactcttccaaagcaggcaaatgagacaaattttcaatcgttgttaaagcattgttggcaatatcaataatagtcaatttgagattattctgaaagccttcaatttttgcaatggcattatggctaagataaatttcttcaagtttatccaattcttccaattctttcaattttagttagtcggttactttgaatactcaacaat

SEQ ID NO: 52700 - DNA, 561 bp, Triticum aestivum
  Clone ID: PAT_TA_52700
ttttttttttttttttttttttttttttttttttttttttttttctttttttttttttttttttttttttttttttttttggaattttacccagctctttttttcattcatacggaaagggggtcacaccaaaaatactggcactttgggcggccccagaacacgcccataacacccacacccacacacacacaagcaagggcccgatggggacgcccagagcacatcaagggtcgaatttttccaacctagggggggggggcccactactgcccattattactcaaacgagggggggggccgggtctccggggggggggggggcttacgggttcactttcggggcccccccggggatcagggtttccttgggcgcctgggtcttgacgaacgactcgcggctgaaaaaagcctcggggtgggcctggcccctgggccgggtttctgggaccctacaccccttggagggctggcgggcggacccgaagaggggggagcgcgtggggcccgcgggtggggcctgggccgcggagcggttggggcgcgcggtgaacgggtaag

SEQ ID NO: 52701 - DNA, 367 bp, Triticum aestivum
  unsure (1)..(367): unsure at all n locations
  Clone ID: PAT_TA_52701
ccaccaaaaaaaaccatgcttggctttctttaaaagggcccaaaccactttttccaagacccctttttggttacccacccccggaaaaccaacaacggggggcaaaacatttagcgctccagatcatcatcatcatggtcttcatttaaagtttcggtttctggggaagcggttaaaaaggcaaaggcaaggttgttcggcgacctcggaaacttattataataattatcatcgcccaggtccttgggcagtagggaagtaaaaaccagggggggacggaaacgggcaaatcagtcaacaacctcctccgtttttttgggcttgaaaaggaggtcccagcccacgcgtccccccacccgtncgggga

SEQ ID NO: 52702 - DNA, 577 bp, Triticum aestivum
  Clone ID: PAT_TA_52702
ataaaaataagtattataaacagatatgattaagttatatgaatatgtatataaaataaaggacgacctgcgtcaagattgaattgaataattctcttggcgttcataaagttgatataagttgtcttgatgaggccaataagtttgtttgactggatcatttttctcctttgtataagtagtatcataaacttgagaagaatgggtttcagaagagcttgaaaaataaacagtagagcttgatgaagaggaaggaaaataaatactagatgaagggtaaaccatagactgtgtaagaggaggaggaggaggaggagggaaatgacccaagggatatggaggggaatagacatcatgagggggagaattaggtaaactgtatggcggagaagaaaaatgttcagcactacttctaaaccgagtgtgagagtctgcatagtggcccggactacgacctctaacgacaagctgagcagatgagcagctcgcgacacgaatgggctcttcttggttcgtattggcataaaggtcgaccacaatctcataatactgctgtgcggctcgtcgcttgccattg

SEQ ID NO: 52703 - DNA, 558 bp, Triticum aestivum
  unsure (1)..(558): unsure at all n locations
  Clone ID: PAT_TA_52703
gagcaatagtaataataataatatattcataataataataataataaaaaaaaaaaaggaaaacataaaaaactcgtttaatcattcgttttataagatgggaatataactgttaattctgtccttttgattttgagaaatacattcagcaatccaaacaatgtttctgatctcttgttcctttaacttgatgtaagcataaaagacaccataattgaattgttgttggaaggcttgtctgttcaagaagacttcagtttcgaaaaatctgtcttccaaagtcttgttactggtcgtggtatcaaagaaagatctgtattcgtggaatatttcacaaactgatttaacttgatcaatttcatcagcaatagccaaacgagcattaccttcaggatacaagcgaccgattgttgggaatagctttctacgatcctctttgggtaattcagtaccaaaagaattgattgtaatgttgatcgtacgacgatcagcttcaaaacggagaatgtcacccataacttcagctgtaggtccaccaatactntggcaaaattgata

SEQ ID NO: 52704 - DNA, 585 bp, Triticum aestivum
  Clone ID: PAT_TA_52704
ccctttttctttttattttatttttattttttattttttttatttttttttttattttttttttttttttttttttttttttctttttttttttttttttttttttttttttttttttgggaacacaaaggggaacaaaaaaaaaacaagcgggggtatggtcaggggggggaaccccaacccggggggggggccccccaaaaggggtaggctttttaacacacaagctataaaaaggggcccaggcttccacctctaatttttaagggggaaccaaatctaatccccatcccacccgatcaaaaaataaagcacccaggaaatttaccctaccccgggtaaaaaaatgggccgccaaaatggccccgggcccaaaagaatattaacggaaacaaccaaaagcccaaaaaaatctacaactggaaaaataccttggggaacccaaagccccctcgggggaaaaaaagacggaaacaatcgacattttctatgttcttaaaaagccgactcaaaagttccccatgggaggcatcccaaatgccgggttgggaccagaacccatgggaggcaaacccaccccaccca

SEQ ID NO: 52705 - DNA, 449 bp, Triticum aestivum
  Clone ID: PAT_TA_52705
tcgcgatctagaactagtcagccaatggtgaacaactagaagtactaaatagggtctttgatcgtacctttttcccatcgacccaagtaagagctgagctcggtcgtcaattagggatgagtccaagaacagtacagatttggtttcaaaatcgtcgtcaagctatgagaacaaaagaacgacaaaggttaatcaagcttagaaatgaatcaaaagctaaatctgcatagaataagcaaaaaaacaaacaaacatttcatttaattatttattttaaaaaaaagcaaaaaaaaaaaaaaaaaaaatagaagcctggtttgctctattttttttctttttttttttttttacttttttttctttgaaatatactgggtaaatttcttaaagttatgtgttccccttacaaagtaggacaaaataaaaacattctcctgtttgtcactctt

SEQ ID NO: 52706 - DNA, 370 bp, Triticum aestivum
  Clone ID: PAT_TA_52706
gggggagcaagggccccctccacccatattaaaagcaaaactttcggcagggcaaaaccgcaaaaaagggatgtaaccaaccccccaatagtacccaaacacgggaaaaggggccggccaatcatgggcaaaaagaccaggcagatagagcctaacacccagggcaaaaacccaccccaccaaagttcaaccaggggggacaaaacaatctatagcatcaagagacggcatgcaaacggactctaatcaaaaaaataaagccgcccctaaaggttaccccggcaagctggctggaaggggcgtaggggttctgctgctgggccacgttgcggaaaacatccatcgcctcggaaaccttggacttgaaagc

SEQ ID NO: 52707 - DNA, 342 bp, Triticum aestivum
  Clone ID: PAT_TA_52707
ccaacggaaaagaatagaaaggggatggaggattcccaggaaagagttttattccaggcggaacctcaggattaacacctcttctaagcccctgggtgcatcatttcgaaccaaccccctcccaagaaaaagcaaatacatcacaaaatccggccgcctttattctccctgcggtgcgggcctagcccaagacattgttgaattggcctgggcgaccgacttgagctctaggagggggaacctgactaccgtgccctgaaaaagcctccaatccttctaaatgatcccggggaatacctcacagaacgaagattcaagacctactgagcatatctaaataag

SEQ ID NO: 52708 - DNA, 577 bp, Triticum aestivum
  Clone ID: PAT_TA_52708
aaatgaacatgattttttttaatgaaaaaaataaataaaaaaacttgtgtggttttgtatacagaaacattattcgtttgaaataactcgatctacaagaggctgaatatctttaatcttctccataaacacatccaacgcagaaaggaagatttgttcagctggtataacacctgaagtttcaactttgaaaataaaatgatcgcgaacgcgagtcaatcgcactttattcgcaaacttgtcatgtcttaatacttctctactgactgtatctttgcgaggattaactaccttggccgtctttacaccattttcttcaaccacttctataacaccttcaacaaagcaatttttaaattcttcagcatcttcacctataataggttctaaaatagtaatctctggtaaaagacgataggatgctgtagcaacaggtgaccattttgcgtgctcccttccaacacccttttgacagtgtaattccatttccatttcttgaccaggtctaagtttagcgatcacaatatcatcatgtacaggtctaggtggattagcggcaaatttttcttcttgatta

SEQ ID NO: 52709 - DNA, 574 bp, Triticum aestivum
  Clone ID: PAT_TA_52709
attggttaataaaatttcttttttttattaatttcaacaaaaaaaatcaaattattttctttaaacatcaatgactcgacttaatttttgaattctattcaacaggacatcaccatgtttaataactgattgatattgagcattctttgcatcaggtctgtttgtttcaatgataccattcactttatcaatgacacagttaagacgaccagctgcaatgaatttataaaggtccctgtcaatataatcctcgctaacaccaaatgcttgtgccatgcttgtcacagtcaaagatctgtaactttctaacaattgagcataggccaagatacgcatttcacgaatgtaataacgcatatgaggcaaaagataacgagatgagcgcaagtgtgcttgttcaatggctgccaacgagcggaagaattgtgtgtattggcagttgtataagctattcatgtagtcttcaagatgaggaatatcagaaataacttccaaaacttctggagcatccaatactctctttttaatatccacacgcttcatgctgatcaggcttgtcaagacagcatattta

SEQ ID NO: 52710 - DNA, 271 bp, Triticum aestivum
  unsure (1)..(271): unsure at all n locations
  Clone ID: PAT_TA_52710
ggggnaaaagcagggttaaaaagaatattttttaataaaaaggtacaaaaaagatgaaagggagcaatttatttgggagcctccctggagggcaaagcaaggtcttcacccaagggaggaacaacgggtaccaacaaggccctacccccaacaaaatcttcttggatcttttcaccgagaacaccctcaggaagcttaacaacatccctgggggtaccctcttgaggcatcaaggtgagggaaccctcaccaaaggngaggaggngatatt

SEQ ID NO: 52711 - DNA, 521 bp, Triticum aestivum
  Clone ID: PAT_TA_52711
agacaacttcaacgtactttcattccacgtatttatgcatgaatgtccggtacagtattaattccaacaacgcaacacgacacacttttatgattacgcatgtacctacctagtgaacaccgttgcatgcatgcatgcacgagactcagatataatatgaacgggaaggcaaacttgcaaagagcacatatatgtgtacggttggtcgatcagcgcgggcaggtgtaggtggattcgcagcgaatgttgcactggttgagaaggagcacgacgtcgaggtggaggccgaggatgccgtcaaggacgtcgcaaaagcacccggcagcttgcaggtcggccaacccgtagagcagtgggcagcactcattcgcaaacaagccgagactgagaattggcaggttcagcacattgacgcacacttgcagatttgggcacgagccaaaactggttgatggtggtggtggcgaccgggggtacgccggttgcggtggcaaccgcggtggtggtggcggcggcggcgg

SEQ ID NO: 52712 - DNA, 542 bp, Triticum aestivum
  Clone ID: PAT_TA_52712
gagatgatatacattattgtttcttttttatttgaatgtatacaatgaaaatagaggttgctttttgttgaatatacaaattgcgagtgtataaataatagagattactttaaacaaactttataaatttaatgcttgaattgatcttcagtgacacctttacccatggctgctgtagaagatacaccaccagtgaccatcttcatgagctcatctacataattagcccctgaccatttctgatgttgtaagacatcgacgccatgttctctttctttacgttgaacttgagacacatagccatacatgccactttccttgaaactctttgcaaaagtagctgaggctaaagcattcgcatgaagaccacccaaggtgatgaattgccatacgaatccaagttttcccaagtttgcgatataggaacccatgtcattatcattcaaaccagcagcatcccagttaaaagatggagacaagtttgtacataataaagaacgaggagaggcagacaagacaccctttgagaattgttcaacttg

SEQ ID NO: 52713 - DNA, 576 bp, Triticum aestivum
  Clone ID: PAT_TA_52713
ggtagcatcatgggctgctgctggattattattatgcaccaaaagagaggtgagacaacaagaccaacgactgcaccatcacaagtttcttatacagaccttagaagggaatctggtaaccagttaggcacttaggccgcacatactccctccgttcggaattttagttctagatacatccattttcaagacaagtaatttcgaacggagggagtacatctctgcgacaaaatgtcgacgagcaccacaacaatagacgaacgaacgaactcacgtgcaaagattcaagtcattttctcgctctttctttctttcttgcaaactaggtgcactgtgctacaagaggaaacacacgagttcaatgctgggcgcatcgccaacccgaaagatgcctacacacactacttcagaagagacctcgcgaagtgctctcttgctgtcgctagggcttggcttatcgtctgctcagtgaacgacccagctccttccaatccatggcctgacaccttctcggctatcacatttccatctgtttccagaacaatccctccatcaacaacttcgtcaaggcacaaa

SEQ ID NO: 52714 - DNA, 400 bp, Triticum aestivum
  Clone ID: PAT_TA_52714
accattaaaacgtatatatgtcgacatattgtataatattatgcgtccgttcatatacatagccaccgatagcattctcatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgagagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacttgtgtggcgtcgg

SEQ ID NO: 52715 - DNA, 373 bp, Triticum aestivum
  Clone ID: PAT_TA_52715
gggggcaaaacccccttatttttttttacgggggggggggttttttttctttttgggaaacagggggggggttaaaacttaagcccaccccctttttttttggggggttcgcccaggaatcgggccggcctgttttaccgggccccgggggggggcgccccccgggggaaaacaccccccaccccccccggggggggggacccgtaaaccccgggggggctacctaccccggggggaagaaaatcccggaaaaaaacctaaaaaagggtgttccacttggttttggggttttgggggaaaaaaaaagaaaccccccttttgccgggggtggggggggggttcccctgggtgttcccccacccccccaggtttt

SEQ ID NO: 52716 - DNA, 382 bp, Triticum aestivum
  Clone ID: PAT_TA_52716
ctaaacctgacgatgattaccttcttatcataatacacaaattcttcgtctgctaggaggttgtaaatatccaagagcggtttatagatgggtgcaataggattatcgggggagccattgttgcttcaaatgttcaggacaaccgttggtgtccctggattatttacttctgaacaagcctgatctggccatgtacgaggtactcactccgtacgtattaaccctatgcattacacgggatcgttgatctacttagctcccatgcacttaacttacttagctttatttctttaggatcgctggaccatgacatttcacgtcctggagttcttgcgggtgcacccacgtgacctatggggagcgcccgctccccactggcttg

SEQ ID NO: 52717 - DNA, 460 bp, Triticum aestivum
  Clone ID: PAT_TA_52717
atggcaaaaaaaaaaactggtgttactctttattttccttttgtataaattggggggggataaatagcttcttgacttcctgaggagtaaacccgccagaaaaaggatggacgtcagggaaaagcttggtaagcatttcaggaaaaacgcgtttgttagtgttagggtcaccaagtttatattcataaccccagtttgttaaattggtaggagtgagctctcttgctaatatacgatcaccacgtaacaagttcactgcatcacttaagatagctctactcatcgtataaggtaagcgaagaccagtgaccttggttctttcaaccatcaaaccagtttaaagctcaacacgatcaggggtaccatacaactctttcaatgcttgctgaacactaagtttttctgaaaagtcttcaaatgtttccaatgttggcaagtttaaaaactttctaaactcgtt

SEQ ID NO: 52718 - DNA, 509 bp, Triticum aestivum
  unsure (1)..(509): unsure at all n locations
  Clone ID: PAT_TA_52718
caacaccatcaaatgttaccaagaaaaagaaaccgaattacattgctgtgtttcactctcagccgcggattacaagaagaaggtgctgctgctgctgttctgccggtctctccaagagatcggagcttatgtatgagagaacacacgggctcgattattgaactttttgttgagttgagacttggacgggatccccatggagacggcgagagagcacgggcattgcaggatgccggccggcggtcgatcaggcctcccagccgcggaggacggtggcgcgggcgacgcggttgacgccgagggtgaaggcgcccatgcggaggtcgcantggtgggagcggcacatctccttggtgtcccggaaggcgcgggtcatgtacgtcttgagctcccggttcaccttctcctcgtcccacatgaacccctggatgttctgcacccactcgaagtagctgaccgtcgcgccacccgagttggccagtatgtccggcaggatcagtacccccttc

SEQ ID NO: 52719 - DNA, 307 bp, Triticum aestivum
  Clone ID: PAT_TA_52719
tttaagtattctgtttgtatacctccagagttagctctagtgttttgtgcactcagatacgtatcttaccctgcgtctgctctttttagtagcctgattaaggatgcctatctcatccctggaggtctgtcggtctgtctggatggatggtaacctggtccgacccgagagtccttcggaaagaagatgatgctgcgtcagcgtaccactggcacgagcgtggcgcgccgcgttgagtggtccatctggttggttggtcatcgggcctgaaccaatctagcgagaatgatgtggttggtgcaccttc

SEQ ID NO: 52720 - DNA, 423 bp, Triticum aestivum
  unsure (1)..(423): unsure at all n locations
  Clone ID: PAT_TA_52720
taagtctatggaatcctctagaagcggcacgcccccttttttttctttttcttttttttntttttttntttttttttctttttttttttttttttttttttttttttttttttttttttttttttggcatttcattataagccaaggcggaattccaattgaccccgacaaaaccggcgattccctgggggccaaacctaaacaaaccggtttaagacgaaaatcccggcccatccgactaaacaaagcttgggaattcaaaaatttaccaagcccaccgacctggtaaataccaccccggaaacaacatttcagcccgatttcaacaaacattttaggcaaacaatttctgaaaccggagcactacccaaataccagcaccaccaccggggacaaaatcagtaccttaaaaaccgaaccccc

SEQ ID NO: 52721 - DNA, 232 bp, Triticum aestivum
  Clone ID: PAT_TA_52721
cgtggtgcggagggcggtaccatacttggggcactatgcttttcgagttcgaaatgtcttttagatgtcatgtcaataggtgaggaaagtttttgcgtggcctcaaattcattatcaaaggcttctactttgatctgcatggctttggctttgatccggagcttgtgtggcaaggcagaggaatcacttctggaacttaccacagttgcatgcacatgcctgagttcaactg

SEQ ID NO: 52722 - DNA, 536 bp, Triticum aestivum
  Clone ID: PAT_TA_52722
atcagcacaaataattatattgcttcaaattaagaataaaagaatttaaatggccttcaaattcaactggcccgaattcgatgctgaattctatcaagaagctcgttcacaacttgaaacagcattgaataaaggaaacaaaccaaaaaatattgttgattatatttccgtcactgaactacacatgggcaccactgcacctgaattagaaatattggaaataggggagctctctactgataaattccgaggaatattcaagttaacttattgtggtgatgcatacattgtgatacaaacaaaagttcaggcaaatccaatgcatgcaaaagaatcagatttacctcgacacactcaacctactgtcttagctgcaaatcaaccattgattgtaccgatgttattaagaatcagtgatcttaaattaagaggaattattgtacttgttgtttcaaagacaaagggcattacactcgactttaaaaatgatccattggaaagtatagttgagagctctacctttgatagcatgacta

SEQ ID NO: 52723 - DNA, 416 bp, Triticum aestivum
  Clone ID: PAT_TA_52723
agcatgatataaccaatgatattattgatacagtatagcaatagaatatgacatatacatgataggctcgacatcaaactacaagcagacattggtggagcacaccagcatggcaaacacatacaaatgaaaataccatagtgctttaatactttcgctaatcgaacgccacatggaccttaaagaagctaaagtctatacttcagctacttcaagacccagggaactttgccttaaaaaaataagcacctgcctattcccaactttaaagcacaacatcttatgggtagacctctatgaccgatcgagcttccaatttcttcacaattttgtgaggcgtgaatacggctttcttgaatagctcgggacagaggttttcatcacaatggccaccccctcgtggtaccatcatgagc

SEQ ID NO: 52724 - DNA, 378 bp, Triticum aestivum
  Clone ID: PAT_TA_52724
cacggggcggaaatctttaatataaagggataaagcccaacaaataaccaatacccaagcccccataataagaaaacaaacttaacaacatccaagacctggctttgaaccaaacagaaacaaaaacctccctcactgaaagggcttaaaggacccaaccttaaaaaaaaaaaaaccccccccaccttggccccaacttaacggaaagcaaacacaacacaccccaacaatttaatcaagggccggccacaaatctcgggcccgggggaaaaaaaaccctgggcttgggctcccctgcaaaagaggaggccttgccccccccccctgtcttggggaaaccaagcaacttggccaataacttgcccaaaaagccctttt

SEQ ID NO: 52725 - DNA, 368 bp, Triticum aestivum
  Clone ID: PAT_TA_52725
gggacgaagcttcaatttattcatgaaaccccatggcaacaacccaaatcgaaaagagggcacgcataccccccctccatgacgaggggaccctaagggcctagtagtaacaacaggtcaacccttggggggaaaacaacccaaaagggagaggaattattggattgacacgatcccccgccgctagggggaccacacgatctttaattagttaccggggaccgggacgttccactttggataaagcaccggagggatgtactcctccaggtcgtccacaccagggaggagggaaaataacaccccagtgcgatgtcgaagaaccccatggagtcaccaccaaaaaacggcgcccccacccccccttt

SEQ ID NO: 52726 - DNA, 550 bp, Triticum aestivum
  Clone ID: PAT_TA_52726
tcgcgatctagaactagtcctagcgagcaaagtttgttagacagaaatcaagcatggctttcggtatggctttcaagacagcactgctgtgccttcttggcatgctgatagcttcccctgccattgccgtttctgattctggtatctactaccagattggtttgatgtggccgggagcatactgcgcgcagaccaccggcggatgctgcatgcccaagagccctgtcgtgccggcggccgacttctacgtatcgggctttaccgtcttcaacgcgacgaccgacgccccggagaccagctgcagcgtaactcacactctcgtcggatgcttacggctcctggaagctcagtacctggaagccaatgcctgagtaggtaagcaccatcatggtgtgtgcacattttagtaaggacaggatagtgcggaggcctgaattgctcacagcttggtgccatctgtgtgtgactgtggaaccctgggtcatggacgccggctgggccggggagaacgtgtgtgctgggtgcagggcatgccggagtgggctgactg

SEQ ID NO: 52727 - DNA, 488 bp, Triticum aestivum
  Clone ID: PAT_TA_52727
aaaaaaaaaaatagcattgatttatttatttatccttcgaatggcactagttcccagcgttggttggatgaaacttcaccttcacgtctttcgtataaaatcacaggtacacagtcattatcttcagcgccttggatatctaaaactaaatcaggacgggcttcacaaaagatatagccttcctcatctatagcccatctttggttggcagcttcttcgaccatcttttgagcatattgaatgatttgagactcaggttgcatttcacctccgcggatatccaagaccttggcagactttgcgttgatgaaatagccattttcgtaacgccagagttggttccagcaatcttcgtacttttgtgtgtaaacaatgatattggcatcatcctcagtagaaccatcctcaacatcaaggacacgtccgttaaattgacttttgataaaaaataagcggccttcttcgaaaacatttttatattttaattt

SEQ ID NO: 52728 - DNA, 562 bp, Triticum aestivum
  Clone ID: PAT_TA_52728
gattgtatataaacttttgttcttttttgtacaactttttaattgaagaaagttctgttgggagagtgatcaaataaagccactcgaatttgaggcagcatctcttctttagcgatttctaaacgagcatcaagcgtattgtccaccgtaatccttccatgatgaccactcaagatgacaccaccagcacttgattcaggaaggtggtcttcactaatagtaaaattaggtctggacttcaggttctcctcatatctatcagctacggtctcaagagtagaagtgacagcgtcaacgtcttgctgacgacaacgaatgtcgatttcgggctccatcagtgcataggcaccttgaaggatgaggccttcgattaaggtacgataggtatcttgatcgtcggatacttgatgaatacgtttattggcttcttcaaaaagatcatcaagtacctgttgacgttcttgaaggattttcaaacgagttttgttgatgtggtttgattgagcaattcttttctgaacttcagcttgcttgatcttgcgttcaaaaacagcttcgatat

SEQ ID NO: 52729 - DNA, 375 bp, Triticum aestivum
  Clone ID: PAT_TA_52729
acagataataaaatgtgcttatttaatatacacactaaatttttgttcaaaacattttacaaatcatctcctgcccagacgatttcttgtcgtccgaggaattgagggagaaggtggagatgaggcaagtgaacgtccggtggaaggatgattgatcaaccgcctgaacaaaggcctaggccagctctagctgaaggggttcctgatttaagagagactggagttgagcctgtctatcggccgatcggtgttggtgtgtcttgagaaattcatgccagacgtgaagcagaaggaccatgcttgccatcaggggtctttgtcctgtggctgccatggccgccataaaaatcttactttcgattgcctgctgaggat

SEQ ID NO: 52730 - DNA, 458 bp, Triticum aestivum
  Clone ID: PAT_TA_52730
aagcaacatagaacttggtttatttaaaagggcattgggcccgagacgacccaccccaccccaacgccttattacagggggggttacccccgtccgtagaccggggggcccctagagaacaaggtcctggggagccctatttgagccacccccattcttgaaggcccatggggggggggggggggatccctcccacacctttgtggcaagcctcatcatagttttttaacccagcactcgaccattttgatacagtcgatgattagccgatttttagggggtacataatcgtctgttgcaggagcccgcagcagcgaccacgaacacccgcgggggttctacatgccgaagggctcacgggtggtgtcaaacttgccagcagaaaaactctggggctcctccacccccctgaagttggcgaccctgcgggtggagcaccccacggggccctgcaggtt

SEQ ID NO: 52731 - DNA, 413 bp, Triticum aestivum
  unsure (1)..(413): unsure at all n locations
  Clone ID: PAT_TA_52731
tttttnntttttttttttatttttatttttttattttttttatttttttttttttttttttttttttttttttttattttttttttttttttggggcaaaaaggacctatcaagaatatttatttatgcggggtcacatccccccctgcctagatggagggcccaaaggcttactatttcactgggccgggagcccaaaggtgaacgacaattgggtggagcagtcgagggttttcccggagcccaagcccaaaaagtcacaatagcgcttggaaaacccgatccgatcgggcaccttggggttttggcccaagccggacttgatcccgccggtgaagacctttgggaagaaaccatacccggggacccggccgggcgggcttttcctgggcgggggagcccacaaccccggg

SEQ ID NO: 52732 - DNA, 209 bp, Triticum aestivum
  Clone ID: PAT_TA_52732
ccagaattgagggggtattgatttgctaaattgacagaagtccagtttcccgctcgcgtaaagaattgcacagggagcttccctcaagccgccagaagcgccgcgtccaagccttgcgttacaagaaagagagaaagagagaatgaatccagcgtagtacagtattcgatacaccgagcgagcctgcagtcggcatcgcccgttttccc

SEQ ID NO: 52733 - DNA, 489 bp, Triticum aestivum
  Clone ID: PAT_TA_52733
ggaaaaacaaactcatgagtcctctcaaaagggggaaggaacaaccaaacatcaatacaacagtggggcctgccatgcaaagctggccggacgtaagtcctcctttcgctgtcacccagggagataatttgaaagcccttattcatatatatgtatatgtatgggtatgaccccaacgtactcagcgtaaatcgctggagctttttgcagcgatgatgaaaaaaagtggtcgatcaacgaatcttaaaacagtccacaaatgaactgatggcgtaagggaccctgaccccccactttgaaaggatgccgggggccttgccaacgttgagcccaccaacagcgcttttgatgcacttgcaccctgtttgcttgtcaacggtgctccgggctgcaccggccaaactcctgacccccttgcaacaagccccaggcgggttggccccattgccccgtgcataggaaatgcaagggctcaaggcaaaggtcacc

SEQ ID NO: 52734 - DNA, 554 bp, Triticum aestivum
  Clone ID: PAT_TA_52734
aagaatggtaacacaatttatgctttgaattgatttatttagatgtgatcacaggagtaatgggtaatccttctttggcttttacagccgaaataaacgcagcatgagaccaagttaaatctctagcaccttgcatacgacctgtattacgattgaattgctcagacatagatccattcgtctgttgatggaactggactgtagccaagaatttgtctgcttccgtagacactttggatatgatctgttgccattgatcgctgttgggagcataagtaccatagtcaaaaggagcaatgcgttcaaagaatggcttgtttactttgttgatttcaatgcctttctgtttccactcttcaatggctaggtagtaaagttcagcataagcagccgttgctaaaaaccaaagattccccttggatttttcgtatccatcatagacatcctcgggataacgaccaatagcagttcctaaacctgttttcaagtctttgttgattgaataaacatttaaaaacgcacgttctatggctgctgcagtagcaagaatctta

SEQ ID NO: 52735 - DNA, 482 bp, Triticum aestivum
  Clone ID: PAT_TA_52735
aaatcaaaaaagtatcgttttttatttcaattgagaagaggaggggggggttttttttggtttttcatgaaaatgatatgcccaagggtttttttttttttgtttttaagaaagggcttttgaaagggggggtttaaaaatcaccatccaaagggaatgtcttttcaacaggggtcttgttcatgaccccagcccgttgataatcaaaaacacccttttcaaaaaagttggccttgccttgaagggaaatcatgcccctaaagccgaaagggttagtagcattgtaaatcttggcgaatccaagagcgaccctgagacgatcagcgaccaattcaatttcctgccccatcaagggagcgttcatcccgatcaatgcaacaggcagagcatccgacaggaattcttgttcgataccgacggcttctacaaagatgtccttgaccccttgttgactgggttgtttacggatgtgggtgaacaaa

SEQ ID NO: 52736 - DNA, 576 bp, Triticum aestivum
  Clone ID: PAT_TA_52736
gtgaaaataaaccacattgaccttactcggaaggaaaatacatccaagacaccaatatgtataactgtagaatacatcaacaagacgaacatgaacatgctaaagccatcgttacgatagaataacgtttacaacccagtggatcaatatggaagttaacgaaggaaatcagcaccattccacatataataatttcgcatagtgctgctggcaggcgtggacctgaaccccctacgcacctgaaccccctacgcagtatgcagctcatgtcacacatgaccatcctgcagtaggattccggaggtgttcctccatttagtatagtcttgaagaaaatgcttggtttgatgagatctagtactcttctgcagcgctggcagcgctgagatcaacgctaagatcaacagtctttccagtaatcagtgtgtacatattaagaacatctgtgacagttgtctcaaagtgagtagtggcatcataactcgatgagacaaagcaattatcaagagaaggttcattgacgggttcatatctgtcatacatatcaaaaaacaattcatctactggaccaagtag

SEQ ID NO: 52737 - DNA, 404 bp, Triticum aestivum
  Clone ID: PAT_TA_52737
attgaataaaaacttgaagctaaagctatatacagaaatgctaaacttgttgacaagtttctttgacagaatatttgggaataataaagatgcgattgagtttgtttagatgatttaaccaccgaaaccataaagggtacggccttgtctcttgagagcataaacgacatccaaagaggtaacagtctttctcttggcatgttcagtataagtaacagcatcacgaatgacgttttcaaggaaaaccttcaagacattacgggtttcttcatagatgagaccagagatacgcttgacaccaccacgacgagcgagacgacgaatagcaggcttagtgataccttgaatgttatcacgaagaatctttctgtgacgcttagcaccaccctttccgagacctttac

SEQ ID NO: 52738 - DNA, 522 bp, Triticum aestivum
  Clone ID: PAT_TA_52738
atgtaaacatctcagcaaaggctttaccaccgacaatgctaagaacaagtacgacgccttgaaaaattcaagtcatttcatcgagcacatggacagcacgcaattctcaacaaaacaaaacaaaatcctctccacgatgtcgacgcatcgaaggacactcacacgagcaacagttcgtcggattattattcactactccggagcactagacacgactcaggcaaggagcagagcaggcgcggctcagagcgccttgagcatctcctcggcgctgctggtggtgaaagcgccgccctcctccaggttgagcaccttgacgacgccgtcgtctgccaggagcgcgtagcggcgggaccgcacgccgagccccatgggcttgtcagagaggtccatctccacgccgagcgcgcgggtgagctcgatgttgccgtccgacagcagctgcacgtctttgccgaggccgaagctctccttccacgccttcatcacgaaggcgtcgttcaccgagacgcacgccacggt

SEQ ID NO: 52739 - DNA, 559 bp, Triticum aestivum
  Clone ID: PAT_TA_52739
gcataatgtttatttatttaattatttttatggtaacattattcccttgatgattgtgtcaccaacttattttgtttctctgtttacatgattcagaaataatttgcaaggatcaacaaccaagcttgtcccagttgcatgctcagttcaagagtccagatgctcggtaggattcgacgctgtcccccagggtcttctctacaggcctgaaggtccaccctagcttctgaagtttctctgaactataaacaagatttccttccacttccgtaaagcttttgggatatgtgtaggttggatacaaggtcttcagtatgttaaccatatcacagacttttattgcaggtgcattacatatgtaccgtccggacatctctggattctcatacgccagaagaatagcatcagcaacatcacgaacatccactatatccctgcttttattttctacagtatcatgttctcctttcaaatagttaaggagaattttactgcttgaatttattgtagactgcatcaagggtccaattaccaatgatgggcatatagttacaatgta

SEQ ID NO: 52740 - DNA, 420 bp, Triticum aestivum
  Clone ID: PAT_TA_52740
caggattggaccggaccaaaaatacggggaacttaatctcgctataaccgggagcaaacatcgaaaacgggttcaagccccaccacagccataaaaaacaacagctggatagaaaaaggaaatagcattaagcaggcccacggcaaattgcccaacattaggcaaagggatctaaacggggggcaagcccacttgccattgccattcccgggcacaaacaaggggggcaaaaaaccttcccaactcctgaacaattggaacaacgttcaattggaaaaagggaaaagcgtttggggcccaacaacattttggtggcaaagcaacgggcacatgggagggatcccggcccaaggcaaaaagggcatcgggtcttttcttgcggccccacatttttcacttcaaccaacattaagggggaaa

SEQ ID NO: 52741 - DNA, 544 bp, Triticum aestivum
  Clone ID: PAT_TA_52741
gaatgtaaagactcgatattgtttttattattattgtgcttgagccaatttaggggcatgacttaaaccaaggtactcaaaaggaaccttgaggtcatgagaggccctttgacgagccagttgagtatagtgattcagttgagcttgaatggtttgaaggacaggcaagacttgagattgaagtccttgagcgacattcttggctttgtcaacagaagaaatatcctcacgtgcatactctgtacgaaccaggtccacttgcttatgagcaatctcaaccagtgaatacaccctggtctttaaccactcgggtgtttcagtcgactgagccttgagatattccatgacttgctgcagctgggtcgatacctgtccggtcaagcagtgaagcctctcttgactggctacttgaaggatctggatacgttcggtagaaggtaaacgttgctgagcatacagggtcagtgaagcctgcaaagattgaatgttggctgtcgttctttgaatcagggcagaggtctcggccagacgagcaagatcggaa

SEQ ID NO: 52742 - DNA, 566 bp, Triticum aestivum
  Clone ID: PAT_TA_52742
ataataataaatattctcaagtttattgctcctttactttatcagtctttttgtttaatttatcaatgataattggtaaaaaaagaacgagaataagaaaacctgttaaaacacctattaatgtccaaggagaagaatagttggatgccattttcactgttttgcctacaaatccaagtagttttccaaataaactgaaaggagacaaaaagcctgatttgggatctacttgacgccaattttcaagtgtaacaaatccaacaatgtcatttacagttttgatcgatgtcaaaacacgtacttcatggtttttgacgtgaataacggtaggcaaccgggagatgaagaatcttgctgccaatccaggattggtatcgacattgacgacgcctacttgaacatgcttgtaactactcaattgcaactgtcgttctgcttcatagaaagtagattcaaacctctgacagtaaccacaccagtctgcataaaagtcaatcaaccattcatcatttttttggaccatgtttgaaaagttttcgtctgttatttcaaccactgctttacat

SEQ ID NO: 52743 - DNA, 571 bp, Triticum aestivum
  Clone ID: PAT_TA_52743
atcatatgaaatatacacaaattttatttccaaaaagaagtagattttccttttttaaaatgctttttgtctgacaaccgttatttacaggtaaaactcgagtcgtcaatttttttctaagccgttaatttatttcttggccttcttgggaacttcccattcagaagcaagaagcttaacgatttcttcatctttgacagacttttcagtttgaacactgacagcatcaaagcgagggttggtgaccatgacattacccttcttggtaacaaagagagtagtcaagtattgggcgacaaaggcaccttcacgttcataaacaacgtcatagggtaagacagtttggtgcttggcagcttcaacaatacccatacgagccttacgttcatcttcaagatcacgaagagagaaggggaaggcaccagccttggcttgaatttcagaaagaacggcacgagaggtggccatcttgagttggtaacggatatcggtctttttgtagatggtggtacgggtcttcaaaagacgtactttaccctcaccgctagagacaaggatgtcaacacagtaa

SEQ ID NO: 52744 - DNA, 375 bp, Triticum aestivum
  Clone ID: PAT_TA_52744
gggtgggcaatcagagataatattaataaagtaggcatgagcatacacacacatgcagtgtagggataccaatatctcaagctactacgtctgagcgaccgctccgcgaccagcggtacaacaattactactagtactagaggtgtttaatgggcgctagcacagtcgcgctggctcagacgtcagggtcgcgcttgcactttggcgccatgggggcgtgacggctccggcctttgcgatcagggagatggggttgtccttactgccccattgctgggggttgggctgcaggtcatcgacgtgccccttgctgtttttagcttttgggaacttcttggcgagatcagcgaattctggatccatgatgcggtttgg

SEQ ID NO: 52745 - DNA, 461 bp, Triticum aestivum
  Clone ID: PAT_TA_52745
aagagggagaaatatggtacgagacgattttttaggaggtccccttttttggctgggaaataatccaaaagggggatccaaaaaaaatccccagggaagggcctttaaaaaaggcccaagggggcccgaaaaggggcacccaaaatccccaaacaaaaaaagggggggggggggccccaacccacccaaaggaatcccattttttaagggcagaaatctacaaaccccgccaggcgggaaaaaagttaaaaaaaggcaccccccccattccaaaaagttgtcgggggtcttgccccttgggtttggctcaatttgccccgggcctggatcaaattggaagaaattttgacccatgttttccccaattttaaaaatcggagccctgttcccaccccgggaaaagggggtgggccccctgaaaacagggacaacttttttttcctgggcccaattaaaccctt

SEQ ID NO: 52746 - DNA, 319 bp, Triticum aestivum
  Clone ID: PAT_TA_52746
tgttgttttttagcatcaatcgggttcgtttcacacgtgtatcagcacataagctctaccgagagcagagcacaggcacaatcaacagccggcgacgtctagccggtcaagcagaacgaagataagccaaggtgaagagagatgcctcgtggcctgctatccttcttcctgcaactccttcgggccggtccccgtcatggtcaggttcgccaccgttcccacggcttcgggggtcttgacagggcgttgccgtggtctctgacttgtcgcccgagttcttggggctcgcctcagtgctggcccctgtgctgctccgcct

SEQ ID NO: 52747 - DNA, 450 bp, Triticum aestivum
  Clone ID: PAT_TA_52747
aaaggggaaaaccaaggccccaaaataattttttttttacaaaggttaatttttttgagccccccccccctagccgggggaagcagccctaaggggcacattaggggcgggtcaattacaaaccggggctaaggagcttaaaattaggccctttttttactgggggggggccccccaaattttggaaagggagataatagccccaaacgtcctccccaaaaaaaactttgaaaacaaaaataaccccttgggggtgggaaaaaaatcttggggggaaacgggaaaaccccccgagcgttcaggggagaaccttcaccggggttagtctcggaaacaaatccatagttttttaaaaggaaggggaaatttggattttccagccttccgttaaaaaattaatccccgcttcccacactgggggagggcccctccccaaaaatttggggggaa

SEQ ID NO: 52748 - DNA, 496 bp, Triticum aestivum
  Clone ID: PAT_TA_52748
gaacagaacgagttgtatgtattaaagtccataaacactgggagtgcccatggtacaaactctcaactctcaggtacacagatactgatctcctccagaggagtaccagcaagccagctggagagagttcttattcatattcagtataaactcgcataactagtgaccatactacatagggatagaggctgcgcgcttcaactccacgtggatggatgagctgagcaccagctctcgtccaggcccagagggactacttcggggcgcacacctacgagagggttgacatgcccggctccttccacaccgagtggtacaagattgccaactcaaagatctaagatgctgctgctgctctgtcatgagtcatgagtccatcaggtttcgtcttttcggtatcctttgttgctgccagtcatgagtccttttcctgtaggggaggaaccgccgtttaatttttattatttgagtaacgagtcctgtatttatttttcta

SEQ ID NO: 52749 - DNA, 478 bp, Triticum aestivum
  unsure (1)..(478): unsure at all n locations
  Clone ID: PAT_TA_52749
caggagacagaacgaaatcgatttcggccttttcccaagcctgaggtactctatattgaacgagcctgactattgcacagatttatataacattgattgacttgactggtggatgctataggacgcttatgccttctggacgatcctctcaatgtcagtgacgctctggtcaaggatctgcttgagggtcttggggttctcgagctccttctcaatcttggcgatgatggactcggcgagctccttctgctgcctctgcttgacctggccctcgtagcggacccacgagtcgaggacggacttggcctcggcggcgatggcggtcttctgctcaagctcgaaagcctgggcctcgagctgggcggtctccttggaaacctcgaagagggtcttggtgatgtcaatgacaccgccgaagtcctngacgctctcgaagcgctgcttgacagcggtggtgtggtcctggcgggcaacgttc

SEQ ID NO: 52750 - DNA, 397 bp, Triticum aestivum
  Clone ID: PAT_TA_52750
ttttttttttttttttttttttttttttttttttttttttttttttttttttttttttttttggttttttttttttttttttttttttttttttttttttttccacccaaaaaaaaaaaccctcctttttttcttaaaaggcaacccctcccccagccccccaataaacagggaccccaaattttaagggggggaaaaaccccccccccttgccggaaaggtccaaaaaccccacccccaaaaccctggcccaacatttccctatttttgggggggcgcttggcacccaaaaaaccgggcccgggctttaacattgtttttgccccccccgggtaaaacccccccagaaaaaccccacccttcttggtgtttgccccccccctggaaccgggccttg

SEQ ID NO: 52751 - DNA, 503 bp, Triticum aestivum
  unsure (1)..(503): unsure at all n locations
  Clone ID: PAT_TA_52751
tttttnnttttttttgttttctttttattttgttttctttttacctactccaaactggggtttattaatgcggtttcgcctttgtgcaaaggctagatttttacaccatcgctggcggggcaatagcccgcatctcgtctgttaaagaaacaccgcctattgttttctccctttcgattattacccatacacgatgggattttgttgccaataatgctccctctgctaaacctacagctgcgtccaggcggtcatcaaaaaccggtatccgagcctggccctcttgagcaccttggtgcgcccgaacaagactgacaaattgaaagcctgtctcccacaagaggtagatagttcgatgcctttcgtgataaacttgacatgtgacatacttatgtgaccaagaaccatacccatatgtcctaatactgctacacaagatctaccatgtttactcataagcgaaagccccccaagtgcaggtgaattagcgttcacagcgatta

SEQ ID NO: 52752 - DNA, 362 bp, Triticum aestivum
  Clone ID: PAT_TA_52752
gggggaaaaagggtttcattcatcggcccccccccagggggggcaaaagtttgtctgccccatgccctgtctttcccccccaaacaagtttaagtttttaggggggttaaaaaagattaccccaacccgggttggatttaacccaaaaaggcaagccacatttcccccccggccccccaaattaacccaaatgcccctgccgtttcccccccctttttaatgggggtccaccagttgttgaccggggaccccctggatccgccccccccccccctgcccgggaggccctcccccttgccccgcccccgctggccccggggaaccggcccttgaattccccgggccctttggccctttcctgg

SEQ ID NO: 52753 - DNA, 341 bp, Triticum aestivum
  unsure (1)..(341): unsure at all n locations
  Clone ID: PAT_TA_52753
cttattcatagatctgccattattgcgagaagaacagaaatacatatggagtttacagcatgatccggacgagaggaacggagcaccagaattcacacatttgataaactcattaacaaggctccaagcattcatgctaaagtcatgcgaacgagctaatcaagcgctaggacggagaatcttgagagggaagacaactagcgcgtgcatgcatgtagctaggtggggataggcttgcagaagaggctcttgttaatgcacgggacaggcccgccggatgagacggcgtnctttctcttaccctcgatcacgggngggctgagagggaagatgtcaacccg

SEQ ID NO: 52754 - DNA, 340 bp, Triticum aestivum
  Clone ID: PAT_TA_52754
aaaaaggaaaacaggggttccacaagaaaaggggaaaaatccaggggttttggcccttttgggcccgacttgggccccagtagccccggtacatatcctatttagcgggcccccccggggtttacagaggacccaaccagcccaagatattttttggtttttggcaaccatacaaatccattacgtttttggggggcaacatgggttacaaacatgcctcatgggacatggccagggaccactttgatcatagggggccatgtcacattttatgcccggggactccaaaagcggggcactgctttaaggggaaagggcttgggaaacaaactggaggaac

SEQ ID NO: 52755 - DNA, 314 bp, Triticum aestivum
  Clone ID: PAT_TA_52755
ggacaaaaaataattatatattaacaaagcatatgtcttttacagggaatacccaacccaagcaaaggtgaaaagattccaagaacgcaaacaggatgggccacgggaaaaaagggcgaaaataacaaaattttctctgggacttttttccgggggaaaaaagggggcttacaaaggcccacagggggggtttacatttgaacataataaaaagaaaaattgaaagccctcgctggaaatgccccaccccggttttttcacaacccggtggcctggggggggattccggagccttcattcaacttgtttggggg

SEQ ID NO: 52756 - DNA, 367 bp, Triticum aestivum
  Clone ID: PAT_TA_52756
aaaaggggcccacatttccattaagtacacacatttttccaacctttgggggcattatcaggcggtgcagcacttttcactcatcaccacaggttttgtctgattttacacaaggggaaaactggtgaacttctgcattggctcgggctttttggttttttttttcctcctcctcctttcctaacacgcttatttattttcacttttgggccaagggctcttctcctcctcctgcctttatcctctccctcagcccaagaacacctggactatccctccacctggggggttcgacggcgcccatactggggctggctgacgggttacaacccgggggctcctcgaagagcgacctcaaaagcctttt

SEQ ID NO: 52757 - DNA, 333 bp, Triticum aestivum
  Clone ID: PAT_TA_52757
aaaaggggggaacccgaagagggccccccacctaattcccctaaaccgttaaaaaaaaaaaccccccgctcggtcggaaggggcggaccctggctggggagccaagtgcccttttagggaagctgtatcggaagaaggggggccggccaaacccagggggacttgtggggcccgccctgcttggaaaaccggggcacggccagaggcgagggccgtttcccgggggccaccccccgaaaaactgtaaacccaccgcggggggggccttcgggtccttggggaaggggaagcgcttgacccaaagcttggcatcccccgcgaaagggggcaaaa

SEQ ID NO: 52758 - DNA, 585 bp, Triticum aestivum
  Clone ID: PAT_TA_52758
tttagcttgtcttttagatatgagttcaaatttacgtattgcgtgtgttatggtgggattgcctgccagagggaaaacctatatttctcaaaaagtttgcagatatctcacatggttaggaattaatacaaaagtttttaacgtgggtaactatcgacgcaagcttcacggggctcatttaccacataccttttttgatccccacaacaccttgggagagcaacaaagaagagaagcagcagcagcagcgttagaagacatgattcgctggtttaatgaagatcaaggcattgtagcaatctacgatgccacaaacagtacaatggcaagacgtcgctggctatgtgataagctaggtaaagaagacattcaggtgttgtttattgagtctatctgtcaagatgaagagttgattttagccaacattaaggacgtcaaactatcctctcctgactatgcagacacggatccagatgaggcagcgattgattttatggcacgtattgatcattacaaggaacaatatgagacgattacagagcctgagttgacttatattaaattaattaatgttggaagccaaaa

SEQ ID NO: 52759 - DNA, 615 bp, Triticum aestivum
  unsure (1)..(615): unsure at all n locations
  Clone ID: PAT_TA_52759
gaacgcgcagcgccatcatgtcaacacaagcaaacgatgtcggcgttaaatccgctcctaactccgaaacggtcgacttgctcgcccttgctcaacaggttactcagcatacgcaggcaatcgccgactatttggtagcaaacaaacatgcatcgcctacgtttgcatcagactgcatcgaccgcccagaaacgattgagtacgctgagcttcatggtaacttgaagcgttccctggaagacctccaatatcttgtcgaggggcccaaacgacacttccgcgcactttgctgccagggctacgagctcgcagccatccaagtggcactggacttcaacttcttcagcatagttcccgcgcatggcaatatctcgctggaagacttggcgaaacacgcaggtgttgacctggacaggaccagccgcatcgtccgcctcctgatcaccgagtccatcttccgagaacccgcccatggctatgtcgcccacagccccagctcatatcttctacaccatgacgaaganattcgttcgacggtgcattacacggtcgatgagatgctcaaggctgcatcttctacagctgataatgtgaaagcatcgccgcttgagtaca

SEQ ID NO: 52760 - DNA, 579 bp, Triticum aestivum
  unsure (1)..(579): unsure at all n locations
  Clone ID: PAT_TA_52760
agnagcacctcagtctctctcagcaggatttacccacaccgagtcactgaccacacacggctctctgtaactgtatcttgttcctctctttaaattttattttatcctccgccgatctatccaaacttctaggatactatatttttctcgagaaggtagaatatgcttataatttgtctgatctgagattgaaaaaagagtgagggtttggtcaataacaaagcaagtaagaatcttaccaacagagcagatctactagcaactaaccagtccagcagagcttcagattctttgttcttgttttgcgtgtagcagagctcgagcttaacccccccaaatcatcaacgaatttggttgcagagtcgcgcgccatcaaccggtacatcgcgaccaagtacggggcggccctgcttccgacgccgtcggccaagctggaggcgtggctggaggtggagtcgcaccacttctacccgccggcgcggacgctggtgtacgagctgctcatcaagcccatgctgggcgccccaaccgacgcggccgaggtggacaagaacgccgncgacctcgccaagctgctcg

SEQ ID NO: 52761 - DNA, 586 bp, Triticum aestivum
  Clone ID: PAT_TA_52761
cccacgcgtccgctctgctgtacatggcgtcggctgcaggtgaggggaggagccgggtgctggtgataggcggcaccggctacatcggccgcttcatcgtcgccgccagcgcacgcgagggccaccccaccgccgtcctcgtccgcgacgccgcgcccgccgacccagccaaggccgccgtcctccagggattccgggatgccggcgtcgccatcgtcgagggtgatatgtatgatcatgagagcctggtgacagccattaaatcagcagatgttgtgatctcggccgtgggttatcaacagctaccggatcaaactctcattatctcggcaattaaggaagttgggcatgtaaagagattcttcccatcagagtatggtaatgatgtggatcgtaaccatgcagttgaacctgcaaagacagtattcggtgggaaagctcgtataaggcgtgccattgaggctgagggaattccctacacatatgtctcttccaacttctttgctggtcgtttcttgcgaagccttgcgcagattggggtcacggagcctccaactgagaaggttctcattatgggtgatggaaa

SEQ ID NO: 52762 - DNA, 544 bp, Triticum aestivum
  unsure (1)..(544): unsure at all n locations
  Clone ID: PAT_TA_52762
gccacncgtccggtacaggagctggtacctagtacactggagtcctaccgcgagacctacagggggaaccgcgatggacacgcccgggtacgcggagccggtgccgtacgggatgatgcacgggaacatcgacgggaggtacagggggaggccgatgacggcgaagacctactggaagatctactgccgctccaacctgaactaccccatgtgcgtgcggaacctgaaggtggtgctgccgccggacaactccaaggactagtatccaggacttgatgaaggacatgaggttgaacaacaaggtgaaggaccacgagttctacctcgtcttcaacgtggcgaacaaggccatcaagcactccatcaagcactccctccgtcagtgccaggctgcgcgtatggtgcactacaagcaagactacctggtctagacggtgcatgaggaccgagagcaaggacttcagcaacgggctcatgggcaagcacatggagaacaacatctacgtcaacttcgacgacctgaaccgcgacgaggtccacggcg

SEQ ID NO: 52763 - DNA, 504 bp, Triticum aestivum
  Clone ID: PAT_TA_52763
cccacacgtactaatgaccgtggtatgctgactaccgcgggaaggattgtatggcaacgcgttagatgatctggcgacgggccaaccggcctgaaaagcgatggatgaagccgggtacagtcgaattgaataaatcttgggcacgattaacgagcacagggcaaggtagacacgtttacaatcgtgttgtatgatccttgggctaactgggatacctaaaaccgctgtctggctaatcacaggatcctcaaatcaaattgatatggtgcacacctacccctgaacagaacgtcttgcttggtctctagaatgaccaaacgcctgcataagaggctgctgtacgtgcgatcaaaggcactgattttgatatggtctatgaaaagggcttgcccgatgccatgtccttgactgtcaactgtacaagctgcaacgggccttgatcgaccaatatgcacatgatggagattcctcactttaacgacagtgtcatcatggtaaccaact

SEQ ID NO: 52764 - DNA, 183 bp, Triticum aestivum
  Clone ID: PAT_TA_52764
attggatatcattctcttgcatcgattcaatagttacatgtcaagcatactgaacatgttctgccaacaactgatatgcaatagttcatgtcaagcatactgaacatgttctgccaacaactgttgtgctaacatgttctatcaaactggcacgtgggattacaacacaacatagtgggactg

SEQ ID NO: 52765 - DNA, 591 bp, Triticum aestivum
  Clone ID: PAT_TA_52765
agcaacactttcctctttacttctgaatccgttggtgaaggccaccctgacaagatctgtgatcaagtctctgatgctattttggatgcctgtttggctcaagaccccatgtctaaggttgcttgtgaaactgccgctaagactggtatgatcatggtctttggtgaaatcactaccaaggctaaccttgactatcaaaagatcatccgtaacaccatcaagcaaattggttatgatgattccgaaaagggtttcgactacaagacctgtaacgtcttggttgctattgaacaacaatctcctgatattgctcaaggtcttgttcaaaagtctttcaacattgaagacattggtgctggtgaccaaggtatcatgtttggttatgccactgatgaaactcccgaaatgatgcccttgacttgtgttctctctcacaagctcaacagccgcatgtctgaacttcgtcgtgatggtagacttggttggttgcgtcctgattccaagacccaagttaccattgaatacaagaatgaaaatggtgccatggttcctcttcgtgtagacactgttgtcatctctgttcacacgctg

SEQ ID NO: 52766 - DNA, 220 bp, Triticum aestivum
  Clone ID: PAT_TA_52766
gccaactataccgaaaagcgggaagaaacccgtcgtcactgacgtggtggaactatgggccctaagtccattgctcagatggctaatccgcgctgacattgctgctaatgaaattgccgctcgccaataagcatctcttgagaactaataaaatcatgttgtaattgaaaattctcctaattttcatacttcgtaaataaaaatcaaaatgaatacattc

SEQ ID NO: 52767 - DNA, 530 bp, Triticum aestivum
  Clone ID: PAT_TA_52767
gggactcgtgggactcaagtgcttcatccttaggaactcttctcagtatccaacaactaggtggttttgggcttgaagaaagtgacaaatggctccactattgaccgctgctcgaagacagctcgaacctactctacctcctttcagtactgatgtttttgcgtggaaatgaatcgaggaccgagatcaactttcaaactattcgacagatactacaaagcaagaactaacccgacagaggaaatattagctgctaccaccgtcactaccacgacgatgtgacatgcctactgaaactactcgtgctaccaccactgtagatacagctgaaagacctatcgttgatagctgatctactttaacagctgattgttctgctctttatatctgacgatggtcttaagatccgcaacaacctacagtgcctacatctctgtagcattatcaacatcatctgctgctatgaatacagacagtacaggggcttggcctacttcatccataaaatgtactagtcctacaatgtctag

SEQ ID NO: 52768 - DNA, 562 bp, Triticum aestivum
  Clone ID: PAT_TA_52768
cccacgcgtccgagaggcgcccaagaaggacgtactggacacggtccttgataaggagggcgaatggaagcaggaggggtctctgctaagccatgatgtcatgagagcactcctatctgatctgtacggcgctggagcaagcacgacagcggctctgatcgagtggggaatggtggatctgcttcagaacccagaggtgatgcgcaaggtcaaggaggagctcgctacggttcttggcgacaaaccgctcatggaagaatccgacattgcccggctcccatacctccaagtcgtcgtcaaagagatccttcgtctgcggatggtggtgccgctagtaccgcgcaaagcggaggctgacatcgaggtgaatggctacaggatccctaaaggcaccaacgtgatcctgaacgcgtgggcgatcaaccggagcgccgacgcatggtcggatccggacaagttcgtcccagagaggttcatcggcggcgagaccaagaacttccaactggggcaggactttgacatgatcccattcggtcttggccgacgcatctgccccgggatg

SEQ ID NO: 52769 - DNA, 577 bp, Triticum aestivum
  Clone ID: PAT_TA_52769
ccccgcgtccgcccacgcgtccgcgatggccggccggctcgtcgccggagccgacgacgacgtgtacctcaacatctcctgcaccggcgagggcgtgcctttcgtggccgcgtcggctagctgtgccctggagcaagccatgacggcgccgtcgatggggctcctcagggagctcaccgttcgttaccctggagagctgtgtcgcctcagcgacgccttgctgctgatgcaggtcacggagttcacctgcggcgggttcgtcgtcggggtgacgtggaaccacgtcatggccgacggcgccgggatcgcgcagttcctgcaggccgtgggcgagctggcccgcgggatgggggcgccgtccgtcgcccccgtcaggtcgggcgccaccatcccgcccatcccgacgcccgtggtcgccgcgctgaggtcccagatgcaggtcctaacggaggagctggcgagcctggacgtcacgatcccctccggcctgatcagccgcgtcaaggccgagtgcggcggcgactgcacgacgttcgaggtcgtggccgcggcgctctggcggagccgcacccgcgcg

SEQ ID NO: 52770 - DNA, 551 bp, Triticum aestivum
  Clone ID: PAT_TA_52770
cgacctcgccctccgcggcgctgctcctcatgccctcatggtgcgcccacccgtcgctcccctacctcgccctcaaggccgtcacctccttccccgccatctccccgcaccgcccctccatccacgccaccgtctccctctttagctccgcctccggcgttcccctcgcattcgtcgacggctccgcgctcaccctcctccgcaccgccgcggtctccgccctcgccgcctccctccttgtctccccctcccggcctccctccacccttgcgctcgcgggtgccggggccctcgcgccctacctcgccgaagcgcacctgtccgccctcccctcactcttccgcatcttggtatggaaccgcaccaaggccaaatccgccgcgctcgtcggcaagctccgggacgcgcaccccggagtggccgtcgaggaggtcgacggcatggacgaggcggggtccgcggcggacatcgtgagctgcgcgacggggtcgcaggagcccatcgtgcggggggagctgctgaagcccgcggcgcacctggacttggtgggg

SEQ ID NO: 52771 - DNA, 594 bp, Triticum aestivum
  Clone ID: PAT_TA_52771
aaggacagggtttcatgatgagatcaacagcctttagtactgctacttcttccgattccaaagttcgaagccggtcacattcaatctcttctcacattttatcttctgtcaataagaagatcaaggaaatcgaggatgctgataggacacatatacttcaatatgttgataatcaagtacatgaaacgtgggatagtacaaaggcagcgatgattggagctcaacgtctcttagaattttatgagttgccaaaagaatggcaagagaatgaatatattttatcagggtatcgtttttaccaaacaagtcaagcatgtttaaaatctattttcatgattcataatgaaactgcaaatatctggagtcatctattaggatttatattcatgtcctgtctttgtctctatggattcaattcccattttcctgatgcaagctggagtgatagaacagtgttgatcactttttgtgtagcttcattgaaatgcttattttgttcatttatctatcataccttcatctgtcattcacatcgtcagatcaaactattcacagccacattagattatatgggaatcgcttttcttatcacaa

SEQ ID NO: 52772 - DNA, 333 bp, Triticum aestivum
  Clone ID: PAT_TA_52772
gccacgcgtcgggctgggctagggagcgctggctactagagaggggactggctagtgcccattaagcgaagactaggcttcatatctacccatccatgcatgcgtgctccctgctagcaataagcgctgatctatcgaacgctgctgccctgtacctttgctttattgcctacttattggataatctgtgcaccgacggctgcgcaagcgatctatcatgaagtatctgcagcttgtggcacagaccgccgacaggctcacctttcctaggcgggttgccgtcgttagacaattttacctgaatggaagaaaatgaaagtgtgtatcttgtcc

SEQ ID NO: 52773 - DNA, 418 bp, Triticum aestivum
  Clone ID: PAT_TA_52773
cccacgcgtccgtctaatgcatcggtgtagtttatggtacaaagcgaccgcaatgataggacaagctgactgacacgttctttatagctgctgattcaaaatttatgatggcctttaaatcaacagtggccgaagaaacatttgcaaaagcactaaaagatatttaagaccacagaggcaaggtcacttatgaatcatactcgtttatgaacggtattgaattcacatttactaatgaacaagtggcactacttaacagagaaggactatgttgattttattgagcaacataaaacagttcatacatttgaatgacgtcctttttttaaataaacgtcatttccacatacaaaaataaagggattagacatctttaagatcgtttgctgttacaaataaaaaaaaaaaaaaagggcgg

SEQ ID NO: 52774 - DNA, 522 bp, Triticum aestivum
  Clone ID: PAT_TA_52774
cccacgtttgcgctccacttccgagctcagggctggcatcacgcttggccaggagctgagatccttcatgactgcaggctgaggatcgcggaactcaactccaataggatacatccggttcgtaacctacatgctggacaacccgaaggatgctattgtgtacctaactggagctcgcgatggcccctgttaggacttaaccaataccctgcctgaaaacaactggggcttccgatctataggatccaactttaccaccccgtgcgttctacctcatagctctatcttatatataccttggtctactgacatggccgaggttatacaccatatgaactgcgcaagccccggcgatacaccaattaggaccctggacggaattcccattttgatgcactccactgacccgaaagaagtccgcctggatctgctttacgaacacgcgcactaacgtcaatggtcacagtgactcgccctgtggctttatgttaactacggatgtggcggtgggtatcctcaaac

SEQ ID NO: 52775 - DNA, 501 bp, Triticum aestivum
  Clone ID: PAT_TA_52775
cttttacatcacccgaacaatatcaaggctattcaatgaatcaatttgactctttattagactttttacccaaggtctcttatcctagtccatgtgaatctcctttagctaacgatgtgtctttgatgacacctaataacaatacacctcaacctgtctttggtgtagctggtggttttttgaatgattctatgctcatggttcctcctattgatcagttcaagtattatacaaactttgaaaagttggtttatgaacccaagatgctcgatattgactaccttgataaattcattgctcaacatgaagccgctcttaatatgcctgaattagaagaagatgaaaatcagatgcccgaagaagaagaagaagaggaagaagaagaagcctggtctcactgttcatctccaaagcactcacctaccaaaaaagacgaagaagaaatcattattcttcaagaccgaaagacaaacaggatcatcaagaaatcacccggtcgtc

SEQ ID NO: 52776 - DNA, 583 bp, Triticum aestivum
  Clone ID: PAT_TA_52776
cccacgcgtccgctggttgtggtcacatagcaaagcatgttacgaaagacatgatgaaaaagttgttatgtgcgatatgtcagaaaaggcattatacagagatcaggacgttaaatatgcagtagtccgttcgaaagattgcaggtagacgaagaggctttacctttcccagaaaattcaatagaggcagttgtgagcagcttatcactaaattgggtaaacgatttacctggctcactgattcaaatcaaaaattcactcaagcctgatggtgtatttcttggtgccatgttcggaggagacacattatttgagttaagaacatcacttcagctggctgaaatggaaagagaaagcggtgtatctcctcgtgtgtcaccgatggcagattctagcgatatgtctaggcttttaactcgtgctggattctctttaccaacagttgatgtagatgaaattcaagtcaactatcccagtatgtttgaattgatagaggatttaaaagctatgggtgaaagtaacgcagtgcttacgagacgcccctttttaaagagggacacgcttcttgctgctgcatcaatct

SEQ ID NO: 52777 - DNA, 542 bp, Triticum aestivum
  Clone ID: PAT_TA_52777
ctaatttatacaagtggaacaactggcttacctaaagctgcaattgttcagcatcttcgcgtgtatggcagcatggctgtgttgggaaaaactgctggaataaaaaaggatagcagggtttactgtgtactgcctttgtatcatagctcaggactgttagtcagcttcacttctactttgcatgctggtggcacatttgtgttaggtcgtaaattttcggctagtagattttggaaggactgtgtcaactataaagtaaatgtgtttacttatattggtgaattttgcagatatcttttaagccaaccacctcgtcctgaagaaaagcgccatcaagtaaaggtgatttatggtaacggtatgaggcctgacgtttgggaacgatttcgagaaaggttcaatattcccactatttgtgaattctattctgccactgaagctccatcaagtatgatcaacgtgaatacaagtgaattaggtgctggtgcggtaggtagtcgtggtagattgattcgtttacttcaaaatgaaatacaaattat

SEQ ID NO: 52778 - DNA, 430 bp, Triticum aestivum
  unsure (1)..(430): unsure at all n locations
  Clone ID: PAT_TA_52778
ttgcataccaacacaccatggcacacgaccgaggaggcctcgggcaagaccctccggcgatacttgtcacgggcctagtcgcaccgcgcgggcctgcccctgacaggcggaggtcactacagcggctacgactctncggccaggcgtagaggcaccactagtgaaggatcatgctcatgacggtgaggtccatcccgggacttaactaggatcagaactctgtactacctgttcaccgctcagaactatacgccttgatgcagccagtctaatacccgaatcggtggaggggggctccttgcctgtgaaaaaccatggaagggctgacactatccgtgagcacacatgcatgaactagcctactacacatggttcaggactggcacttgatgaaacagcatatgtgcccatgcgcctgcaccacctcaca

SEQ ID NO: 52779 - DNA, 568 bp, Triticum aestivum
  Clone ID: PAT_TA_52779
cggacgcgtgggcgaccttggagcagcaccagcaggatatggttgacagcatctgggtggtgctcggccaactggatatgtggtctgtgacggaccgccacttcgccggcgccatccgggccacctgcacggcgcacgcggcgtacctgaatgcgctcgtgctcggcaccagcgccgacaggagccggtgcaaggacatcggccggattgtcgtcaagcacaaggacctcctcgggttcgaggtgcggatgcatttcgccagagcgatgctgccggaaatggacgcaacgtcgtcggcgctcatgctgtttgacgatgagcctcatgcgctcgagatgctcattgatcggtcgcagctgctgaccgactccctcagatatgtctccgaggcggcgagccacgtgctccatggtcgcctgttcgtggagttcctggacgaggaggccattggcgagggggtagcaagggagtggatctccctggtgtgccgcgcgctgttcgacccgcggcacggcctcttctcgccctgtccgcgtgaccggcgaaggttcttcctgaatcgagcatc

SEQ ID NO: 52780 - DNA, 198 bp, Triticum aestivum
  Clone ID: PAT_TA_52780
gcagcttaacggtagcggcggagggagacggtctggttgcgctgccccatgcacaccttgatagtattcgtttgaaccatcagattttgctacctttgttcggaaactccttgaagctcgtgctagaacctttatgtcgaggcaatatctgttgaactatttgctatttgcctgtgttaccagaacaaggattgaatt

SEQ ID NO: 52781 - DNA, 542 bp, Triticum aestivum
  Clone ID: PAT_TA_52781
gccagaccttcggatagagctatgcgccttaccatccggctttggctcttgcattggctctcaacatcgtgcttattatggccctcattgtcttgctgggcgagttactgctggatgcactggtggctagcgccgggactgggagaccgactcagccaccgacacaaccttgaggagaagcatggtgagacgcactgcacatgcatacaccacatgctataacgaatgcttttaccaaggttttaaagactgccctatctacagccctgtcgctttctgcaacacttggtcgttggacttcagatacggcagcatatactgaagcgtaaatagtattgcaattccttctcagatgcatgcacaactacactagcaactgacctcattaatggcaactattatagtgcctttgttcttggcgctaggcctagtaagagtcctaatatgttcctacctttattgtcaactatgatgaatcaacggtttaaccaactatttaattgctatattggctgtcgtcatggtacttgttcaactaaaaa

SEQ ID NO: 52782 - DNA, 608 bp, Triticum aestivum
  Clone ID: PAT_TA_52782
cccacgcgtccgcgaattcagacgtcaacagtctgtctttcgtgattgtattgaagcggatgcgaatgcaaaatttgctgctgaacctgatcgttatcatctttatatctcttgggcctgtccttgggctcatcgtacagcgatcgttcgtcaactgaaaggtctggataaaatcatcggcatgtctgtggtggattatttgatgcttgacaaaggatggaagttttcgaccgaacaagaatgtcctggcgctattcctgacacggtcaacaagtcttcttatattcgcgatctttatttcaaggtcaatcccaactatgaaggtcgttttactgtacctgttctttgggataaaaagcttcagaccattgtcaacaacgaaagttctgaaatcatccgtatgtttaacactgcattcaactcgttcttgagtaaagaacaagccgaattgaactattatcctgaatcacttcaaaaggaaatcgatgagaccaatgaatggatttatgacacagtgaacaatggtgtttacaaatctggttttgcaacaactcaacaagcatacgaaaacaacgtatacaatgtattcaaatcattggatagaattg

SEQ ID NO: 52783 - DNA, 560 bp, Triticum aestivum
  Clone ID: PAT_TA_52783
gtcctgatctcgctgctgccagccctggacgcagtggtactacgcggtggactcggtgcgggagccggtcaaggacagcgtcaaggtcagcaagcgcttccacaagcgctaccgcaaggaggacaccaaggaggtcattaaggacggccattgggaccgtcatcatgggcttcgtcatggtcttcgtcaagctcatcttcatgctcatcatcatcatcatcaacagcatcatctgatcttccgtctgaacttgaggtgcgacatgactagaggatggactacattaatgggggcattcaagcaggtgatttacgacttcattgaagaggacattgtacatggcattttcatttgagacagcattacctgcagcagttcctaacctgatactgaatctactgctgtatcaactgtcctatgatgctggctatgaccctatgattgactctatgatagcactgtgctaagaagccttctatgatatcaatacttttgtgaaattgttcaaagagttgtgacatgcgctatgacagggactgggttagtggaagcgttagttg

SEQ ID NO: 52784 - DNA, 581 bp, Triticum aestivum
  unsure (1)..(581): unsure at all n locations
  Clone ID: PAT_TA_52784
cccacgnncgtccggttctaggatcggcgaggcggcacnngccctttnntttttttttatttttatttttttttttatttttttttttttttttttttttttttttttttttttttttttttttttttttaaagaaaaaaaacaataactgggataaaaaaacgcattatccaaaaaccaaaaagtaaaaaaaaggacaaaggaaaaaaggggccattaaagggacaacttggggggggggaattttatttaggccaaaaaaaaaccggtaggggaaaaatgggccggggggaaccaaaacttggtgggaaagtcctccttgaaaggtccaaaaaacctggccttgaagtttcctttctttaaaaaaaagaaggggggaagggcccccaccctgaaatggtcaaaaaaggactttaatttaaaaaaaataaccttgggaaaaaaaaaagggggaaaaacggtggggggctctgggaacggtgggccgatctaggccctgggttcggacactaacttttgggtttgtgctaaaaggcaatgggggaaaattaaggggggtgaggtttgtgttgttggaggcg

SEQ ID NO: 52785 - DNA, 609 bp, Triticum aestivum
  Clone ID: PAT_TA_52785
atggattatcagcaatatatcagcgaacttagcaagaccagacaaccatcggctattcgtgcgcttacgccatatcttcatgaagaaaatatgatatctctaggcgcgggccaaccaaatcctagcacatttccttttaaaagcatgtctgttactcttgagtctggagaaaccttgcaaatggaccaacagttattcaagcgctgtttgtcttatgatctttcttcaggtcttcctcagttaaatgaatggcttaaaaaccttcaagaaatagaacacaaaccttctgtaaagggttactctctttccgtcggtgtaggatcacaggatttgttaacaaaggcatttgaaatggttattgagcccggaacagctttacttgttgaggatcctacttatacaggcgccattgcacatttacgcactcaaccttgtgaattaattggcgttgctacagacgcagaaggcgtaaaacctgatgcattggacaaaatactaaccgaatggtcatctgcgcccaccagtaaaggtaatggtaaaaaaccaaaggtgttgtatacaattccttgtggtggtaatccaactggtgcaaccgcatctcttggacgt

SEQ ID NO: 52786 - DNA, 183 bp, Triticum aestivum
  Clone ID: PAT_TA_52786
cgacatcagatagagtaatgggatatgctgggttacagcggtcctgcggatcgccaccccgcctcgcgccgacgccttcgatgctggcaaaaacatctcggtcgtggatgggagcctccgagctgtgctgcacgccgggggcgggacgaacacaacattcagcggcgagcaggtgtgctcgct

SEQ ID NO: 52787 - DNA, 534 bp, Triticum aestivum
  Clone ID: PAT_TA_52787
aaatatggttttcctttccaacgctatctctaatgctcgtatcgaagaatctcacagtaagggtgagctccaccatgatgctgtagaaacaactatttatggcactcgatgggcttctgaagatattccaagatttgacttgcctgaggacgaaatgccttcaaatgttgcttatagactgatcaaggatgacttggctcttgacggtaaccccgcattaaaccttgctacgttcgttacgacatatatggaagaagaagccgagaaactgatggctgaaaacctttccaagaactttattgattatgaagaatatcctcaaagtgtcgaattatgtaaccgttgtgtgaacatgatcgctcgtctttatcatgcacctatgcacagtgctgacgaagaagcacttggttgttctaccgtcggatcctctgaagccatcatcttggctacattggccatgaaacgtcgatggcaaaatgcccgtaaagaaaagggtttgcctaccgataagcccaacttgatctttggtgccaa

SEQ ID NO: 52788 - DNA, 585 bp, Triticum aestivum
  Clone ID: PAT_TA_52788
gtcaagggctacgacccaaccccttccggcttggctagctgcctcaagggctccgacatcatcctcatccccgctggtgtcccccgcaagcccggcatgacccgtgacgacctgttcaacaccaatgcctccatcgtccgcgacctggccaaggcctgcgccgagtctgctcctgatgccaacctcctcatcattgccaaccccgtcaactcgaccgttcccatctgcgccgaggtctacaaagccaagggcgtctacaaccccaagcgcctcttcggtgtcactaccctcgatgtcgtccgcgccagccgcttcgtctccgagatcaagagcaccgaccccaaggacgagaacatcaccgtcgtcggtggtcactcgggtgtcaccatcgtccccctcttcagccagagcaaccaccccgacctgagctccaacaacgagcttgtcaaccgcgtccagttcggtggtgacgaggtcgtcaaggccaaggacggtgctggctctgccaccctctccatggccatggccggtgcccgcatggccgagtccctcctccgcgcctcgcaaggtgaggaagggtgtaat

SEQ ID NO: 52789 - DNA, 570 bp, Triticum aestivum
  unsure (1)..(570): unsure at all n locations
  Clone ID: PAT_TA_52789
cacggaggggtccggaggctagaaagagaagaaggctctcgagcggcggctgcgcgacgaggatatgagcggcgaggcgggggccggcggcggcggggaggcgaacggcgtccagccgaacgtgaccatctacatcaataacctcaacgagaagatcaaactcgaagcgcttaagaagtccctgaatgccgttttctcccagtttgggaaaatcattgaggtgcttgcttttaagactttgaagcataaagggcaggcatgggttgtgttcgaagatgttgcatcagcaactgaggctttgaagaggatgcaagattttcccttctatgacaaacccatgaaaattcaatatgccaagaccaagtcagatgttatagcaaaagctgatggcaccttcgtacctcgagaaaaaaggaagaggaatgatgagaaacctgaaaagaagcagaagcgtgagcagcaccacgatgttaaccaggctggcgtgggcatgcatgcctatcctggtgcttatgggngctncgccgctctctcagctacctttttggtgcgggaccaaaagtcatgatg

SEQ ID NO: 52790 - DNA, 583 bp, Triticum aestivum
  Clone ID: PAT_TA_52790
ccccgcgtccgtgagcctcctcccgccacacagccagcgagccaacgctgcccgcttgcctccacccattcgccatggccagcgcgcccactgcaagcgagcacgcgccgcctgcgtctgccaccgctcccgtccccgttccagtccggccggtcgacctccccccaccggtggtacccgccagcaccgccgcgccggtggacggcagccgtctgtccgagcaggacgaagcggtggtcctccagtccctccgggcccacctctggagccacggcgacctcccccgcggcgccgacctcgtcgacatcttcttcggccggctcagcagggcggactacagcctctgggacatcgaggccaagatccgggccctgcggcgccggttccgggaggccgacgccgcgctctgcaccggcaccggctgcccggcccccgggcacggcctccggatgtacgcgctctcgctcgaggtctggggcgccacgcccgccgtcgttgccccgccccggcgcgacccggtgcccgacaaggacgcggcgtccacggcggtgacggcggtggggaacaggatgcctgtaacgcc

SEQ ID NO: 52791 - DNA, 606 bp, Triticum aestivum
  Clone ID: PAT_TA_52791
gtaatcgtagttggcggtggacttgctggtctctctgctgccatagaagcacacgatcaggggaatactcgagttattttaattgaaaaagaagataagattgggggtaattctatgaaagccagctctggtatcaatgctatcgaaaacaccacgggtgatagtcgtgaagccttcatacaagatacactaaaatccggcgacggtctaagcagtgaggaacttgtgattaaattggtagatgaaagtcaatcttcccttgactggctcatccaccaaagtgaattcgatgctggtaagccaacactggacctatccctcgtatctcgatgtggtggtcattcttttggtagaacccaccggtgtcctccagagaatggtagacctgtacctgtcggttggaaattgattgatactttaaaaaaacgattgacatccctgccacatacccaagtcatgacccaaacacgcgtcttgggcttactgtccgatgcttcacagagagtctgtggtgtccggctagagtcggatgaagaaatcacagcagatgcagtcattttgaccagtggaggatttggtggccaaacaggtacatatctaactgat

SEQ ID NO: 52792 - DNA, 586 bp, Triticum aestivum
  Clone ID: PAT_TA_52792
tgacaaaagaatctttaatattattgaaaaaactttatactttccagacagcaacttgaacctatcgtaaaagggtttgatcaagaatataaaatggggctcaagactccttccaaaggcttggcgactatgattccctcatttgttaccaagatgcccaagggcaatgagaccggaacttttctttccctggatatgggtggtacaaacttacgtattgctgctgttgagctcaagggagctggtaaaagcattgttcatgaactcaagcgctgtccttccatagaactcaagacaggtgaaggtgcaatgttctttgactggattgcagatgctgttcgagatctcatcactattgaagctaaacatttatttactcaaaaccaagtggaaggtaaagaaactttggctttaggtgtctgttggagttttcctgtagatcagactgctgttgaccgtggtactattctcagaatgggaaaagggtttacattaaagaacacggaaggtaatgatcttgctgatatgtttcatgaggctttcaaaagaaagaaactgaatgtcaaggtgactgctatattaaatg

SEQ ID NO: 52793 - DNA, 600 bp, Triticum aestivum
  unsure (1)..(600): unsure at all n locations
  Clone ID: PAT_TA_52793
agcccgtccgccgccggccggcctcgaaccttccaagctaagcagctagctagctagctacagcggcggcgaggaatggagcgtgtctcgccgtggctgctgctggtggtgcttctggtggccgccgcgtccgggcggagcgcgcgcggcgatccgcaggtgccgtgctacttcgtgttcggggactcgctggtggacaacgggaacaacaacgacatcgcgtcgctggcgcgggccaactacccgccctacggcatcgacttcccgggcggagccaccgggcgcttcagcaacggcctcaccaccgtcgacgccatctctcggcttctgggcttcgacgactacatcccagcgtacgcgggagcaaacaatgatcaactcctctccggcgtcaactttgcctccgccgccgccggaatcagggacgagaccggccagcaactgggacagcgcataagcttcggcgggcagctccagaactaccaggcggcggtgcagcagctggtgagcatcctnggggacgaggactccgcggcgaaccacctgagccagtgcatcttcacggtgggcatgggcagcaacgactacctcaacaactac

SEQ ID NO: 52794 - DNA, 558 bp, Triticum aestivum
  unsure (1)..(558): unsure at all n locations
  Clone ID: PAT_TA_52794
ctggcggtcaatagcgtctgcccatttttcacgcttcgggatgcgtcagctagccaaacccggcgcgcccaaagggcggtcgcgccgggccgtcgccggagccaaggagaaggcggtggccggctcattccggcggctgtgcttcgctgccgtcctcgcggtaaccttcttcctctactaccgtttctcacagctggacgacccgtgccggggacggtacatccacgtttgcaagctgccgccgcgcttcaacaccgacatgacgcgcgacgcctgtcgcggcgatgggcgctggcccgcgggcgcgtgcgagtccatcgacaatgccggcctcggcccgccgctcgccgacccggccgacggcgtgctcaccggcgaggacgggtggtacggcacgcgccagctcgccctcgacatcatcttccacaaccggatgaagcggtacgagtgcctcaccaaccacaccgncgtggccaccgccgtcttcgtgccgttctacgccgccctcgacttcgcccgctacgccggccagaacaacgtgacgcgggacgccgcgtc

SEQ ID NO: 52795 - DNA, 143 bp, Triticum aestivum
  unsure (1)..(143): unsure at all n locations
  Clone ID: PAT_TA_52795
cccacgcgtccgcccacgcgtccgctacaattgatcttaatctaattggagagaaaacaaagtcccaagaccgtattgttggtgcacacttctttagtcctgtgctgaagtgtgctgnntacgaactatttcntgcagaggac

SEQ ID NO: 52796 - DNA, 621 bp, Triticum aestivum
  Clone ID: PAT_TA_52796
cgacagtcttcctacgttatgataacctgaagatctattatccgaacagtgtgctggccaccaagccgatttttaatttctacaggagtcctgatatgggagagggaattgacttctctattcatgttgccacgccggtggaaaaactagctctcatgaaggaaagaatactacgttacattgacggtaagaaggagcattggtaccctggtgcgatggttgtcctccgagatgtagatgacaccaacaagctaaaggtgtccatatggctccggcacacgctcaacttccaggacatggggatgaggttcgtgaggagggaactggtgctccaggagatgatcagagtgctcaaggacctcgacatcgagtaccggatgctgccgctggacgtgaacgtgcggaacgtgccccctcttcagtccacaaggatgccgacgacatggagctatgcctgaagcggcgaacgcgagggccagaagatacagcagtagcaactatagcggatagccattagctgttagtgtgcctgctgtgatgagtgtgttgtgtagtataaaaagctttggtgcacttggtgataggcaatgcagatagtggccatttgaaatgttgaaagcg

SEQ ID NO: 52797 - DNA, 349 bp, Triticum aestivum
  Clone ID: PAT_TA_52797
gcaagcatatgcctaccgagtttaagctaggtgcgcagtactagatgtctatgcactccgcgcgggtgtgtgccgtgccggtgccggttcaagagaagagacctcccgtggctgtgggtgatcatctgcccgtctagttcgagtatatgctttcagtttcagcagcgcaaggaatccgcttgcgcttctgttcgtgcgctggattccgctttaatttgtgcactagtagtaaataaacaacggactggtcaatgctgctaatccgtatgtcctatatagtactgtacaccactagagatcagaatggatccaaagcaaataccaagaatactaggcccgtaagggttcc

SEQ ID NO: 52798 - DNA, 426 bp, Triticum aestivum
  Clone ID: PAT_TA_52798
gcagccagggcccgtgaacacaacccgccccggagtgcgcgacctctagggcagagccaagtgtgactcctggaagctcgccaaagcgaaatctagggaggcatggccatggcgtcgcctacagtcactcaaggtggaagcactctgccttgaggacgctggcgctgtatctgcttcttcttaagccatgacactatcattgatattatcctggcgtaccatacacatgtgttatcactaaacacaaataaatttgaagtactactctcacaagctcatctcactactggtgtgtattacttcaaacatgccctgcctatggttatatgccatatactcactgtttcatttctacgccgcaaatgattcatatatgtgctatctagctaagactggccttctttgcggaaagcgagcgcttcagaa

SEQ ID NO: 52799 - DNA, 561 bp, Triticum aestivum
  Clone ID: PAT_TA_52799
cccacgcgtgcgggtcgcgtgggttctcctttatgcgcgccaagaaagtaatcttttgcattatccgttgctgtttccgctgtatctgcagcttttactgctgcaattattacaaagatggctattgaaaaggttcctgaaacactttcacgaaaacctatcaacatgctcttactcaggtcaatacttctctcataattactttaactctcaacccatcaatccccccatggaaacctctaaattgaatcctgatggtagtgctaattattgcgactcattatacacctattactatgctcagtactatagtgagactgaaactgaaacttcacctgaaccatttactgcaggcttttacacacgttcatcccatctttcggagccttctactcactgtactttcattccttgcttataacattatactaactattctactagctctaaaacatattctgaaaatggtactgaatatggtactcaatatcgggctggtttactggaacgggtcattattcctgacactttgactgtcgggcgtgttcaagggctagacca

SEQ ID NO: 52800 - DNA, 330 bp, Triticum aestivum
  Clone ID: PAT_TA_52800
aaagagaagctgctatctatgatcgtcaaattagattatggggacttgacgcacagcaacgtattgggaaagcgcacattttaattgctagtgttcgcgcattaagtaatgaagtctgcaaaaatcttgctctagctggtgtcgctagcattacattacttgatcacgaaattgtcaaagagcatgatttgggatcacagtttctattgcatgaagacgatattggaaagaatagagcagaatcagctgcacgtaatattcagttgttgaatcctcgtgttcatgtttatgttgacacagaagatatttcagaaaaaccagatagttatt

SEQ ID NO: 52801 - DNA, 555 bp, Triticum aestivum
  Clone ID: PAT_TA_52801
aaaaatggagacaagaaattcgttcgcaacaaagaagtattcaaaagcagatatcagctatcgacaacgaggaagctaaagtcaaacgatccataaagcaagtggctaaaaagggagacactaaaagttgcaagatgcttgctaaagaactgatacgttctcaaagacataaaaatagattgtataccagtaaagctcagctcaactccatcgttatgcaattagagcatcaattagctacacttaaagtagctggctcacttcagaaaagtggggaagtaatgaagctggttaatcagctggcaaggttgccagagctatctttatctatgcagcaaatgtcaatggaaatgacaaaggcaggcattatggaagagatgattggtgatacgatggagatgatggatgatgatgatattgaagaggctgccgatgaagaagtgaataatgtcttatttcaaattacagatggtttgcttggcgaggcaggttctgtgggccctatacttgagactaagccagctcaagaggaagaagaagaagaggaagaagaga

SEQ ID NO: 52802 - DNA, 604 bp, Triticum aestivum
  unsure (1)..(604): unsure at all n locations
  Clone ID: PAT_TA_52802
acatatttgagactaatctcaagttaatatttgcagttcttatagcacactattttatttcggctttaaacattaatgtcaccaactacattataaattctagattggtatatacacttaaaacattattcattcttcgatgctgttacaatttatggtacagtactaaacatattacaacacccattgttgcatcatataaatttcctttgagcaaatatttatttgctcctagtcctttgaccaaaagcatccttaactttattagaaatttattcaatattcttcgaaaaccacaacctgtcagcactgaaccaactaaatctcctgctaaacaacctatatctatggttgatacctttcaaaaagcagaacaaatgtttttagccaatgtcaaaaataccaagacttctacgctcaattttctcaacagcaacaccaattctgtttatcgcgattctttaacagatataaaagaagcatctaaggcctctaaactagaacgagacagtttaaaagaacaggtatttggtactgaatctacacacttacctacacttcgctntgtaccttgtatacaagctcctactacgccccttgttaa

SEQ ID NO: 52803 - DNA, 242 bp, Triticum aestivum
  Clone ID: PAT_TA_52803
cccacgcgtccgcatccgtgtccgcattatcgcgaacactgtttcgatcacccattacattgggtaagacgctatgagagcgagagacataatggatgctcttatgcatgctgatgaataagtggtggcaataatgatggatgattaaatacacgctgaccaatggcgcttgttgatgaacttattggacaatggacttgacctgttttttttaatttatgagaaaaaagggcggaacgatc

SEQ ID NO: 52804 - DNA, 493 bp, Triticum aestivum
  Clone ID: PAT_TA_52804
aaattaattgttgggtcggtgtttaattcacataccgggggaaaaaaaaccccccacgcaccaaacaaacacgacgaccggggggggggggaaagcgggccccacacacacaaccgaaagtaaacgcacacgggcacagagacccgccccccaccgcccaaagaaagggcaccagcccccgggccacccacaaccaagccggcacccacccgcccccccacccggccccccacccgcggggcccccccccaaacccggacccaccccggcaggcaaaccaaccacccccccggaaagccggacgaaaccccgccggaaaaacggacaaacccgggaccggggggaaaaaaaaatgcggtcacaaacccacacaccaaacaaaccggaagcaaaaagtgcaaacccaggggggcccaacgaacgagccaactaacaaaaaaggaaaggcgcggacggcccaatagccaaccgggaaacaaaaaaggccagccgc

SEQ ID NO: 52805 - DNA, 540 bp, Triticum aestivum
  Clone ID: PAT_TA_52805
gataaaagccgaagagaattgtctggttaatttgcggaaaaccgagcaaaacctattacaacacacctaaaccgccatcatgagacatggccatgcatggggcactgccgaccactcttgtaggtacataaggtactacatgatgtatatgtaataaaccactatatttacatgaaacatttatttacataggataactcgacatttctactacctgttttacggctcattgcagagcacgagattctgtactgtcgagctcgttctgaacatagctgccattgttcttcaggaagccagagtaccatcgagcagagagcttggcttgtcgtggccgcgcctcatcgttaaaatcgacacggtataggccgtaccgtgactggggccctgcaaagaactcgaagacgtctaggaaggaccagacaaagtagccttttacatttgctccattccttactgccttcagtgtgctacccatgtaactcttcaagtattcgatcctttcggtgtcattgagagtgtcattagatgcaacaccat

SEQ ID NO: 52806 - DNA, 460 bp, Triticum aestivum
  Clone ID: PAT_TA_52806
aataaaatatttcttttattaagttttttgaatataaaggaagttgaagcaaaaaaagctatatacaaaatgctaaacttgtttttgcaagttttaaaaacacttgggaatcaaaaaagttttttttaagggatgcaaaagatattttataatatttaaccaccgaaaccatagagggtacggccttgtctcttaagagcataaacgacatccaaagaggtaacagtctttctcttggcgtgttcagtgtaagtaacagcatcacgaatgacattttcaaggaaaaccttcaagacattacgggtttcttcatagatgagaccagagatacgcttgacaccaccacgacgagcgagacgacgaatagcaggcttagtgataccttgaatgttatcacgaagaatctttctgtgacgcttagcaccaccctttccgagacctttaccaccttttccacgac

SEQ ID NO: 52807 - DNA, 449 bp, Triticum aestivum
  Clone ID: PAT_TA_52807
ccaaaggggtttttggttttataaggcccccccccaacccatgggggggggggccgcccggaattaaaaaaaaaaacccccctttaaggaaggggcccaaaaaaatttttttttgggggggggggaccccccgaaccctttggttccttaaaaaccccttcccaaaaaaccccgtccttaaaacccccctaacccctccaaagctggaaaccgtttcggcaaaaaacccaccccgggccccccttcttcccccccttcttcttctccccctgggccgggcttagccccaagtatgggccccccaaaacccgcccccccaagcaacccatttgtaattggaaaaaaaccatttttccctttttcatgggcgcccctttaaatataataatcacccatcatccccatgggaaccccaaaaatctttcccaaaagcccccccttggccattc

SEQ ID NO: 52808 - DNA, 543 bp, Triticum aestivum
  Clone ID: PAT_TA_52808
acattgatggtcagaatgatttatgtcaaggattttataaaagttatttttaaaagacaccccatgagagttctggtgtcattttaatatagattaacaaaaacttgaatacatcgccttcaagaggtaatagaggtggtacgatgtgtggttcacgcatcttcaaataggtacgtacgatataaaagataatctcagcatcagaaggcattccctttattttaggtattcctctgaatgcagccattctttgactgcttgaaagctcttttactcgttcaagagtatattttttagattctgcatccgtacgaccattgatagtaataagttgatgtatttcactaagattgaataaaaagttttcattgttattgaattcaggtaaaagcatcgtaatagccataaatttaggatcacaagtaacaatgttttgtccagagtttgacaagacgatttcaaatgattcaatagatttcaaaagaggtctgaatatatgctttaacaatgcctcatttaacttgtgataatgagtacgtgacc

SEQ ID NO: 52809 - DNA, 539 bp, Triticum aestivum
  Clone ID: PAT_TA_52809
ggctgtgtcgctgaaagcgtaaaaatcgttcttttatttgtcaatgcaagaaatgtacaagtgaataaaacactaataataaaatatctaatatcctaagcgttcttttcttattttaaaagcattttctctcagatatttccatttgtctgacaatctgccagtgactgcatcgtttgattgccattcttctaagggtcggtccaaccatccttctgaccaggcgcttagcatgtcactatagtgaaattcttgttccaggctcataataaaatcttttttgtcatcggttcccttagctgattcttcaaaaggaagcataggaattttatggcaccaataccttgccataactgtagattggagttgcatcaaggggaacggtacgactctcataggtaagccaataaaacacagagttggattatgcttgtaaaacatgtaatgtaataggttatgtactttttgaccagtctggattaaatttcccttttgaaatggtaagaaaggataactaaataaatagccagttccaaaca

SEQ ID NO: 52810 - DNA, 559 bp, Triticum aestivum
  Clone ID: PAT_TA_52810
aaatcacgataacgtgaaatagctgccaagagtatttattgtctacacatgaacatgatgaatatgcaaatataagcacacgtgcatgctactgtaaaaatcttggacgaacagatatgaacagtgcttactgctcgacagacacgccatagcgttgactcaatgtcaaccacattaattttccacaaagaattaagcatggcaccctttttctcctcaatactcttcagtatctgctcttccttgttgtcaccatcctcaatctttttcatcccctcttgtaattgtatcagagcaattgcacctgaagctgcattaacctgtgactttacatggtggcccttgtctcttacccactcagcaatgaatggcacgcccatatacattttgctttttccaagttctcttgctgcttgtcgaacatatatgtagccaatggtgtggagcatagcctcaccaaaagcggcttgagacaagcgttcagcttctgcacttgcccaatcaccaaattccttgtgctttccatcgacgtatggttgaattcgattcttaaggctca

SEQ ID NO: 52811 - DNA, 535 bp, Triticum aestivum
  Clone ID: PAT_TA_52811
ttttttttttttttttttttttttttttattttttttttttttttttttttttttttttttttttttttttttttttggacgcggggggggacgcgggggcccccccggaaaaacccggaccgggcccggggggccaaccagcccccccgagggggggggggaagggaggggggggaaaaaagggccaaagcggcgggcggggaaaaatggtcacccgggaacaagcccaaaaaaaaaacgagccgaaagaaaaaaaggaaaagccgggggggccaaaagagggaacaaacaaaaaaaaaagggggggggccaaccgcccactaaaaaaggggaaaacccggcgggccagcaaaaaaaaaaaaacggccaacccccgggaagagggggttcgcaaaagggacgccgggggggatttttttttaaccaaaaaaacggccaaagggggagggcccttaaccggccggcccgaaaagaggggcagcaagcggcccagggggggcgcccccagggggaaaaaaccccggtggggggggg

SEQ ID NO: 52812 - DNA, 548 bp, Triticum aestivum
  Clone ID: PAT_TA_52812
ctagtgaacttaactttcttacgaactactaaattgaactacaagcatatgtatatatcatctctgttgacttcctcgtcacgatttgctgtcaccatatcctagcaggtctctcgaaacgtaaccacagccggatgaacaaggccctgatcggttcctagatgccttacttgttctgatcctccagaagcttcttggccttatccaagtcatcgccatggtccatcaggccagcggaaaccatcaaagattccttggccttgatttggtcactgatggcctttagtttcgcgatccactggatctccttggccaagagatccttcgcactgcctttgtcgggcgctgccttaataacttctgtggccttgacattagtctcgtccgagaaatgctgggcttccgaaatcttgttctgaagaatctggaatctctcaatgtccgtgccctccacgctgacggcgccaaaggaggcgcgattgtcgaattggaccgctagccaagatcgccattctttgatgatgaggttagagacaagacgctctttg

SEQ ID NO: 52813 - DNA, 432 bp, Triticum aestivum
  Clone ID: PAT_TA_52813
aaaaaaaaaaagggcccggggggcccccgaagctgttttgtttaaaagggggccgcccccaggggttttacattaggcccccgaacaaaaaaggaaaacactaaccgggccctggtttttaaaaaggggcccccaaaaaattggggaaaaaaggaatggggccccgggcaaccccaccctgaaacttgacttgttttcaccggggacgggccccctggggggggggggccccccatgggccccccccccaaaccccaggaagaagcgggtttgccccccatttggcttttggccgggaggaaaaaaaaaaacaccccttcggttaaaggatttggggggaacggccggttttaaccccaaaagggggggccataggccctccaaaatccccgggggggatgagcccaaaccccaacggggtccccatttttc

SEQ ID NO: 52814 - DNA, 466 bp, Triticum aestivum
  Clone ID: PAT_TA_52814
cccgggaacggtttggccgctttaaaattgggcaggcaagaggaaaacattacccccagggaaaaaaggggggtacattggccggggagggggggctccgaacaaaacttaaatttgggaatggattcagcgggcaaccctctcaaaaaatcggccctagctggacaacgtaaaaacggaaacaaaatgggggggggggggacccccttttccagcaaagggccaagaaaaatcgggaactggcccgggagttcctggagctataacaaaaaagggccaggggccctgaagtccctggggggggaccatttttaacttttttttttgggggggggaattttccaacccttggcccaaaaccaaacgggaggaggaaagcgggggcaaaaatggggtccctaaaactgaaaaaacccctggcctcaagcgtcctaaagggcggaaagggaaaggtctggctcaaccc

SEQ ID NO: 52815 - DNA, 448 bp, Triticum aestivum
  Clone ID: PAT_TA_52815
ggaaagaaaaacactgggggggggctagcgggtttaaaaaaatatgggcggggttaaaaaaaaaaaaagccctccccaaagccccatgggggttttttttcctttaagctcccttttccttttccttttaaaattagggggcccccctttaaactttttttgggtcaaaagggtgggcttcccctttggggggcaggacaacaatttaaaaatttttggccccgggtggaacaactcccaaaaaaaattgggggggaaaataaacgggatttttcttttccaaatcttggggggaatttttttccaaaaaatcacaaaccggttaaaagctttaaccgagggggttggctttccatgcagaaaaaaacccaaaggggtcagccatataaaatttcgggtcatggggaccaaagcctacaaaaggggggaaaatcccaaaggggccaac

SEQ ID NO: 52816 - DNA, 361 bp, Triticum aestivum
  Clone ID: PAT_TA_52816
ggaacaaagggtgaaaatctcgggttgcccaaaatgaatggcccagcagtttgggggggggaaagaaccccaataatcccacggggggcccaaaagggggcctattttgggggaaaaccctgggggggggttcaatagtggaccaacccccccaaaccatgtttgccttcattcatggggagacctcaatggggggtcgatgcccccctggggggatcttatagtccccaaatcctgcttcaacgaatatttttttccaatggtgctcgtctcggtcgaccccatcgacccccattattacgatatcgaataaaacttgcgtctccttgaaaataacatcctgggatgtccccggaccccg

SEQ ID NO: 52817 - DNA, 465 bp, Triticum aestivum
  Clone ID: PAT_TA_52817
acctgaagaggtcacctttattatctttaaaccggctcgggaacaaccactatgtaacagggaaaaggcagagagcgagaacaagaacaggtgggctcaagggatgccaaaatggacatgcctgggggcaagaattaagggcatacagaggcaaccaacggatggcatgtatgtccaccgatgaacgacaagagggcggggtcgagcaagaaccagtaagagaatcagccacgggagcactcgggggggaaccccttggggaaccgccagccggcgtcgcaatagttgtagcgcatgtaattcttcttagcccaagcgagggggccccgctctggggggctgggccggcgccgcatccaacgggcggtgtcggcggggcaagcaaacgggcggccggccccggcgggcacccaggcgtccccggagtacccgcggggggaggcgacaaagggggcgggggcccaa

SEQ ID NO: 52818 - DNA, 502 bp, Triticum aestivum
  Clone ID: PAT_TA_52818
ggaaaaagaccaacaataaaaggggttattggccggaaaatgggggaaaaggtccaggccccaccggcctttttgggggggaaaaccccttggcccaaaccccgaggttggcggttacaatttggggggccgtttggcccgccccaacccaaaccttgggccccaggacggttaatttaattggggcttattttaggggggacaacctggttggacccgaaacccctaaaggggggccccgggggtcaccccggaaattcgggccgggacccggagggggaccaagttttccttaaagggggcggattaaaagctgggggaaacaagggcaaaagtggttcccgggggaaaatggtaatccgttaaaaattcccaaaaaaaaacaacccgaaagcaaaaagggaaaagccgggggggccaaaggggggaccaaaccaaaataaatggggtgggcctaacggcccgttttcaagcgggaaaaccggtggggccagttgattaa

SEQ ID NO: 52819 - DNA, 463 bp, Triticum aestivum
  Clone ID: PAT_TA_52819
ataggcaaaaaaaggacaaggcctatttttaattttttttggttaaaaacaggctggaaaaggggaccaaaaacagagggaccggccaaaggaaatgtttcgccaaaagagcccggctctccgtccacaattttacgaaggatcccacccaggattttcccagagcgggttttggggaaatctgaaacaacgtaaatccccttaggagtagcaaagggaccgatcactttacaaactggaaaaaccaattccttttaaaacccttaaaagccccaaaaatggggtttaaaaaaagcaaaggcatgaatacatgggccagttaaataattaggaccacctacaacaggtgtttttgcaacggaaggaaaaaaaataaaagctgattcaatttcagcaggggatagacgatgaccaaacacattgttaacattatccacacgtccacaaatccaaaataaccatc

SEQ ID NO: 52820 - DNA, 465 bp, Triticum aestivum
  Clone ID: PAT_TA_52820
gggggcccttaaacaaaatatttcactaccctggtatcacaagggggagcagggggcggggggaactttcactcaaaaaccaacccccgcgggtctatctagggggaattcccccccccccactaaaaaatcccatatcggccctttaaaaacaaagcagaggcccaagcccaggagccgggtcacgggggcaaaaacctaaaacgggcttaagtagggggcaccccggcaatcaccggaacaggcatgggccaccgggaggcaaaaaaacacacggcccgctacaaaatgtacaagggagcggggcccccccatcaaaaaaagacccaggagctggggccccccccggccctgggggtggggaaaaaccggggcggggggaacaacgggggggggggggggtaccacggggggtacaccgggaacgggtcctttttggggccatcctttttggcgggggccttt

SEQ ID NO: 52821 - DNA, 333 bp, Triticum aestivum
  Clone ID: PAT_TA_52821
tccggtctcccttggacagcccctgttaacaggcagaccacctacgatggcacgcaagaggagaacctattcttcaagctgctccgatccaactccagcatctcgctccagtagtaactaagaggacgaggaggagatgcgatgacacacaggtgaggctgaatcaattatgcacttaagtaagtaatggacagtaatggggcaagtctaaggggcgatgctgcacctggccacaaggtacatccgaagggctgagcacattgaccggcgctacccgcatccgcagggttcatcgcagctgtcatgtggcaggacgccacctatgacacctga

SEQ ID NO: 52822 - DNA, 464 bp, Triticum aestivum
  Clone ID: PAT_TA_52822
tgatctgcagaatgacgtgaagaatattgaactgatcaatttttcaaatgatttaaatagaataacagaagaaggagattacttcaattggtttactgcaaaatgtgaccttagagtcatcaagggacaaaccaaagtccttcaagggcttcttatccctcaaaagtgcgccgaacttaaaattacaagtatttcatttgatttaccatcacgatggcaagtggaactcaattatactgtggatcaaatatctgaaagtcaaattacaggccgcagaaagtggttagaatcagtttcagagcttgatggtaaacctacttttaaagtattggatggtcgtggagtactctatagtacaaacatcatgcaaaaaccacctagcattgatattgtgtttgatcataatgcacctgctttacttgatgagctattcaaacttgacattacgataaaaaatactgaac

SEQ ID NO: 52823 - DNA, 461 bp, Triticum aestivum
  Clone ID: PAT_TA_52823
cacgtttttggctgccaagctcttactttcctctagtgtacacgcgtggtaccttgcaaacagattttcagggtcatccttttttgacggctttactttctttactgactcagaatcccactcatggatttgtaaagtatgttgatcaagcaactgcaaagtcttctggtttgatctacaatcaaggtagcacggtcatcatgagggccgacaataccaccgatagccctaatggcagaaaagtctgtcagaatcactttaaaaagttcctactccaactctgctttggtattactcgatcttgagcacatgccagttggttgtggtacctggcctgacttttggatggttggacctaactggccaaacagctgagaaattgatattatcgaaaacgtaaatgaagctactgttaatcaagttactttgcataccaagaatggttgtactatggctggtgt

SEQ ID NO: 52824 - DNA, 352 bp, Triticum aestivum
  Clone ID: PAT_TA_52824
ggggaatggggcccatttttaataagaagataagcaaataaaagtatagaggggttaaatataaaaaaggaaataaaggggggggggatgagtgaggatgcccccggccatggtaacaatataaaaaaacattctaaaattctttttttttttacggggggggattgaatatcacttaaaaatcttttagttggaaacaaagggggatcatttttttggggataaaacccatttttttttcgttcttttttttcaagcataggggggaaaaaacgtttttttgccttaataaaccaattactaatttgatttaaattcaaatgggtttttggtgccaactgccccttttttt

SEQ ID NO: 52825 - DNA, 564 bp, Triticum aestivum
  Clone ID: PAT_TA_52825
tccgccccgcgtccgccccgcgtccgccccgcgtccgcacacaccgcacgcgtttgacattttccgcccaccaccaccggagggagcgagctccagccatggccgccaagtgctacccgacggtcagcgacgagtacctggcggcggtcgccaaggccaagcgcaagctccgcggcttcatcgccgagaagaactgcgcgcccctcatgctccgcctcgcgtggcactcggccgggaccttcgacgtggccaccaagaccggcggccccttcggcaccatgaagtgccccgcggagctcgcgcacggcgccaacgccggcctcgacatcgccgtcaggctgctcgagcccatcaaggagcagttccccatcctctcctacgccgacttctaccagctcgctggagtcgtcgccgtcgaggtgaccggcgggcctgaggtccccttccacccggggagacaggacaagcccgagcctcctccagaaggccgtcttcctgatgctacccaaggctctgaccaccttcagcaggtgttttccactcagatgggtttttgagtgacca

SEQ ID NO: 52826 - DNA, 401 bp, Triticum aestivum
  Clone ID: PAT_TA_52826
atttactcttgctggaccaggaacacatcaatatcaaaaagaaggccattcaaattatggtgaccatgaaaataatgaagatcttcttaaacatattcaggaacatttcaaagaaataccagtgacagagatgccagagatgacaggaaaagatattattttttatttatttgttgttcaggagttaaatggagatggttacttggatggacatgaaataagatgtgcttacactgactttcattttaagaataattcaccatctttaaatgaagtaacagatatggttgatcacgttttagaagaagatgatttaaatggagatggtcttatttcatggaatgaatatcttgaaagtcaagcctatcatttggatgtctttaataaaggttaatttaatg

SEQ ID NO: 52827 - DNA, 562 bp, Triticum aestivum
  Clone ID: PAT_TA_52827
aatagaatctggatagctttagatcacaaccaaaacaggaaaaacattctcagttcaacctaggactcgaacagtttacagaaaatggtgttcagtatgtctgcaaacatgacatggacgcaacatctaagaaaatccaacaagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccgctgaactgctcctcaatgtgagagtccagtgtacgtccctgctggcgcttctcaagcttcctctggacattgttgctcttctttgcttcctctgtggcagcagcagcaacctcagactcttgtccctcagcagcatccttcttggcagctgcagcagctttcttcttcctaccgatttccactccataatgagtcaggtaccactgcttgaaaggggcagcatcaacttgcacaatggcattcttgacaagggtctg

SEQ ID NO: 52828 - DNA, 441 bp, Triticum aestivum
  Clone ID: PAT_TA_52828
ggggtggtcatatgccgcagcaatttagggggggaccaaacactcttatattttttttacgggggggggcccccctataaagcggggctttcattttaatttcttataaaataattatttaggagttttacacacaggtcccgggtcatcaagacactcgttacagggggcctgaatggtccagacactgggatacataccacgtcgggaattcattggcccacgtccccatgccttttccggtttctaggggttgaccaccttgcccttgttcctgatctggcccctggccccggggaggacccccttctggcccctgcccttggtggagttcttgaagggggcgaaaaaaacccccttgtcctgcagcttgtccaccaacccgggggcccgggagttggtgaacaccgtggcatcgggggggaacaacccctgccgggc

SEQ ID NO: 52829 - DNA, 539 bp, Triticum aestivum
  Clone ID: PAT_TA_52829
acaaaataatatttttaatcaatatacgatactaatataaaacaaaaggtatatatttaaaaaaacaaagaaacattaagggtgtggaggggagtacatagggcctaagttggccattcctgagcagtcgtcttccttcattaactttaatatgattgggttgatggtattgcttaaaagtacaggctttagaggattgtatctatactttgatttgatactgatatgttcttgtttaagagccacaataattttattgatgcttctaaaatacacttggtctcccaacaaaactgaatcaattcaggtaccaaatcacatttgtccccaaagtcaggcttgattttaaggtttgtctctctccaaaggccaaacataccgtccttttgataacacacactccagaagtgcaattcagtatctaagtttttttgaaagtaaaaaaaaaatgaattgtactgatttcataaaatatcaaaaatttacatcccagctttatcatttttttctgtcaacttcaatatgctgggattcacaat

SEQ ID NO: 52830 - DNA, 536 bp, Triticum aestivum
  Clone ID: PAT_TA_52830
aattgcgtagaacaaaagataattgattttatgatacaatgaagatacagtcttgcctcggttcacccatgcacccttacacagccacactgacatggggatgaactctagaacaatatcggaatgtgaaaatagcgacaaagaatttgttcctcagaaaacagagggaactaaatgtaattgggaataaaacaaaaaatagtacgcagacgaaatccactgatcgccgcaacaaacaaggcaaaatgatttgacactgccaccaacgacactcgctggatgcaagtcagtcgcttctctccttcctctcgccggcgacgactctccgctacccgcaggaagaaggagagagaaagaaaatggcggacagcggcggcagcgactgggaggtggtgtcgctcacggcctccacctacgccgccgccccaggaccaatctcgcccatccacgacaccgctgacaaagcagagtcgcctcttcttctcctcccaaatcctcccgctccccctgcacatttcttcatgtcccagcacttc

SEQ ID NO: 52831 - DNA, 231 bp, Triticum aestivum
  Clone ID: PAT_TA_52831
gaaaataaataatccagccagccatacccaggcaagggttaataattatggggggaaatagggagccacatccatccatgcgtgggggcaagcgaattattaccatgcatgtttgtatcgggcgcgggttaatcgggcaaatattaatcgggcggggaattcatcaccgggctctgggcgatgccgatgtctggtggcgatgccgatgcctacccctcccggacgcgtggg

SEQ ID NO: 52832 - DNA, 533 bp, Triticum aestivum
  Clone ID: PAT_TA_52832
agcgctaacacaagttaatgtgatagcatataattcattaacgtatgcacagatatgaatagcaggcggagccacatgacgacctcaggtaattagcaacgactaaattccaatttcacatataaaccacgactcacgcgcctactgtaagaccctggctcaggctcatatgatgccggtcacgttggccacatcaagagcattactctttggtgtaaaatggacgttcgcctgcttctctgaatgaggcctgatgagggagaaaacctttttggccggacagcttacagtccatagcagcaacctttattcagttcttgcaagtctaatagcctacaattaaaacactggtgaagatgtcaaaccacacacaacatgatgactaactgtgaatcgaacccttaaggaattcttactgccttaattggtagctaacaggatggctgaagctggggtaacaggcttccctgaagatgaacaacgattacgtgttgggaaacttcaattaagagagcattatgtttaacaacaac

SEQ ID NO: 52833 - DNA, 544 bp, Triticum aestivum
  Clone ID: PAT_TA_52833
gcttattgcgagcaaagcaaatgtgtatgaatgcttagctgcgaatgaagaagtttatttgttgcttttggaatttgattgctcagtcaatggctttatgtatttttcatgatatggtggtactcctgtgctttttggagcaagaagtaaggaatcaaagtatgactcataaatatttccatcgtattttcctattggtgctttaaggacaaaatctggaaggccatagctatcagtaaggccgacgacctgagatcgaagtgatttacacaacttgaagtatactttttcaatacttttgatatggtcgggcgtaaggtaattttccttgatgccctgatcgctgtatgtgtaaagtatgcacaaaccccacaaggctgttaattttttcattatagccaaaacacttggctcaatatgaggggtgcctataggctgtccaaatttttcggcacaaacatcaaacataaaagcagcaccatgcatttcggtgactcggacacattcgagaagaagatcatcatgtgtgccatttttaagagct

SEQ ID NO: 52834 - DNA, 536 bp, Triticum aestivum
  Clone ID: PAT_TA_52834
ggtatgaaggataaactaaacaaaaatagtggtacacaatccagcgtaacattttatctggatacaactatttatatcttgaacttattaaactctagagagctgatagatcaagttagctagcagcaaattgtatattgtatgtagttactccgacagaacaatgatggacgacgatcaagctagctagctagtagcatggcatggcacgaccttggcacggagtgggtgcttcatgaccatggtgagctccagcgtgtcagtgaagtccaccggctcgccgggcacctcgctccactggaacgccctcaccatggtggccacaaggaggttgacgtgcagcagcgaaatgtcgatgccagggcacatccggcggccggcaccgaaaggtatcattttgatctccttgctccctgtgaggtccaggtcctccccctcaccacccgccaggaaccgctccggccggaaccgcgtggggtccggccacaccttcctgtccatgggcatgtcgcccagcgtgaagttcaccgccacct

SEQ ID NO: 52835 - DNA, 542 bp, Triticum aestivum
  Clone ID: PAT_TA_52835
aaaaggattattctatccctgatttggattgtgggttttattatgacaaccaaaacttctatttaaaatcaaaactttctctttgcgtgaacaaatgccaagatgggttgttgtatattatctgaaggactggcttgtcttggttgtaagtcattgtttaatgtaaacgtagtccctgtgcccaccatctcgactggaatctccttttctccatgatgttgttgtgaggccacaactttgagttttggcagttttactttaccggctaataatggatagcatgtataatgatacatttttctagacaaaggtagcacactgcccttgacttgtttatatccagaaaatacaaatgcttcacttagctcaatggatgctgtatattcagtgatatgttcagttggattatagatggtataagataaagtaaaaggttcgcctagatatatctcagaaggtacatctgcaatgatactcaaaccttgctgttgtaattgaatagtaggaaggctaatgattgtcttacagcattcgttacttgc

SEQ ID NO: 52836 - DNA, 542 bp, Triticum aestivum
  Clone ID: PAT_TA_52836
actgtaatacattttttttatcgaaaagggaggttgaagcccctggcctctgcatcattctgatgcacacaaccagctatatataattcataaaacttatgctctatacaacatcaaagtaaaaataacattgatatgaagataaactatctaggagttatcgtagatatagtcacatcattaaaactacaacacttagcagaatcagaagcttctttgttgcctacacttatactgtaatatgctgggtgcttaggcttatttaagatcatagtcttgctgcttagcattgcaacaacatccaacatggtcggtcgatcaattgcatcttcttgtacacataacaatgcaatgttaatggacctcatcatttctgacgaatcgccgttgggaatcaatgccgcatcaacgagttcgatccatctttcctcttcaaataattgccaagcatatccaatgaggttgatgaaagctccacactcatgggaattctttttcccgctaatgatctcgagaactaaaacaccaaagctgaatacatc

SEQ ID NO: 52837 - DNA, 546 bp, Triticum aestivum
  Clone ID: PAT_TA_52837
attaaatcaaatcaaactcataagtctttctgttatccacatttttagcatctaaaggatcgatcgtattttcaccttcagctgccggtagagtcttgctaacattgtaactgcttcgctttctagaagatgacctaaatacttcctgcggtgtgctttgactagtttgtgcattttcttcatctgatagtatcaacttcagcttagcacttgctgaagctttggatgcaggtgattgaagctccggatctgataataaatcttcaatgcgatatttgattgttggtttaggcggggttggatttgcaggaacataagtcacaggaacctgtggcaacttgctttcaaataagatagatgattgctttttcaaaggaggcaacggtttatccttttcataatttatctttttgtcattttgatgtaatggttttgcctgttctgcaggaaatgtttcaatatccctttgctccaccaaatgccaatccagatcattactatcttctggattgtgtatccgcattacacttgcgggaaattggaact

SEQ ID NO: 52838 - DNA, 290 bp, Triticum aestivum
  Clone ID: PAT_TA_52838
ccaagcaaaaaaagaaccccatagttttagccgggttccccccaaaaacaaccaccataatttcttgggggaaaggtgcggcgggccccctccccaattaacaacaggggcccacgttgatcaacaccaacgcccaaacaacgaaggggaaagggcgatgggacccgaaaaaaaaaaacatgccccaaccaataaagcgtcttattttgggggggccccgggaagccccatcaccgccatcgggcgggagtagaggctccctcttggtcgggggccgtcggcttgttctt

SEQ ID NO: 52839 - DNA, 477 bp, Triticum aestivum
  Clone ID: PAT_TA_52839
aaaaggggcgaccggctcatatttttataacaagaaccaagcctgggaacccaaaaagggaccctatccccgtttttgcccacccgtttccaaacaggaatccccgttgtttacctatccaaagccatccttaaaccctgggggggggaaaaaacccccaccccacaaagcccctgggttccttgcatccatgcaaccatcccccccaacacagggtaaacaaacccgatgttgtcccccccaaaaaacggcttccgctgggaccattccctaaaggccccctttaccatctccactcctgcaagcgttggcttccccccttcgcctttctccttggcgggctggcccacaaacattttccaccatggggcaactagcttgttgccaatgtaggctccccaaaatccacccctaaccctttggaaggggccgccgggaagaagggagggcccccggccccgtgggcccacccggaaa

SEQ ID NO: 52840 - DNA, 529 bp, Triticum aestivum
  Clone ID: PAT_TA_52840
cagacgactaaataatctcagcatttattgataaactttaacataattaatactccagtatgagttggtgaatgagcgaggattatttgcgacataatcattgcaagatgaggggcatccggatgagctgtagacgctacctgcccagtcaccacagaaagtcaagtcaaaaacaatttgtaattgagagaaataacttattgaacacgatcctgattggaacgggaagctggctatgggagcaggccaagagggaggattgggagatccgctactgatatcagagggaatattgttacgaggaaagaaccaaacctgtacaccttgacttgcggtcatgcgtgtggcatagacaccacccttgatgttattcaagccctttccataagtatttgtgtttgtagcttgtacaccgcatccagcgttgtttgcttgaccagcagcattgacgtaacagttgtcagtgagagatttgccagtttgtgtacgtggaacaccagccatagtacaaccattcttggtatgcaaa

SEQ ID NO: 52841 - DNA, 534 bp, Triticum aestivum
  Clone ID: PAT_TA_52841
aaccacaccaatttcacgattaccattacaaagcaaatcccacaattatcagaaagttttcaagacactcaacatctgatagttaccgacacaacattggagagtcgactgacaaccatagagcagagcaaaaatcgtggggggcggtagattttagcatacagcgcgattagcacttgacctctttcagcccatgtgcaaagtacaggaaagttggatcagcagctccctccttgtaggaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggttcttgatgtagcgcttcatgtgagagagaaactgctacttgtcaaaagcaggttgctcctgaagacggaaggtgtcaacaatgtcaaccaccttgacggcctggtcatcgacaccctgatgatgaccaccacccagagcgggaggga

SEQ ID NO: 52842 - DNA, 447 bp, Triticum aestivum
  Clone ID: PAT_TA_52842
aaaaacacaattacaaaggccgccgggtagcattcgggccccaaaaaaacatagatccctttttatcaagggaacaaacggggggtccacgggtccagttttaaggggttgggcaaaaataacttaggggcaaacattttgcattttccgggaacgactcaacagggggggccggtgggctacccccataatgggggggctttggtctacataaagggtaagggattttacagggatacctggtggggtataaaaaagctctaaatcttctggtatgggaatttccttggaaaacaattaaggcgcttttttttggttcttacggggttaaaggaaacttttaaccaaactatttttttcaaaagggggggccccccttttggtaataagccccaggatcgcaactcccaaactataaacatcacttttttaagggaggaggccttc

SEQ ID NO: 52843 - DNA, 260 bp, Triticum aestivum
  Clone ID: PAT_TA_52843
aaaaaagaggggccccttatgggtaatttatttatttttaaaaaagaaattcaaatgacagggggggctttagccccctttttacttggatccctggggtttttcagccttgggggggggcttatcagattcatccgggaaatcagagggccacaagggcaaatgggctttcaacaatggcataaaagggggagagcccttggttgattcttcgggggggggttaaagctttgaaaaagcatcggcgcccacgcgtccgg

SEQ ID NO: 52844 - DNA, 511 bp, Triticum aestivum
  unsure (1)..(511): unsure at all n locations
  Clone ID: PAT_TA_52844
aatggaaaccatgccttattccatttataaaggcaccagttctagctgtacaaacttaaatcccagggcactatgttttggccggatcaaatggtaagtgtaccatcatacaggggacaacaaccctaacctttttgtggttcaacgtgggtgttctttcctttgccgcaatcgggtggattggttgagcaccggcttctccgggtaagtggtcccgacctgcntggtcgataggcctgtgctgcagttccaacactctcttttccatccttattggctttgcctcaggccatcgtggactgctgccttcaaaaatggaccaacagggcactggtgaccatcaatttcttcttgggctacaggattagcggggtatgtgaactgctttcatggatggggcattactacgggatcagcatccttgctatcgcccttattatgcttaccagcttgcacgaccttatcttcgcgcgtcgatctttaacaatggccttcaaatcattcttagttt

SEQ ID NO: 52845 - DNA, 286 bp, Triticum aestivum
  Clone ID: PAT_TA_52845
ggggccaaccaaacaaaattttggtttaggcgaattggccatgcgttaacaagggggtcaaacccttttagggtgcccaggggcctttgcaagaaggttcccctataaggctttcattataatttactttgccaaaggggaaattcggctggttttttttggaacccccttgaggttccaaatacttctccacattggccaagccacacaggtcctttaccacaggggtgattgccggaacttccaactcaaaaaacgaaggggaaaaccatcccggacccctggg

SEQ ID NO: 52846 - DNA, 581 bp, Triticum aestivum
  Clone ID: PAT_TA_52846
tcgcgatctagaactagtctcctttcttttactttttatgaccttttattctttataaaaaaaaagagaaaaacaaaaaaaatactttttacaaatgtcagttcatctcgaaaaaaagaaattacgtacgtttagtcctgttatattatttcatgatcatcactatgtagaagctggtgatatccatcatattcatattccttacaatgataaacgtcatcttgatttacacaagaagaggataaatgaaatgcttgaaatcaatggtaaatattggttggatgtcatcacttactctcgagaccaccctgaacctcattcacctgtcccttcacttgtctcatcacccagtccaccacctgttaataaacatatgacaggaaataacaaacgccgacgtgggaatctcccaaaagccgtgacagccatccttcgtgattggctgtgcaaacacaagaaacatccttacccaactgaggaagaaaaggcgcagttggcagcagaaaccaatctgaatttaaatcaaattagtaattggtttattaatgcaagaagacgtatattacaacctatgcttgaag

SEQ ID NO: 52847 - DNA, 549 bp, Triticum aestivum
  Clone ID: PAT_TA_52847
gatggctcatcattactgcatgaacaaaactgaagcaaacatcggctaaaacacttgcgataacagggactgactgactgactgactctttttgtttctcaatcatccaggcattaagctagtacgtaaaattgcattacaccccagtgccatagtatcaagctatctaacaaaatcttacagagcaaagaagagccttccagactctgcctaacattagagtttaccgcaagagacatcataaaacactcaaaggcatggtatcaatgcttaacattagagtttaccatcattacagaccactcaaaggctggctggctagccctctagaatcttgcaaactgcctgttatcatcaccgcccttccatccataaggatttgcggcattgataccatgcctcctcgccccaccatccactttccttgtcttccgacgtttagaagcgctgctctccaagtcgaggttcacttttggagggttcttaaaacagaatgatgctgctacagccttcatatcaagatcatgaacattaaaaatgtccttcatg

SEQ ID NO: 52848 - DNA, 566 bp, Triticum aestivum
  Clone ID: PAT_TA_52848
tcgcgatctagaactagacaagttagaagaaggcatgaatcaattcaaagagtatcaatctcttcgtaaaaagttggaatcacgtcgattggattacgatgctaaattggctcgtttacaaaaatcaaaaaaggaaaaaccggagcttgaacaagaaatgcaagcagccaagatgaagtacgaagaagcagaatatgacgtgatccaaaagttggcttcattacaagagtttgaggatgaacactgccaagcacttgaacaactattagaattacaaactcaatatttaactcgttctttggaaatcgtaaagcaagtcaaatcaaattggggtagaggtactccttctgttcttagtgcccgtcagaccaagatgacttctgtttctcgttctgaattaagtgtgccaagacaagcaagcacggattccttgagtcatctttcaccaagacaaccaagtacagattccactagtcacctctcaccaaggctagtacctacacctattgctagaaagctttcttttacacaagaagagcaaccacgtaatattcctcctcctgtat

SEQ ID NO: 52849 - DNA, 368 bp, Triticum aestivum
  Clone ID: PAT_TA_52849
aaaacggggaaaacattttgggttcaaaaataacaaacaaccgggggggggggggggggatttcctttcaaaaaacacggggtgggcccactacaaaaacgcggggggttcccctttaaaaaaccccccggggggggggggcccccccaggggccccggcggccccaaaaggggccccccctacaaccgggcctaaaggggccccctggaaaaggaaaactaaaaatttttttttggttaaaaaaaaatggggaagagaggccccgggccctatgttttcagaacaggggagggtcttttttttttctcaggggcccttgtcgggggggggggggcggggcgaaaaaaaaaaaaaaaaaaaagggggg

SEQ ID NO: 52850 - DNA, 421 bp, Triticum aestivum
  Clone ID: PAT_TA_52850
ggggcataaaataaacctttttaaaaaacccccaaaggatgggctggcctttaaaaattttcatcccaggaaaaaaacccccccccattaaaaccatcttttttaaaaccgggaccaaccaaatggggtccctcattaaaagggggggaatttttctaaaaaggaaagccaggggggcccccttttatttcaggcccccccaagaacccctccccctttaaaccggggccaccaaataaaaaaaaaataatttctttcccgggaatctcgggcatctcgggcacggggttttttttaaaaggtccctgaatatgttaaaaaaaaccttcatttttttcagggcccccaaaattggaagggccttcttttaaatatagaggggccccgggcccacaaaaagaaaaacggccccgggggccac

SEQ ID NO: 52851 - DNA, 537 bp, Triticum aestivum
  Clone ID: PAT_TA_52851
aaaaaaacaaaggatttatttctcatttattcatcgccaaatctgttggcgattacacaagaacagacaagacagggaaaagaaacgcactacatatatttctcatcagagataagactcgacaagaacaaagacacaactatagcataattttaggttgcagaactcttacacacatcaaccaaactggctccggcccaaaagatcatcatacgtcgacgatacgcgtccactcagccggagatttcgatggccttcacctggggcttcttgacctctgccttgggcacggtgacggtgagcacaccgttctccagcccggccttcacctcctccaccttggcgtcctccggcaggcggaagcgcctgacgaacttgccgctgctgcgctccacacggtgccacttgtcgttcttgtcctccttctccttggtgcgctcgccgctgacgacgagcacgttgccgtcctccacctccaccttgacctcctccttcttcacaccagggaggtcggccttgaagacgtgcgcctcgggg

SEQ ID NO: 52852 - DNA, 592 bp, Triticum aestivum
  Clone ID: PAT_TA_52852
cgttatgtctgctacagttactcttacccaggtcatcgtttaggtggtgaagaatacaaccctaccttaggcttggaacactttgatggttacaagtttgctcccatccgtgaatcacaagtgagtcgtgagatggtaactcgttatatgaacgatatgcttcattatgccgaatcggatgttgttattgtcggttgtggtagtgcaggtctctcttgtgcgtgggaattatccaaggatcctagtcttaagattgctatcatcgaacaaagtgtttcacctggtggtggatgctggttgggtggccaacttttctctgctatggtggttcgcaagcccgcagacaaattccttgatgagctcgagattccttacgatgaaaaagatgattacgttgtagtcaaacatgctgctttgtttacttctactatcttgtccaagatcttgatgcgtcctaatgttaaacttttcaatgcaaccgctgttgaagatctcattgtcaagaataacaaggttgctggtgttgtaacaaactggactcttgtcacgctcaaccacgatactcaatcttgtatggatcctaatgtcattg

SEQ ID NO: 52853 - DNA, 557 bp, Triticum aestivum
  Clone ID: PAT_TA_52853
cccacgcgtccgcctatcctgcaggaggaggccaacaaggaagaatcacctgcacccgccgccgcacctgaagctgcaccggcaccggcaccggcagaggagaagaaggacgaggcagcagccgaccaagacccaaagaaggaggaaccaccagcagccgacccaccgtcccctccgccgccggtgccggtgatcctgggcgtcgaggtgcactgcacgggctgcgccaagcggatcaggcgctccctcctccgctgcaagggcgtcgaggccgtccacgtcgacatgtccgccaaccaggtcaccatcaagggcgccgtcgacccgcaggccctctgcgaccgcctccgcgccaagaccaagcgcgacgccaccctcatctcccctctgccacctcctccgccggccgagggcgaggagcctccgccgccccctcctccggcaccgccgctcgtcagcgaggcccgcacagtggagctgctcgtcaacatgcactgcgaggcctgcgcgcagcagctgcagaccaagatgatgaggatgaagggggtggtcagcgc

SEQ ID NO: 52854 - DNA, 322 bp, Triticum aestivum
  Clone ID: PAT_TA_52854
aaaaaaaaaaaacagggggaggggtcttttacccccagagcctaaaaaaagaagggggaacatgttcgttcggcactgttttggaattttttccggccccggtcggttccgatctttacctcaaaaatttttaaggtcgcccccattatttgccgggccgacaaaaaatttgggccttctaaggaaagggtcaacccccgcgggccattggggaacccaacccgttttttcgggagggggggccaaaaaaatgctccgggccggggggggaacaaaaccggacaccccgggaggcctgccgtttccccgggaaaggggaaag

SEQ ID NO: 52855 - DNA, 544 bp, Triticum aestivum
  Clone ID: PAT_TA_52855
aaacaatgggcaaacttccgtgcgctgctattatacagaaatcacgttcgaagggtatgttctcagcgaggtaaaaaccaagcacccctagtgccgattgtgttcaaattataaaaagtcagagaaccaaccaacaattgacaaagaaacctgtgaaaaaaaaaaaaagtaagcccattttgagagaaagttaagccgaagcggccaattgctcttccttggcttgtctagcaagagaagcacggacagcacaagcagccttttgaccagagatcaacatggctccaaaggtaggacccattcggggagcaccgtcgagttcggcgagctccataccagtaacaaccatgccgggaacaacttcacgtgtgtatcgaacaatatcatcttcagcagcgttcatgtcaagagaaagcatacctttcttctgatcaattaagccaatagactcaagtcgctttacaccactagcacccataggcccgtcatgtccagtgccagacacgatgacctttgcttcaatgacattaggatccatacaaga

SEQ ID NO: 52856 - DNA, 544 bp, Triticum aestivum
  Clone ID: PAT_TA_52856
aaaaaaaatcaatcctcacgtcagattactttattctatttactttattttcttttggaaataaacaaagaaaggtttgtcagaagggatcattgcccacagtacaatcatagcaatagtcataacggtgcaaacataaggcatagacaagataccaagctttccagagattatgccagtaataaaggggaaaaatgcagcaccacctgctcccaaagcagaaataaacccaatagatgtagcgtgatagcttcttggtagcacttttgatgcaattgaaatggtggtaggaaccataggaccgagaagtaagccaatgaagattaaagctgacgttttcacaactatatcagctgagataatcattatggacaaacaaccgacaatcattgctgtaaatatggtaatcatgagcttttctccaaacttgctagccaggtaacccagcaagattcttccactggccaaacctgcccagtaaccactaataactcggcccattgagatgatatcaccatgccgaccctcagtcaggtaagtgtat

SEQ ID NO: 52857 - DNA, 545 bp, Triticum aestivum
  Clone ID: PAT_TA_52857
ctgtatacaaaaccacacaagttgttttatttatttttttcattaaaaaaaatgatgttcattccttatttctcatggctgaaacagctagagctaaattcattaaaacggattctgtgtcttgccaattgatacaaccatctgtgatagatacaccatacttgagagcacaagttccttattcaggcacgctttgcttaccttctactagatgcgactcaagcatgacacctacaagtgcagtgctgtccttgagatatttgtgcaccaatgcattgtgctaccttgggcagattttcgtgatccttggttgaattcccgtgagagcaatccatcatgatggaagtaggcaaaccggcattattcgagcatctgctttgtttcttgaacataagatgcttcataatttggccccttgttaccccctcgtaaaatgatgtgacaatctgggttaccagttgtatgcgtgatagaaatcgtacccaaattattgatacccaagaaatggtgaggtgcggctgctgcaccaataccgtcaatagcaa

SEQ ID NO: 52858 - DNA, 412 bp, Triticum aestivum
  Clone ID: PAT_TA_52858
agcaccgggaacccaaccccatgggcttatttaaaacgaagcaaaaaacccccagaaaaaacactacgaccaaacccgcccaaggggccaaaaaccccacaggggaaatttgttaggctgggtttagcccccaccccctcacgggaacggaaaacgggaaaaatatggggcggggggttgggccaccccccgccataaccggcctaaggaaaattaaaattttggggaaggcaaaaagggcacaacttgggaggaccccggggggggggcaaacccaaaaaggggtttaaaaaaaaggggcaacagaaacaagggcaaaaaagaggggcaaaaaaatcgggagctttttggggccatatccaacggggaggagctgggaagccccccaaaaaaggccccccattttgatgct

SEQ ID NO: 52859 - DNA, 409 bp, Triticum aestivum
  Clone ID: PAT_TA_52859
ctaggtagcagctttctttaccaaaacaaagtatacatatggggttatataaagacataggcagaaatcaggtattccaaggacccacagttaactcggtgaatagacatgagtttcaaacaaggacggaatcaagcataaccagggaccgttattgacatgctagaacaacattacatttagggtagtctagctctggctatccaatctgagaacatcgcggaatcgcacaacgaatccgccgccctcctgccagatccgtacgtactaattaccaatcaataagtcgtcgcagaggtcagggagggaggacgagccgagggagcagggcaggtccgggtccagctccggggcggcggcggcggcggtcttgctggcgagctccaccgcgcggtcaaggaggctgcgt

SEQ ID NO: 52860 - DNA, 443 bp, Triticum aestivum
  Clone ID: PAT_TA_52860
aaaccggggccagaattatcccaaatccccggaccaaagaacccaccccacccaaccccctattccggggcccttccaaagggccgggggggcgggggccccccccccgggcccttccgggaacaaaaaaaaaacccccccatatggcggcaacccccccccggggaaaaacccccaggggggcccccaagggggggggatctttttcccctggcccgccacagctcaaccccgcccccacggggggcccccaattatggccccaaccatccccggatcgaacaaaacgggaacatgggccggggggggggggcaaagggcatggggggggcagggtcccggacccccccccgccggggcaggggggcctcgggcgggcccccccccgggggggcccgggggacccccgtgaaccccccgacgacccggagcccccgggggac

SEQ ID NO: 52861 - DNA, 504 bp, Triticum aestivum
  Clone ID: PAT_TA_52861
cataaggaaaataaaagggtttatttaaaatttttgtctcattgttctttaccccctttatcctgggggaagttgcattataaaattagttgtttttttaattttccatgaaaatgacattgaaaatggggggggaatctaaagtgctttccaagcttttatgaccccttgaacaggctcctttttaccccccgaaactttaacaaacgtttcacatccgtaaccaggctttccatttcgaacaggcccaccagtttcacgagccaaataaactgctttggatgctgccttttttgacttcatatccacccaaacccaacttaggaatgatttaccgggataaacccaatccttactagcatccaagttaaacaattgttgtatcaaataaaatcttaatcgacttgttttttcccaagttttttttaaatactctgaatcttgaacaacagcctttacaaacttaagtgcaggaccattgaccgaccagggcacttgtttttt

SEQ ID NO: 52862 - DNA, 164 bp, Triticum aestivum
  Clone ID: PAT_TA_52862
gggggggggcaaaaggaaaattcgggaaaacatttttgattaaaatatatcgaacaaccgggggggcccgggggttatttccttttaaaaaacacgggttgggccatttacgggggacccactcgggccgttttacccatatccattaccccccacccgtccgg

SEQ ID NO: 52863 - DNA, 605 bp, Triticum aestivum
  unsure (1)..(605): unsure at all n locations
  Clone ID: PAT_TA_52863
tcgcatgccaccgccgtaccgtaagccttggaatnccctctagaagccggcccgcccctttttnnttttttttttattttatttattttatttttattttattttttatttttttttattttttttttttttttttatttttttttttttgtttttccttttaaaaaaaatattggggggagaaaaacagtgtttaaaaagatgcgtttttttacggccccaaaaaaaaaaaaagaggggaaaaaacccggggcaaaaaaaaaggggggggaaaaaaggggttaaaaaaaaaaacaaacccatgggaaacaaaacccaaaaaaaaaagggaaaaaacctgggaaaccccccggggccgcccaaaaaaacccccaaaaaagggggggaaccccccccaaaaaaaaaaaaaacgggccccaacaccccccaaaaaaaaaacaagggggggggccccccccaaagaaacgaaaaacaaaaccgggccccggggggaaagaccccgatcccccaccccggggggagaaccccccgacaggggcccccccaaaaaggaaaaaaccccgggggacccaaaaacccaaaaggccccgggccggggccccccc

SEQ ID NO: 52864 - DNA, 519 bp, Triticum aestivum
  Clone ID: PAT_TA_52864
aaaaacgacgagttcattggatatactaattctcatggcaggcttgaagataacactaatattacaagtacggaaatacatactaatatggttgcggacattgaaacatgctaaaaaaacagtaataaagatacaaaaggttttgatggagcgtccccaaacttggaacaagctagagtatccatcaacctaggttttcagttcagactgggagaaccatttattcttctcttcacgagtctctcttagatgtgctttgggacttcatacttgtagatgaaatcagtccactgactgatcattagtctccggttacgactctgttgctcccagacacgacatggttgttcccagataccgtattgctgctcccggttacggtattgttgctcccggatacagtatggttgctcccagatacattattggtgcagcccgtcactttattgaaactgttagttacaatatggttgcttccagatacaacatggtggtcaccacttagtatattgttgtttc

SEQ ID NO: 52865 - DNA, 532 bp, Triticum aestivum
  Clone ID: PAT_TA_52865
acacaaaatacacccccttatatgcaagtcataaactgacacacaacaccttcttagaggccataaaacctaaagcaacagggttgacactacgccaataaccggctacacccgcacgcagaccgctgtttatatgcatgttaaaggctcggcctaggctaaccaagttttgcatgccaccccgaccagtgctagtacataagggatgcatcatcccaggcaaacacactcaactgctcacatacttgcagtcttgaactacactaacacttcaacatgctcatcttaccatgcttgccttgacgagaactcgacgagccaccacaaccacttctcaaacttgtcggccaaggaaacaggccactctgcatatcacccatggccgtgcaccatgcttcctaagaatttttccacctaaccgtttgctaaccaagtaaactggtttactgctctagcgacgcgaggatctacccggcaatcacctaccatgccctgcatgcccaccacttctccttaatgggtaccactttaa

SEQ ID NO: 52866 - DNA, 470 bp, Triticum aestivum
  Clone ID: PAT_TA_52866
ggaaaaaaaaacaagccgggcggggtttttttttcccccgggttttcctttatgccacacccccatacccacatgatacagggctttatagggacaaaagggcgcgcccggacccctttccgttcggtggggccggggctttgccctgcccatcggttttttattctccaacgccggggaattcgcttaaaatttccgttacaagcctggactggcccagcgccaggtcaaatgccctgagaggggggggggggagggtcacctccatttcctccggggggttacgcaacttgatgggcaccggcacaaccttgttggggttagcgaaggggttttcgtccattacactgccaaatgggaaaacaggggggggggatccgagcccattgatgctgccctggagcccaattgccgaaaatggaagggtcacgggttttggcccaaagttcaaaaccttaactttaaggaag

SEQ ID NO: 52867 - DNA, 455 bp, Triticum aestivum
  Clone ID: PAT_TA_52867
agaaaagcgggaccgggtcttacctgggtcaaaaaaaggccccggggaggacaaaaaaagaggggtcttttgttcgaaacaaacaaccaaaaaatgggtacccgggttatcccccccaactttttgggggaaaagggggcttatttgcagggggggcccattggggggcacccccatatgccaaaaagggcccggcgacggggagccccccgggatacaaacggggggggtttctctgaattcttccccaaaacaaacgggggggggggaaccaaaaatccccctcgatccccctcaagggtcgggaaggaattcatttgaattccccccacatttggcaagcatggggcatgttgccccccggggaagtataaaacacaaaaccggccccaaaaacagggttgcagtccgggttcatgtcgttgcccaagaacatggttttggggtttttaaaa

SEQ ID NO: 52868 - DNA, 547 bp, Triticum aestivum
  Clone ID: PAT_TA_52868
gaataataaatttattttatttcctctttttaaatatgattggacaagaatcgtttgccgatcttctctttctacttacagtaatagcagtagccatagtgacagtaatagattacaaatgcttatgggtgatgatggatagcttgatttaaagagattaaggtaggtgtagtaaccatatgattagaaggatcatacaacatggcataagtcagtgtccactgaattctgtgaactgcccaacgactcaactgccaccatctcaatctttcgttgtgtccaatagcacgaataccatcccaataaccaagtccatctttgtttgagccatattcttttaccatcctgatcacttgatcttttggttgatgtagcataggtgttttgtaggtcagtgcatagctaaggttttttgtataaataggaagtgaaatcaagtcaaacagggatcgatagatgaacgggaaactgtacggagaggaaagaggtgacaatcggatgtgcatcaaataagcagcaggcaaaatggttaataaaggataaccca

SEQ ID NO: 52869 - DNA, 517 bp, Triticum aestivum
  Clone ID: PAT_TA_52869
agatgaagcaagaaattccacccacatttatttctgattggtacgaacgaaaaagactcaactgacactttcatacgtagaaaaacataacacactcacatgacacacacaagcaaataaaagcaagcaaggggcagggggacatcaaccggttgaaaccaacatgcaagaaacacaaatttccaacgaaactagaggttttgcatgcacgaaaaggtcactagcatgccttttccctgacgcattggacattattttgagcacttttgccctgagccttccacgccttttttatttggcacatgcacgaaatggcctcccgcaagcgcacctgggccacggggcaacaggtcatggagggatgccagcactgctggatgcgggaggcgctcaaggagctcgtcgcccggcacgccaagccgcaatccgccctgtgaacagccaaacgggctggcggggtgactggagctcgagcgcgcgccacttttgcgagaagaggccgggagcgagcaccaac

SEQ ID NO: 52870 - DNA, 275 bp, Triticum aestivum
  Clone ID: PAT_TA_52870
ggggggaaccctgaaaaaggggataaaagggggcattggaccaacaaagcgaacagggggtctttttctaaaacaacaggggaaattccaaaaaagggaaaaaaaattaaaaccccaaaaataacaaacccgccaaaacagggcaagagtcaacacccaaatcaattcccaaaaaggggaaaaaccgacccaaacttgggggtccccaaacccaagaaaccgaaaaggccacccgatggggaaaaaaaaaaccgacccaattttgggggaccccg

SEQ ID NO: 52871 - DNA, 534 bp, Triticum aestivum
  Clone ID: PAT_TA_52871
attcttgaaacacaaaaacaaaaaaggagtttttattaaaagatgcatcagcctgtttacacaaaagtagaagaatgatactttctttttacttgcattaagttaaataaaaaaagaatgtgcaattagtattaatattagggattagttgaatttagtccttgcgcttatagaaacgtctccatttatcatcaatcttttcaatgtagtacacaccagaagcgatatgttcaaggctaccctttgggctgaaatcacgagcattatgagttaattcacgcatcttcatagcttcagagaaatcttcaggctttgagtgagtacgagcagccagacgttcacgcaagtttaaggtgttcttgatcttttctgttgagctattgatacggaaagaaatcatggaggcagctaaacccgaaccgtaagagtaaaacaagacacgtttgttttgcaaggtttcggagtctacttcagagaccaaggaggccaaaccagcccacacagcagcagtgtacatgtttccaatctgtttag

SEQ ID NO: 52872 - DNA, 370 bp, Triticum aestivum
  Clone ID: PAT_TA_52872
gggggggaaaaacccccaaaaaaaataacgggggaggaaggtgggggcatttaaaaaaggggccaaggtgggggggggcaataatggggggaagaaaccaaattggtgcatggggttttgccccgggaaggattgggaaaaaagaatttaattgggggacggggctgggggggggttacttcccggaaaaagggggtaaaaccccttaaagaactctggctgggggggggggggggcctttgggggaaaaggcccaaacggggggggaacggctttttttctggcggggggattgagggggcgcacctaatggggttcgtggctggggtccttggaatttaaaaaaacggggggttgggcccaccgggtg

SEQ ID NO: 52873 - DNA, 531 bp, Triticum aestivum
  Clone ID: PAT_TA_52873
gggatgattgatgtttataacaaaagtagtcaaatcactttttctgtttcatgttgcaacatggttgaaaataaatattaaaaagcttataattcatgggctttacggaagttttcgcccgcatagatggcacttgatcccaattcttcttcaatacgaagcaactgattaagtttagctaatctttcacttctacaaggagcacctgtcttgatctgtcctgttcgaagaccaacaacgaggtcagcaatagtcgtgtcttcggtttcaccagaacggtgagagaccatgacaccccaaccggcagcttgagagtcgagagcagcttgaatggattcggtaactgtaccgatttgattcactttgagtaaaagagcgttacatgccttcttttcgatagctgtggcaatacgtaaaggattagtgaccgtcaaatcgtcaccaaccaattggaattctgaggtctctaaaagatgagcccagttttcccagtcgtcttgatcaaaggcatcttcaatagaagcgattggg

SEQ ID NO: 52874 - DNA, 450 bp, Triticum aestivum
  Clone ID: PAT_TA_52874
ccccgggggcatcaacgaggggggggcaacaagggcgtgtggaaaaaaagactttccgggctctccctacctcgacgacgcccgacccggccccgggaaagggcatgtgaaagtttgggcccccaaaacggggggtccccttcaaaacttggcagtgggggggtctttaaaggagtactttgggccggcgtttgggggggcaaccacaacattttttgggtggtccgggggctaaacccgggttccccaaccccttgatccggggggggggaaatgcaattttgctccgccgggggggacgccccagccgaagctggttaaacgacttataaaattcgtaccagggggcgaggggataatgcggtcttaaaacccttgggaggagagggcattcgcaggttttgcttttctttgctggggggaagggcaattttaaataaccggggggcg

SEQ ID NO: 52875 - DNA, 397 bp, Triticum aestivum
  Clone ID: PAT_TA_52875
aacaaaaactggggcggttatggaatattcacggagcattacatgggggggaaaaaaaaggggggggggcaaacccccaaaaaaaaaagatcccccccgcccgggacgccccacacggccggactcaggccaaggggggccccggaaaacactcgtttgggcggatcaaagacgggggctatgggccccagcacaaaccatagtttgaacgccgggacgtggaacgatcactggttggcgttggccccggggggggggggggggggagggtcctccccttcggcaaagggggggggggggaaggagccacccatgcccactttggacttgaagtaaaccttgggggggccgtcgggggtaatttcgacgaggggcccccaaagaattatttgtttgc

SEQ ID NO: 52876 - DNA, 401 bp, Triticum aestivum
  Clone ID: PAT_TA_52876
ggaggacttgggcgccgttttcgcggggacacaaaaacatatttttttattgggccacaaaggctaatgcgagaatccaaaccatcggttgaaaactccaggcccatacctcccctggcttaaaaagaaatacaaaaaggggggatagtcttttgcaaaagttgacgaaaatgctgctttgtcgttgcctggcgtcttgggaaaggcaccgccagagcctttagtttatatgtacaaaactgggtgggcccattctacgcattttttatcgttacaaggcgggtctatcaatcgtttaggctggggcatccttcatgaaggggaacagggcgttccgttccttgtcctttttgaaaccgccgaaggccattttggggccagggatgtactttttgggggtc

SEQ ID NO: 52877 - DNA, 275 bp, Triticum aestivum
  Clone ID: PAT_TA_52877
ggttgcaaggcgctactcgaacgggatacatatattggcagaggatttctcaaagcgggcgaaaacaggtgggggtttcaaaataggcaacaacccgtgcatgccgaagcattcccaggacgccacagctccaaaccaaaatacataacaaagcccggtggggggctaaaaaaaaatacttgcaaacaacaggggggaaaaaagaaaggtgggaccggtttttattagcaaaaacttgggttgaaacatgccatgccgtagggcggacccctggg

SEQ ID NO: 52878 - DNA, 528 bp, Triticum aestivum
  Clone ID: PAT_TA_52878
gcttttcctccatccggttgttcctacttttctccaaataagggcctgctgttgctcggaaagaccaacatgcatgctgatgagcccaggggacaaccggcgcgccccatttcaactgtgtttcaccatggggtcattgtgaccggctaggccgcgaccgtgtgaatgcacctgatgggcggcaccctcttctctttgcatgcgcatttgccgtgcgacagtcaacagcacgctgggcgagcggtaaaagataacctttgtggagcccaacaacaaaacggttgcccggggggggcaagcactccggcacgggcaagtagctgaccatcggcgacttacccacctagaattgggtgatctgcgtggaaggccaataacgcttaccggggggctgaataccaatggttggtaaagcgcctggtgcctgttcatgatttaatgaatgcgtgaattgaagacaacaaatatccaaataagaggagctgtggaacgaataccgggccacatagaaatcatgggaccccgatg

SEQ ID NO: 52879 - DNA, 484 bp, Triticum aestivum
  Clone ID: PAT_TA_52879
aacatacatgaaccccgtgaacaggtgcgcgccaatatacatttcaccgatccctgccctacaattatccaatcgcaatacggtgtcgcgaaaatgtactaaggcgagcacagatcacctagcctagatcagattcaatgcgctggggacgtctcgcaggccaacaacctcagccgtcacaggcgcgacggtcgcccagaaggtccctgcgactgtaccgtcgatgagggcgtagaacaccagcacgccgtatgatttggcgaagacccacatcagcagggcgaagacgccagagagcagcgtcatcatgcctgccatattaatccggccgatggagtcggagaagtagcctatgggcggccggccgaaggcttgtcccagattgaacagagcgctgacgatagcggcctgcgaggcatataggccgatggcgttggcgtttttagcgagcgagaatatgatcactacgtaggcgaagatgctg

SEQ ID NO: 52880 - DNA, 316 bp, Triticum aestivum
  Clone ID: PAT_TA_52880
ggggggccttcttttttttttttgataaagacaggccaatgagtggcatacatatatagctgctagaaggttgagtaatggagtgagagcgcagtcgcaaagagacactgccgtaaggtataagagcagatgggggacaggtacagcggccggataggcggagaggcagcagagcgcaggggggccagatactatgtgccaaggagggagcctaggcaggacctcccaggcattgagttggggcatcagggcgcatccaagagcctctactgagagcagatggaggctgagggctgcctcacagagtgcacgcccg

SEQ ID NO: 52881 - DNA, 531 bp, Triticum aestivum
  Clone ID: PAT_TA_52881
aacaaagacttgatcgattattgaatattcacgtagcattacatcgttggtaataaaaattaatggaagcaaactcgcaaaataaaaagatactccacgcacgagacgcaccacacgtacgtactcatgccaatgcgtgcaccgcagatcactcgtatagtcgtatcacagacaggtactataggcaccagcacaaaccatagtatgaacgccgggacgtcgatcgatcactgcttgtcgttggcctcggtggcggcggcggcggcagggtcgtcctcgtcggcgaaggcggcggcggggaaggagcgaccgatgccgacgttggacttgaagtagaccttgtcggcgccgtcgaggctcatctcgacgatgggcacccagagcatcatctgcttgctccggaccccggtcatccgcttcatccgcccttcctccacgtacgccgtcacctcggcgtcgtagcgcacccgggtgcccgtggcgcggaagtggtgctcgtagggcttcccctgccgcatccacacgtagccg

SEQ ID NO: 52882 - DNA, 443 bp, Triticum aestivum
  Clone ID: PAT_TA_52882
agaccgaaaaaaaaaggcataaagacttctctctcagataggacatagagatatactgagcacataatacagaactcggaaaatcataggtgcaggacgcttagcctatgcaacagaaactatctatcatcagaggcaaagcatcaggtaggctcgatctgaagtcgcgctagacacgctccaaagcataagttatgcatcacaggatgcagcatagcgagataccatcaaagagcatacagctgtcgcccagatactagatcttgcgcaagcacagaggtctgctgaggcagcaagctaacatatgtcaagggcctctgattgggatataggaagacgcaggctcctagtaccctgcttcgtagatcatatagagctggagcgacccgagagaggcaagaattctgccagcaatccaaacactagaccgcctaggcataaga

SEQ ID NO: 52883 - DNA, 435 bp, Triticum aestivum
  Clone ID: PAT_TA_52883
aaggtaaatttgccccatgttaaaacattttcaaaaggccaacatgggtcccaagttcaacatcaaagtttcacataatcaagagggcatttccggggcgctacagcatttacgttgggggggaaaatggtgggccagctttttttgacagggtcaggggctgggggaggcaaataagccatcaatctgggttacacaaaagaaccgccttcaagggctacaccgctctcgttcaatggcccccacctgctagggttgactagcctcgctgacactccagctggtttgggttctccaatagcacctttcgggtggagggtgggaacgctttgcacccttcacttggaagggccattacaggctcaaatgggtccattgggaggttcgcggccatctgcagaagagtcactttgtccatttttggaagaatgccaa

SEQ ID NO: 52884 - DNA, 477 bp, Triticum aestivum
  Clone ID: PAT_TA_52884
gcacttgcaaaaaaaaggaaaggttcttttaattgcaccatgcagacttttacaaaatattcacagcaaaaaaaattcaacagggggggcaattttaaaggcccacaacgcccttttcattttcactgccttttaacattgaaatccccgacgggggcaaatccctaatcccataattggggagggaccccaaggccactgctgtattttttggaagggggagcgacacgatttcttttgggaaccgcaaaataaacattcaagcacttttcccgggtgaaaatacccgggaatcagaccggggcctccctaaccaaagaaggccccccccttaaaagccttggcgaaggcgggatataaaagaccatgggcttttttaaagaccgggcccctaagggtaacggcccgggcgggaggcacccctaaacgtaacccggccagtaggcatactggggagggataccctgtaagggaaag

SEQ ID NO: 52885 - DNA, 539 bp, Triticum aestivum
  Clone ID: PAT_TA_52885
tttttttttttttttttttttttttttttttttttttttttttttttttttttttttttttttttttttttttttttgggcacacacaaccatttattagggaaaaaaatttccggagggccagtttatacaataaaaatttatgggaattggagggggggctttacttcgggcacaggacgatttgtaaacggggaattagggaaggcctaaagagcgggatcacctttgggatcaaaaaaggggggggatgggggcggccaaaaagggctcccgtttttaaaatgggttgggccaaaggggccaccgttaaacgggtttgatgacccaaaggctgggtggggagaaccgattggggggggggaaccaaatgccggggccgctgttgaactggggttgtttgctaacttccaaaacaatgtaaattgcccaaaggggggagaactgctgcctatactacttggtggcccaaagggtgacccatttcctaaggcccttggttttccaaaagctgatccaataccaaaaacagctgggtg

SEQ ID NO: 52886 - DNA, 420 bp, Triticum aestivum
  Clone ID: PAT_TA_52886
atgcagaaaaaccaaaaactttgtgcagacacgaccaaaaatctggggtccagccaaaaaacatttttttttttctcaggggggccccactttataacacaagaacagcggccgggactaatcttgcacaggaagaacgacggaaaaagctttgacaacctgccttaggggggggggggggactaaaaatatatagatccaagcgagcccgctgacctatatcaatacagttacctttatttctactagcccctgatgaggggcgggggttccccccaaaatgataacagcacgcctctcacatctaataaaagacttcttttttgggcgccaacctctagggccttcccacagtttcttatagaaattcttgaatatcccccaccatgacccaccaccagggagaggggtaccaaccca

SEQ ID NO: 52887 - DNA, 406 bp, Triticum aestivum
  Clone ID: PAT_TA_52887
gggggacacaaaaacactctggtgggggttataatccacgatccacggtgccggaaaggggttgtgaccctttggaaataaaaacgcccctggttaaatagggcgcttgctttcacatttattctggccacgctggcgggggtggtcccatgttttaggcccttcaggcggggggcgccaaaagggcaaaccctttccctggtgtttcccaaaatagccccgggcccgggaatattttcagcctggcgcccccatctctttttatcatttttccccctggtaacccgatgcccctttgccccaggggggggcatgctcatttgccccctaattgatccggccaagttgaaagttccccattgcttgttttttggtggcaatgaccgcataacagtgctgttgaagc

SEQ ID NO: 52888 - DNA, 544 bp, Triticum aestivum
  Clone ID: PAT_TA_52888
aaataagtgtaatttttttatttaaaatataatacaagaatctaaaaaataaaataaaaaaaagtagataaaactcttcctttttttctcaaatgtatgtatatgaatgtatatgctacgtttttcttaattcaccttctttgcagcagcctttctctttccatacgttttgcgtgcaaaatcaacaaaaagataggttaaaggtaaaagataagcaatgttcaaaccaacagcaaaacgttgaccaggtgtttgtaaacaatcaggcacaaacaaatagctgatagcagtcgacatacccaccaagaattgtgagatttgcatggaagtcaaataacgcttaccggggggatgaagaccaatggaggtaaaagcatagtacatgtacatgatagaatgaatgagtgaattaaagacgacaaagatccaaataggttgagctttgtaacgaataccggaccacatagtaatcatggcacccgagtggtgatatgtttgcaaaagagatgagcgacgacccttgatgagaatgatggcagtgtca

SEQ ID NO: 52889 - DNA, 362 bp, Triticum aestivum
  Clone ID: PAT_TA_52889
gcttgttagatcaactctatatttattataaaagcaaagaaaagagtaaagatataccaaaataaatctcgttgattattcctttctgaccttgttggtcttcttgacaccacggaacttgttttcacggttcttcttttccttacgttgcttacgaccacccttgggaggtttagcaagaccgtttcgaacgagacggaatctgggctcaaacttgttgtgagcttccaagatgttattaatcaaggcgaaaccagtggtctttccaccaccaaagtggggcttgaaaccaaagacagaaacaactaactttttagcttgtgccatgttgggaatgttggttcggggttcacccttgataa

SEQ ID NO: 52890 - DNA, 455 bp, Triticum aestivum
  Clone ID: PAT_TA_52890
ggaggaaaagtcttatgtttattatgaattccacaataaccaaataagcaacgatacgtttatttggcctttttcttgggacgaagttggttggtgtgtccacactttcttttacgacagttagtggcacgaggaggaagacgagcataacacttgcggcaaaccatcttttcacagttgtacttggaggccaaagccttaagagaaggttcgatgataccaccaccaagacggagaaccaagtgaagagtagattccttttgaatgttgtagtcgctcaaagtacgaccattttccaattgcttaccagcaaagataaaacgttgttggtcaggggggataccttccttggcttgaatcttttgcttgacattgtcaatggggtcggaactttcgacctccaaagtaatgggctttccagtcaaagtctttacaaagatttgcatagtaaaaac

SEQ ID NO: 52891 - DNA, 491 bp, Triticum aestivum
  Clone ID: PAT_TA_52891
aaaatatcgtttaatataaaacaattctaacaataataataaatttaattcatcaactgggattcaaggcaactgggataaagtattattgggtgggcgggggctacttcctccgggtttaaacataccaccaagagagggtcgaagggaataattggaagtagatgatttagggttcaatatccgtttatgggaatccaaataagcaatttgggggttggtgaatgctcctcttcttttacttctaataaattcaattgcctccagggggttcattcccatttcaatcaaagcaatagctaccaaaacaggggctctacctaatcccgcaacacagggaacagcaatcatcgggatagggccatcatcctttatgctatcagctatttccttgtttttttctaccaattgtaaccattcacgcacaacttgagggggggggacaccaccgtctttgaaagggagatccatgacttggatattcctctcgt

SEQ ID NO: 52892 - DNA, 537 bp, Triticum aestivum
  Clone ID: PAT_TA_52892
gatggggggataagaaattcttttgatttgcatatttgctttatttttacaagtcatcatcttcttcaggaagaggttgagcagcagcttctgccatttcattgttgtattgggtcatcaagttttcgtcaacttgaacttcaggaggagctaaagcaggagcagcaacaaagtccaattgagggttaccaaccaacttacgggctaaccacaagaagggcttttcaaagttatagttagatttagcagagatatcgtagtattgcaagttcttctttctgtggaaagggatggtcttggccttgactttacgttccttaatatcaaccttgttaccaccaagaacaataggaatgttttcacaaacacgaactaaatcacggtgccagttgggaacgttcttgtaagtaattctagaagtgacatcaaacatgataatagcacattgaccaccaatgtagtaaccatcacgaagaccaccaaacttttcttgaccggcagtatcccaagtgttgaaaacaatctcaccaaagttag

SEQ ID NO: 52893 - DNA, 325 bp, Triticum aestivum
  Clone ID: PAT_TA_52893
ggggggcccgaaatgccccctatttgggttacccccccccttccatcttggggcccccccgagttcccccgtcaccaaacctccggccacccttaaaaaccgtgggccccggacccttgttctttttccctgccggtaaccggcttttgccaaaccccccaaccccccaaaatcccgccttggccgccccctgggccggggcttcccccttcccttgctcccttttggtggggagcttgctccccttgcccttgggggggcccccccctggctggggccccttcccgttggtggttcccttgccccagcggggggcggccggggc

SEQ ID NO: 52894 - DNA, 542 bp, Triticum aestivum
  Clone ID: PAT_TA_52894
gaggatggaaaaacacatttatgatcgaaacatgtcgacaaaccgtgggagagcaagcgttatattgcttctaaacaacagtggtctggccatattactgaggttctcactcggtacgtgatggccgtatccagtacacggactggtggcttatacttagctcccagacatacaataactgtagctcttttctattaggatcggaggaccatcacatttgatgcctgagagcaagaggcggatgcacccaaccgacctgatcggagagcgcccgactgccaactggcttgccagcatacacctgccgaggtgctgctccactgttaccacccttgcaccgtccccattggcaccaggaccaccaatgcaccccgccctggccgcagtaaccccactgaatataccacataccctgccgacaaggtcagttctggaccaccggcaggccaggtacaccttgcaggagcactgccagccctacttccacaactgtacgagcctgccgcatgccctgctgtgccctgagctcaccataagtcacc

SEQ ID NO: 52895 - DNA, 464 bp, Triticum aestivum
  Clone ID: PAT_TA_52895
gggggggcaaaaaaacccacatttttgggagccccccccaaacactacagggggttattcacggggggttttccgggtaggtgaacaacaagcaacaccaacttttttttgggagagaaaacacaggggccaaaaccccacataccgggttacaaatttggggggcacacacacacccctaggccccaagaccctggtcattttggccgagcttttatttaattttagggggaacaaattatatgccgggatgaacccaacaatactttttggaagggccaccccaagggccccccacgggggattttatattcccgcaacgccacattttgggggttggtgacaccacccgggacccccagcaacccttgggacacttgggggggggggtgttgaaaaacttgaaccacacgttcgcccaagcgttcgcccacccgttccgggacccctggggcgacccggga

SEQ ID NO: 52896 - DNA, 427 bp, Triticum aestivum
  unsure (1)..(427): unsure at all n locations
  Clone ID: PAT_TA_52896
aacggacaaacaaacgggcgggttattggggggggccgagccccctataaaaaccggcccccggggttatggggggggcaacaacaactatctctcaagggggggggggcgggggccccgggcctgtcccccacaccgggcgggtcgggccatctggggggggccttcttatttattttcggcccatctggggggggcgggggaacagttttttttgcccgggggggggcagggattcttgggggggggggggcggccctccccaccccggaacgttttcacgggccctgtgggccccccgggggngttcaccccgcccgcgggggcctgggggcccccgttgtccaaaaattgggcccctggccaggagttgcattggtcccnncccttggggaaaatggccgccccggcccgggggggggggggg

SEQ ID NO: 52897 - DNA, 538 bp, Triticum aestivum
  Clone ID: PAT_TA_52897
atggagaaattaatgtgtatcattataaagcaacctgtacttgagatatgttgcatttacagtagaacccaatgaacccctaaaatcaatgtgcattattagtttgaacatcggaagtttcaaaaggtatttaactttggcgggtgttaggcgtcaaccggctgatctttgcaaaaagatcagccgcctaaacagccatccgattgtccgcccaggatttgattagagccgtctgatccttccttcactaatacagagtattagacacgcttcctctgaaaaccgtcgatgatgcagagcaacgcagcacctccgccgtggcaccttcgcctgcgacctcccccggcaccggagccgccggcaagcgctccaaggcaacaccgagtgccacctcccgaagcttcattgcagccccggcagcgctccaatgcagcacatatgacatgcgtgcgcggcacctccggcgaagcttcattgcagctccggcgacgctccagtgcagctgcggcagcgctccagtgcagcacagaggacatgc

SEQ ID NO: 52898 - DNA, 536 bp, Triticum aestivum
  Clone ID: PAT_TA_52898
aaagagaaccacgagaggtgcagataaataattggtacctacacaacctctagttgcataagcggaagtcacaaatacaagaacaaagatcaaaccaggggaaatatcacattaatttactggcagagattggtctagatattacaacggggatactttgcaagtgccttctggatgtctttctcgaatgaaaatggtgtggtagcagttgcgtatctgttgattacttttccattcttgtcaacaagaaacttggtaaagttccacttgattcttgaaccaaacaaaccaggtttgttagctttcagaaacttgtaaagcggcgcagcatctgggccatttacacgcaccttctgaaaaactggatattcagctttgaatcttgtgcatgcaaatttttggatctgctggtcactgcctggctcttgtcgcaagaactggttgcaggggaatgctaatatctgaaagttctcctgggtgtacttctgataaagctccttcggctgcgtgtaattagtcttcgggaacccgctttt

SEQ ID NO: 52899 - DNA, 545 bp, Triticum aestivum
  Clone ID: PAT_TA_52899
aagcacatatcattattctgtattttattgttttatacgtaaattaacgatatttgacaatatgaattaaaaatacattatttttatataaagatgctagtaagttttagattggtgcgccttcataatcaggaattttttctttaataagattctctgtatagtcccataattccaataagtgctcatcggaggcagcaattcctttgggcgtagaaggggcaccaagaggtacatagtattgccctttgatacttttttcctcgatttcaggactagtggcaagataaagctgagtaagagcaccgtcttcagcagaaatagagaagaaatcctttattctatccatgatagacccaatactgtatacatgacgaaacaactgggtacggacaacacctggatgattgcagttagcataaactttggtcacgcctttgctttctaaacgtttgctaagttctcttgtaaacaagatgtttgatatctttgatattgcataaagagcaacctcattgtacttatcagggttgttaatatctttg

SEQ ID NO: 52900 - DNA, 452 bp, Triticum aestivum
  Clone ID: PAT_TA_52900
ggggcgggaagcaaaggcttattcccccatgggacaagcaaacaaccggacggggaagggggcccacccccacacacgggttaaatcagatcagatcagatcagaagggccattgccaaaaaaaaaaaggaaggaaaaggggggaagcccaaattcaaaaatcccacaagctaggggagcgggcccggggaggggaagcacaccaccccaactagaggggggggtcgccccaagggggggcccaattgggggggctgcccacccggggcatggagttgatcttggggaaagcgcccaccttgaagttggggcccaacaaaaacccctcgttgtccacccccgggaaccccttgagccggttcaaggggggctcaaaactcttgagccccccctcggtggggaacaagcacccgggggggaacggggcgtacaaacgcccgaacccgggcttg

SEQ ID NO: 52901 - DNA, 465 bp, Triticum aestivum
  Clone ID: PAT_TA_52901
caacacacagaaactgggaaaggttcggaccacaaaagggggaacatcataaggggggacaactaaaaaatcagggccccggggcaaaggcggggggccccctttaatcccaaccatccatttagagctaatggggcttctcggcatcagacccgacataaaacccagcctgggaatcctgggcccaaaaatggggatcctaaaaatccaaggaataatcgccccaaccagcctgggaagcatcccccttttccttttttttttaagccgggaaaaaagcagccttttaagcctccttatgctgggcccaggtcttttaaaaaaatgtctgggccaaggcaacatcgtaagggaaaaaaatgttgaaaaaaaaagttcctgacttaaccggccaaagttaaattccgatgtacttaaggctggcaaaagcataaatgaaaggaccacccttgaaggcgggggggg

SEQ ID NO: 52902 - DNA, 422 bp, Triticum aestivum
  Clone ID: PAT_TA_52902
gggccccaagaaaattccccccccattaatgtgggggaaaaaaaaaaaagacccagggggccgccgtaaaaaaagaaaaaacccacgccgaacccacacaaaaaaacagggaaaaaaaaccccgcggggggggggggaaaaaaacccgggagaaaccaaccggcaagaggcccccatataaaaccaactaggggttttgaaagcaaaaaaaaacaaaaccggcgggctaaaaaaaggggtttttccgggaccccccacaaattatggggggaagtttagcccagacccccccactttttttttatttccaacacccccagggggccccaaaggggtatgcacccccccattaaaacctggagggccccccgtaaaaataaccctgggggggggggaatttttaaaccccccccccaaaattt

SEQ ID NO: 52903 - DNA, 471 bp, Triticum aestivum
  Clone ID: PAT_TA_52903
gggataaaaagaggggtgggtacaaattattataaaaagggggccttaaaaaaaaaatttggtacaaggggggaaaaagggggaaaaaaaaaaaaaaaatttcaaaaaaccggttaaaaaaaaactttaaagactggttaaaaaaaaaagaaccgggaaattttttatttttccttaattaattatttgggaggcaaaatttttttttggagggcaaaaaaaggcaaaaagaggttttcattttttcaaaggggggggggttggggaagggggccaaaaaaaaagggaaacagggggggcttaaagtcttggggaaggggggggaaaacgggaccaaaaaaaatttgggggtggggttggtctttaggaagaaattcttaaaccccttgggggggaagccgaacaacttcgggcaaaaaaattttttttcaacggggaggggggcggaagaaatcaattttggaagaatgg

SEQ ID NO: 52904 - DNA, 547 bp, Triticum aestivum
  unsure (1)..(547): unsure at all n locations
  Clone ID: PAT_TA_52904
attggtaaactttctctttttcttattttatttataaaagtcaaagtttgaatcttctttcttcacattagctttatatcccttctccaaatccttgctcaagataacataacgattctttctcacagcatgcataccagcttcttgacaaatggctgcaatttctgcaccagatagtttatcaggtcgtgaaacaaaatcttctaagtcaacttcttcagacaaattcatctttgatgtaactgtctggaaaataagacgtttttgacgacgatctggtgtagggaattcaatctttctgtcaagacgtccaggacgtaataaagcaggatctaacgtatctgcacgatttgtagccatgataacttttacatttgaggtttgatcgaaaccgtccatctgattaagtaattcaagcaatatgcgttgcacttctctatcggcacctgtttgagcgtcaaaacgttttgtagcaatggcgtcaatttcatcgatgaagacaattgaaggagaattntcacgagctaatctaaatacatcacgaacc

SEQ ID NO: 52905 - DNA, 573 bp, Triticum aestivum
  Clone ID: PAT_TA_52905
gatctattttaaataatatgtagcaacaaggttaactttaagttgttctaggttctaaggggggtgaccaaggtcagggccaattgtctgatatacttcgtgctgaagcagttatctgcgctcgctgcgctggtgcaaacaatgctggtcatactatggctgttaatggtattaaatctgatttacacatgttgccttcaggttgaatcaacccaaattgtgttgggcttgattggtcatggcgctggtggtcattgaccttctttttttgaagaaaacgcaaaagctcgaagctaaaggtcttgactgtcaaggccgtcttcttctctacgacagagctcatcttgtttttgatctccactcaaaatattgatggtctcaaggaagttgaattatgtcgtggtagtattgtttcaactggtaaaggtattggtcccatttactcttccaaggcctatcgttctggtattcgagttcatcactttttccagtctgaagaattcactgctctgttttagaagcatggttgagaacatgcgtaaacgttacggaaactttgaatatgatgttgaa

SEQ ID NO: 52906 - DNA, 560 bp, Triticum aestivum
  Clone ID: PAT_TA_52906
gttggccgtccgtgaccgactgttggaagactggaatctgacagaggaaatgatgaaggccaagaacccgaaacgatgctattatctgtcgatggagttcttgatcggtcgtgcgctcgataacgcccttcactgtctgaagatgaaggaggcctatcgacagggcgtgcaagatttgggcttccgtctggaagatttacttgaacaggagcgggatgcggctctgggaaacggaggtcttggacgactggcggcgtgctacatggatgcgacggccacactggattaccctacgtggggctacggcttacgttatcagtacgggatctttaagcaactgatcaacaaagagggctatcagaccgagatgccagattactggcttgatcccaacatcaacccttgggagtttccacgcaacgacgtgctgtatgaagtccaattctatggttatgtggctaccaagatgaacgacaagggagaatctcgcatgtcctgggaaggcggacaaaaagtccaggcgatggcgtacgatgtgcccatcccaggctttggcaccc

SEQ ID NO: 52907 - DNA, 528 bp, Triticum aestivum
  Clone ID: PAT_TA_52907
ccactgtaacaatcttcaaatccatggttaaaaaatgtacatgggaaacgagccaaatggcagtaacgtgtgtccgtctcgaatcgaatggacaaacaagaacaagaacaaggatggaaggaaggaattgacgctggatccatggatcagttgcggttgcactcggcggggaagccgttggggaagcgccagccgtcggtgcagtagtcgtaggacatgtacttgctctcggcccaggcgacggtgccgagggccttgccgtcgagctccgtgttcatccacgcgtcgctgccggcggggcaggccgaggagccgccgttgctgacgcagccgttggaggagtagccgcggtagttgacgacgaagggcgcctgggtccagtcgatcttgacgtcgccgtggcgggtggcccagtagctgccgtcccagagcgtggcgtgcaccgtcatcggctggctgctcgggtacggcaggtcgtcgtacttcttgaacgtcctcaccggcacgtcgtccacctggaatatgatg

SEQ ID NO: 52908 - DNA, 543 bp, Triticum aestivum
  Clone ID: PAT_TA_52908
caaatggagcgcggtttgggagcaggcaccctcggccagcactccagattgatccagagtgaagaggcatcatcatacaagacatgatctaccttaaacgttcacaagactttaagtcaaattataaacatgtcatacaaagcaaatgtggagtccagtcgtattcagatcaaacgctcacaagggctgaaaccgtttcagcagcacagtttgcttcgtttcctagctcatggccttaccatgttcctacagcacccttggatgggttctcaaaggcggcaaacccccagttggtcttcagggcatacggcgggtagatggttgatccctcggttgtgatcttggcaatctggaatttgttgatggatgaccggtcacggtacagcaggaccagcaagcacttctcaatcagcttaacagcttcttcaaaagtcatgtcctcgcgccattcaccacgaagtattgggattgccatatggttcccaaatccagtggcaatgtggttttcctcaaagtgtgtaccaatcatgttaaccatgccaa

SEQ ID NO: 52909 - DNA, 546 bp, Triticum aestivum
  Clone ID: PAT_TA_52909
tcgcgatctagaactagtctttttttctttttttttttttctttttttttttcttttacgggaaaatttaactgcgtcgctttatttttacaggagttacgtttgaaccaataggcttgcaaaagttactgctgcgacaatttaaggtgataggacttaggtcttgtatattgactaaaaccttgtttactcattgaaaatcccaatccactctcttttgcgcccacccaggctaaagcaggatcgatataatcacagcgattcatgaaccaggttccagtctcaatttgatcaccaatttccactgctctttcttcgttggtggtccaaatacaagctgttaagccatatttggaatcattcattagcttgactgcttcttcatccgaggatactttcatgataggcaaaacaggaccaaaggtttcttctttcatcaccagcatatcatggttgacattgattaatatttgagggccaacgtaagcagtgtcaggcttgtcttctgcaaatggttctattaagggcttggctcctttttcaata

SEQ ID NO: 52910 - DNA, 551 bp, Triticum aestivum
  unsure (1)..(551): unsure at all n locations
  Clone ID: PAT_TA_52910
cttaaaaagataccgatttatttatcacattgtatagactgatacaagatcacaagcctttcatgctacctcacaaatctcaacctatcttaatctcgtcagagctcgcgacagaacagagagttggcttcgatcacaagtcgaagtacctaccagctactagtactactaagtgctacatacattatacacgtgaattttgatttggttagtgttagatcaaaagtatgccgctatgctcgatttgagcaggcatctttccggctcccggacgatataaatctcatctccgacagcaccttgatacagatcctggttcctgtgccatttccacagagcgtgcgtctcattcttcacctcgagaatgccgtggccgaagctgctctcccggtaggcgctgtagtccggctgccggtcccagcagaagctgccggcggccgggccggacgtgaagttgaaggcgcagaagccgcccatgaaggcgtcaggcgtggacattggctccgggcagcgccctgngtcgtcggcgtggggtggtggccatcttctcg

SEQ ID NO: 52911 - DNA, 477 bp, Triticum aestivum
  Clone ID: PAT_TA_52911
gggaaaaaccccctataatgggcggttttcacttggggcccggggcggggggaaaggggaaattaaacggggggaagtcccgaacgggggccgcatagctttttattttgcccaaattctcaggcccccaattgccggtcccatgggggccccccagcgggccctctatttgaaacaaagacctgggtatatggggcttttccccccctgaaggaaccaatcccagcagaatcgtttcggcaaaaaaatcggacccgggggatccgaatggaaaaatggacccttactggcttacatacggggggctggtggtactggaccatcccatcaggcaccagcttttgcaatccccgccttaaccttttgccggggagccctgggttttcccccttcagccctccgaaggaaacacgggtgtttccggggcccccgctggggctcccggggatcactgggacccccggcttggtcgcgagc

SEQ ID NO: 52912 - DNA, 449 bp, Triticum aestivum
  Clone ID: PAT_TA_52912
gggaaaaaaaaacaggaacccaggggactgggggggaagcttttttttcatcccggcaatcatagggttatacccaaccctggtacatccattatacaaccaaacgggggcaggcttttattcccggtataaaggattcttcatggggggccctaacaaaggctaaaaaaacccccccggggctccaactttgtggggggggatgagggccaacttaaaaccctgcttaaaaaaaacggtgcccgcactttgggggggggtgaagcccaccccctccttgggaaaaaaggccctggtctgggggggaacctttaaccccccgggggggaacttgaacccccgggggaagggggccccctccggcaccctgaacaattttaaagggaacttgggggcggaggggaggatcaccttgaaagaaaattttttttcttcgccggccccggggg

SEQ ID NO: 52913 - DNA, 472 bp, Triticum aestivum
  Clone ID: PAT_TA_52913
ggaccagcacaaaggattttttcacaggaaaataaactggtcacaacatggacatgaaaacgccggcaaccaaaaagggaaaaacattgggggaaacggctccaattattaacacaaagggggggggggggggggggggggggcttcaaacaaaaaggtcttattcggcttgggggtaaaaaaaaaaaattgccctgcctttgggcccacagctgggggggggggttgaagaaccccagggggggtgggaaggcacccccggggaagggatccttggggaacttggtccctttggtggtgctagcaaaaaaaataagggggccctttgggaagcccccaaaaaacgcatttttccaggaatactttccggggaccctttccactccatactccatgcctacaaacactccagaaaaaagaccccaaaatggcccctccttgcacatttttatcaagggttttttaagcttgg

SEQ ID NO: 52914 - DNA, 431 bp, Triticum aestivum
  Clone ID: PAT_TA_52914
cgatgcgaatgattcacgctagatatatctactacaatgaaatgaccttcagtcgaaaaaaaccgccttacaggcaaaaaaaacatctataacgggtgcacatctgagcacaccacatttttttgcaacaaaaaaattaccctacgctagcgtgattggagacaccgatctcgcacacactggcaaggaccgtcgactctctcgggctgacgtaactgagacgccggaaccttattcagcatatgtcacatgggcatcacgtatcaattgatcataacatggccttggacgatgcgtaactgttgcttgcctaaagcttgagcttgccaccgtactcctcagggagctgggactcaatcccggcccatcaaaatgaggagtgaagggccctataagcgactaacacaaacttctttttggcagacactggg

SEQ ID NO: 52915 - DNA, 306 bp, Triticum aestivum
  Clone ID: PAT_TA_52915
cattatacaatatcatgtccacaaaccctagtaaatacgtttttaaccacactatgatccgagttaaggatcccaaggcttccatcaaattctatactgaagttatcggtatgaagtaaagtatacaaaagaagagacgcgacattctcggatactgacggaacataggcttattacttctgccgactatgaacaaagcaagttcacattatatttcttggcttttattgattctgttcccgaatctgaagaagaaaagaagaagttggcctttagtattcctggtgtattagagttaacacagta

SEQ ID NO: 52916 - DNA, 492 bp, Triticum aestivum
  Clone ID: PAT_TA_52916
aaaacttaaaaagtgaactggtcttttcattttttgtggcgcccaaaaaacccaaaaggggcaacggcccaaccaaaaaaaggcccccgagggacggggggggaaccccttgccaactgaaaaaaaaagagcctgattggggggggcaaaccccttgagaaaggggaccgcgcgggacgtaaccgggccccccactttctttatttgggggggggggaaaaaggggaaaaacaagccatttggtgcggttggggctcgggaaaggaaggcaaaattttcggagggggggggggttggcgatcattcggggtcggggacctcgcggggggggcgccatttgggggaggccgttagggcggcgggggtctccttggggggccgggccttcgggggctccggggggttgggtggcctcccgggaaaagcgggtcttgggggggggggggggttgttgggtgaagttcggccggccccggcggacttggggggggg

SEQ ID NO: 52917 - DNA, 537 bp, Triticum aestivum
  unsure (1)..(537): unsure at all n locations
  Clone ID: PAT_TA_52917
tttntttttttttttttttttttttttttttttttttttttttttttttttggcactggctggcaagctatatattcatcctggcaatcataggattatacccaaccatgttacatccattatacaaccaaacatggacatgcttttattcctggtatataggattcttcattggtgactctaacaatgactagaaagaccccaccggggctccaactctgtcgggggggatgaggcgcaactcaaagccatgcttaaaaaacacgttgcctgcactttgctgggggttgatgccgactccatcgttggggatgatggccctggtctggggcgggaccttgaactcctcgggggggaacttgaacaccgcggggaagggcgccccctccggcaccctgaacactttgaaggggagcttggggtcggaggggaggatacaccttgaaggacacctttccttctccgccgcccccgccggccttcggcgncatgggggcccccgcccccgcccccgccttggttcgccttgccggcgga

SEQ ID NO: 52918 - DNA, 495 bp, Triticum aestivum
  Clone ID: PAT_TA_52918
aagctatattcataatgcatacaaaaagttatatactttattataagtaacactttttgctataaaaagcgaatgttgcagaaatgactgaataacggaaggaagggaaaagaatgaataacttaattggtctaactagagtcgcttgaagaaagccaatcattactttcatgaatagatgaaggttgactactaccaattgcaagatttcttttaagcataccgtcccgaattctttggagtgcttcttgggcctgcttgatcagaggtatcctatccaaatgttcaatgacaaaatggaggccatgaatacagacttttctttactcttgtgaaccaacataaagtacaactagctgatgcggtaccaacaaaggttgtattcaagttgtctatacccgagacggaaggtatcaggtcaatacagtgtgcaatgccacctgcttcttacttggacaaagcacgtaccctgactctggctaatgtcagatggcc

SEQ ID NO: 52919 - DNA, 325 bp, Triticum aestivum
  Clone ID: PAT_TA_52919
tcgcgatctagaactagttgaatcacttcttccttttgctattattacaggtctttttactgtcaccgccacaggtttaaacattacaagatattattccaatgacagaaagcctacaagatacggtctcgatctttgggaaaagcaaatgatggagcgtgatagacgtttgactggatcacttagaggacaaacttctgaaccaattgcaccagcagcatttgccacaaacagcatctggtatttggaaaagcaaagaaaccactaaattacatagtacagttgattagaaaacaataaagacacggaattagtttgttgtatg

SEQ ID NO: 52920 - DNA, 353 bp, Triticum aestivum
  unsure (1)..(353): unsure at all n locations
  Clone ID: PAT_TA_52920
gcagcacaatcatcacatgggtttattcacggcggatgggggaacaagtccaatcatcacatgggtttatggacggagaatgggtgaccaagtacaagcaccaccagcctttctgggggggggaaacacattgcccaagacacgacgatggcagtttacatgtggggggccnggtagcacgccccacacacaagcttgggccccttgactgctcatcttatctgggctttctttgagggggcccacctcgtctgagcctgaggccctgaacggttcagggcttcttgcctggcccgccgcaggggccatcgacggggctctgtctgtgggcgccccggaccgttttgtgaggg

SEQ ID NO: 52921 - DNA, 229 bp, Triticum aestivum
  Clone ID: PAT_TA_52921
ggaatataaaatccttttaattggggcgggggatactatatacgggtaagctaagctaagaaaacagggggccccgcaataaaaagggggaaaaggggagggccaggggggcctccaggtaagggggggagggaactacgggccaggggggacagggggccccttttggggggaataaggggcccatccaccaggcaaggcctaacgggctttttgggggggggggggg

SEQ ID NO: 52922 - DNA, 260 bp, Triticum aestivum
  Clone ID: PAT_TA_52922
ccccaccaatcaatgggggggtaaattaattaataaaacaaaggccaaaggccagggacgacgaaaaggcgcgggggaacaacggggggggggggggccccacacgggggggggggccgggggagggggctaatcatcaagcccgggcaacacacacggggggccaacagggggaacacacacaggggggggggcagccccatgaacgggggctggcatttaaaacaaacgggtggggccaaacacaaaacaagttcccc

SEQ ID NO: 52923 - DNA, 411 bp, Triticum aestivum
  Clone ID: PAT_TA_52923
cggaaaaaaaggggcttgggcaattataaaaggaaatgggcagggaaaaataaaacacaactgggaaaaaactggggggggccctaaaaggggcccgcccacagggttaaaataaaacggaccgggggacaccaaaaaaaccttgggggggaccgggaaacggaaaaattagccgggggcgccgggcacggacttgagctttttaacgggggggggggcaaaaaaggggaccttttaaaaaacgggggacgggaggttgtgggaaaaaaacgcgtaatggggaatttgcaggccgggggtggggcccttaaaccaaaagagggccaccccggggaaactgcccccgtttttctggtaagggaaaaagccctggggaaaaaccaagatgtcccccttgtaaagggttttggg

SEQ ID NO: 52924 - DNA, 456 bp, Triticum aestivum
  Clone ID: PAT_TA_52924
ggaaggaatattcgggaaattacatttcataaaacaaatacaaggggtacacaggcttaaaaaaaggggggggcattcacacacgcccacccaatgggggggttttttgggggggcgacccagccaaactaagacaaattaatttcaccaaaccgggggttataaattaacacacgcgggaaaaactacttaacaaccggccggttttttatgggggggggaaatcaaattggggaggaacaactaaaataacgggggccctgacaatgcatgcatgccctgggggagggacaatttgggggggaattaagggcactggaagccctggggggggggcttgccccaatagttgaggaggagggtgaccttgagggggatgttgaggacaaagccaaggacattggccttgagcggggggcaaaggcacacggggggctcaagggcggccaggccgcc

SEQ ID NO: 52925 - DNA, 406 bp, Triticum aestivum
  Clone ID: PAT_TA_52925
aaaaagggtcactggaaataaaaattaaaagggataaaagataaaaaaataacactgaacttggcaaagggggggggtatactggtttttaggggggaaaaaaacaaaagatggttttagctaagaaggttttgaacataaaaaggggaaaaaatgggggggaactggaaaatggttaaaaaaggccatgggtacaagggacttaataaaattcaatactaaaaaaggggcaagggagcaaaccaggtaaggtattggattaaaattggaaaaaagggggaaaaaaaaaaccctaaatgggtttcttgggaggtttgaaacaaagggcaacattttttcaaaaactggtacccttcttggcaggcttattggtcccctttgggggcttttttgagctggaattgga

SEQ ID NO: 52926 - DNA, 229 bp, Triticum aestivum
  unsure (1)..(229): unsure at all n locations
  Clone ID: PAT_TA_52926
ataggtaatcaggaggaaattttatttaggggggcccggttacaatcatggcatggcacccgactgctgatgccggccaggggcctagataaaggcccccgatcagggggcgggtacatggtatgggagtagtagatcgatatgatcgatgatgcccgcccggcccggggcatgcctatgggcggtgggcgatctagccgccgccgcaggagcccccccngcgggggcc

SEQ ID NO: 52927 - DNA, 472 bp, Triticum aestivum
  unsure (1)..(472): unsure at all n locations
  Clone ID: PAT_TA_52927
ggaacaaaacggggtgtttgttttaaagcccaaaaacccggggggggcccaggggacaaactttaaactttaagggacacaaatcctggtctcctccaggggggtcccagcaagcccgcgggagagggttttttttcattttcagtataaacccgcataactggggcccatcctacatagggatagggggtggccccttaaactccacgggggggggtgagctgagccccaatttgacggatcggcgcccattacaccctgttgaaatcgatgttaaaactgatggggtttgggaggttaaccccccacttgggggggatgctgcgggcctttccctctttgaaattggggatgccacaagcgacccccttgagggaattgcaagccctttggcgatccctttgggatcccccctggttatgggggtttttgaccccgtcnaaacattgcccaaaagggccggggcccccct

SEQ ID NO: 52928 - DNA, 487 bp, Triticum aestivum
  Clone ID: PAT_TA_52928
ggaaacatcaaacaggccaatcttagcaacacaggggggccgggtttccaaaaccacaggccacagacaatagcagacagttttgacacacggggggaaaacgttctttttcatcggcgggcaaagacaacgggggggggttcacgccctcagcatatgaaagccacctcggggggcctggcgctgcagtaaagcccaggctggtggttggacccctggttggacaggagcccgggcgccctcagcaccagctccttggggctcaccttgccggccttttccgggaggatggcctggatggggttgctgaacgccccgtaagacaggcccttggggggcgtcgcgtcccccgagggctggtcggtctggcccccgctgatgaggaccccgttggggggggcccttgccgccgtcccggggtacaccttctccacgccgtgcaccttctggtccatgggcgggttcagctcctcctggttgccctgga

SEQ ID NO: 52929 - DNA, 561 bp, Triticum aestivum
  Clone ID: PAT_TA_52929
ctaaagtgaagtcgtccctggaaaaaaaaatttacataggaacggaaacttgtgaggcatccaaacccaaagcatgcaaaaataagttgacgtttgcaatgcggtgattggcttgatcaagaggaagtctattactctttgcaagtacaatgttttccatcacacgatccctgacttctgtgacaagaatatgttgttggtccattgaggcaccaacagccatagcagccaaaaattgccagacgtacatatcatcaacagccagcgagatttgcaacatggatgtattaggactaattggttccaagtaatataatgaagggaacacacccagataacgtcccttgagcatattgaaaagaacagtataaagctcttgccagtgagccatctcctctgctgtaggctgagcaaatccttgcaaggcacctccgccttgtttcaaaatctctgcacgtgacaagagcatagtaaggaaggccaatccgggctttgtctgagcaacacggatgatatcattcttttctaacaagagttggagcaaaccgttgatgacactaa

SEQ ID NO: 52930 - DNA, 293 bp, Triticum aestivum
  Clone ID: PAT_TA_52930
ggggaacaaacgggatacatagaacttggtttatttaagggggcgacacgacacaaaacgggcatggtacaggggtttacagtacaggacaggggaaaacgggggcctcgagagccttgtttgagctatatgcagggctcatttttgatgggatggcaacaggggaggggatacattgtcacacatactagtagcaagcattatagttaattaaccggcccatttttcaatacgggcgatgcatgattcgggggtaattaatcgtcgactggagtaccctggggggcaacgac

SEQ ID NO: 52931 - DNA, 241 bp, Triticum aestivum
  unsure (1)..(241): unsure at all n locations
  Clone ID: PAT_TA_52931
ggcaatgcaatgttcttttacagctgaaacgcagtcttcatagcgatgaaggagatcataccctgtcgctgagaacataattatctattacagtcgatacaaagatggtaagaagtctgatatacgaaacctgcccgacgaaggccgttttcaggccagacatgagagggagcgacaaactaaaattcaagcgatgcgactctnttaaccccctcagcaatactaacaaggcaaattgtag

SEQ ID NO: 52932 - DNA, 415 bp, Triticum aestivum
  unsure (1)..(415): unsure at all n locations
  Clone ID: PAT_TA_52932
gttgctaatcactctttgtatttatactggcaatactacgcaagaaacatctcttcagattacatcggagtagtacaagcagtttattgtgcagatttacaacttaacagaggtctagcccaagctgaggtaaacagcggcggcgacgccggcggtgtaaagagcgaccaacttcccagctgccccggcgcctgcgcgggacacgatggccaccccgaggatcccggccgcgccggccggggcacggacgagcgctgcctcgccgatgcccagcacgccttctccggcgtccgcccctaccagctcgcggacgcgtccgcgcacctncactcggncctccggggctccctccctttcgnncgncgntgggggccctcggcggcggggcgcgggcgcnnnggccctgcgntgggcg

SEQ ID NO: 52933 - DNA, 433 bp, Triticum aestivum
  unsure (1)..(433): unsure at all n locations
  Clone ID: PAT_TA_52933
tntttttttttcatactgctaaattaacatgttttctttcttctgcaatacaatgggcgctggggcaccacaaaaaataccatacaaaagggggcacgcgacagccaccttgttagggaggtggcaagctgccccccccagcacggaaggggaggttgccagctagccacaacagaccgcagcgtagggcaagaataaaagcatcccccataacaaacaggctgcagccagacagaaccagtggcccttacaaccccctgcctgaaaggatgcaaaaaaccttgcaaacggtttaaggctggcccattaagctcacaataaaaagacaccgggggaccacttgggataagaggtaaagcttgcctctctgaggccccccactaaagctgaaggccctgggccggcccaggcaaagccactcttgaaggctcct

SEQ ID NO: 52934 - DNA, 538 bp, Triticum aestivum
  Clone ID: PAT_TA_52934
actatcagacattttccactaaccattctcatcaagttacaagcttaaccgggaaaattttggaaacatatgttagctttcccctactaacgttgggagataattctgtcgacgggagaaaaatgttatggtatgcttttgatccatgcttctcgttcaaaggctcactgttgctttcgtactgcagacattacccaagacacaagttgcattggtcctgctccctctgctgaagaaggccaaactccaagcaccacagcagaaaacaacacctctcctgggagaattgaggggagcccatttattgtaaaacaggtcagcaaatcatcatacggcccgtgatgtagcaacccaattgattaaacaggagcttatgtcttgggaactgtaacattcaagatcttcacatcctgatacggcttgtcatttttgtccgtcttgaccttctcaatttgctgaacaacatccatccctttcacaactctaccaaacactgtatgtttgttatctagccatggagttgccacagtggtgataa

SEQ ID NO: 52935 - DNA, 128 bp, Triticum aestivum
  unsure (1)..(128): unsure at all n locations
  Clone ID: PAT_TA_52935
caaacaagaggcacccatatccgaaagtgcataacgngattccaagatataactcaaacaagcagnncggcagctttagtcagaacccaaaaaaagacaacttaggttgttcccttggggaaaatatc

SEQ ID NO: 52936 - DNA, 520 bp, Triticum aestivum
  Clone ID: PAT_TA_52936
ccaatgataatgtacttgaaatatttatttttatttttactccatatgttgtaacccatctgccatatttaatttcattatgtgtgatcattgcttttctctttgatgcacaatccaatatgaagattgtgtttttgtcttgaatctttacatagtaaatatcaacacaatccaatataccccctccaatccatattaattgacgctactttggtataatactaaagcagcatcaattaatatggataggagggagtagtaacagatcatggtggtggcagactattgcatgttggattgcatggatactcgcagtcaatctctttcactccttggctccttccaaagtaccaatctccaacaacctttgcaatattcttatttcccagccttggggatgttggtgaactccaagagatgcgaaagagcgtttggcagtgagtgaagcatgaatcaatgaacatgccccagtctgccttatcattgatgaccttcaaatcattgatcattgtgttcctga

SEQ ID NO: 52937 - DNA, 99 bp, Triticum aestivum
  Clone ID: PAT_TA_52937
aacaacaaagaaagaaggcgtgtgccatagggtgatgggtgatgatgataaaaccgaatgaaagagggtctgggctgtaggaacaagggaaaagcgacc

SEQ ID NO: 52938 - DNA, 556 bp, Triticum aestivum
  Clone ID: PAT_TA_52938
acatgaatagtgtatatattgatacaaatgaaaataatattatacaatgtcttgcaccacataaacgtacaagcatacagtacacacatccccaccacacgcaccaaccgaaaagatataccacacacgtacacaagtgggtacttcttttttacttggacgtagacaagtgctgctcaaacgaatactactaccaagttacagaaaccatatgcagctcaaaaaaaaagttacagaaaccatatggatggaacgttacagttttattacacttgtaaatcgtgcatgcacggtcgtgggcacgtacgtacgcgtagtccgttgacggtggaggtgcaaggaactatggcacggccggcacaccgggaacagacggcaccggcggcagtggcaccttgggcacgccggggacggacggcatgggcggcagtggcaccttgggcaggtcggggatggacggcataggcggcagcggcaagtcaggtatgccagggacggacggcattggcaacgtcggcacccctggcactgtgggaaccgtcggcacactcggcgc

SEQ ID NO: 52939 - DNA, 447 bp, Triticum aestivum
  Clone ID: PAT_TA_52939
gggataaaaaggcagctatagataggattttaaaaagcctaaggttaaagaacaaaagtttccgggacaattttaaccaaaaagtttataactggaaaaagaaaagggaaacaagacttttgaatccatcccaaatgggaaaaaaaaagggtgggcgccaaaaacaaagccactgttcaaaagtaagacacagcaccgaacaaatgagttgggcattatattggaaattttacaccaccccaaaaggaagtcgcaaaactagttgtccgccaacaaaaatttttaaatagtagtagcaaaaatttgcaaggatgaaagtttggacgatttcaaaaaggagcaccattgatgggcaaaagccatagcccaaaacagtcaataatttggcacgagtattcaaaaactgaaggaaccaatgggcacaactaaagaaacttgccacaccca

SEQ ID NO: 52940 - DNA, 195 bp, Triticum aestivum
  unsure (1)..(195): unsure at all n locations
  Clone ID: PAT_TA_52940
gcttaatgaaaaattcnatattaccccccaattttcatttttcccatcanattcccctttaaacctttaattcccaaaccccaaacctttctcccccaatttttttcaagcctcccccccaaaggttccacccggtttccaagggtgccccccccgnaccccccttttttttcttattttttaaaaggcccttta

SEQ ID NO: 52941 - DNA, 414 bp, Triticum aestivum
  Clone ID: PAT_TA_52941
aaaagagaagttccaggtgatcatggactggatgctctctatgctcttgacccgacattttaatcgacaggtccgcgaaaagggggtgtcgtttctggattccagggggggggggaagtcgctgcagttaaaatgggggcagcgaatcggtgggttttgttaaacaagggggggcttgtactggagccaaggggctgctaactcagccccccctttttgcacagttgtagacgaagacgccggtgcgctgctttgccgggagcccctcccagccggtgggggaggcggggccgcttccattttcggggccccaggaatgcggcttaatcaccttgcccggaggtcctttggggccggcggtgacccgccgcctattggcggatcccttgaaagccaggccccatccggtggaag

SEQ ID NO: 52942 - DNA, 443 bp, Triticum aestivum
  Clone ID: PAT_TA_52942
aaagaaaccccccttcctgaaaatgcctaaaacgggcctgggggggggggcccccttttagggggaatggggatgggggggaccgtttaaccaggggggggttttttcggggaccaaaaacccgctttttgggaggtcctttcttttttttggggggggaaccactaatggcaacgtttgggtggcccgtttttgggggtagggggaaaaaaacccccccccccccctagaaccgcttgggggggtttctcctcttccgggtcggaaaaaggattccaattttgggcgcttttacttgaaattggcctttggggggctttaattcccttccgaaaaaacacaaattccttttttccccaggacccaggggggctaatttcgccgggcaaccctggaggggaaaacccccccaaaattttgggggcggctttaaaccttttttt

SEQ ID NO: 52943 - DNA, 543 bp, Triticum aestivum
  Clone ID: PAT_TA_52943
atagaagagtatgcttttgttcatagtttatttataaatatatgagtcctatcgaaatctgacaagatctgattttagatgtggattatttacgcatagtataatatagcatgcccgagactgtagtaatttccatgaacttgatgggtgctgaaaagctacagccttggtgttgtctagtattttataatagcttggaagaagcaagctttctatttgttgttttccatatttagaatttgatatcttgtaatgattgtcctttaaaatttcagataagtaatctttgacacaaaaaaagttcgagccataagccaacagtttttggtatgattccttgtctttgcaatatttatcccatttggaaaacttgttaataagttcatgcctgaccaagttagcaaaaggcaccacgcaatcattactaaagccatagccggtcatataagacacagcatgatcccagtaatagttttctttggttgtcaaatctatgggttcagcgtccattccaggatcaaagttcagattggggcgggtatt

SEQ ID NO: 52944 - DNA, 334 bp, Triticum aestivum
  unsure (1)..(334): unsure at all n locations
  Clone ID: PAT_TA_52944
ttttgtttttaactcacattaaaaaatattcagacaataaggagggattattgtaagctttaataaagataggattctttgggaatcttatccttcgttggagtctggtttgtgatctttttttaattgcttgggtgtgtcctggttcagcttgctcagaaatagcgcttaccgctcctgggtgggccatggctgtcctgcgtgggtttgtgcggtttcttccatccaatggtggaattcttagccggtgcggntcgtcgcgcgtttgccttgtttggaaagtggccgttcttctgttcggggctggctccgcggtggttgctttctccgctct

SEQ ID NO: 52945 - DNA, 432 bp, Triticum aestivum
  Clone ID: PAT_TA_52945
gggtccaatttaaaaggggaataaaatgttttttttttaaagggaaggggggggaaaaattgaatagttcaaggggggggggggggaatttaatacaaaaggttgggttacaagatttggttttcaaatttttcaagagcgggcgggttgaattggggatttttttggaatttttcccggggccccaaagggaatggtggtttagggtggttttgtttcaagttcactagggagagttacgggttgggcccccgaatccaaagggaaatctttacccaagtcccaagggatttgttcgttgtcaggatcgccctttttgagataacccaacttggtataaccttgttgaccggaaggaataggagcttgttttttaccatcaaaggaagtggtttcccatttggctacatagggaccaccagcttttcactt

SEQ ID NO: 52946 - DNA, 538 bp, Triticum aestivum
  Clone ID: PAT_TA_52946
tttatttatgttttctttttattttctttgttttattttttattcttgtttgatatatttttctttattgttgatggaatgccgccgaaaaccgagggacaaacggccggaaaacaggaaaaaaccaaaaggcaaaggaggaggaaaaaacaaaaaaaaagaaaaaaaaaaagcaaaaaaaaaagagaaaaaaaaaaaaaaaaaccggaagaaaaaagacaccaaaaacaaaaaaaagggggagaaacaagcaaacaaaagggcccaagcagggggcaacagcacacaaacaaaaaagggccggctaaagaaaaagaaaaaagccgcaagcgggcggcccaaaacccgccaaagggaagaaagaaccaagaaagaaacccacaccaacccggaaaaagaagaacaacccgagagcgggcaccagggagggagaaggaccccagaaaaattgcagccggagacccgggccaaaaaagggaaaaccgctttggagccgcaagaaaaaaacagggggcagacaaactctttttagggcccg

SEQ ID NO: 52947 - DNA, 429 bp, Triticum aestivum
  Clone ID: PAT_TA_52947
attacaaaatttcagttctttttctttttatgctttttttcagtgtcggttcaacagctgtcaaattgtttttctacaactgatggtatgtacaggatgcatcctcgcgtggcccgagccagagttcctccgaccaaacaatcctggcagatcatcgacctgcaagcctcgcggggggaaacaaaacagagggcggctagtggtagaaaacctcgacaagccaacccggaaccccggagctcacttggcggtggttttggcctaaacacgagagggaaaaacctcccaggcacgaacccatctgaaactgcgggatgcccaccggatcgaagagcggttccggcaggcgctcctatttctcgtattgggcaaggaatcccatgtcggtggacaccgaggggaccgcgcccagcgccagaaaatggatgg

SEQ ID NO: 52948 - DNA, 481 bp, Triticum aestivum
  Clone ID: PAT_TA_52948
agaaaaaaaccaggggtttaggaaaatttggggaaatgggggatcaaatatgtggggaaacacaggggtgggccattagaaattgagaacactggagcaaccattggacaaccaggtacgggtactacagattttactactaatcatagaaggggggggacccagataaaataaaggtttttcctttcctccatttttttgaccgggaggcaggggttgggggccacgggcgagcagaaagggccgggggttctaaaccgccgaatccgtacagggggggtccctggggcttgagggcgtaaacgacgtccatgggggggaagggtttccggggggggggctcgggggaggggaaggggtcggggatgaagttttcgaggaaaaacttgagcacccggggggtcttctcgttgatgagccccgaaagggggttaaagccgccccttcgggccagtcttcggatagccgggttggggatacc

SEQ ID NO: 52949 - DNA, 160 bp, Triticum aestivum
  Clone ID: PAT_TA_52949
gttagagctgatcagttgtgtctacataccataacaagtagtacaaaacgtaagacggcatcatatcggccgggaattacaacacggtggatccgacagtacaattacgccatcagacgagtgcatacaggagcgagggctattcatggacacacagcgg

SEQ ID NO: 52950 - DNA, 575 bp, Triticum aestivum
  unsure (1)..(575): unsure at all n locations
  Clone ID: PAT_TA_52950
gggggggggggggnnncacagcggagggcaacncaggcaaacggcaagagagcagcagacacaggagagaaaccaaggccgccggacgcagagccagcggcccaaagaggccaccgaaaacccgccnaaaccaaccacggagancncancggacgggggggggaagacacgacacacgacncgcgnacggagacggacgacccgacaggggacacacggggggaggacgacgacggcgaccggcgggcggggggggcaagagcgggccggagccggcgaggacaaccggcggggagcaggggccgcggngggagcccacgcgcgggaggggngggacgaccggcaggcccgcgagaaccgngggcgggaccaccgggcngggcgngcggccagcggcaggggacgggggagggcggaggaccgggaggcgccgggggggggggggccagaggggggagcgggngcagggggggcgggggggggggggggccgcggggggcggnggccggcggggggggggggggcggggggggccgcggggaggggcggagggggcggaagcggggngngggggg

SEQ ID NO: 52951 - DNA, 355 bp, Triticum aestivum
  unsure (1)..(355): unsure at all n locations
  Clone ID: PAT_TA_52951
gaggcgtnnttttaattttaggcttttcaagcgcagcagtccatctgcgccntatgacgctttaggcgttattaccgtncctgccacggcnncnncgtgaacatgcaaagtttaaaaggctcgcgttcaataaactaataggggaaaaccttttcccagcggctggtctgcccatagtttacagttctggaagttgagctgcgctggcgtctcttgtcttcccctccggcggggtggagttggttgcgctccctgcttcngactactgcttgtggttcgggcgccgctgcgcttcggcgcattcnngctccttttttttcgcttgttgtcggtcgcgggtgtcggcgggctgggc

SEQ ID NO: 52952 - DNA, 189 bp, Triticum aestivum
  Clone ID: PAT_TA_52952
ttggtaagatggaatctgacagagggaaagaagaaggacaagaacccgagacggagcacttatcagccgagggagaacaggatagggagagcgcgagagaacgcccggcacggtctgaagatgaaggaggcctataggacagggcgagcaagaacagcgctaccagctggaagagagactgggaaagga

SEQ ID NO: 52953 - DNA, 433 bp, Triticum aestivum
  Clone ID: PAT_TA_52953
gggggcccaagaaaaataccctcctgaccgaaaaatctgccactcaatatacatagttttacaacagtccaggtttgtttgccgagaaatattttacatcaaaagtcggggggggtgggaacataatggggtgacaaatcttcgggggttcgatgactaagggggggacttcagatttgcctggtacttcactcttaaaatattttaagcttgggtgagctgaagctgccgcattttacctcttggtaaagcctaccctcttaataatgtggggatgtgatcatatttctccacgggaacctccaccggcgtggtaatctcttttggggccagggatcgccacgggcttttggggctccagctttggacagtcgggaagacggtgcccaagggcaccacaaaatggacattcctttgacaccccttttttttg

SEQ ID NO: 52954 - DNA, 550 bp, Triticum aestivum
  Clone ID: PAT_TA_52954
acagttgaaatgattggactttatttataaattctactcttttttgtctttttcagtagaatgcttcaattcttttgccttttcaacactatctgcaatgcgctccttggctattcttgttgcctccccagcaacagttgtgatgatacgttcaaggggaccccataaattcaaggcaaaaataacgtagccaaaggttatgagaagcacgaaaagtattaaatagatgggatttctgatgatagccatgaattcattccagcccaagaagaccatagcagcaatagcccaactagggattttggcagttgtggatacaattgaacgttttgcttccaaataaaaggcgtcacattcgcgtttgaatctgttagatatatcaatctgcttggcctcactaagcactgtgagggattgatcaaagtcaaagtcctctgtagactcgatctctaaatcttcttcttctttcaaatcaattttagagaatagttttataagttttaaggtatcatctttagcgcgtttaaaatgggcatcaatatcatcttga

SEQ ID NO: 52955 - DNA, 479 bp, Triticum aestivum
  Clone ID: PAT_TA_52955
cgggtcaagaattcggggatctgaaattgggcaacagagtaaagaggcccccccctaaaaaagagcagggaaaataaagaggttgggccccgtaagatacagaagaaaagaatatgtttccaaccagcgcgaaagcccgcgtcgggagtttgatctccaagccgccctgtcatctacagtaaaagaattggaacccccatacaccctcaagacgggggtggggacttgcttatgcaagggcgcaacaccagataccctggggggtagcacaaccaatcttggtgtcccggtcggaggggaggatcttagcggggccggcctgacccttgtagttccagcccttggacgcgctgccgcatacatcctcaaaaccgggcaggctggggatctcccagagccatccaccgtaaaaaacgtggtcgaaggactccatggcgggcttgccgggggcaaaaacctggccgtaagtgccggggtta

SEQ ID NO: 52956 - DNA, 568 bp, Triticum aestivum
  Clone ID: PAT_TA_52956
cgaagagttcaagcaagcgcttccccaccttacagctcgaggacgagctgtttgtgcaggcggggagaagtgttatggccgccccagatgtcgagaaggtgtttgacgctggttgattacctcgaagagttcaagcaagcgcttccccaccttacagctcgaggacgagctgtttgtgcaggcggggagaagtgttatggccggccagcttaggcccgcaagttatcttagtttttattttcagattaggcaagttatcttaggcaagttatcttaggttgattcttctacaagttatctaggatataaatataggttgtaagactctttttgaaggcaagcaataagaagaatattatctcctattgcccggctccctgaggagccggaaccctagccgccaacagccctagccgccgcccttctcctagccgcgacggcgccctgccgccggcgcgcccgatcctcgccacgtctccctccatccttcccttaccacctacgccctagacctggtagagtacttgatcctaccagatgtattgggcatttttacttgaggaccaaa

SEQ ID NO: 52957 - DNA, 216 bp, Triticum aestivum
  Clone ID: PAT_TA_52957
ctctggtcagagtagcactagcttcagctagccagcctctgccactccgggcattttcttgcatccacgacggcaatggccaccggtgatgaccagaacccatcggacgcgctgacggaggaggcgcccgcggtggaaaagccggacgacgtcgtagaggccgtgaagacggtagaagcccccgtgccggtggaggccaataacaaggctcctgac

SEQ ID NO: 52958 - DNA, 547 bp, Triticum aestivum
  Clone ID: PAT_TA_52958
ggcttctgagacgcgagaatgagggagcaggaggcccgtgtcgaggcggggcgccggggcggcgtcatcaggtcgctgctcggcgtcgccaggctcgcggaggacggcggcgccggcgccgacgagggcgactctaagaaggaggacggcgtcggcgcggagaggaaggcggtggtgcgggtggtggcggccgacatgccgcccgcgctgcagcggcgcgcgttccgctgcgcccgcgaggagctcgccgggatgccgcacttcccgcgccgcctcgagcccaagcgcctcgcgctcgccctcaagaaggtaactaaccatgactaaagcaccgtgcgcgccacaccgcaagaactccatcgccgtctcccagatgagaataccaccgcacagcttgccaggagctggcgccgttgtttgctcccgaaaaatgcaccgccaaacgcggcgggttggcagtactacatgattgctactactcgtagtagtatttgcctccgttgtcttctactctagccgcagattataatactcgtaattgttcagc

SEQ ID NO: 52959 - DNA, 555 bp, Triticum aestivum
  Clone ID: PAT_TA_52959
ggcaggtgacggcggccggggtggcgtccatgatgctgggcgcctccatggcgctcatgctctgcggctccgtcaccttcatgctcggcttcttcctcatgccctgggtcgtcggcctcgcctgcgtcttcctcttcgtcggcttcctcaccaacctctccgggatctggagggccatcctctgctggcccgccgcatgctcctcctcctcgccccataaggacgcctccacatgtacgtgatcccctttcttccgcgtcatccccgagggggcggattgttcggtatcgcgattcgatttggtgtaaatgttagcgtgattgggaacagacacgaggattggtgctgtttctgggctcgatcggggttaaaacgcgccgaactggccgcctccgcttaagttctgcccaaatttgaagcgtctgtggcctctggctgtttaaattgttctattctaaatgataatattgatgaacctcctcgtgcggatcaaacttgaaactgtaggattggcccaccaattctctccatgagggcatcgtatatgcatgctga

SEQ ID NO: 52960 - DNA, 561 bp, Triticum aestivum
  unsure (1)..(561): unsure at all n locations
  Clone ID: PAT_TA_52960
gnagatgagcaaggtatgcgtcaccggagcggcaggctacatcgcgtcctggctcgtcaagaagctcctcgaaagaggctgcaccgtccacgggaccctacggaacctcggggatgagaagaagacggggctgctgaaggggttccccggcgcggcggagaggctggtgctgttcgaggcggacatctacgacgccgcctccttcgagccggccatccagggctgcgagttcgtcttcctcgtcgccaccccgctgcagcacaactccggcagctccaagtacaaggacaccaccgaagcaatcgaggacgcgacgcgtgccatcctacaacagtgcgagcggtccaagtcagtgagacgtgtcatcggtacggggtctgttatcacggcgtcgccactccacgaggacgggaaagggtacaaagagtttgcgaatgagtcctgctggactctgctcggcctgcccattgatcacaacaacgaattcatggacgattacctctcctctaagtgcatcgccgagaaggagctagtcaagtacaacgaccgcccctccgagag

SEQ ID NO: 52961 - DNA, 547 bp, Triticum aestivum
  unsure (1)..(547): unsure at all n locations
  Clone ID: PAT_TA_52961
ctggctcctgtgcgcgacccatggggatcacggggatggctgctcgcgggcgtgcccgtggtgcccgcggccctcgatctggcgcagccagatctggtcgtcggcgtctcgggtggcccgtggctgccctcggcggcggtggctggcttgggctggtggtgctccggctggtcctcacgatgggggcagctctggtggtggcgctggttgtcggtgtggtcgcggcgcggcgattggactcgacggcggggtgcggggnggtggaggtggctctggttggtggtggcagcggggccggctcgtctcttgctggatccgaccggatctggcgttgggggtcggcccgtggcatcagtggtgcgtgcccggtggctccgacgcttggagctcgccgggcgacgcgggtagggcagcggccgggcgtggccgctgctccggccgtgggcggcggcgtagggaggtccggcggtggtggccttccggtggcgtgccggcttcacggtggctcgacggttctgcccgcggcagcggccggcttctccggcgt

SEQ ID NO: 52962 - DNA, 572 bp, Triticum aestivum
  Clone ID: PAT_TA_52962
cggtggggtcttgtcctaccaggtctgggacgcctgcctgacggaggccgacaggaggttccttgccaggtttcttccgcccggctccgacgccgaggaagcagtgcaggatttgctcactggcgaaaataccactttgggaacccccttgtaacctggtcctctgctctttgctgtggtgatcttcatccagatgctgtccttaacaaggagcagcaaatcagagctgataagaaggcatatcatgcacacttgaagaactaccattccgacatgactgataccgtcacgaggtggagggacaaatggttaacttgtgacaatcctaaaagcttgttcagggataaccttgctaaacagcgacgaggggaccggcagtcatccggagaaaatgtaatattttctaatgctcctaagaatgcaatacccatgaaggttgtacgaaacggtgacgtcacaaagtatatgtcatatattaaggtcagcagggctcaacatgatcttgttaagagaatgaaacaatctggtgatggcattcagacaagacatcttgttggtgttattggtgatat

SEQ ID NO: 52963 - DNA, 572 bp, Triticum aestivum
  Clone ID: PAT_TA_52963
gtgcggtgtgcgcctgccatgtgtggctggtgctgctgcctcgagtgcatccataacatccctcccctcaatctcctcttcctccacttctcctcggctccacgaacgggaagcgagggagaagaaggagcgcgaaccctcagccccatggcctccatctcggtcccgaaccctgccccttccccaaccgaggacgcggagagcataagaaaagcagtgcaagggtgggggacggacgagaacgcgctgatcgagatcctcggccaccggacggcggcgcagcgcgcggagatcgccgtggcctacgagggcctctacgacaagcccctcctccgcacgctccaggacgagctctccagccacttcaagggcgcgatgacgctgtgggcgatggacccggcggcgcgggacgccaagctggcgtacaaggccctcaggaagaagggcggggaccggcacgcctgggtgctcatcgaggtcgcctgcgcgtcgtcgccggaccacctcgtcgccgtcaggaaggcctactgctccgcctacgactcgtcgctcgaggaggacgtcgccgcctg

SEQ ID NO: 52964 - DNA, 203 bp, Triticum aestivum
  unsure (1)..(203): unsure at all n locations
  Clone ID: PAT_TA_52964
cggacgcgtnnttnaaacgtacaagctttgattgtagtgtgttgagttatagggttaagatattttgtgttgataaggaggaggaggatgtttttgtgggaggtatatgttgaggatgtgttgggangtgtgagtgggaatggtgtagggggggggagagggttaaaggggtgttgaggggttttagggttgggggaagggga

SEQ ID NO: 52965 - DNA, 552 bp, Triticum aestivum
  Clone ID: PAT_TA_52965
aaacccgaaaacaaacaagtggttcaaaagtttttttcaggagatcggtaccttaagtgtggatcagatacatggacgacaatcacattgtccggcatgccaaaatggaccaggagcaattgcctggttcaaagggctggaatctttggtcagacatgctagaacaatgggttctaggagggttaagctccacagggaattggctgcattgctggaagaggagatgtctcgcaggggatcttctgtggtacagcctggcgagcactttgggaaatggagcggattgacagaaagcactgaccggcagatagtatggccgccgatggtgattgtgatgaacacaagactggagaagggtgaagatgataagtggttaggcatgggcaaccaagagctgctcggatatttcagtgattatgctgtgatcaaagcacgccatgcatacggtcctcttgggcaccgtggcatgagtgtgctaatatttgaaagctctgccgtgggctatatggaggcagaacgtctgcataagctctttgttcatcaaggaacata

SEQ ID NO: 52966 - DNA, 567 bp, Triticum aestivum
  Clone ID: PAT_TA_52966
ggagaagcacgaggtgcggcatgacagagtcgggattatccaccactcttgccgtttgcttcctgaaataggcgttgatggaagggcatgggcttggaggaagacgccaaggttggcacctctcttcttgacatgtactgcaagtgtggtgccattgcttctgacgaaggtggccgcgatgattgaggaggtagaggggatgctcggcatgccaatggagcatctctgatgcgctccttgagctggatcattgtctgcacagagacatccgctccaagctcaagatgctcgtcagctacgtcgacaacctccctctagggtgaagaagtccggcaagaatgagaaggccgacatgtcagagttcacagcgcagttggattccattgggtttaagatagtcgagggaagtatttgtgcatggtggagaaagaatatttgccagaggtttccattttcccccaatatctaatatgtggggcctactgctcagtggagaaagaatatttgccagctatctcgccaagtaacgctcgtgaagccaaatttggaacatccccattctaagga

SEQ ID NO: 52967 - DNA, 547 bp, Triticum aestivum; identical to SEQ ID NO: 50394
  Clone ID: PAT_TA_52967

SEQ ID NO: 52968 - DNA, 571 bp, Triticum aestivum
  Clone ID: PAT_TA_52968
cttctttttccgcaagcaagccatatatacacgcattatctcttcttcttcttgtaggtagcagcgcctaccaagctcttttccatcggtgaccattccagtcgtccatcacatggatcaagacgagcgccagcatccagagccgccggccatggagaaggagctctctgccgacgcgctagcctgcgactactgcagcggcccacaggcggtcgtgtactgccgggccgacagcgccaggctctgcctgccgtgcgaccgcctcgtgcacgccgccaacgcggtctgctcccgccacctgcgcgccctgctctgcgccgcatgccgcgcaaccggggccgtcttccgccacgctggtaccgaattcctctgctccaactgcgacttcgggaggagccgggacgccgagctgccgctgcacgaccgctgcacagtccaggggtacacgggacgaccctcggcgcacgacctcgccgctcttctcggggtccccgacttcgacaagccctcggccggcaaagccgacgacggttggtgggccatctgggaggagccccaggtgttccgcctg

SEQ ID NO: 52969 - DNA, 461 bp, Triticum aestivum
  unsure (1)..(461): unsure at all n locations
  Clone ID: PAT_TA_52969
ccggccgcgggggtcgcccgggaaattccggccgggggcgggggggggaacaacttttccctatggggagtggtaaaaaggttgggggaaaaaaaggaaaaaaatgctcccggggaaaaattgaaaccgggtaaaaattccaaaaaaaaaaccacccggaaaaaaaaagggaaaaaccgggggggcccaaggggggaaccaacccaaaaaaattgggttgggcaaacggccccctttccaggggaaaaacctggcgcccccgccgcataaaggaatcgcccaacccccggggagagggggtttggttattgggccccaggggggttttttttttcacctgggagacggggaacaacggttggccctccacccccgccaaaattctagaattttggngggcgccccccgctggtttcccccccggggggaaaaaacctgttttgtgggggggtcaagggggg

SEQ ID NO: 52970 - DNA, 437 bp, Triticum aestivum
  Clone ID: PAT_TA_52970
gggaagaaacagaggctcttcatttctcaaacaataataagcctcacttcacaattaccccagagcattcttcccatatgtacaaagtttgctggcaagatgtatccccctagttataagtatacaaccctttaaacctgttgcatttgttacatggtaaatgttgcccaggaaggaaaatactgctgcccaaactcatgtgcttcttctgtacatcgctgctccgtattcgacttcacgtctacatgaatggaggctttggaaatatatgccctgtgacaagaggataatgaaaaggtcaagttatatattcttgtattggatagttgagcaagcaataaattggcaaaaagtcttggcagcaagatagtgacatatgcgcaccactattttagcacgtagcaatgaaggatatggaaaggaattacattgatatc

SEQ ID NO: 52971 - DNA, 505 bp, Triticum aestivum
  Clone ID: PAT_TA_52971
ggaacaacacataatagaatctggatggctttagatcacaaccaaaacgggaaaaacattttcagttcaacctaggactcgaacagtttacagaaaagggggttcagtatgtttgcaaacatgacatggacccaacatttaagaaaatccaacaggtaacatgcagcagtttttcagcctaagctggggcacccttgcccttttttttttggagcttcctcatgtaaaactccagctccttgccctccaggatgtacccatcagctttgccacactgtccagggcgagacgaaatgcaggccagcagccttccaccggtgaactgctcctcaatgggagagtccagggtacgtccctgctggcgcttctaaagcttcctctggacattggggctcttctttgcttcctctgtggcagcagcagcaacctcacaagctcattgtttgacgaattgtaaaccacatccaggagacgggtcttgcgggtcacagcctcactaccccat

SEQ ID NO: 52972 - DNA, 101 bp, Triticum aestivum
  unsure (1)..(101): unsure at all n locations
  Clone ID: PAT_TA_52972
gttaactctggattcatatatctcggcaaacacagtgtttgcccatcagaaattcagaacactganagcaaccattgaacaaccagctactggctactaca

SEQ ID NO: 52973 - DNA, 580 bp, Triticum aestivum
  Clone ID: PAT_TA_52973
gacttttggtatgtctgtgcttcctgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccggttttaaaggaccaaattttacttccccgggcttgcaacgtaaaagtttttttttggggcccccaaatttaaattcatgggccgggttttaaaaacgtggggatgggaaaaacccgggggtacccaaattaaatcgcttggaaaaaaatccccttttccccggtggggtaaatagaaaaagggccccacccaatcccctttccaaaaatttgcccaccctaaatggaaaagggacccccccttttaccggcctttaaagcgcggggggtgggggggttccccccaggggaccctttaaatttgcaaggcccttagcccccgctcttttggttttttccctttcttttttggccagtttggcgggttttccccgaaaagtttaaaatggggggctccttttggggt

SEQ ID NO: 52974 - DNA, 574 bp, Triticum aestivum
  Clone ID: PAT_TA_52974
agcacccaaatcacctgatttcttcgatgatgggtgtttaagccctcctgtccaacaaaatcaatcaaatatgctgagttgtaatggcatcacgcaatcccagagaactgcatcaacagggaacatagattccacatcgcttaagtcaggcaactcaagcttagctgatttgttttttgattttgagaatgttcaccgaactcagcaatccaacaattctgcagctccaagttttgtagccttttctgctgctgtaaatggcacaaaggaggatctctacagtcagccaaatttgcagcaacaacctgtaactggctatccatctgtagatttatttgcaaatatgcctcatacagcttcatctgctgataaaataccactggaagctcatccatctgtagatttgtttgcaaatatgcctcatacagcttcatctgctgataaaatgccactggaagctccatcaatgggcaatgctgggtgggctacatttgacacgcccccaaaggataaacagcctggagtcactggtccctctcctgtagctgacgtaggtaatcataaacagattctg

SEQ ID NO: 52975 - DNA, 549 bp, Triticum aestivum
  unsure (1)..(549): unsure at all n locations
  Clone ID: PAT_TA_52975
cccganaccanagctcgccctcgtcgatcgcccgcgcgccgctcagccaagaagccgcacgacggcgttggcgcattgccccggagaggcccgccgaccgatgaagccgctgtacctgcgtggcagcggcagcttcaagaggctgctgctctccctctcgccgcaccgcgccaagcgcgtccacgcgccccccgacgtagagcacgccagcgcgcagacggaggcagcgtcgccgccgccgccggagcggaggcccgagtgggagtgcttctcgtacgaggaggtccggcgcgccacgggcggcttccgcgcggccaacctggtgggccggggcgggtcgtcggaggtgtaccgcggcgagctggcggacgggcgggccgtggcggtgaagcggctcctgggcgcgtccgcctgcgagcgccgggagcgggacttcctggcggagctcggcaccgtcggccacgcccggcaccccaacgtgtgcccgctcctgggatgctgcgtcgaccgcgacctctacctcgtcttcgccttctccgcccgcggctc

SEQ ID NO: 52976 - DNA, 572 bp, Triticum aestivum
  Clone ID: PAT_TA_52976
attgagaggtccaccaaccttgactggtacaagggcccaacccttcttgaggcgcttgaccagatcaacgagcccaagaggccctcagacaagcccctccgtcttcccctccaggacgtttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaacgttggcttcaatgtcaagaatgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagatcgacaggcgatctggtaaggagctggaggccctgcccaagttcctcaagaatggtgatgctggcatagtgaagat

SEQ ID NO: 52977 - DNA, 647 bp, Triticum aestivum
  unsure (1)..(647): unsure at all n locations
  Clone ID: PAT_TA_52977
anaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccttttttgtgtacccaacttttccttcccctgccctggccttcgccaatgcttttttttttttttgccccccactttaattccattgcccggcccttttctaccccaccggccgtggaggacccaacccgttgcccccccctaattttatttgccttgccaacccccctctcttcttttccccgggttgtttttcaaaaagaggccggccccgctcggccttttcctttccaattccgtggcccctatttggattgtgggaccgccccccccccctgggcccttttaattcccggcgcggggggtgtggttttggtcccaccggggccgtttccccttttcccctggcccccttcccccccccccccttttcggtttttttttccttccctttttttggccccccccgggcgggttttcctttcccggtttttatattggggggcgccccttcccgtttgggccttctaatttttttgccttccccccccccccccccccaaatttttttt

SEQ ID NO: 52978 - DNA, 574 bp, Triticum aestivum
  Clone ID: PAT_TA_52978
aggcgcaaacctactccaaatcagtttaacatggtctggtatgctgtttgcaaacatgtaacatgagtaatcagcgtccagctatgctggttttcgtagctagcattttactcccagcagcggcaacactggccggagcctcttccgggcgctccgtctcgctgccaagctgccccgacaagtgcggcgacgttcccatcccatacccctttggcatcggcacacactgcgccgcgaccagcctgagcagctacttcaacctcacctgcaacggcacgatcgatccaccgcggccaatggtcggcaatgacgaggcagtggttgagatcaccgacatctcgctggagcacggtgagatgcgtgtgctcagccccgtcaaccacatctgcttcacttcggacaccacgttcaccaagttcctcggagggtacgagctgcaactcacgcccttcctgccctccccatcgcgcaaccgcttcatggtaatcggctgcaacacgcttgggctcatcagcgggtacaaaggcaccgcgagccagtacgtggctggttgctactcctactgcgagggcgt

SEQ ID NO: 52979 - DNA, 570 bp, Triticum aestivum
  Clone ID: PAT_TA_52979
gctcgcaccaatatgatagggcccaggagttatactctggtgatgaaggcagttcagcatatgataagagggagtactctcagtgtgccaccatgtccatgtctcctcgggctggtctcccagagttctctcacctgggtttgggtcattggtatactctcagagagttggagcattcaacaaatgggttctctaatgagtatatcattggagagggcggatatggggttgtttatcatggctgtcttgtaaatggaactgatgttgcaatcaaaaaactttttaataacgtgggccaggcagagaaagagttcagggtcgaagttgaggccattggtcatgttaggcataagaatctggtgcgacttctgggttactgtgttgagggaagccacaggatgcttgtctacgaatacatcagcaacggcaacttagaacagtggttgcatggtgcgatgcgtcaacaaggtgttcttacctgggaagcccgcataaaaattacccttggcattgctaaagcactggcttatttgcacgaaggcatagagccaaaagttattcaccgtgata

SEQ ID NO: 52980 - DNA, 577 bp, Triticum aestivum
  Clone ID: PAT_TA_52980
tctcgatccagcgcaaccgccgccgacaccacacctcgtgagtcctcgtcgccggagaagcagcaagcaagatggccggaaggaagggtggcgacaggaagaaggccgtgacccggtccgtcaaggccgggctccagttccccgtcggccgcatcgggcgctacctcaagaagggccgttacgcgcagcgcgtcggctccggcgcccccgtctacctcgccgccgtcctcgagtacctcgccgccgaggtcctggagctcgcaggcaacgcggccaaggacaacaagaagacccgcatcatcccccgccacctgctgctcgccgtccgcaacgaccaggagctcggcaggctgctcgccggcgtcaccatcgcgcacggcggcgtgatccccaacatcaactccgtgctgctccccaagaagtcccccgccgccgccgagaaggaggccaagtcgcccaagaagaagacctccaccaagtcccccaagaagaagaccgccgccaccaaggagtagccgtccccatagcctacccagtgttgcctagttagttggatcttgtatgtagtgtggtggcc

SEQ ID NO: 52981 - DNA, 546 bp, Triticum aestivum
  unsure (1)..(546): unsure at all n locations
  Clone ID: PAT_TA_52981
cacgnncgtccgnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaataggggaagccttttttgggggtccctggctttacgttccctgttttgccgccctgtatatttcttttttggggcccccgtttttcattttttgggccgccctttttcccctggttgcctgggaacccctgggggttcccccctttgttcccccggctgtttcccccctttttatgccccgtgtttttggctttgaggccccccctggtccccctttccaccggtggtccccccttttggggccgggggtctcgccttgggtgggccctttattcccggcggttttgtggtttccttctcggggcccccgtcccctttgtccgcccctttggccccgctttttgccccttttcgcttcgttttttcccccttttcggggcttttccccgcggtttttttttttgggggtttttttttg

SEQ ID NO: 52982 - DNA, 576 bp, Triticum aestivum
  Clone ID: PAT_TA_52982
gtgctatcaatcgagaattaatacactgcactagtagtagtacgcacatacatatcatggggtcgcagaacaaaatgcgagcttccgagtcagcccgtgagttgctgatgatggccgctcgggagggcgattcggcgcgattgaatcatcttctgggcaaccacgatgcaactgtggttgtgcccatgcctgaagtcgtcgtcaacattcatgacatcgactccctcaccgtcagcagggtggaggactcggttctccatgtggttgcggcctcggcccgtggagacaacgctgagtttctggagagcgcaagtgtgatccacagcaaggccaagcacctcctagacgccagcaatagcaagggtgacacgcccttgcattgcgcagccagagctgggaggatcaaaatggtctctcacatcatctatctggcgacggcggaggagggcggcgacgcaagggtgaaggctgtgctgagaaagcagaacaagaaaggcgagacggccctccatgaggcccttcgcttggccgacaggaagatggccagggcaatggttgacacgctaatggaggtcg

SEQ ID NO: 52983 - DNA, 484 bp, Triticum aestivum
  Clone ID: PAT_TA_52983
cccgctcctcgcacctccccacccccgtcgccgtcgccgtcgcggagaagaaactttgccgatgtctctggcccgcctcggccagtcgctgatccgccgcctccaccggcctctccacctgcctccagcgccgccgacagaccaccatgccgccgtttcccgatctttagctctgatccacgcgaatacatctgtaagaggtttttcaagcttaacatacaacggcggcggcttgattgctggcaagtttggaggtccgtcgcctctgcacgctgttcaggttctggagctcgtagttcacctaaatcatgcaagacaaatgtcatcaggagctgtggcaccggcaccggcagggccaacgccatcaggagcaccggtgacgccaccgtcagtggccaaaggcgtacctgttggtgctaaaaaggttggcctgaaagctcttatgatgagccctgcgcggggcgatgagccatactgggggcgg

SEQ ID NO: 52984 - DNA, 577 bp, Triticum aestivum
  Clone ID: PAT_TA_52984
cccacgcgtccggtaccactccatccacttttccccttctttctccctccggtccggtggatctccagccacccaggcccgagccatgggcggagacggcgacttcaacgccgcaggcggcggaaggggggttgcgggtcggaggcgtgggcggcaagtgcgaggcagccgcgggcgggagacgcagggcggcgccccggcccgaaggccgcggcaggagttcgtcgccgagggcccgaggcggcaagtgcgaggcagccgcgggcggaagacgcagagcgccgccccggcccggagaggtcgcggcaggatttcgtcgccgagggcccgaggcggagcgcacggggtcggcaggcgcagcgccggcgagttgctggagtaaggattgtgcagcggcgaggaggcgctggctgcttccgcttccgcaacacgaaggcgacgatgcgcgagtcccggcctcgtccagatcatccatcgccaattcgccaggtagtagatcaccattgagaggtgctgcttctaaggtgtaaaatccatccaggtacctaaacctaccctttccctcatatgggtatat

SEQ ID NO: 52985 - DNA, 564 bp, Triticum aestivum
  Clone ID: PAT_TA_52985
ggctaggtccaagttttgaacaacaaaacaaaagtaaagatgtttgcatacatttacacgctccacagagccgcatggatacatgcaggccggaatgtgtgcttatttacgtacgtacgtaacatttgtagacgtataaatattcaaaccacacaaacataaacacacgcacgtacgtatgcatgtatgatcacactcactcgcacgtactaggcttcggcgtcaagggtgaggaacgcgaacgggcgctcgccgttgaagttgcccgggggattgtagttgcaggtgatgaagacgccccggttccccgtgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctgcagccggcaatcgccggcgcgctgcgccgcccagtcctgcgcaaac

SEQ ID NO: 52986 - DNA, 446 bp, Triticum aestivum
  Clone ID: PAT_TA_52986
ggcctaaataattcaccccggggggggggcatccctccaacccaacaaaggtaacccgaagcatccaactggggacccaagggacataataagaaccaaaaacacaccggccgttaaaatttatttgcccggcccaaaatacagatagagcagcggctttttttcaaaggaacctgttgagaaagtcgcccacgggggggtacttgacctaagggaacaaattgttcgcctccaccccaaacgagggggcaaactaaaggggggtctggccccccttgaaaacaacccggggcccaacgaaaaaaatatgttaatggggaacgggcccttttggatttggttggggacggggtccttggggacgaacaccctttggaaggttttggcgggttttttttcccacaggaaccccatttttttttgcaacaacctgttggccggcggtt

SEQ ID NO: 52987 - DNA, 376 bp, Triticum aestivum
  Clone ID: PAT_TA_52987
ccaccagggggaaaagggcccccccctgtttcccatccataaaccagggaaaccaacccccccccccccattatgccagaaaccccccaaaaaacatatcttgccccgatccaaaagggaaaggaaaattcccagctcccacccatcccgccaaccgaatggcaggccattaatcctatataccatcccaaataacccccccaaacccccaaaaaaaaaaaaatattaagaagtgggggcccccccaaacctgaaattgaacccaggaaatcaaaccctcccccacctaaaagcccggggcaaaaacaccacccaaaaccgggggctttaacccaacccctgcattgccaaaaaaaaaacccccagggttttggct

SEQ ID NO: 52988 - DNA, 559 bp, Triticum aestivum
  Clone ID: PAT_TA_52988
aaccaaggctcagtggattccatagattctggtatatattaagatactgacagttattgcgtacggccagagcgacaccaggagagtggctaccattgtaagcgcaaacctgaagcattgtctcatacgcagcctattaaaatgcaccaattgtgctgcagttgccatgtacacaaaccaaccgatgtcaagcagcatgatagtgctgcatgccattgtaataagagcaactgtgcgggcgaccggagccaacaccgcgtatatgccaactgaaaatgcagctaccatacttcggcctgagctgtttaggaatacgatggagaggacaaaggctttcgagcgtatcctgagatcgatgctggtaaatccagcatacatgaggcttgcaagggaaagggcggagcaaagcaatgctagattgttggccacgatgaacaccacaaaagagtagttctgtgcgagcactggcgtgccacctttttgttgagcatcttcgcctctgtacccacctggtacggtgaaagctgctgtgaatgaaaccgttacgaggagggctgat

SEQ ID NO: 52989 - DNA, 581 bp, Triticum aestivum
  Clone ID: PAT_TA_52989
aacaaaaattaccaatactgtatgatcactgaagttattggcaatgttctatcaaaatgaccacaatagagataaatctggtaacagtaaagtaaactaccaaatgcagtatgcccaagttgcttccctagctaatacgggacaagacttgtatcttcagctgacaattccccaaggaacaagaaaaaacctaccattactgttttcataagcatgtctgtagatcttcgttagacagtcagttagacaggcaaaaaagggcggcagggcaaaatatttattcaaactgctgcgcataacaaaagccatccttcagatcattcaggaaggaaccaagagattatcacaatgtgattcgcccacacacacgccagtatgctccagggtggaaaagggatctttcaaacacccatatgtctttcaccagtacctcctttgacttgtcccctgacacaacctctccttttgaattataggcttcaaatttctgcttagtgacgaactcaagcgtaagctgtatgaaagctttgtcaaggtcattcttatcaagaccaatcatacgagccctcaaagttcttatc

SEQ ID NO: 52990 - DNA, 728 bp, Triticum aestivum
  unsure (1)..(728): unsure at all n locations
  Clone ID: PAT_TA_52990
cggacgcgtggggcacttctcacctagtaaatcatcccccatcaacgcgccaaagccgccctgaattttcccgctttgatagttcgcagcaaaacagcgaatcgcgcccactacagattaaaacgcgtctatccgccgttcagcccccatcaaaccgtctgcgtntagcttcatttgaggtcagtgccngcnnanccnccacatcaccacccaacctccnnnttntncttncaccagcncaaaaaatgggcccccccccnnnnnnnnnnncnnnnnccccnnncccnnnnnnnnnnnnnnncccccnnnncnnnnnnnnccccnnncccccnnnnncccnnnnnncccnnnnnnnncccccccccccccccccccccccccccnnnccccccnnnnnccccnnnnnnnnnnnnnnnnnccccccccnnnccccccnnnnnnccccccacacnccaaccncnnnnncccccccccccacaaacacccnnnncccccccccccccccccccccnnnnccccccncccccnnccccccccnnnnccccccccnnnnnccccccccnnnnnnnncccccccccnnnnncccctctttccccncccnncccccccccnccccccccccnnnncccnnnncccccnnncccaccccccccccccccccccccccccccccccccccccccccccaccccccccccccncccccccccnnccccccccccacacc

SEQ ID NO: 52991 - DNA, 264 bp, Triticum aestivum
  Clone ID: PAT_TA_52991
tttttttttttttttttttttttttttttttttttttttttttttttttggagacttaactattttctattaagatgagaattagcaaaattggttctaatttattttgcgctggcaattaaatcggtaaatccatcctgccacgatgccggcgatggtcaactcgcaaggccggtgcccatggcagctcgaatgggtacccggcaccggcataccggttcctcttatgcgcccggtccacctccagcgtttcaagggcgacgg

SEQ ID NO: 52992 - DNA, 584 bp, Triticum aestivum
  Clone ID: PAT_TA_52992
atagcccacatcagctgcagctgcagctgcagcgatttgaggtactcgatcgcctcgtccagcatcgacgccttgtccgttttgttgcagtggggtacgagttcttgcagggccctcatcttctcgttgatcctgtcccttctcctcctctccgagaggttgtgcacttgggcggcgcgccgccgtttggctgtcgtcggcttctgcgccgtctcgcacgtcacgtcggcggagttcgactccacgtcctgcataacctcactggggccctcgctctgcttccgcttgctggtgccggaaggcctcgaccacgtcgacgacgaggtcaacgtcgccgacgcgctgtggtaggacctagagtccctggcctccttgcggttgcggatcagcggcagcggcacgctgtcgtcgccggcggcatccgagacgtgcgccgtctgggcctggttgcccccgccgccgaccctcctggaaccaatcgtgaccacagaggactcgccggcctctgacgccagcgagacgcgcggggccgtcgccgtgcaaccctgctttacccgtcagcagcggcggcggcatcaccccgc

SEQ ID NO: 52993 - DNA, 510 bp, Triticum aestivum
  unsure (1)..(510): unsure at all n locations
  Clone ID: PAT_TA_52993
cgcccacgcgnnccgnacccgcaccgcacgacagacagacagcacgaggaaggcgagccaaccacccaccaccgccgcgagactagcaccacgagcgagctcggccgannccnannccgnctgcgctattaaggtttgtttggaggaaggggaggagtctnggaggtggagctgangagagagaccggcagaggcggcttccgcgaggcagggggagagggcgaccaggcttnngncatggccctgcagcgctgctggagnncgntacgtnccgccagaaacgggcgccgccggcgggcgagctgaggcctnnggaatcaacaagggtgaggccgaggcacagagnacggcggacaccaagagccctttgcccggancggagggcgaggaggcgggcaggaagaaggagaccatgganctgntccccaaaagcgccgggcctggaggacgccgncgggccctgggaggctgccaggggagggaagcacaagggagccaggggggacccag

SEQ ID NO: 52994 - DNA, 598 bp, Triticum aestivum
  Clone ID: PAT_TA_52994
ctgcgacctcaagccgggcaacgtgctcctcggcgacgacatgacggcccgcatcggcgacttcggcctcgccaagctgctgctcctcaacgccgccggaggcaccgagagcacaatcggcatcaggggcaccatcggctacgtcgcgccggagtacggcacgacggggagcgtgtccacggccggcgacgcgtacagctacggggtgaccctcctggagatcctggccgggaaggcgccgaccgaccgcgggctcggggacggcacgacgctgccggagttcgtggcggcggcgttcccggagaggatcgagcaggtggtcgacccggccctgctgccgatggaggagctggacagatcagtctctgtttcggcttcgatgtcgaccatgtcgacggtgtcgacgtcgtactcggaggacagcgaggtgcgcgtcacggcgcgggactgcgtggtcgccgccgtgagggtcgcgctgagctgctgccggcgggcgccgtacgagaggatgggcatgaaggaggccgccgccgagatgcacctcatcagagacgcctgccttcgcgcgtgcggtgcaaagaagcctgtggtttagcgt

SEQ ID NO: 52995 - DNA, 461 bp, Triticum aestivum
  unsure (1)..(461): unsure at all n locations
  Clone ID: PAT_TA_52995
gacccagcggccgcccacgcgnccggggngcaaacngggaagcgacggcggggacacggngaagagaaggagaagagagcggcacgggcaagagaagaggggnnccnaggggaaggcangacnacnnaacggggggagncaccgcaanaacgacgggggcgcagnagggccgcgacaanggccnacnncggcacagccaccgngcaaggcaggcagccagcgagagacagaaaaaccacgggaggcacgnccgcgcagaagcnaaagcancgcgnagggcggggggagagcagagccacgccggaacagaagnaggcaagngagaaggggaacgcgaaangacngnaggaaaggcggcaggagcgcgcgaggagcggagagaaaaagagcgggcacgcggcacccaccccacacaggacggggaagccaggccaggcgcgagacccggagcgagagggggg

SEQ ID NO: 52996 - DNA, 538 bp, Triticum aestivum
  Clone ID: PAT_TA_52996
cgccacccccacccccggggccgggggcgccgcctccgcctccttcgccgggggccgccgcttcccgggcggccttgacgtgcccaacctcaagaagcgcggcggcggcacgcgcagctggatccgcgtcgaggccgccacggcctccgtgcagacgctggaggtcgacaaggccaccatgatgcgccgctgcgagctccccgcccgcgacctccgcctcctcgacccgctcttagtctacccctccaccgtcctcggccgcgagcgcgccatcgtcgtcaacctcgagcagatccgctgcgtcatcaccgccgacgaggtgctcctcctcaactccctcgacagctacgtcttccagtacgccgccgagctgcagcgccggctcctccagcgcgccgagggcgacgagctccccttcgagttccgcgccctcgagctcgccctcgaggccgcctgctccttcctcgacgcccaggcagcagaattggaaaatgaagcatatccctttactgggatggagctaacatcaaaaaaatta

SEQ ID NO: 52997 - DNA, 289 bp, Triticum aestivum
  Clone ID: PAT_TA_52997
ccccgcgtccgatctgttttctctgccgtttacctttatggttacagggatttactttagcagtaaaagggtttactcaagaacaaacagatatcagatgttgttcaacattgaaccaaaataagataaatctatcgccgctaaactttcactgccatctctctgatctctgttttctctgccgtttacctttatggttacagggatttactttagcagtaaaagggtttactcaagaacaaacagtaccaactggtaatgacattaataaatttgccatttgtgtttt

SEQ ID NO: 52998 - DNA, 480 bp, Triticum aestivum
  Clone ID: PAT_TA_52998
gaaaacagcagctaagctcctgtctcgagcaagcgtggtagagatttcaaacgagaggttgtcagctaacccgacggctgacgagactcaatgaacaggcgacgaccaagctgcccccgctctcgcctgtacggacggacgacaagccacgcgcgccggcggcctcagtggtgctcaaggggcaggacagctccagggccgaggcgtacgagcagtacctgcggttgccggcatctgtccagactgtggaaggccgcatgctgcccgggctggcccgacgagggcctggtcaagcccgcgctggaggcgctggagatcaccttccgctttgtctccgacgcgctctccgacccgcggggctacgccagtcatcgcgagctcgcgcgggggctcgagtcgctcgccccgcgggatgtggaggttgtggcccggctctgccaagggggaccgcggggcgccgctgcacgagctgagcttgtt

SEQ ID NO: 52999 - DNA, 378 bp, Triticum aestivum
  Clone ID: PAT_TA_52999
ccgaaccgcaatcccgggtcgcccccgcgtccgcccagcgtccgcactcagcctgtttgcctcctcttcctcgcttccttctccgatccaccactcggatttgtagtggtggcctcggtgattacctagttcgctgggtatcttttcttctctatctgccgaatcaggtatggatagccctctttgtagccgcccggcccctccgcgtctgcctttcgtgccagttgaagaagcacctgacgcgtcccacccagctctcccaaacaaacgcttaaaaaagatggacctaccaacatgacatgacacaaaaaattgcgaagggcatcacatccccgataaccttgaactgaccacaagcaactagaactgcacatctat

SEQ ID NO: 53000 - DNA, 566 bp, Triticum aestivum
  Clone ID: PAT_TA_53000
gattcatcatattgtttattccaaacctcagtgaatttaaatcgttgttggcaacaagcactacgcttacttaccaattgccacaacttcaaaagttcaaatacacgtggtaaatattgaaatcaacaagtgcgtggccagtctttcaatcacacgtctgactagaattgctcttctgtgctaagcatcgatcacacttccacccttcatcacattcacctgtgctctcttcatgctccatgcccttagctgtggcactctcaccgtggtacttccattgttgaaagcatacatgtgggcggcgccgtcgtcgacaagtgccaccggataaactctggccgtgatgcagatcctgccaccgctgccgaagctctccacggcggaccggtcaatcagagtcctgagggatatccttttttcattttcaaggtcaaattcaaagaagcctccataggctggtgtgtacagtcctggtctcagggaagaccttctaagatcagagcacatgaggataatgtacttttgctctgatttgtaaaccctgaaatgcactgcagtgtgctcct

SEQ ID NO: 53001 - DNA, 439 bp, Triticum aestivum
  Clone ID: PAT_TA_53001
caggcattaacagcaaatgtccaaagccgaaacgatttgtgcgatttttggccctatcgcatcaaccttcactggttatgaaacaaaatcgataaacaagccaaaaaactttgggaaacttataacagagttgaagccactggggcatgtaacaaacaattgtgcaagggtagttttcacaaatcatcccaacatttgggactaggggtacttctccaacaaggacaaacacattgtctgcttacttggctttaatcaactggtcgattattcttttgaaagccggcgctctatctcatgcacctctgatccgcaaaccacgacctcccttcctcatgctgccttgcacacctgcgggtccatcggcaccttacccaggaaaggtacccccatctcatgggacatcttttcagggccgcccttggtggtgtaaaacacc

SEQ ID NO: 53002 - DNA, 550 bp, Triticum aestivum
  unsure (1)..(550): unsure at all n locations
  Clone ID: PAT_TA_53002
tnttttttttttttaagcaatccgcaattcttcactgccgagctacacaaatggttcagattacagcaaaagcatttacaatatgttctcgctaccttgttcagaataaatattctcactacaagcaaatccagaacaacagcatgcacacatcttatcagataaattacattaaactgaaggtgcgacaccaaaccagtgcaccgctgtctcctacttgtcgtcccctctttaaagcacagactgttcaccagcttctttgcctgggacaatgataactggtgctgctttacagttgtggaagcaatactcactgacacttccctgcaacacactctgaataaagcttcgaccacgtgtgccaataatgacagctgctggcttcagtcgctctgcttctcggcaaataacctttccagcatccccttcaacaatccgtgccttggtgtggaccagtgactccttgaatgcctcgacggccaactcatccattagttcctgacttttgttgtataccagatcattatgcacactggagacggcgtggaca

SEQ ID NO: 53003 - DNA, 572 bp, Triticum aestivum
  unsure (1)..(572): unsure at all n locations
  Clone ID: PAT_TA_53003
gccctnnttttttnnttttttttnntttttttttttttttnttttttttttntttttttttttttttttttttttttaaaacaaaaattttatatttataaccaccccaccaaataccggttttattaataggcgaaattttgggaaggagggaaggttaaaactggaaaactttttttatgataacccatttacataagagtaaggaaaaaaattggttttaatttgattttgaagaaggaacatggcaagcccctgaaaaaatgtggattaacatggattaagggctttttgataaagtaccttaaaaaaaaacaaaaggttgagtccgaataaggaggggagcttatttttacaggggcataagttttttgtccttgaaaaaccagacaaaaaaccaaaagatgaaagcccccaccactccagtaatgatcagcacccactggaatgcgttctgaatgctaaaaacgtgggtctcaaagttaatcccaaatacccccgggaccactcaaaaaatagcgacaacaaacgttggggttgttagcaaaagctcgaacgggatcaactgattc

SEQ ID NO: 53004 - DNA, 425 bp, Triticum aestivum
  Clone ID: PAT_TA_53004
gggggaaaggaaaccaccattttttttgggcgcaattggggggaggaaacccccaaaattttccttattggggcattaaaaagtctcaaaggaggggaacaacaggagcattcctatattttggtcccgaacaactcgtttttttaaaggtaaagggaaaaaaacaactttacacgggtccaaaaagaaaaacacccccaaaaaaaattttgaataaatactcccagcccatacccccaaaattatacaaaaccccccggaaaaccttttttggcacaaaaccctggaaatttcgttttttttaaaagatttccccttgtaaacccccctttacggagcaacggggtacccatattggtggaggactgaaaaaaaaccatttccaagataaaaaaaaaattctggattgccccctggaagggccc

SEQ ID NO: 53005 - DNA, 290 bp, Triticum aestivum
  Clone ID: PAT_TA_53005
aaaacacaaatggcaaatttattaatgtcattaccagttggtactgtttgttcttgagtaaacccttttactgctaaagtaaatccctgtaaccataaaggtaaacggcagagaaaacagagatcagagagatggcagtgaaagtttagcggcgatagatttatcttattttggttcaatgttgaacaacatctgatatctgtttgttcttgagtaaacccttttactgctaaagtaaatccctgtaaccataaaggtaaacggcagaaaaaacagatcggacgcgtggg

SEQ ID NO: 53006 - DNA, 569 bp, Triticum aestivum
  Clone ID: PAT_TA_53006
aaaaaaaccgcgaggaacgcctttattttaatagaccgagtacagatttgaacatactaacatactaataacacgataacagaaaaaacaagtagcaggttgtgacacactgccaatcagttttccgccactaaaatatcactgaatgtgaagttgcaacctaaaaaacatggcctcatgtcacaatgcgttccctgggatcagagttcgatctttggttcccatcaccatcaccaagcccaatgaagaaagtctcatcaccaccagttgcgaaatcggcagcagatggttcatgatttgcgtacagttcagattgtgtattttgcaatcttaagatacgcatcatgacgtcagctgaaagtgtcatttctcctcgggaggcataaaattgcctctcccgcgcgtttgaagctattactttatttgcatattgaggcaattgcatcactttgcttgacgaaagtgtccaaatcttaatggtgctgtctatcccactagtagctaggaagggaaaatgcggatagggttcgatgcaattaacgatatgtttatcgccgcgcatgatcctc

SEQ ID NO: 53007 - DNA, 570 bp, Triticum aestivum
  Clone ID: PAT_TA_53007
gcccgccaaatgttgtcttcaaaatgtacagttttgaacatactcattttgcgaatgctctccccagtttcagagagcatcaaacttcctggtcggttgtaacaatcaatacaatctttacaccctaaaatggccagattaggaaacctaaaaggacaactgcatgccatgcaggatcatatgataaggcgaagaagatacttgcatgtgatatcaagaagggtaggatgcatccaattgtggcgtgaagcacggcgagcctctccacaccctggcgtgcatcttgagcatctccctcgccctttccctcggccgatcgcccgcggcgccggtctgcaccaggaacagcagcctcaccaccaccccgaccgccagcatctcctgcaacactgctggggtcgccgagtgcctcgccaccgcgtgcagggcgcgcaccgcgctctccgtccccgcggcggacactcgtgtcaccgccctcgccataaccgccagacctgccgggtgcgccacaagctccaaacgcccttcagcgcagccacagagatggtccattaccacgatcgcgagctc

SEQ ID NO: 53008 - DNA, 543 bp, Triticum aestivum
  Clone ID: PAT_TA_53008
cagacgcagccgccaatttattctggaaaaaccagacgaaagtctcacagctgtctgaacacgtccacaacatattcagaaaattcagatcatacaaactagatgaaagaacacatatcagttacacagtacagaaccaactagctgattactcctagctcaatgacatcaaaaacactcagacagaattaaacaagttattgctgattatttatcgagaaatgcctacaggtgaaagacaattatctcagccgtagttctgctgctttgtgacagttgttccggcggtgtccttcaactccacagttcttgcatctagccggcttacgaggctgttttggtatgtcaccgccttcaggacatgttgtccgcttgtggccttgctgcctgcatatgacacaaaaccctgttcttttacttaaaccttcatatggagctttctccctactggttgtccgtctgcccacttgtttacgcttagctggtgctaataagtttgaaagcctaatcacatactcatttgctgaattgctgtcagcgttg

SEQ ID NO: 53009 - DNA, 533 bp, Triticum aestivum
  Clone ID: PAT_TA_53009
cgctaaattatacggtcatcccataaaatggaaatatttttacaggagctattgggctctaacgctgtatccaatgcaacatcgccatgctagttgctacttgcttactagacatttagctttcctttctttgagaaatagacatttagtcctgaaccggagtatcatgacgtgagttgtccgcggcgcgcctaaaacgaatgtgcaccggtcgcgggcgtctctcgcgaagcacagggcgaggaagtgcttcgcctccgcggacagccacgccggcacctccggcacggcgtccgtgtagccgatccggtgcatcgccgcgaggacgtcgtccatgtcgctccacggggcgcggccggtggccatctcgacgacggtgcagcccagcgcccagacgtcggccgcggggccctgctcctcgccccgtgccacctccggcgccatgaacgccggcgtgcccccgatgggccgatcggaagaacccaccgccctcgcaacacgaagtccgcgatcttcgctcggccgtcggcgcc

SEQ ID NO: 53010 - DNA, 547 bp, Triticum aestivum
  Clone ID: PAT_TA_53010
gtgaccaaatttctttcttcccagtgcctacctgatagtaccgcgcggcctgataaacccgaatttcctcccatcccatgatgatgttgttttgcttgctctaacttaactatatatacaccacacgcacgcaaaagacctgaatgtgtcaattaattacattattgatcgatcgataaacctagcgaccagccgaggagccactagaggcgtagtggcctgaatcgaatcacgccgctctcaccttctcgccgagcgtctgctggacgagccacagcaccgggttccccagcgccgggatcaggctcatcgccaccagcgggaccgcggcgcacgcaaacacccacggccagaggttgctgttcgccgcggcgtgcttcgtgggcatcgggggcctgaacttctccagcccctcgtgcaagtccgggtggtcgcggaacagcagctgcagtgtttggtaggcctccagctgggacagctccgtcctgccgaagatgtcgaacagcgacaggtacagcatgtagttgcgagccttcactttcttgac

SEQ ID NO: 53011 - DNA, 301 bp, Triticum aestivum
  unsure (1)..(301): unsure at all n locations
  Clone ID: PAT_TA_53011
aagagaagagcccaccaagnccccaaagaagagggcgccgccaggagnagcacggagcagagccaagccaggggngcnnagagccaaggcgcagggcacaagaagagaaccggaaggnaaggccgggcaggcagaagaggccggaagaaacggcgagcaagcacgacaacgcagcggggaaagcagagacaacgccgaaagaggcaancagnccaacccaggacggcgaaaaaaaaaaaagaaaaaaaaaaaaaaaaaaaaaaaaaaaaaaaaaaggggggcccggcgaaaagcacccaag

SEQ ID NO: 53012 - DNA, 401 bp, Triticum aestivum
  unsure (1)..(401): unsure at all n locations
  Clone ID: PAT_TA_53012
cacaacagaagcaccaggaaaggcacaaagagaaccagggaaacacaagcccaacacagcagaaggcggaagcnagacccccaaacnccaaggcggaggccccaacggagaagaaaccacagcacaggggganaaacagacagacncagggacacggcgaaccggacacaggggaacagggaaacaggagcnccagggccaaaaccagaagccaagagaccgacccacaacacaggagacacagggccaggggcggggccaacgcaccggacacgaagaaagcaggacgagggagacaaagagaggcagggacacggccaaccccacagcggggaacgccgaagcggagaacnccaaggcccagggaaggagacaacggaacgacccacaggccacaagac

SEQ ID NO: 53013 - DNA, 527 bp, Triticum aestivum
  unsure (1)..(527): unsure at all n locations
  Clone ID: PAT_TA_53013
gagaaacatggaggggatggaagatgagtccaagaagaagaagaggaggagcaagaagcgcgcaaggctcaagtcattcctccacttccccaaggccctcaagaagctccatggccatggccgtccgagcgccaaccacaacccatccccttccccctccgccgccgccgccgctggctcgttgctctccgcgtgcatgcacccccggaccaactccttctccggcgtccgccaacgccacgtcgccgcccgtaaccgcgacgacgacgacgacgatgaagacggcgctcttgccgtcaacttccggtctctcagagtcggcccgaccgccgttcgtgacgacgacgacgacggcgacgatgaggacggctcgtcgacgcaggaggatgacggtggctctgagagcgaggggggcggcgtcttggccgggatggctgccatgaaggtggtctccggcggnggctgcggcgtggccgtggtgacgctctccgtcgcgccgtacgaaggacttccgcggtccatgcggg

SEQ ID NO: 53014 - DNA, 592 bp, Triticum aestivum
  Clone ID: PAT_TA_53014
tgagtgacaagcttgctaaattcattgtgaacaacccgccagaactgaagaagggaggcaaggacaagaaagccatgcgaagagctgagaaggagcggctcaaggaaggtcaggctgctgatgaggagatgaagaaactcaagaaggatgggaagaagaaaggtgcttcatccaaggacagcactgcaaaaggtgttgctgcaaagaaaaatgctactgctggtggttctgatgaagaacatgcaacctcgtcaacttacagtcaagctgtggactttccagctgctgcagatgacgactatgacgacgacgatgatgacggtgtggagtggcagactgacacgtcagcagaggctgcgagaaagcgcatggaggagcagctgaatgcggcgactgccgagatggtcatgcttgccaccgaagagacagaaaagaagaagcaacatgccaaaatgtctccatatgatgaactggtcgaggagatcaaggccaacgtgggcaatgctgccactccagctcagatcaaggctgtgctgtcctcctcgaccctccccgccaaggacgtgacggacgccctctttgaggcgctctt

SEQ ID NO: 53015 - DNA, 506 bp, Triticum aestivum
  Clone ID: PAT_TA_53015
cgggcgcgtggtgcgcagctacacagaggagacatgactccatccgtatcatgtatcaagcacacacaaggagctatagggtagacgagcgatggttgtgcagggtccatgctgtgtaatgatggacgctgagcagggctcttgtacgcaacatgatgacaagtaccttgcgtgcctacatgcacaggcactgtcacaggaactgcaccacgctggctaacgaagcgtttctgctagggcgtgggaagacttcgccattgcgatgaatcaaatacctgacgacggtacattaaaggatcaagcttcactgtggaggaagaaaaatcgaatcatagcagctggcccagctattattgaacagattgctcgtgattgcaggactgataacccaatggtcaaggctcgagactcctaccacatgtgccacctaaataagaactcctgtcctaacgagcgtgcaggagccataaaccctgttcagcatccgcacgaaggaggtaaccacc

SEQ ID NO: 53016 - DNA, 347 bp, Triticum aestivum
  Clone ID: PAT_TA_53016
ggggggggaaaacaaaatttggtaaaaagaaacgggaaacaagggggggaagcccaaacaacgatttggtaaaccccttcaagggaacaaaaaaaaatcccgaccccccacaaaaagggggggttcgcataatcatttataaaaggcccatcagcaacttcaaagggaaaaaaggagctggggcctttaaagttacttcccttggaaggggaagaggacccctccattccaggaagggggggggaagcaaccggggttgtcctcgacctcgaacacctttttgggcttggggggggcccccggggggggggtcttgccccccccggccgcgggggggggcccggggg

SEQ ID NO: 53017 - DNA, 494 bp, Triticum aestivum
  unsure (1)..(494): unsure at all n locations
  Clone ID: PAT_TA_53017
tttttnnttttttttttatttttttattttttnttttttnttcttttttttnttttttttttttttttttttttttttttttttttttttttttttttttttttttgggggaggactttattttcaacaaacctctaaaaaggcccaaaaggggtccaaaaaacccagaacccaaccccctaagaggggttctaaaaaattaaaaacggaaaaaaaaacccttgaaagtttttaaagcaaaaaaaaaaaaaatttaaaccaaaaggcgggaaaattaaaaaaaaaatttttaaaagcccgggttggggaatttaaccaaaaaaaaaaaaatttttactgaaaaaaaaaaatgcttgtaaattttacaaaaaaaagggaaggaaaccaaaccgaaagggggggaagtcttaaaactttgggaggacccaccaaaaaatttgaccggcggaaaaaaacaagtttgttttcccaaaaatgaacgggaccccccctga

SEQ ID NO: 53018 - DNA, 509 bp, Triticum aestivum
  Clone ID: PAT_TA_53018
cacatgataacgaagccatatttctcaagaagtgacatcgtaaacatacatcatgatatatcctagcttctgcagtagagcatcattgttgtgttcagactcttcgttcgacaatacatcagccaagaaaaaaaagaccgtatacgctcatgtaattaatcttttacagtacgtatgcatgtactcgacatggcaggtggcgcggtgatcctccagctccatcagcaccccacgcgttcgcgcgcctacgcacgtacacagagaccggcccgtgtcatttccagatcttgagcgactccttccaggccccgtgcttcatgcagtgcgcgtagatcttgtccagccggacgatcatctccgagaacgtcggccgcgccatcgggtgcgtgtcccagcactcctcgatcagccctttgaagtctgaagggtaccccttgagcttgttcttcagcgacggccgcatcccctcgcatcgggctatgacggttgtggattccatgttgggtagt

SEQ ID NO: 53019 - DNA, 487 bp, Triticum aestivum
  Clone ID: PAT_TA_53019
aatagaaacgatgtgatgattgcattcataattcaccaggcacagagcaatgcaagcatgaatcaaacctcagaacccacatgttcgcatacatccgagatgttcatagctacactcgtactgacaatctcacagctccaagtttaaattaatcaccatcagtcaaaactgcagacgtgcttaaaataggctcaaagcccctagaaccatgatagccgacttggatgacgggggcgaagaaatgaaagggatggggtgctccaggtgatcatctcttagcatgcaacatcccctccattctccacagcaggctcgtggtgagaagccgaagccggagccgaagaagagggagggggagctaagggttcggggaactccagtgggatgtctttgctgaacaggctgaggtggttgtcgaaggccgggacggggccgacgctggcctcatactcggcgatggtggcggcggcgaaatcggcgatttggc

SEQ ID NO: 53020 - DNA, 389 bp, Triticum aestivum
  Clone ID: PAT_TA_53020
aaacattaattaacctttacaactcaagtgtttaacgttttgaaacttcaaaattctgttccaaaaagggggcacgaaaaaccctttgaaaggatacccaaagcaagccggcaggaaaaaaagagggagcgcgtaaacggaataaaaaagcacggccaaaaaaggccccctccggcccggggaacagaacccaaaccaaaaacgggcggaaaaaaataaaaacctggaagggcttaaaagaaacaacagctttatccccccactggacaagggcttcttaccccaagacaaaaacatcctacaggttttaaaaaaccacggggccctccttcagggccccggttctgcactcgccggaaaaaggctttatggcctggagcacccccctc

SEQ ID NO: 53021 - DNA, 396 bp, Triticum aestivum
  Clone ID: PAT_TA_53021
aaacgcaaaatttaattaatcccagccccagaaaggggaaaccaaaaagtatttaaaaggaaaaaggggttaagggaccaaaaacgacccccctaaggggggggtagttaaagggggacactctaagggggggggtaagttagcaaaatgcccaaggggccggccggccccaaaaaggggggaaggggaaggccaaagaaggggagggggccccccgcgggggggctgggaattaaccgcccgaagggggggccctgggggaacgggaaaaaccaccccgggggcccccgaggggggccgaaaaactccccgttgggttgggccccgaaaaggatcgccgaccccaaaaccgcaagttgaaaccctgggaaccccgggcggcccccgccgggggcc

SEQ ID NO: 53022 - DNA, 721 bp, Triticum aestivum
  unsure (1)..(721): unsure at all n locations
  Clone ID: PAT_TA_53022
gcatttaactgttgttccagcaagctggcctgcttcggatgtacttaatttgaagcctgatggtgttctttttagtaatggccctggtgacccagctgcagttccatatgccgtgaaaacagtacaagaaatagtagggaaggttccagtatttggtatctgcatgggccatcaattgatcgggcaggctcttggtggaaagacgtttaaaatgaaatttggtcatcacggaggaaaccatccagttcgtgacaacaggaccggacgtgtagacatcagtgcacagaaccataactatgctgtggaccctaaatcgctcccggaaggagtacaagtaacacacatcaacctaaatgaccagagctgtgctggtcttgtgttccccaagatgaagcttatgtctctccagtaccatccggagtcctccccagggccccatgactcagacttggcgtttggtgaatttgtggagctgatgaagaacaacagattgtgagtggaagaaaggttgggaagcttggtgagcatcatgagttgcgaaacttgtactcggttgggtttgttgttggaccgacgcagcgagctccgaggagttngtattntttcttgttgatttatcttatcagctgaccaaacctataaagtaactagtgtattgtactattttgttggagtttaaaaataaaatcctttgaaaaaaaaaaaaanaaaaaagggcggc

SEQ ID NO: 53023 - DNA, 768 bp, Triticum aestivum
  unsure (1)..(768): unsure at all n locations
  Clone ID: PAT_TA_53023
gaaatcttgttaggtatcctgggtattgaatggcgacctccctcagtaaattttgctgttgggcccacttacgatgcaaccactggcgagtaccaaatcatcccagttactgatccagataggtgggaaccacttccagagataacagacttcatcgagcttgaaccagaaaatgaagcgatctctgatgatactgattccgagtacaatggcatggatgactattctagtgaaggagaacaggggatttggggtggtcatgcttctggtgcttcatactcaagtgcagagattgatggatctaatcttaacagtactgctaatctccgcagatctagaagaaagaagaaaagatgtgatgctgatcttgttacttcatctgatcggcgagttaagaaaagaaatttggatgggcacggtgtggctacaccgtcaaggccacatagaggcaggaagtctaagactggccgtgctaccaaaaggaaaatatctcctaaatctaggagattgtgacctcaaagacgtgctactcacagcacacacagttttttcttgaagattgaaacttcaacagaagaggaagatggatcagcgagcagtctttcagacaacgaactcaacacagaaagcactgaagctgagcagtcagcgtggcatggcctgccaagatttggtagagaaaccaccaatatgatntcgaagatgttacccgaccttctcagttcacttgaaccaagggaaaacattctgccaataagtagaaactga

SEQ ID NO: 53024 - DNA, 566 bp, Triticum aestivum
  Clone ID: PAT_TA_53024
cggattcgtgggcggacgcgtgggcggacgcgtgggcggacgcgtgggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcggttttaaaggttcaaattttacttccccttgcttgcaacgtattattttttttttggggcccctaaaattaatttaattggccgggttttaaaaactttgtgattggaaaaaccttgggtttcccaaatttaatcgctttgaaaaaaatccctttttcccaagttggcttattaccaaaaaggcccgcaccattcccctttccaaaaatttgcccaccttaattggcaaatggaaccccccttttagcggccttttaagcgggggggttgtggggtttacccccaggttaacctttaaatttgcaagcgccttaaccccccttcttttggtttttttcctttcttttttggccagtttggcgggttttcc

SEQ ID NO: 53025 - DNA, 559 bp, Triticum aestivum
  Clone ID: PAT_TA_53025
gaccattttagagcagtggaacctccctgaatcgcgtcaatcgagtagcggcggccagcgatgtcggcggctgagggaaggaagacggcgtgcgtcaccggagggagcggctacatcgcctcagctctcatcaagctgctgctccagaaaggctacgctgtcaagacgactgtcagagaccccggtgacatggagaagaactcccacctcaaggacttgcaagcgcttggccccttggacatcatccgtgccgatctgagtgaagaaggcagcttcgaccaagctgtttcctgctgtgactacgtcttcctcgtcgccgctccgttgaatctgatgtcagccgaccccgagagagatctggtcgaagccaccgttcaaggaacgctcaacgccatgaggtcctgcgcgagggcagggacggtgaagcgcgtgatcctgacgtcgtccagcgccggagtgtccaggaggccgctgcagggcgacggccatgtgctggatgagagctcctggtccgacgtcgagtacctcagggccagcaagccatcaaccctggggtact

SEQ ID NO: 53026 - DNA, 713 bp, Triticum aestivum
  unsure (1)..(713): unsure at all n locations
  Clone ID: PAT_TA_53026
gcaagcttttacctactagtacagcctggcccccaccgtgatggcctcgtcggcacacctccggcgctcctttccaggggctcaagtccaccgccgggctccccgtcagccgccgctccaacggcgctagcctctgtagcgtcagcaacggtggaaggatcaagtgcatgcaggtgtggcccatcgagggcattaagaagttcgagaccctgtcctacctgccaccggtcagcacggaggccctcctcaagcaggtcgactacctgatccgctccaagtgggtgccttgcctcgagttcagcaaggttgggtttatcttccgtgagcacaacgcatcccctgggtactactatggccggtactggacaatgaggaagctgcctatgttcgggtgcaccgacgccacgcacgtgatcaacgaggaggaggaggtcaagaaggagtaccctgacgcgtatgtccgcatcatcggattcgacaacatgcgccaggtgcagcgcgtcagctttatcgacttcaagccaccggtctgcgaggagtccggcaaggcctaaacagctcactcaccacgggccacatataaagtgccattgcggatctgacaactctgacattgctttgngttgtccttgtccatgtatctttcttgagtgatcctaagatacgactatgtgtatgtccatgctcccgacatgactcgagaaagcatgctc

SEQ ID NO: 53027 - DNA, 732 bp, Triticum aestivum
  unsure (1)..(732): unsure at all n locations
  Clone ID: PAT_TA_53027
ggaggaggaggagcaccgtggcggtggtgggggcacggaggcggtggctgggaagaagcggcagtacttcaacctctacttcttcaccatggggttcgccgtgctgctggcgctgacggtggtggtgtacatccaggagaacgtggggtggggttgggggttcgggatcccggccatcggcatgctcgtctccatcgtcgtgttcgtggtcggctacccgctctacgtccggctcaagccggggggcagcccgttcacgcggctggcgcaggtcgtcgccgcggcgtacaagaaacggcgcgccccgctgccggaggacccccgcatgctgtaccaggacaaggagctggacgcgctcatctccaccaacggcaggctcctgcacaccaaccagctcacgttcttcgaccgggcggcgatcgtgacgccgggggacatggccggctccggcaagctggacctgtggcggctgtcgacggtgcaccgcgtggaggagctcaagtccatcgtccgcatgctgcccatctggtcggccggcatcctgctcgtcaccgccggctcgcacaacaacagcttcaccatccagcaggcgcgcaccatggaccgccacgtcacccagcacttncagatcccgccggccaccatgtccatcttcaccaccaccgccatgctcgtcaccctgggcctctacgaccgcgccttcgtgcccctggcgcgccgcttcacgggcct

SEQ ID NO: 53028 - DNA, 374 bp, Triticum aestivum
  Clone ID: PAT_TA_53028
gctgctgctccctctcccacgaacctgctgctgctcttctctccttgctgctcctagttcttctctgaactgctgctgcttctctcctctcttacttcttgcaaatttctgaaaaccgcgaggtgaaccttgtgtaatattcagatttgtgccttgagatgcttatgtaatattcagatttgaagtgtacttgcaatctgctgtttgctctgtttaagtacttgtataatatagtgtatgtgttttgagatctgactagttgaggctttgttactttgagagatccttgatctatcatattttggttttgtcaattggtattctgctagtatgtgtgtgtgtgtgtaattcatcaaaaatattgttgtgtgctg

SEQ ID NO: 53029 - DNA, 618 bp, Triticum aestivum
  Clone ID: PAT_TA_53029
ggaggttcgtcgtggccgcgtacgatagcgcgacgagcaacggccgtccgcgttaaggggatcctcatcaccaacccgtccaacccgctgggcaccgacggccgcactcggcgcgagcgctgggccagtgctccgcgcacgctgtcgcgcactggagtcgcccgctgtgctgcctgcagtctgcgcacgatgatctactgcggggtgcggggcgtggcccagcccgcgtgcctgagcctcgccgaggtgatcgagcgcgacgccccctgcgccgaccgggacctgatccacattgcctacatcctgtacatggatttcgggctcccggcgttccgcgtcggctttgtcttctcgtgcatcgacgccgttgtggcctgcgcgcgcctgatgtccagcttccgtctcgtcttctcgcagacgcatctcttcctggccaagatgctcggtgacgaggagtttatggctgcttttctgctcgagagcgcgcgccggctggctgcccggctcgagctgttcacgttggggctcctggaggtctgcatcgggtgcctgggcggcatcgccgggctcttcttgtggaatgacctgcggggcatgctctcggtcgaagacggcggt

SEQ ID NO: 53030 - DNA, 595 bp, Triticum aestivum
  Clone ID: PAT_TA_53030
gtaagctctatacatacatagctcagccagggcccccaccgtgatgtcctagagctccacctccgcggctgctttctaggggctcaagtccaccggcagccttcctgttaggcggcgcttcaactgcgctagcctgagcagcgtcagcagcaggcgaaggatcaggagcgtgcaggtgtggaccattagagggcatcaagaaggaagagaccctgggctacttgccaccgttcaaaaacacaggccctggcttaagcagggggagtacctgatccgctccaagtgggtgccttgcctcgagttcagcagggcagggtccatcttgagtgagcacaacacatcctctgcgaactatgatggcaggcactgcacaatgtgcaagctacctatgatggggtgcaccatacaccacacaagtaatcaacaaggtaaatgaggtcaagaatgaactcactgacgcctatatccggatcatacgataccacaacatgcaccaagtgcagcgcgaccagattatggacttcaaccaccgaggtgcgaggagtacggcaaggactgaacagatcactcacgacaggctatatatcaagagcca

SEQ ID NO: 53031 - DNA, 472 bp, Triticum aestivum
  unsure (1)..(472): unsure at all n locations
  Clone ID: PAT_TA_53031
ccaccgcataccggagccacgctggtctgccgccgccctgaatccccccctccttccctccaagcctctaggccataaccagtcgcgccgccgccgcggtcgaggggctagtctgcgccggcgaccaccggagaggaggagggacgttctcgagccgtacgccgacgccggtggccactccgcagccccgctgaaccaaaaatggcggccctgccactggccacggcggaggcgtgcgacgcgaacgcgcgcatgatcaccagcggcgagctccgcgcgctgcagcccgtcttccggatgtacggcgggcggcggctcttcgcgggccccgtggtgacggtcaaggtgttcgaggacaacgtcctggtgcgtggcatcctggaggagaagggcgagggcagggtcctggtggtggacngcggcgggagcctncgncgcgccctcctggggggcaacatcgccatgctggcgc

SEQ ID NO: 53032 - DNA, 605 bp, Triticum aestivum
  Clone ID: PAT_TA_53032
aggtaatcccaatccccacagaaatccccatctcaaaaccctagccctcatccccgatcccggtgagcgagatggccagcccgcgggtgttctgtcgacatgaccgacggtggcgcgccggccgggcgcatcgagatggagctgtacaaggacgcggtgccgctgactgtggaaaacttccgcgcgctgtgcacctacgagaagggcgtgggtaatagcggcaagccgctgcactacaagggcaacgtcttgcatctggtgatccccgactttatgtgccagggcggcgaattcaccacgagcaacgtcaccggctgcgagttcatctaccgcgagaagttcgcctactagaagttggtccacaagcacaccaagcccgggatcctttacatggtcaacgcggggcccaacaccaacggattctagatcttcatctgaaccgaaccctgcaattagatcgacggcaaacacatggtcttctgcgaggtcccctagggcatggacttcttcaagatcatcgagaatgtgggctcccgcagatggacctgctgcaagcacgtggtcatcgccgactgcggacagctctatatccgaccgggcgcggg

SEQ ID NO: 53033 - DNA, 785 bp, Triticum aestivum
  Clone ID: PAT_TA_53033
aactgctctggtaccaaacaaagaaagaccccctacgtacaaaggccttcaattcgtgaattcatgtggtttcgcgggatggtcagtgttaaggaagaggttgatgaagctgtaactgcaagatttaaaagtcgttatggagattcagctttcctcagggcaggaggtgggcaatacataaatcttctcgatgatacgttcaagaaggatatcttgaggaaaccattgggaggttttggattagaaatggatcgaagtgcctactcacttgcttcagaatcaagcaaacttcttgcttcaaaaatgaatcgaagtgttgtctcacttgcttcattcaatggatttgcaaaaaagttttcttgctcaggtgtatttataaagggcgaagcgtgctctgcaacaattctgacttcagcaagtttgttcagagttcctggcagttcacacatgatcgatgataacttgaggattgaagtttgccttccaaaccaatatcgagttgtagggatattgaactgttataatttacagtacaatgttgctcttgttgacatcatgggattctggcgtcctcgtacaataaaaatccatgggcatccagttacctcatctatggacgtaatagctgtgggtagtctttttgcgtgtcgcaaactaatggctgttgaggggaaggtgttgattggcaaacatagcatacttgattgcaaagaactttgtgtctccacctgtaaaatcaccaaggctgggattggggggcctctttttgacatgatgggaatttt

SEQ ID NO: 53034 - DNA, 781 bp, Triticum aestivum
  unsure (1)..(781): unsure at all n locations
  Clone ID: PAT_TA_53034
cccacgcgtccgtgccagcagtagcacccaccagccaccacccaagcaaacggagagaggccacgctgccgccccctccctcatcctccttccacttgcagcagagcagggcaggcattgcctccgctctcactccagtcctcccccctgccctcccctcggccccgccgctcgagggagatagcgtaggaggctcctacccgcttaatttgctcgccgaggcaggtggatgagctaggctgagaaagagccgctgtggcaggcgacgaaaagggggaaaacccaccgaccatggcagggcgaggaatgctgccgcgccggcgcgagtgagcgatctcgcagatctgcgcccggccgcattttcgctcctccgcaccaaggagatcgggtgattcgtcgggggggagggagaaaccggggccgcagcgatggcgaacgtgggggacctggccaacatcgcgcagctcacggggctggacgcggtgcgcctcatcggcctcatcgtcaaggcggcggccacggcgcggatgcacaagagcaactgccgccgcttcgcgcagcacctcaagctcatcggcggcctgctggagcagctccgggtgtcggagctcaagaagtacccggagacgcgggagccgctggagcagctcgaggacgcgctccgccggggctacctgctcgtcaactcctgccaggaccgctcctacctctacctnctcgccatgggctggaacatcgtctaccgctttcgcaccgcgcagaccgagatcgacaactacct

SEQ ID NO: 53035 - DNA, 778 bp, Triticum aestivum
  unsure (1)..(778): unsure at all n locations
  Clone ID: PAT_TA_53035
acggggcgaccgtggaaccagacgtgatgaccgtgatggctatagtaaaccaccagtgaatactaagcccaccaagacactgtttgtcataaactttgacccgatcaacacaagagtcagtgatcttgaaaggcattttggtcattttgggaggatttcaaatgtccggataaggaagaactttgcttttgtgcaatttgaaacacaggaagaagccacaaaagccctagatgctactcatttgacgaagttactggacagagtgatttctgttgagtatgccttcagggatgatagtgaaccaggtgacaagtatgacaggccaagtagaggtggtggctatggaaggcaggatgacagttcatatcgccgttctgttagcccaatgtaccgaaggtcacgacctagtcctgactatggtcgtccagtgagtcttcagtatggtgcatatggcaggagcaggagtcctgttcgtgatcgctatcgaagccgatctcctgtccagcgctcaagatccccagctcccaacagaagaggttatgactgatggacagttatctcggtttatggtagcgaggcggtttccgcatgccgttctagctctagcattagtaaacaagaacccttctgtacccgtaccgaagcttgtcgtctagctgacaccgtgttataagaaagtggacctgtcctttgacaactgctntgtcgtctgtgtgttataagaagttagacctgcactttgacacctgctttgtgcctaaatcgtgacatttttcgt

SEQ ID NO: 53036 - DNA, 714 bp, Triticum aestivum
  unsure (1)..(714): unsure at all n locations
  Clone ID: PAT_TA_53036
tggaagcgcaggggatctccccaaacatagtgaccttcaacactctgatgtccgtctatgtcgagcaagggaagatccaggaggtcttcagggtgtacgacgacatcgagggccgcgggctggtgccgactgccgcgacttactcgacggtcatgtcggcatacaagagcgccggggacgggttcgccgcgctcaagttcttcgtcaagctcagggagaggtacaaggacggcgagctcgtggggaaccccgcggactggaagcaagactttgtcaagtatgagaagctggccatccgggtatgtcacatggcgatgcggcggtcactcacaggtgcggacaacccagccggtgcggcattgaaggtccttctcgcaatggacgaagcaggggtgaggccggacaggagctactacgagcgcctcgtctgggcctgcacgggggaggaacattacaccattgccaaggagctgtaccagagaatccgcgagcgcgacgacgggggggtgataagcttgtcagtgtgcaaccatctgatctggctcatgggcagggccaagaagtggtgggcggctctggagatctacgaggacctgctggagaaagggccgaagccgaacaatctgtcacacgagctcatcaggtcgcatttcaacgtcctactcagcgctgccaagaggaggggcatctggnagtgggctgtgaggctgctcg

SEQ ID NO: 53037 - DNA, 633 bp, Triticum aestivum
  unsure (1)..(633): unsure at all n locations
  Clone ID: PAT_TA_53037
gttccgggtcgagcggctcaaatgacgctgaccctgaacaaactggaaaaactgagacccagtgatagcaccaaacgcacacggacattgttcagcatacgtgattgttcatggacacgaagaggagctactgcacatagaaagattgtttgtttgttcagatcgaggttacatcctttagttggtaaattgctggtgcagaactgtggtgcagactatgtgatccatgcactgaaagactatttgcacgtcatgtttttcttgccaagttgttacctcaacaatgtgactttggctgctatgttccaatccctgcaaggtaatctgttctttcgttcgataccacgctggcgacctctgttcttaatgtaattgtaagcaggaggatgctttgttgcttcttggttacagctcctatgtttggtgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaannaaaaaannnnaaaaaaaaaaaaaaaaaaaaaaaaaaaaaaaaggggggcccgcttttaaaggaccaaatttaacttccggggggttggaaggaataattttttttttggg

SEQ ID NO: 53038 - DNA, 631 bp, Triticum aestivum
  unsure (1)..(631): unsure at all n locations
  Clone ID: PAT_TA_53038
gcgggccgctgatggtaggctggctccttcgctcgcgggccttaggccagtncatggggacagaggctaactaggctgaggcaatgctctctctcgccacgggtcttccggagtgacgcatgctgggaactcgagacacgatcttgcgaagtgccagtacaaggccgtgcgtacagcgatcgggcttcgcggncggtccgtgggacagctcacgatcgtagcgatcgtctgtgccaagtgccaagctccactcagtcgagcctagcacgtctcaaatccacatatgccgagcatgtctaaggatatattacatggatgaaagcctgtaccaactgtcaaaagccaagggatactctgacatgatcactacggacactgccattatcttgaagatcttctacggattgaaacaaaaggcccaaattctaattatagcttcatggtggattatcaagaatccagcataactattgccaatagactattcttgttttaggcgcactggaagtatatcatcatcttgtccttacatttcttgtactaaaccatgaaactctctttatcacacgagattgtaaatggtacaaagattaactgcgggagaacatgattatggataagttgaagaatg

SEQ ID NO: 53039 - DNA, 750 bp, Triticum aestivum
  Clone ID: PAT_TA_53039
ctcttctcgctctcgctgcgcctcggcgactgcatcggcggcggcggcggcgatggcgcaccggctgctgcgggacgcgcaggccgacggctgggagcggtccgacttccccatcatctgcgagtcatgcctcggcgacaacccctacgtccgcatgctgagagctgaatatgacaaggaatgcaagatctgtgcgcgtccttttaccgtcttccgttggagacctggtcgggatgcaaggtacaagaagacagagatctgccagacgtgctgcaagttgaaaaacgtctgccaggtctgccttctggaccttgaatatggtctgccagttcaggttcgcgatactgcactcgcgatcaattcgaatgatgcaattccaaggagtgatgttaaccgtgagtactttgcagaagagcatgatcgtaaggctgcagctggcatagattatgactcttcatatgggaaggcccgtccaaatgataccattctgaagcttcagaggacttcaccatattacaagaggaaccgagctcatgtttgcagtttctatgtgcggggtgaatgtacaagaggtgctgagtgcccatatcgccacgagatgcctgagacaggggagttatcccagcagaacatcaaagatcgctactatgggagttaatgacccagtggctctcaagcttttgggtaaggcaggtgagatgccatctctgcagccaccagatgatgagactataaggaccctctacattg

SEQ ID NO: 53040 - DNA, 367 bp, Triticum aestivum
  Clone ID: PAT_TA_53040
aagataaagctgtacaatggttaacgatcttgctccgtgttggcaggaaaaacttggaggaaacaaccaagatttgaacaaataaatgcattggccgtcaaccacacaactacacaagcttgtttcaaagtatagtgtggttttcggagggagcttttaaggcatcaaaacggaaaaaaactttcagcttgttcaaatcctaggtgaactgctcaagaactagagatatttattcagtaacaaaaccaacaaggcccctctttcatgcttaatttacacttgaaccgggaaaccaaaattctgaaacactctgatttctcctccctgtcccgccgggacgatcaccagaccccacgcggaccggggc

SEQ ID NO: 53041 - DNA, 367 bp, Triticum aestivum
  unsure (1)..(367): unsure at all n locations
  Clone ID: PAT_TA_53041
ggggcgaacctggtttggttatattcacttcaggtcatatgggccatttaaaaaacacacacatagactccgggcccacgaaggcaaaattttacaaggcacaaagaccccaataggaaaccacaccacaggaccaaccaaacggggggggggggtttcatttttcggactcgatcacacccgggacaatcaccaaaagcgcataaaccggttggaccttaacagttgcaaggggcgcacttggagttggggccccaattacaggcgggggggggcctaccggactggggggccttcttgaattggacctttncaggccccacccccgggacaacggggggggcctgcacgggggggcccctttttt

SEQ ID NO: 53042 - DNA, 536 bp, Triticum aestivum
  Clone ID: PAT_TA_53042
aacataacgaatgagcagtctccttaattatatacgtcatatagggtaaacaaactgatcaagttaacatgaatggcatacgtacgagactattccgtgtatatttattagcggaaacgtctattatacatacatatgcacgtcttcaccggccacgcatacaatggagtggtgcgcatgcacaggacaagggagtagcaggccgcccggccggccggctggccgtgcctagtgtcaggaggcgacgctgttgttggcgttctgcagagactgtagctgcgccttgccgctgaggccgcgctgccggatgtgggcccggtactcgtcgaaggtcatctccgggtacagcgccgggcgtcccggcgccaccagctccgccatgggcgccacgggcacgtcgctccgcgggttgtagaagaaggcgagcgatagccgctcctccgctgcgctcaccgtgacccggtgctccacgctcttgtacgccgcgttgctcagcacctggatctggtctccgacgttgacgatgaaggcgtcag

SEQ ID NO: 53043 - DNA, 439 bp, Triticum aestivum
  Clone ID: PAT_TA_53043
ggggtcaaaaccgcaaaccctggcataatgacatgggaatctgcccccaacacaccaattaaaaaccggctttccgcccggtgggggaccaactttttcgggggggggggcaaaaattggctttcacggggcccactcatagccggtacagcagctttgggccaaaaagggggcttaaccaccctcccggggggtttactagaccccttccctcaataagaacaaacaataagagggcggggggctcaactaaaattcgagggcccccgttagtaccacacaagctcggatagcagcaggaagcaaatccacgggagcagaggcccccaaagggatcttggtccccgggagattctcttgagggtcaccatctcctggctctgaacatgaacatattcaacatggaaaagggatctgcatccccttataaatgctggtt

SEQ ID NO: 53044 - DNA, 261 bp, Triticum aestivum
  unsure (1)..(261): unsure at all n locations
  Clone ID: PAT_TA_53044
agggggacggcaacaacaggaagcnagaacaagggggcacgaggcnnggcgagcaagaaacgggggaaaccgagggggcccaggcagggggcacaacggccaaaaagggaggggggggggggnagaacanannacagggcagccagggggancgggaggcgcaggggaggggnagggcaggggagggggaaccggccacangggcaagcgngggncgcaggacacaacnacgagggagccacagaggggaacaggggggag

SEQ ID NO: 53045 - DNA, 443 bp, Triticum aestivum
  Clone ID: PAT_TA_53045
aatgaggggcttgtcttttacaagatcatccaacccacacccggccaaggctccaccaaatttccaaaacattgcccgggggggggccggcgagccaggccccccccccggaacctttggcttgcaggacaaccccaccaagtttggccctttgccccaggaaactttcttcggagcgcccggaaaattgcatcttttaaaaaggcccgaaaaacaaaggcagggggcacccggggggtccaaaccctttcaaaaggggggtggccctctcccttcgcggggcaaaaaaatcttggcccaaaacacccccaaaaaaaatggtttcacccacttcccccccccttttaaaagccgggtaaggaaggctttggcccgaaccccctattttaaaaaagtgcacccccaccccctctaaaattcaaaaaaacaaacaagggggggga

SEQ ID NO: 53046 - DNA, 466 bp, Triticum aestivum
  unsure (1)..(466): unsure at all n locations
  Clone ID: PAT_TA_53046
ggggggcggcaggngcagcgagaccaaagcgaagatggggcacacctgcacggacaccggggggcaagaaatgcgcgagtcaaccccacaccgacatcagggcctccaaacgacacgtggcgaaaaacgcggccagagcggtggtcgtcggaggaagaatgaggggggcggttgcccgccaaccataagcgaggcatggctggggaactgccatgctcaacccctactgcgtttggacactcggtgcaaacggcacgcgggcaaaggaaagacccctgtccggctgggccaggtaatgggccactctaccgaacccgcatggagggctgaccaccggcaccgggccaagggcggacggggcaccatgcccgacgggggaagcattggcatgcacgctctaacactctggcgcgaggataactgattgcacacaagatactgcggggggggacagggccagcacctg

SEQ ID NO: 53047 - DNA, 342 bp, Triticum aestivum
  Clone ID: PAT_TA_53047
cactggcgacagccttaccctgcatgtttgtcacgggcccagacggtgaatccgacatgaattttcaagagcactcataacatttaatgggtggctcgaaccttatcaggaacatgctgtgatcgacagcactaagcacagggtgaggtcaaccccaaccaactagcctttttctgtaggctaccaagtaagggctaagggaccaagtactgcatcttcgccgttgcacaccctgaactccggcaagaggcggcggataatcctggagcctgttttgggagcttaaaagggcctccacgattaaagggggcggccagcttctcaccccttgaagcatccggc

SEQ ID NO: 53048 - DNA, 198 bp, Triticum aestivum
  Clone ID: PAT_TA_53048
ggggggcgcggggggggacccgggaacgccggaccggtccctggggggggaccagcttcccctagggggagtcgtggaaaaagggggcgtctgcgggggcatagctgtcgcgggggggaggaggttacccgcgcgcagggccacaaaagaggcaagccggaggcgtaaaggggaaagccgggggcggctaagggggga

SEQ ID NO: 53049 - DNA, 254 bp, Triticum aestivum
  unsure (1)..(254): unsure at all n locations
  Clone ID: PAT_TA_53049
ccacttccacccttgattattatctattgttacacacacattcatggnaagcagagcacaaagcaaggaaaccaagattttcacgacattttctcacgcacacgaccagttttttttggggggggtcntnntccttgaggagcggnggttctacctcgaccctgaaaacaccnnccccnnccttnggcacctttgcgacctccacctgggggacgaccaccttcttttccaccttttgcttcttcccccctttc

SEQ ID NO: 53050 - DNA, 570 bp, Triticum aestivum
  unsure (1)..(570): unsure at all n locations
  Clone ID: PAT_TA_53050
gggacaaaagcganacanaggcnaacagcacgccaggggaannnaggggggggggggcgngnancaggangcnnacccgggaaaagaggcgcncgaggagcggcgccncgaagaccccnaagaagccggggaagcgaggaacancgncggcgcccacggaggccanaagcagcggcagcncnnggaggggcggggganccacacnggccggaaagaacaggcgcgcgncgnccaggggcggnaggcccacgggacaaagggggnaanncgngggcgggcggggaccgggncccaggaggccggggnggggcgacccgggagggaccgcgggcgggggcgggggagcccgggggggggcnggggcccgncccgngggcccccgcccggcccgggggccccggcggcggggggcacggggcngcaccccgggccggcccgggccggggcgggcgggggagcccggggggggggggggggggggggcggggggggagggcgggggcggcggggggggggggggggggggggggggggngcggggggggggggggggggggcgggggggggggg

SEQ ID NO: 53051 - DNA, 310 bp, Triticum aestivum
  unsure (1)..(310): unsure at all n locations
  Clone ID: PAT_TA_53051
gcgctagctgtagtggcggtggcgccgggcggcgcgggtggtgccggtgccgctggtgctggccgtggtccccgtggtggccgcggacgcctgcgcggccatggcgagctcgaactgccgcgcggacatttttttttgctgcgcctgtggcggtgggggggcggcggntgatgaggctgagactgaggtggacgccgacgcggtggccggagcggtggtgccaggaggaggggcggcgcggttccaggagcggacgctggaggtggtgctggtgctgccggcccagccggtgtgcgcgacgtgcttggcg

SEQ ID NO: 53052 - DNA, 146 bp, Triticum aestivum
  unsure (1)..(146): unsure at all n locations
  Clone ID: PAT_TA_53052
aaacaacacacaaagatttccttcttgccacttttatgctctgtttcttcttcaccgaatggaagttcggagagaagcttccacgctcggcgatnggggacggtgngccatgnagcctatagccttgggaccgagcctatgccggc

SEQ ID NO: 53053 - DNA, 345 bp, Triticum aestivum
  unsure (1)..(345): unsure at all n locations
  Clone ID: PAT_TA_53053
gtgttctaaggctgcgttttcttaaagctttttgtaagacaacgttgatgaaatggaaccagtgttggctttgttgccaacttgccatcagcgtagccatgctgcccattctctcgtacaaatgtaaaacatcgcgcgcgcctgctttgtgcanccctccccccacngcgaaacgcgcatcagttcccgccgccgcaacncgccnggcangatgacgggacgccgggcgggggtccccnatcctcgtcatcttcatcnaccnctcncttgcccccncctcnncncaccngcccctctttcttnccnacncgtccttgaggatcacgccgaacagctttaccttct

SEQ ID NO: 53054 - DNA, 192 bp, Triticum aestivum
  unsure (1)..(192): unsure at all n locations
  Clone ID: PAT_TA_53054
atangaagattacaattacaaaataagtactaataatgggctaggattacataagcaacacgatttataccatattttattatgaaccaaacaaactgttggtgggggggattcttcattttttttagatgagcagcaattatatccatgggggggcaatgcagnggcatgacatgtcttggcggctcttgg

SEQ ID NO: 53055 - DNA, 469 bp, Triticum aestivum
  unsure (1)..(469): unsure at all n locations
  Clone ID: PAT_TA_53055
aagggggaggaccaaaccancacccccacgacaaggnnagggancggcagggccaaaaccccngggnncnaaaaccccggggcnnggccaggaaanaccggggacggggggggcaaccacccccgaaaggnncaaagaggnagganaggancnaccaacggancgacggccagcggaggagacccagcggncnncagagaccccaccgannggggcnnaagccccnnggcccnnncccncgccggggcgccancncccccnnccagcaaccccgcaagggcgggcgcaancnccccccggnccancnnacccaccaacaagggcccnancncccacacggccnccacggaccccccggncgccagcggggccccgaagaaagggcngcacaacancgggacccccncgcagaaacccnccagcggcgagggccagccacggggcggccggaacccgcccaccgcacggg

SEQ ID NO: 53056 - DNA, 311 bp, Triticum aestivum
  Clone ID: PAT_TA_53056
ttcagataaatgcaggagatctgattacatcaacaaaaaaagggttcggcattttttaagttcttgacaggccccaaccaaagccttaaagttaattaatggtttggcaggtgggcaaaagaaaaaaaaattttaagtcggaggtttttttttttttgccaggaaaaaaaattgccttttttttttttttccaaaatataccccccctttttttggagggggaaaaaacaaaattgagatttttttttttttctcaaaaaatgtttcccgggggggggcaatttttttaagaagaaaaaaatttttttttt

SEQ ID NO: 53057 - DNA, 483 bp, Triticum aestivum
  Clone ID: PAT_TA_53057
acagtacgctccattgagctgctgatagattctattgccacatgattcatccactaaccttatttggattctatcttacaaagtaagaagcactaaggcggctcactactgtcctagtatacatatactatggacattagtgggtgggccacaaagtgcaacagttccgggtctagaatcatgaccacaaatatatttaacccgaaagccctaacttgtatcttcaaatcttaacacgctcggctgaactgcattcggatgcacctggatgcgcctctatttactgttgctgacaccatccgtgcttgagctcaccacagtttcgttgagagttcatacaacatctcaccatcaatgctggtagcggagctccctaagttggaaccagcttacccttcctggtggataccttcaagctttgtatactcatgcgcgtggacttcccgaaagccactcggttcgaagaacttttgtagcaggttc

SEQ ID NO: 53058 - DNA, 396 bp, Triticum aestivum
  unsure (1)..(396): unsure at all n locations
  Clone ID: PAT_TA_53058
gatctaaacgtttttatatttcttttcaaaagagtagaaaagagtttatacaagagttagataaagccacacccaaaattacaagcccaccggggccacacccaaagcttacaatgtcataaggcatcatagctcaaacttttgacgccaaccttcgtccattgcctgcttctacgttgatctggtcgagcaaggccgagtgagggttgtagcgcgtttggtgtacataactatttgtgatttggtcgagccatactgagttgagggttgtagcgcgtttggggcatataattctatgtggggtggtctctttttaaccgttcgaaaaaaagcgctttggtgtctgttttggggggagcttgngggtttttgggtctgttttttgtgttgtggggg

SEQ ID NO: 53059 - DNA, 412 bp, Triticum aestivum
  Clone ID: PAT_TA_53059
gggaaacacgaggcaaaagctttgcccgtttcattaattaaaaaaaagggtgcccagtttattaccaaaaaccgggcgaaaaccggttcagatacaaacagggcaagccccactcgccacatgggcaaaccaacccgaatcgccccaccggaagggcacaccacacttggcaacgatgccccaaccattattggggcacacttacccccttcccacagatgaacccactgttgccagaaaaaaaaagccaccactgctttgagaggggcaaacctgggttgcttccacaaggggaaggggcctgcgattccacaaacgccacacttgagacgttcccgacatttttggggagaacctctgcccccaagccacttgaggggaaccccattgatgttgccgaaatttttggggt

SEQ ID NO: 53060 - DNA, 364 bp, Triticum aestivum
  Clone ID: PAT_TA_53060
ggggtctgtgggtttttttaccaataccaataccaataccaataccaataccatacagggatcgatcatcacaacaaacaaacagacaaacaaacaaactacttctccaaagagtcagatgggaaatgcatagggattcaccgtcatagtttgtcaagggggcgtgaagaagcataaccgcgtacaatcgcttaaaacagcagcttgatgatcccgcctgatatgaactatgcgtgtcaaatgcacaaggtggtgttggtgtgaaaaaaaatggaacacaggcgaaaagggtgtgagggtgtgcatgctgcttgctgcctgggatttcttggttgttggtgctttgggatgattggttgttgtt

SEQ ID NO: 53061 - DNA, 470 bp, Triticum aestivum
  Clone ID: PAT_TA_53061
gggtgggctggtgtttttttttatttttttttttttttgttttttttttttttttttttttttttttttttttttttttttttttttttttttttttttgggcaaaaaaccccaaatagacctttaaaatttttaggaattattccttgtttggggataggggggtttggattccaaaaaaattttacatttattttaccgggctttggaaatttgccccggaaataagctttacgatgaaaaatacatttcaagggcagggggaaaaattcaacaaaaacaagaagactctcttcacatttggaaaaatgattggctgaattagcgggggttttgaaggggattgcccggataaacaccacgtggtaaatggccgccagggccgcgccgttaaacgggccaaaccaaaaaatccagggggcggcccaagcctgttttttgttgtaaaagaatggggggcccaaggacct

SEQ ID NO: 53062 - DNA, 454 bp, Triticum aestivum
  Clone ID: PAT_TA_53062
caaaatcgagcttcaccaaacatttcgccgcggacaccaaacaagtaaagagggagaaaagggagtagtttacgtccttttcctcctctacaattacattgtcacttcagagagaaaccacagccttttctaagtaaaaaaaagagagaaaccacagcgatgggatgcgtgtcccctacaaaattgcagcgttactattccagcagagatctcgactcagactccattgccttctcactgagcgatctctccctagcttcgtcagccattttctgccagttggtgaaaaacgtgatggcggaaaggagcgtggtctgagagatggatccacagacgacgcccatccaaagcccttttgcccccatcttgagcacaaaacccagaagcatcgccatggggattccgagcaggttgaaggagccgaggttgacgtacgcccccacgtgctgccacc

SEQ ID NO: 53063 - DNA, 281 bp, Triticum aestivum
  Clone ID: PAT_TA_53063
gggtcgtggggttttgtccctttatatcgggacccgggcggggaccgggaaaatccggaccgataccgggggggaaaaaaaggggcccaaaaagggggcaaataagaacgggggggaaaagggggaaaaggggaaccctggggaaaaaggagtgccggaaaaattaaacaaaaaatacagggcgaaaaaaaaaagggtaaaaccagggggacgaaagggggggcacaacccaaaataaaggcggggaaacccagtgcgcgctttgcaaaaagaaaaacggg

SEQ ID NO: 53064 - DNA, 301 bp, Triticum aestivum
  Clone ID: PAT_TA_53064
cctgatgcacacaaccatctttattgaaattgatgcaaggcaacaaggccaaatacatcaaaaggtagggtacatgacttgggcagctacaaccgaaccattacaagatgttttattgaaatatatggataacgataactagaaacgatttacagcttcagtcagatgtacaactaaggtgtgtacaactaacaaccatttattgaatttttcttcttgttcctttgacagaatgatttgatccttttaagaccatcttgaagagaagatggaacgcaagcaaaagtaatggggacccaat

SEQ ID NO: 53065 - DNA, 249 bp, Triticum aestivum
  Clone ID: PAT_TA_53065
cctccaatgaaggtactgttctcatatacgcatatgtaccgtctcgtttgctggatgaatacatgaggtgtatgtgtccttttctcaacaacaacaaaatcccccgatctctctacaacaaacacccatgatggcagcatgcgagcgaatcggacaccttgatcagctgtccaggcttttattcaggaaacagaacacgccactgatgcttgcaggggaaagaacaggacgcatgcgtgcatgagacac

SEQ ID NO: 53066 - DNA, 327 bp, Triticum aestivum
  unsure (1)..(327): unsure at all n locations
  Clone ID: PAT_TA_53066
gggcccgcttaacaatcataaaaagaaaaggggggccccatgaaactcactggcacgtcagacatttaccactgtacagcaatccccggggtacaggggaaaattgacccccaagcccaaacctgtttcatagtttggaaatgccctgagcacccaacacctttatgacaagtttcagccggacagatattttttcccgttgttcataagccgaagaaaatgnccttctgctcctttcggggagttctttcctgctgggaggaggggccggtttttttacccaaaatcttttgtctggatcctgaagnaagttttcccccgcgtttg

SEQ ID NO: 53067 - DNA, 516 bp, Triticum aestivum
  unsure (1)..(516): unsure at all n locations
  Clone ID: PAT_TA_53067
gaaacaaaatgtcacactagcaacagaaagtgttgtgtgctttggtattcacatcagacaggcaacatcatctacaacatccctcacaaaccccctacaacaacatcatcctcacactacggtgcggtttctacagtccacaagtatacaacacctagcttcgacgcaaccggtttggtcatggtatggtacaacacgatgtgtctgcaaaattttcacattttttaggtcaggatggccttgagggcgttaataccgtccgtaacaggccccggcggccaccctctccacatgaaggccttgaggctggctggcacatatgaaacgcatatgccgtcctgtgaattttctagacgaagtagtcctggcgcacgacggtgatgaaatcgcagggaagcgactcgtcctccttttgcttccctacgtcgccgtttccttggatgtgccaatatantctttggaggggagggcgcagtgagagatgcataaaggtctggggacagattttgatcggat

SEQ ID NO: 53068 - DNA, 366 bp, Triticum aestivum
  Clone ID: PAT_TA_53068
aggttagggaacaatattaacatttaaataaagtaaagttacaagggaaattaggcgggaggcttacaggggaccatgagtgaaggggacaaggtagaacgggcacgaaaaggacgaggactaacttctaaaaccaaaacctggggctgtcataaacggagggaacagggacagacacataaacagaggccgggaacaaaatggtaaccaaggcctatccaacaccaagaaccgtagggctaaaaaaataaaagaacccttctcaaacacgaacaaaggcccaatttcaaagccaaagctcgggtcgcattccagggcaaaaacggagcgagcaccaaccggaaagggcatagcgagaaacccacg

SEQ ID NO: 53069 - DNA, 591 bp, Triticum aestivum
  unsure (1)..(591): unsure at all n locations
  Clone ID: PAT_TA_53069
tatgaacgtcgcatggcacgnnccgtacgtaagnncttggnnnatcctctagaagncggcncgccnnncttttttnnttttttttttnnntttttttnntttttttnnttttttttnnttttttttttttttttnttttttttttttttttttttttttttttttttttttttttttttttttttttttttttttttttttttttttttggggggggcaaaaaaacccatttttttggggggccccccaaaaaattaaagggggttttttagggggggattttcgggggggggaaaaaaaaaaaaaaccaatttttttttgggggaaaaaaaacacgggcaaaaaaaacaaattctgggttaaaaattggggggccccaacacccccctagggcccaagaccctgtttaatttgccgggggtttttttttttttttggggggaaaaataatggcgggaaaaaaccaaaaaaattttttgggggggcccccccaagggccccccaaggggggttttattatcccgccaggccaaattttgggggttggggaaaacccccgggaaacccaaaaaacctgggggaaattggggg

SEQ ID NO: 53070 - DNA, 638 bp, Triticum aestivum
  Clone ID: PAT_TA_53070
catgtatatatatttatttgagcataaaaccattgtgcgtctaacatcaaaaggaatggtacgataaattgttacattgcaaggtaactgttttgcagagcaatcctgagatacaaagtttatatagtaatatagagctatttaaaatttaaaagtgtttatcttgtatgtgacttgattggctagctacccaagaccttaattggcagctggtcttttttgaggtgttggccatcccgagtctgataacatttgggaactctgacttggttgagtactagttggcagctggtaattttgagatgttggccatcccgagtacgatgacaccacagaagtctgactcggttaagtgctatgatagaaatatggttgttgtggtcgcaagccaagtaactgctgaaaactagcagtgtctgcctgcgatagtggaggcaagccatgctttaatacttgcaaattatagttatgaggttgtggcaccgatgtcatagtacccggcagtacatgccaagatttcctgacaccgaaacctacatgtcctgcatatgtattgtaaaactcatatgcaatatcgtcattctcaaattccattcctatctctggttttaaccttttgatgtaatagtcatttgtat

SEQ ID NO: 53071 - DNA, 257 bp, Triticum aestivum
  Clone ID: PAT_TA_53071
ggggagaaaggagcacctttgtttttcattcttcaaacagggaaaacattaccagcacattttgacatgaatttgacaaaaaacatattttgtcccgattcaaaaagaaaaaaaaaatttacaggtttgcaaccatgcgtgcctaccttttggatggcatttattttttttttcattacatattaacttcccatatgccccgattaaagagaatatttagtagttgggggttccccaaaactgagattggggccagg

SEQ ID NO: 53072 - DNA, 450 bp, Triticum aestivum
  Clone ID: PAT_TA_53072
aatagaatctggatagctttagatcacaacacacccaaggcaggctaaacattcttagttcaacctatgactcgaaccgtttacagaaaatggtgttcagtatgtctgcgaacatgacatggtcgcaacatttaacaaaatccaacgagtaacatgcatcagctcttcagcactaagctgtgggacccttgcccttcttcttctggagcttacttatgtagaacttcaggtccttgccctccaggatgtacccatcacactctgccacactgtccacggcgagacgaaatgcatgccaccaatctttcaccactgaactgctcctcaatgtgcgaatacatgtgtacgtccctgctggcgcttatcaagcttactatggacattgatgctcttctttgcttgctctgtggcagcaggatcaacctcagcctcttggccctcagatgttcc

SEQ ID NO: 53073 - DNA, 187 bp, Triticum aestivum
  unsure (1)..(187): unsure at all n locations
  Clone ID: PAT_TA_53073
ggtgggtttgggtgttttttgtaaatcaagtgtagtagtatcaattttacaacaacaacaacacagtaatacacacagntnaggcnncctnacaagnacaagctgaatggcgggnccgngaagcctnngnccttgttaaggaacggcncnatttccgggggcgcggggaggtcgccgtagaaatcgt

SEQ ID NO: 53074 - DNA, 186 bp, Triticum aestivum
  Clone ID: PAT_TA_53074
ccattcggctcactttttttaataacattggcaattacaaatgcaatctgtttataatactaaaagattcttgtttcctacctacctacttaacattgtggaccatttttttacacagcctcgaatggtcccggtgaacactcagtgctgaagcctcttgtgggtggttgttgttgtaggtgtacc

SEQ ID NO: 53075 - DNA, 498 bp, Triticum aestivum
  Clone ID: PAT_TA_53075
cacacatgtatgcaagtaagctcttgattttgagttcaacctcctgttacaaaatatgacaaatcagttgagatgatgcttcctctagagtacacctttagacatttgcaaagagaattgacttgcccaaatcaattaaatcgaccaaaataggattaaaaatgtaaaataacaagccaacgtttctaaaaagcaagaaaaataaataactaaatacaagcacttgtacaatgttgtagaaataaacaggcagatggaatcacgggctctagtatagttttggatggtctcaaagcctaagctcaagatctagttcctcggccggggtgctaggacaaagcttaagtaccttcacacgacgattatcatcgtcgccatcatcacgaggatcatcacgttgcagatgctcactagaggaagaagacagaacgaactcggtagcctccagatcaatccttctcctcttgcgacatagatgaacaatcctttcatcgtctt

SEQ ID NO: 53076 - DNA, 472 bp, Triticum aestivum
  Clone ID: PAT_TA_53076
ggcatattagcttactataaagatatacagggtacgggacaaacccttactcttatatcaggtccaaacttaggaaaaccaaagccacgtaaccaggggatacggtacctggcggacagcaacaaccataggcctatacccatgaagcctgcacctagatatatatctatagctatctagctatatccatatttcaaaatttatatatataggtaaagctgttggggatgcccctaaacatgtacccggcggtgtgcccgttgagggcagaggtcttgggcatcagcgacgtgtatgataacagggagggcccatagaacgctcttgagctgggggtacccgtcgaaggcaaccaccttcactctgaggcccctcaaacgggtgcctgaacctttgaacgcctctttaggcacagcgttgggaggtcacttctgaatgttatgttgggccaggcaaatgtcttctgcggagc

SEQ ID NO: 53077 - DNA, 472 bp, Triticum aestivum
  Clone ID: PAT_TA_53077
gtggctggtggtttttgaaaaatatttttttttttgtgtttttttttttttttttttttttttttttggccaagtccttgatttattgcttcggctaaatacgaataactcgcttacaagtaaccccgttcttttttattattcattccacctagggggcgcaggggacaagcaaagatctgatcgatacatgtacatatattaagaccggcccggcatggggtgcatgctgcattaattcctgactttttgaactccccctcctttcctcgtgatggatactggttgcccggcaaatgctgaaaagcattccacgggaggatcacctgtccggcaggctcttgtttaatcgggttgcgcttggggtttcagactgaaggggccccgggagccaagggggttttttgcgggcccccgggttttgatcgcctcccgatgggggttgaggattttttcgggttgtggggcttct

SEQ ID NO: 53078 - DNA, 202 bp, Triticum aestivum
  unsure (1)..(202): unsure at all n locations
  Clone ID: PAT_TA_53078
caaataccctgtgttttcatttcgagctgtttctgtttcagatctagagcatcatgtcatctccaagcgcttccaaggacaagtttttcgngagggttatcaacccttttcttccgnccntcttcttctgctcgacgttgttanctttttttgggctgcccatccccnntgttgagggaccaaggcgtacccgnagcgtggg

SEQ ID NO: 53079 - DNA, 242 bp, Triticum aestivum
  Clone ID: PAT_TA_53079
aaacacggaaaacagcattttaattcaggggacaaacctgttatggggcagctactccggggaagtttccaggggccattttgggggccgatataactaagtgtgtttccaaaatggtggaattggtcggcccagggcccaattggccccacagtttaaacagaagcttacacgggagggccaacatgcctgattgcaaaaaggaaattggccacatgtaaatcaggtgcaaaaaccatttt

SEQ ID NO: 53080 - DNA, 254 bp, Triticum aestivum
  Clone ID: PAT_TA_53080
agctaaaagcaaacgggttgtattacatccggctcaaaattcttggtttaaatttggctaaatacataacactaaaaggttaaaacatgactgggtgggtccatatttttagacaactctaagcaaaaggattgacatcagacaaaggatcgtctcggggggaaaagaattgttgttttgaacacaaagcataataacttaatcttacatggggggtttcatctgggtgtttaccagggacaagaaaacaatac

SEQ ID NO: 53081 - DNA, 269 bp, Triticum aestivum
  Clone ID: PAT_TA_53081
gagctctacacaggctgcatcaatagaaatgacagtaggataaccaccgttgaactcttgactaaagtgataaatctcagcaattgagacaaaccagccatggtaccgtgaaaattaaaggaccggcaaaacatttccactagctgggaccacatatcaacaccatgatatcaactttcacgattctcctaatgcaaatttacatctccacagttctcagtgtgaaacaggagcagcagtagtaagtagtgacacacttcgtgtcactt

SEQ ID NO: 53082 - DNA, 576 bp, Triticum aestivum
  Clone ID: PAT_TA_53082
gacaggcaagcagattgaaccggctgagatataaaaacctgaaccccgggctcagaaaaatccagctacacataaggggaaaggtacagcaaaatcaagctgcacataagaaggggaacggcgcagcaacagacaaattgggggggaaccactgaatatggattgaatgaatctggtcaatatatacacaaggatttggactagctgccagttccatctaaataaacagcatcgcgggctgacgaacggcacacacgctacttgtctacacatccgaagcatcttgcctgtggatgggcattgtgcttcccagattcattcataacaaacaatgtgggggtgaccatgaaatgaaatagtgttctcgtggcgacgcagatctccagcaggcgggtgacgggcagacttggggtccaaggtcccgccgtgctgctgtgtcgtcgtgtgaactcgcagaccatgtgtcatccacctcacaaggcctgtatggcccaaatccaatgaagccgccgcatgctgtgccttggtatgtacaggtgggctaggtgactcctcttcggggttcatgaggcgcct

SEQ ID NO: 53083 - DNA, 559 bp, Triticum aestivum
  unsure (1)..(559): unsure at all n locations
  Clone ID: PAT_TA_53083
gtttttgtttttntgaacaacanaaacaaaagtagaannagtgtttgcatggacgtagaacatatatgattacatttacacgctgcacagagccgcatggatacatgtagccggaatgtgtgcttatttacgtacgtacgtaacatttgtagacgtatgagtgttcaaaccacacaaacataaacacatgcacgtacgtatgcatgtatgatcacactcacacgcacgtactacttggcttcggcgtcaagggtgaggaacgcgaacgggcgctcgccgttgaagttgcccggggggttgtagttgcaggtgatgaagacgccccggttcccggcgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggggccgcgggagtgctggagccggcaatcgccg

SEQ ID NO: 53084 - DNA, 697 bp, Triticum aestivum
  Clone ID: PAT_TA_53084
gtcgttgcccagccttccgagctctctacaggaattaaagatcgagtgttgtggtgccatcaagtctctgtcgaacggcctcccgagttctctggaaatattgaacatctgccgctgtgatgccatcaagtcgctgcccaaggacagccttccaagttcaatgcgagagttagatgtccatcttggcaacagcaaggagctaaaaagggactgccgcaagtttataggaaccatcccaattgtgagaacttgaccaatccaagggttcttcttcaatctgcatattcttttagcctcctacagttctctctgtataattacgagcaaggctcccacttgccagtgcaagcatgatgatctcagtttgtttctcccatcctgcatgcaaagctgtgagcaggttgggccatggaattgtcaattcttccatctttgtaaaatctctgcgttgatacaaggttccttcatcatcaaagacttgagtggcatctccttatgagcatgaattgataattaattaattatgggatccatctaggagttttagccttgtaaaattatctccatgcacgcacaggtggcacttgagggtcttgtgtggtatttcgtcctatatgaaaagtccataaatctggagtctttatgctaattctggttggattatagatactttccatttacattttggtcatctctc

SEQ ID NO: 53085 - DNA, 575 bp, Triticum aestivum
  unsure (1)..(575): unsure at all n locations
  Clone ID: PAT_TA_53085
cccatccgcccctcatctcctccccatccggccccatctcccttcctccacccctccacggcggctctccattggtaatggcgatggcggcgtcgtggtgggcgctgctggcggcggcggcggttgtggcggcggcggggtgcggcgaggcggcgcccacggcggcggcggaggcggcgcacgacgtgctgcagacccacggccttccgcgcgggctgctccctgcggggatcgcggcgttctcgcacgacccggccaccggccggttcgaggcggtcctggagtccccctgcacgtcgcgcaccgaggtcggcctgcggtacaacatcaccgtggcggggcagatcagctatggccggatcgccgagctctccggggtggacgctcaggacctattcctctggttcgccgtgcgcagcatccgcgtggacgtgccctcctccggcgtcatctacttcgatgtgggcgtggtctacaagcacttaccgctgtcgttcttcgaggcgccgacgccgtgcgtgcccaccccgctcatcctnctgcaaccacatcagattaggggccacggatcggtg

SEQ ID NO: 53086 - DNA, 612 bp, Triticum aestivum
  unsure (1)..(612): unsure at all n locations
  Clone ID: PAT_TA_53086
agcagatcggctagcaatggaggtggcgtcgctgtaccggcgggtgctcccgacgccgccggccgtggagttcgcgtcgccggaggggcggcggctcttcgcggaggcgctggagggcggcaccatggagggcttcttcagcctcgtctcccacttccagacgcagtcggagccggccttctgcggcctcgcctccatcgccgtcgtcctcaacgcgctcgccatcgacccgggccgccgctggaaggggccctggcggtggttcgacgagtccatgctcgactgctgcgagcccctccacgtggtccgctcccagggcatcaccttcggcaaggtcgtctgcctcgcgcgctgcgccggcgccagcgtccgctgcttccgcgccgaccacgccaccgtccacgacctccgcgcccacctcgcccgctgcgcctcgtcgcgcgactgccatctcatcgcctcctaccacaggggccatttcaagcagactgggggtggccatttctcgccgatcggcggctaccatgccgggacagacatggcgctcatcttggatgtggcgcgcttcaaataccctcctcattgggttccattgacacttnttttggaagc

SEQ ID NO: 53087 - DNA, 749 bp, Triticum aestivum
  unsure (1)..(749): unsure at all n locations
  Clone ID: PAT_TA_53087
ctcccccgcctccctctcctcctcccccctccgcctcgcctcccacctcggcggcgccgccctccgtcctacctcccaccaccaccgtcggttcctcgcccccgctccccaaaccgcggcgcggggccccaccaccagcggcgggttcgcggcgatgagctggctcgggaagctggggctggggggcgggggaagcccgcgcgcgtcggaggcgtcggcggcgctggcgcaggggcccgacgaggacaagccggcgcccgggagcgagttcgcccagttcggggccggctgcttctggggcgtggagctggtgttccagcgcgtgcccggggtcacccgcaccgaggtcggctacagccagggcgccttccacgaccccacctacgaggacgtctgcaccggcgccaccggccacaacgaggtcgtccgcgtccagtacgaccccgccgcctgcaagtacgatgacctcctcgacaccttctgggcgcgccacgacccgaccacgcccaatcgccaggggggcgacgtcggaacccagtacaggtcagggatctactactacacatcggagcangagaaggcggcgctcgagtctatggagaagcagcagaaggctcagaaccggaagatagtcactgagatcctcccggcgaagaggttctacagggcggaggagtaccaccagcagtaccttgcgaagggcggtcgctttggcttaaacagtccacggagaagggctgcaacgaccc

SEQ ID NO: 53088 - DNA, 503 bp, Triticum aestivum
  Clone ID: PAT_TA_53088
atataatatgagtatagatatatagatattttctgaagttaatggccatgactgtaccacatctcatttacaaaatcatgaaactttacatgtctcacactcgaaaaagtacaatgctagggtcgattccctcaggaatctgctgctcgtcacacgtctccggcagtgacagcgcgatcttggtggcaaactccaggtagctctcgaacttgttgctgtcgccagcactcttgttccccttcatcttcgtgttagagctaccatgaccatgcagcagctcctccatcatgaggtggtgcttgactgcacggagccggaaggtccagttgccggtggcccagtcgaaattgtagagcggcagaaaccggtggccgtgcgccgcgacgaagtcgatggcggcaaggatgaaccggaactcctccggtgggaggtagtaggcgaaagctacccttgtccatcccggctttacaccgtgatagcccttaagaatggcggagcggatg

SEQ ID NO: 53089 - DNA, 280 bp, Triticum aestivum
  Clone ID: PAT_TA_53089
atatatccacacaaaactagtgtacatacatatagacatatataagttccacacgcgtgtcgtgcattgatacatgagatacgatttattcagggacaaataatatgtagcacacatgatattctcgcatatatgtgtatatgaaagccttaaccctgccatcggtgttgagatcttgatctttgaagcacgtagcgggggtgtatatgtgtgcagccgggggtctcatgtgtatatgtggatggtcagttggttaggtgtgtgcttgaagtgaggcttg

SEQ ID NO: 53090 - DNA, 669 bp, Triticum aestivum
  Clone ID: PAT_TA_53090
gttagcaaactaaacggcaaaaaagtgtgcgaaccagagaggtgtagcagtcacatacatgttcggttccattatatcgtagctgaagacgaagatttacagcagctgtgggttctatatacatgtatttaccaaatatttcacaatcttcagtgcaatagacctgtttcttcagtacattcacattagagaaagaagaatcgtccctggctttggatgtggcatgggttctgtagacttgcaggcctttgtatgatcatattgcttgctcttccctccatcacactcttggccattgggggctgactacctctaatgtactgaaaactaactgcatccgacttgctactagcgatggctcctccgaactgcctgtcacagccatctgttccagctgcaatgttttcactggtagccatgccatgcccttggtgtagtaagcgtttgctatcagggcacaaaatcctttccactgatgcaagacatccgccgacaccggtggggtggtagaccacctgatgaccgtcggctgtggcgtgcacaagattgtaatgaacactatactgagccacaggatgcactcctttacctcaaaagaacgaactttgaagctcaagcttgttcctccataggattgcaggccttcgatcttgacaccaggatttttta

SEQ ID NO: 53091 - DNA, 732 bp, Triticum aestivum
  unsure (1)..(732): unsure at all n locations
  Clone ID: PAT_TA_53091
cccacgcgtccggtccggtcggccagccatggggtcgtctcgccggcgcgcgctcctcctgctcctcgccgccctcctcgcctcctccttgtgcgacggctcggcggcggagcggctggccgccgagcggacgcgccggaaggaccccctcgacgggctccggccctaccaccgcggctggaacatcagcgaccggcactacatcgcctcggtggccttcagcgcgtcgccggtgttcgcggccggggccgtctggttcgtcggctttgcgctcgcggcgctggtggcctgctgctgccggtgctgccgcggcagccccaccagggacgacgactactcctactcgcgcaagaccttcgccgcctccctcctcctcctcctcgccttcaccgccaccgccatcgtcgggtgcgcggtgctgtacgacgggcaggccaagctggacggcagcacgtcggggacgctgcgctacgtggtgcgccagtcggacggcgcggcggcgagcctccgggggttcgccgggttcatcgagatggccaaggcctccggcggcgccgccatgccgcgcgacctcggggccaaggtcgaccaggtggcgagcaggggtgggcgccgcggncgacgagctcgccgcgcgcaccgncagcaacgcccgcaagatccggaccgtgctcgacaccacaggaagatcctgatcggcgtcgcggccgtgatgctggtgctcgcgttcct

SEQ ID NO: 53092 - DNA, 721 bp, Triticum aestivum
  unsure (1)..(721): unsure at all n locations
  Clone ID: PAT_TA_53092
tcccggngtcgaacccactgcgtccgagaaatacttaagaagaaactactagtcattgctgtccttgttttcacattaagtaaaactgataatatacactattttttaatacatcttcagatattaacgagtgtgagctacggagatccccaaaactcaacaatttacaagaacatgtatccttgtcatggagggagatgccacgatagagagggtgaatatgagtgtaaatgcaatttcggacgaagatgtgatggtaaaagccacaagggttgtgaacttgtagtgtccacgactgctgcagcggtgataggaacaattggtgtcattgcattactcgccgtgctactgatattcttacatatggagaacgagaaaagaaaactgagagattgtttcaacaaaaacggcggacaattactcaaaagcctcaaggtcgaagatcttcacaaaggaaaagctagaccacatcacaaataactaccgttgcataatcggccaaggcgcctttgggaaggtctacaagggagccactggcgccagagacaatgtacgggttgccgtgaaatgctcgatccccatcaacgaggactggaagaaggagtcttttgcgaatgagatcacaatccagtccaatatcagccaccggaacctggtccaaactgttgngttgctgcttggaaccngangtgcccatgctggtctacgaagtacgtgccca

SEQ ID NO: 53093 - DNA, 552 bp, Triticum aestivum
  unsure (1)..(552): unsure at all n locations
  Clone ID: PAT_TA_53093
gccggatccgctgcacaggaggccgcctcccctagctcgagcacgagcgccgcctgcccgtactcgcccgccaccggaccccctcccctgagctcgcgccttcggcggcgcaggaggcctctccgcggtcttgagcctcccctactgactggtccctccccgacctcgagcgccgtcgtcgtcctctggctcgtccctcccctccgcgcacccgacttccccctgtccaaccatcatgtcaaaggtagaggcttgtgttgagacagccaagtcaatggtcattgttaaagagatcgacggtactgaatattgcagtggatttattgcaatcactgaagcgagacagggtacctatgttgttaccgatgctgaatttgtcatggaccgtaaggacaatttgatggttttcttttctgacaatactgagctgccagcctcctttattgagacatacgggcctttttgtttcctgaaaacaaagtttcattcagcgtgtgagcaaattgagttgatggaagcgaatattacccccttacctgngatcatnttccc

SEQ ID NO: 53094 - DNA, 258 bp, Triticum aestivum
  unsure (1)..(258): unsure at all n locations
  Clone ID: PAT_TA_53094
gcgtcttcgtactcgcctctctccgcgcaaccgagccttcgccctcctccttccccatttcgccagcggcgcagcccaccaaccacccccacccgtcgncatgagggagtgcatctcgatccacatcggncaggccgggatccaggncgggaacgcgngctgggagctctatngnctnnagcatggnatnnagnctgatggcnagatnnccgncgacaagaccgnncncggaggcgatcatcngccgcggccggggcc

SEQ ID NO: 53095 - DNA, 577 bp, Triticum aestivum
  Clone ID: PAT_TA_53095
gcaggggcgcccttctgtctgaccgcgcaccaaccgcctcctccctctcctccacgctcgattccatctgcgaatctctccctctcccaccgatcccccgccgcgccgtcgccggcgccgccgccgccatggcgctcctcctccgccactcccgcaagctgcgaagggtgcacggcgtcctggactgcgagcgcgggagcatcgcccggcacttctctgtcgccgctgcaaaagaagacgctgtcacaagttctagtgttcatggggagtacgggaaaaaggttggaaggtcgagcattttcctagacaggcagtctgaaaaagatctccataccttcaaggtatcaacacgagaggcaaggggaagctacagctccaaacggatgccaattgctgctactggggtaaatagcttgttctcatgtggacaggtagtttcggccagacatttttcaagtggggcagatttgccaccgcatgaggcaatcgggatgccttctctttgccctaccatgactgagggaaatattgcaaggtggttgaagaaggaaggagacaaagttggacctgtggaagg

SEQ ID NO: 53096 - DNA, 636 bp, Triticum aestivum
  unsure (1)..(636): unsure at all n locations
  Clone ID: PAT_TA_53096
gacactcctccccgcccttcgtactgtaggcgccgccgtttcccccatccgctcctcccggcgccgcccctccgccgcgccttctctgtccgcgagcggcagcgcccgatcggcgaatctcgcgatggctggcggcggcggcgggttcctcaacctggagcggcacttcgccttctacggcgcgtaccacagcaacccggtcaacgtcttcatccacgcgctcttcgtctggcccatcttcctcaccgccctcctgctcctccacctcaccgccccgttcccgcgcgccgccgcggtcttcaccgccgtctacggggccttctacgtctccctcgaccgccgctcgggcgccctcgccgccgtcctctgcctcctctgctgggccgccagctccgccctcgccgcccgactcggcttctccctcggatggaaggtggtattggtagctcagctgttctgttggactatgcaattcattggccatggagtttttgagaagcaggcacctgctctagttgacaaccttgtccaggctttgatgatggccccatatttngtgcttctagagattcttcacaagtttgttgggtncgaaccatattctggntttcatgccantgggcaaaanctgattga

SEQ ID NO: 53097 - DNA, 447 bp, Triticum aestivum
  Clone ID: PAT_TA_53097
ccaagttcgagagggaggtaggccttgccttgattctgctaggtagcatccgcgagagatgggatcggaggcggacgcggcggagatgaagggccccctccttgctggcgtgccggcggcggcggaggtggtgccgccatggcgggagcagctgacggttcgggcgatagtggtgagcgccatcctcggggtgctcttctgcctcgtcacgcacaaactcaacctcacggtggggatcgtcccctcgctcaacgtcgccgcggggctgctcggttactgcctcgtgcggacgtggacggcggcgctcggcatgttcggcgtcgtttccaagcccttcaccaagcaggagaacaccgtcatccagacctgcgtcgtcgcctgctacagcctcgctgagttggatgatcgggtttatgtttctagttagctttcttggtatttttattc

SEQ ID NO: 53098 - DNA, 190 bp, Triticum aestivum
  unsure (1)..(190): unsure at all n locations
  Clone ID: PAT_TA_53098
gtggcgtgcgcatcccggggcgactgcagccatgaagctgaacatcgccaaccccgcgacgggttgccagaagctcgtcgagtgcgaggatgaccgcaagcttattccgttnatggataagcgcatggcgaccgaggtcgcggncgactcgctcggcgacgacnnnaagggntacnnnnnnaagatcacg

SEQ ID NO: 53099 - DNA, 659 bp, Triticum aestivum
  unsure (1)..(659): unsure at all n locations
  Clone ID: PAT_TA_53099
ctctgtcttgcataagaattagggatggttactcttgttgctgtccggtctggtcggggatggcaggccgtcgtccgcctgggaggtcgtgagctcgaggcaaccccgggtagaccgggcaggttgtcggaggctccgacgcggtcctctgcggcgcacgacttgcagcttgggagtgtcctggcagtagtcggcgacctggaggaggaggcggaaggaggagcggtagcaggacgtgttagcaggtgcagctcttctaggcgttcttggattctaggcactgctttcatcgttggttctggtcacttggaagttctataatatgggctttcctgctttcgtttttccttgccttggggtggcgacgagaagagcacggaaagagccggtgagggaaccacaccgcacacggacggcggggtgagaggccggcgccgagttcgcgttaaagctctcgccggatgtgcttctcttctactttctccagtccttcacacccgacatgttcaccttgacagtccgtcctcgccgccgncgactatgcatgctcttttgtttgccagcgaaggacgatgtgcagccgctgccacagtgggtacattgtccgtggcgctgccgactccccgggcggtttcattgcgatctcctggagtctggac

SEQ ID NO: 53100 - DNA, 402 bp, Triticum aestivum
  unsure (1)..(402): unsure at all n locations
  Clone ID: PAT_TA_53100
caacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgaaagaagtactgatcggcttatgcnagnatgatatgnnnncnctaaaatgaaatanaagnnnanactagatga

SEQ ID NO: 53101 - DNA, 485 bp, Triticum aestivum
  Clone ID: PAT_TA_53101
agccaaaaaaattctgccccgggggtcatttaatcgactatacatattacagcttaaaaacccctgccccagggatacagggggcaaaccctcgaaaccaccactcggcactttgtctttttacggccaaaaacacatgcaaaaagccccacgggccgaatgcttacaaacatggcttttggaaaaagggtggggggccaggcaacttggaaaagcttcctgattcgggcttgacatttccgggctcatcgacggccatgggattagcgcccacccgaagagcttgcttggaggggcccatgtcttcccccaaaggttctgaacccctatggtcacccggtactctgctaccaaccggggcttttggctcagctccagctgattctttcttaactctgggaccttgaatagggattccccccgcgtgagcttccaaaggggggggaaactccaatcccaaaaaaaaaataggggcaacaagcctt

SEQ ID NO: 53102 - DNA, 158 bp, Triticum aestivum
  Clone ID: PAT_TA_53102
aaaagtaaactcaaagttacttgagagccaaaaaattacatagtgtgccttgagagccaatcaatctatctaagcaatctatctaacagttaactggtaaagcagagttgttattggatcgacacgagcccctgccggtagtggagacacatgatctt

SEQ ID NO: 53103 - DNA, 307 bp, Triticum aestivum
  Clone ID: PAT_TA_53103
ggcactgacgtttatttacatgggttgagaggggcgggcgggtggggaggggcgcgttcctggcctccccttcctttcctcctttttttcttgcttgctcgtttctgtcccgtttacagtgttgcatttggggtttgcctcgtttcacgagttgacgacggtgaaggactctggggcggggagctttgcgagcacctgctgcgcgatgctgacgaccgccgtgaggttctgcttgacggcggacgcaaagcccgcgtagtcgagctgctcgcccgtgaggacgccgttaccaaaggtgtcgaccatg

SEQ ID NO: 53104 - DNA, 675 bp, Triticum aestivum
  Clone ID: PAT_TA_53104
aacgcgagaggaaaaaggcacacttgctcaaacttaacgcttacaaatgtcacagagaaaccaacgcttcttccatggcatgaagatcggaatgatggagatgcacccgtgcgcggtgagctgcggtgcacgtatggtatgcaatccatccaggtaagagcatctccacccgtgcccccacgacgccccccaggagccttttttagcaccggcgacataaaaatgccccagccatacccccacggcctcacttttcgccggattaagcgaaaaatacagccggcgcgcgcagggcaaacccaggaagccggggggcagctgaggcgccggcgcttaactttagttgcaaaaggcccactgccagcctctctagtctctctctcttggccaagcccaccacgtgcctcccccgctgttgcccgccctcgcccgtccgctccgtggcgtgtctcccctgctggcccttgccggtccgccgtgcgccgccgtctgctcgcatggctctcctctccgtcgccggagggccgcccacgccaagccgcccgaccgcctcagtcgcgccgccggcacgacaggcgcttcgccctccctggccatggctcgcgcgcatggcgccttcttgctgcagctactggacttgcgcaccaccgaggtcgtcgtcgagctcaggtccca

SEQ ID NO: 53105 - DNA, 360 bp, Triticum aestivum
  unsure (1)..(360): unsure at all n locations
  Clone ID: PAT_TA_53105
aatggaagcatttatttcttttgtttagtaaaaacatcaaaaatatacacttggtcactcacttgatctttttgtgtatanatctaaatagtcaacataaatcctcactgtacctgtataggtacaggcgaggattcatattgcaaccacaaatcatacacatatagttcaatgaagaccaagtgctcgagataggttgagaagcaacatatttaaggtggtaaacaccttgttcgcttagcagtatgggactaaacttaattagttgcggtcatacttaccagcagcgagttttgggcaaaaccgctgctactaagttctttagcaggtggcgcgtgccggggaggtcgctgctgctgt

SEQ ID NO: 53106 - DNA, 763 bp, Triticum aestivum
  unsure (1)..(763): unsure at all n locations
  Clone ID: PAT_TA_53106
cttggttccttcgtttttccagagagctcccnatgggaaaaagttaagattgacagcacgagtgaaaaggcaggttcttactaccagagttcaggaagcaatcactgatccttttgtcgtcaaagaccgccgaagtgaattaaataaaaagagttatcctccgtctaaagaagaagcggtacattgtttggagaaaatttctctaaagggaaaacattgtgctatccttgttgagaaaaatatcactacagtgaagcacttgatgcgtcagtatcacagggatgaatctgttctccaaaagcttactggcatgaaaaaaggggattggaataccatgattaaacatgccaacacgtctgttcctggggatgagatctattcctattgggttccagaggataattgtgaaatcttattcaatgatttctatgatcttgtcggtaagatgactgataactatgttccttacagtgtcaacaacgtcaatcagtttccacagcataaagtgaacaattggaaaaaatccgcgtataagaagtttgacgagcgggagagctcaggtggtcttacccctgattacttcatgaacgatggccgccctgtccgtgcaatgcatctgaacaatgatgcaggtccttctgtacaagctagaacaacatggcaatatcctaatagcatggccgcacaacatgaatntggtgatcgacgcccattgaatgggttctcacgggccgcagtcctgtcaaacaatgatgccggtcct

SEQ ID NO: 53107 - DNA, 615 bp, Triticum aestivum
  Clone ID: PAT_TA_53107
ctttctccttctgtcccgcaaacccccgagagatccaccatgttcggcttcggtcaccacggccaccatggccagaaccccccggcccacgctccggccgccgccggcggcaaccagcccaccttcaagatcttctgcaaggctgacgagggctactgcctctccgtccgcgacggcaacgtcgtcctcgccccctccaacccccgcgacgagcaccagcactggttcaaggacatgcgcttcagcagccagatcaaggacgaggagggcaaccccgcctttgccatcgtcaacaaggccactggcctcgccgtcaagcactcgctcggccagtcccacccggtgaagctcgtgccattcaacccggagtacctcgacgagtccgtgatgtggacggagagcagcgacgtcggcaagggcttccgctgcattcgcatggtgaacaacatccgcctcaacttcgacgccctcaacggcgacaaggaccacggcggcgtgcacgacggcaccaccgtcgtcctctgggagtgggccaagggcgacaaccagagctggaagatcctcccctggggcgaagaggcctacgccggaggcagcgccaacgccccccgcggc

SEQ ID NO: 53108 - DNA, 234 bp, Triticum aestivum
  unsure (1)..(234): unsure at all n locations
  Clone ID: PAT_TA_53108
gcaggacggagtcggagggcttcaggtgcgcctccgcgacggacggtgggccgacgtgccgccggagcccggcgcgcttctggtcaacatcggggacgtgcttcaaggtggtttaaatgatgagtacgagagcgtggacacagggtggtgatcaagtcttgtgaagatgcgagggtgtccattgcactcttctttaaccctgcgaaagcgcagnaatccgacttgtttgggccc

SEQ ID NO: 53109 - DNA, 712 bp, Triticum aestivum
  Clone ID: PAT_TA_53109
ggacgtagaacatatatgattacatttacacgctgcacagagccgcatggatacatgtagccggaatgtgtgcttatttacgtacgtacgtaacatttgtagacgtataaatattcaaaccacacaaacataaacacatgcacgtacgtatgcatgtatgatcacactcacacgcacgtactacttggcttcggcgtcaagggtgaggaacgcgaacgggcgctcgccgttgaagttgcccggggggttgtagttgcaggtgatgaagacgccccggttcccggcgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctggagccggcaatcgccggcgcgctgcgccgcccagtcctgcgcaaacctggccacgttgttgtcccacgccaccgggccgacaccgtccacggcgcgggcgcggttgtgcaggttgacgaagtcctgcggggtgttctgcgccgagacgtcagccaccacggccatgactatggccagtgcgaacattgcaagactgctcttggaagatgccatgactagc

SEQ ID NO: 53110 - DNA, 176 bp, Triticum aestivum
  Clone ID: PAT_TA_53110
acatatacacataaataaatggaatcaagtgcgacgaagttcatagtgtacagttggcatatacaatagtaacacctttgtgtgccaaaaaaatgaagaaagaacaaaaacattggcgtttcctaaagagaaataagccagcattggctgtgtggcagtgagatgtgcgtgggcgg

SEQ ID NO: 53111 - DNA, 286 bp, Triticum aestivum
  Clone ID: PAT_TA_53111
aaagccccaaacaaacatcgcccccaattttgagtttcatactaagcctgcccgactagccggctttaaccccatagcaacggttttttttccccaccatttttggcgtgggtctcactgacctcctgaaccctccgcccctagttttcaaacgaggccccccctatgtccatggtttttctaaaaaacatgggaagccccccacctctaacacgggagcgatgaccttgctttcccaaggtcagttgccttgcccacccctgccctgtgccccccgtaaccagcc

SEQ ID NO: 53112 - DNA, 499 bp, Triticum aestivum
  Clone ID: PAT_TA_53112
ggctgaacattcaccagcgatttggaaaatatagccaagtttttatccgtttttcccgagtcacgattcaacagggggcgttttaataaaaccataacgcaacgacgggtcgagagcagttcccaaattccatgacaggacggggaccctggtacaaaatatgcaaatccccactaaaacttattcagcttttggacacttccgaatgactgactgactggtataaaaagacggggctaaacaaagtctgccttggtgtaaatccgtacggggacggccaggcccagtattgcgagggggaccaaaaactggaggatcttgatgacaaactcgggggtcttgtcctggttgtagtgcggctgcttgggcggcgtgtacttgaccttggggggtatcgggggcgcgtcgatctcgccgacgtagtactcgtccatcatcgcccgggcggttgtgctgtgtcccacgtcctcaaagtcgtcggtcgcgtccttggcagttg

SEQ ID NO: 53113 - DNA, 589 bp, Triticum aestivum
  unsure (1)..(589): unsure at all n locations
  Clone ID: PAT_TA_53113
cacctgctcacatagcactctcatgccttacgtatctcacctatgaagagttcagctgcagcaatggcccacaaggaagacaagaagccggagggcgagaacaaggtcgagaaggaggcggagaagacacccggcgggcaataagcccaaggtcgagaagcggctgccggcgggcaagacggcgtccaaggaggccggcggcgaggccaagacccggagcaggaagaagggcagcaaggccaagaagggcgtggagacgtacaagatctacattttcaaggtgctgaagcaggtgcactccgacatctgcatctcctgcaaggccatgtccatcatgaactctttcatcaactacatgttcaagaagctagccggagagtcggccaagctcgcgaggtacaacaagaagcccaccattacctggcgggagatccagaccttcgtacgactggtcctccccggctagctcgccaagcacgccgtgtgggagggcaccaaggccgncaccaagttcaccttctcctagactgttgatgcgacagatgtagttggttgttgatgtcttctgttagtggaacataactttgtt

SEQ ID NO: 53114 - DNA, 610 bp, Triticum aestivum
  unsure (1)..(610): unsure at all n locations
  Clone ID: PAT_TA_53114
agaagnctattttcctccgcctcgatcccatcgccgccccccctccaccctcgatctcgccgccgccgccgccgccgtcgcgccatggcgaaggcgaagccgtcgtcgtcctcggcgaagaagctggcggcgaagagccagggggcgcagcagggcggcggggccgggcacgcggcgccgtccggcctcgcgcggtacctcgacccggacgcgccgtgggacaaggaccggctgctggacgccgtgcactggatccgccaggccgtcgggctcgcctgcggcctcctctggggcgccgtcccgctcgtcggcgccgcctggatcgtcctgttcgtggccatttcttctggcataatttactggtactatgcgcacctattgaaggtcgacgaggaagaattcggaggccatggcgcgctgcttcaggaggggatgttcgcatctttcacccttttcctgctttcatggatccttgtgtacagtttggctcacttttgatgagaagcccctttgttgaacataccgtgatttgggatcggattggctggagagaaaaaaaattcaccagacctttgttgattattgaagaagccctaaaacagcattgttt

SEQ ID NO: 53115 - DNA, 520 bp, Triticum aestivum
  Clone ID: PAT_TA_53115
cccacgcgtccggcccgagctcccctcgcccccgcaagccgcctcgccggcgaccccacacctccgccgcgccccgccgcctcgccccttccctccttcctctcgatctcctctcacctctgtctctctttcttgctgaacagggacctccaggagggccatggcgccactagccctcaatctcgccagatccggccgcctccacgccaaatccgccggaaatggatccatcccgtccagatccacccggatccgaccgggccccccatcctcgccactggagcacgacggtcggcgggagcggcatgacgtcgggtatgtatgagagaagagagagatgagcaggagagaaaaagggaggacaagaggaggccagaggaagagagatgggagcggtgaccgcgtacgaccgccccgaccacacggtcgcggcttggccaccgcggtctccacgcggagcttcacgactacgaccagccggaggtggaggccatcatgtggtgggccgttaggtaagact

SEQ ID NO: 53116 - DNA, 496 bp, Triticum aestivum
  Clone ID: PAT_TA_53116
atgtaacaaggcctgagctccgaaaaagcgagtcggcagcgacgccctgaagaatggagttaacatccgcaacgttgttccctcaaccgaagaagaggcacgccgtatattagaccgcatggatgcagagggtttgttcgattgatccttcggcggggtcactggttccagccataattttagcaactttttactggccatgttaactagtgggagatgtaccctatgatttgaatgaacatcagcagcagataagaagcatgctggcagcagaccggcgaaagtgtagctttttggcgtttcttttgggaaattatttggagtatagtagtataggatatataataaccccaacctcgagacccaaaaaatgtgccttttgtgagggcactgtccattaattatatatgtaattgcttttttgttccagcatgtaaacaaagatagaggccattgccttcaggtcagaggggaatgcagagataattctcttgtc

SEQ ID NO: 53117 - DNA, 510 bp, Triticum aestivum
  unsure (1)..(510): unsure at all n locations
  Clone ID: PAT_TA_53117
attgcgttttgttcgtgtttaattgttggtgaagtatttattccacgtttaattgtcaatatatatgaacttgtcgttaaaaaaaaaaaaaaaaaaaaaaaaaaaaaaaaaaaaaaaaaaaaaaaaaaaaaaaaaaaaaaaaaaaaaaaaaaaaaaaaaaaaaaaagggcaaaaaaaaaaaaaaaaaaaaaaaggggccctacacattcaaaaaaaaaaaattttttttacggtgggcttaaaaaaaataaaattgtttgatagttaacaaaaaaattaattgaaaagaccctcgttttacaaaacctaattgggtaaaataagagcgttccctacttaaatggcttaaaagaaaaaagaatagttccaaattgttttactaacaaaaaagcactcaaaaattgaaagtgaaaaaaaattttctcatctaaaataaaaaaaagaacggcgcttgttttttngaaataaatgctgcttatttaatttttttattaaaataatactcgttta

SEQ ID NO: 53118 - DNA, 112 bp, Triticum aestivum
  Clone ID: PAT_TA_53118
tgaattttggggctgatcctttccgtggatgaatctgtcttaaaaaaatgttgatgtcccatttagaggtgcttggtaaatttttcattgatcagctggacatgtattgatc

SEQ ID NO: 53119 - DNA, 312 bp, Triticum aestivum
  Clone ID: PAT_TA_53119
ctagttctagatcgcgcgcggagcgaccttttttttctgcagatgtaactaatacattagccttgctttgtaataaaaaaacaaaaccgatcccgcccgacccaaaaatcataaaggacgacaataacccaacaaacaaaaaaaccccaaacctacagcggggaggcctaacaaacccaaacaaatggggggggccgttctaaagaaaccaagctaacttccccgcccttgcgaggcaaaacttttttttttgttaacccaaacttaaatccattgcccgggcttagccccccccccgccgggaacaccccc

SEQ ID NO: 53120 - DNA, 149 bp, Triticum aestivum
  Clone ID: PAT_TA_53120
ttcctcttcgcactctcgcagcaaccagcggatgcctgcgagattaccctacctcccccaccctcggtccacggcgcggactggtgcggtggtgcgacgaccactacgaccaccgctggtgcagcccactgctcgggcgacgatgggtc

SEQ ID NO: 53121 - DNA, 363 bp, Triticum aestivum
  unsure (1)..(363): unsure at all n locations
  Clone ID: PAT_TA_53121
aaggattttagtttagttttcctgcgattccgtctctgctccgtcgtcctcacgcgacctgcaggttgactccctgccgcaccgcacgcacgagcagtaggggcgcgagaagatgcagatcttcgtccagaccctcacggggaagaccattcaccctggaggtcgagagcagcgacaccatcgacaagcgtgatggccaaaatccagctacatggaagggattcctccggatcagcagcgcttgatattctctggctagcagttggaagatggacgcacgcttgctgactacaacattcagaaggagtcgactctaaacttgangctnaggctcaggggcggctctgtgattaaggttgttac

SEQ ID NO: 53122 - DNA, 212 bp, Triticum aestivum
  unsure (1)..(212): unsure at all n locations
  Clone ID: PAT_TA_53122
ggaatccgcaaaaatttttgaggaggggttgaagtaaagcagaaatgctttcatctggccaggtttaccagaccagaatgctttacatgggcgaagggaaagtaattgtcccccccgccaaaataatggggtttgcttgttttgcccngttttctcccccgttgggacgaggctccttgttgccggttccgccccccccgaaatgtgggcgg

SEQ ID NO: 53123 - DNA, 235 bp, Triticum aestivum
  Clone ID: PAT_TA_53123
aaaggcagctctaattttttacttctcatggttgaatcaccaaaaaaaaacatttaacgggcaataacagcaaaggggcaaaccactatcaccatttttttcaaccagacgagctcataataaccttctttttcaacaaaatccttgcataactggtgggattcaactagagaccccattccatgagaggggttttcaaatgccacctacaggttcttttttcgacccgacatgc

SEQ ID NO: 53124 - DNA, 462 bp, Triticum aestivum
  Clone ID: PAT_TA_53124
ggaacacacatttgatcacattgccaaaaaaagggaacgaactatagccatggcgtccacacacgtatgcagcacgccgatggcaacgacactgtacgacgcatgttagaacgacgacgacgatgatgacgcgtcagagggcctggtcgttggcggggaagaagagcttccagtagagcagctcgttccatgcgtcgggcacgccggggaggcaccagtgggtgcagtcggcgtagctcttggggtcggcgagctgctccttggtgggcggcgcccactgctcccggtacacctgcgtgtgcgcgtcccggcggtactcggacatctgcgtgacgtttaccacgccgacgggcaccctcgcggacgcgggcagcacctcgccggtgacccgcagcatcgccctgctggtgctcccccagtaggaggcgtcggcgatgggcttggtctggccgtggcagttgc

SEQ ID NO: 53125 - DNA, 217 bp, Triticum aestivum
  Clone ID: PAT_TA_53125
atggccacgagcgcggcgacgccggcgcgcgcgctcccggccgccgagtcctcctctgccacgggcgccaacgcgggcgacagcaagccgagcggggagagcgaaggggccatgatgggcgacagctcgggcgccatggacggggccggatccggtgccatcgggggcaacggagtctgggcgataatcggagccagtatcatatccagggaaaggg

SEQ ID NO: 53126 - DNA, 158 bp, Triticum aestivum
  unsure (1)..(158): unsure at all n locations
  Clone ID: PAT_TA_53126
ggaaggcaacnaacagggggcagaaggcagcaacaagcgaggcaaaacacagccaaaacgcaggaaccgggagcaacccagaagggcancacagggggcggggggccgncccngagagagaaccgggcaccaagggangggcgaagggcagggacagc

SEQ ID NO: 53127 - DNA, 324 bp, Triticum aestivum
  Clone ID: PAT_TA_53127
caagccgatgaacacataccactgcgttaccagttcaacaatgttacaacgattacagggagaggtattgctaggcacttaattacatacatcctcaacccaaggaattagcattcttgctatcaaagcaaaaccaggctaggcagctcatcaacgcgccctccacctacctacctaatctagatacagagacaggcacttgggtttaagcagcatctaacccttgtttttcctgtgtaaaacagctggttgaaatcatgtgaattagctatcacctgtctaagctacatgtgtcccttctttgttagctgacacagatgtctt

SEQ ID NO: 53128 - DNA, 306 bp, Triticum aestivum
  Clone ID: PAT_TA_53128
gagcaagacgcatagaaaaaccttccaaccgaaactggataaaacaagcccccgattgggcaataattcaaacaggaacctggctaattttttagacccacaagcgggacaatttttacagagattggaacatcggactggtaactacacacagaacaccggcattaacttatgatacaagggggaagcctaaaaagaggggaacttggggacggccttggggccctcggaaacggggtgcttggggagctccccggggaggacaagggggacggaggtctggatctccctcaacgtgaagggggg

SEQ ID NO: 53129 - DNA, 240 bp, Triticum aestivum
  Clone ID: PAT_TA_53129
ggaacaggaaaggccctgaagggcccaaatctttattaaaacttcagggggtccaacacaaagcccacccaggggctcacataaaaggaaaataacccctaaccccttgtttttgccaagaaggcccctaaacgggttctgaaaatggcattcgggtccaaaacattttttttcgggatgtggactcgcgcgcgccggggcccccccctttggggcggcgaaaccctggcggggggttgg

SEQ ID NO: 53130 - DNA, 541 bp, Triticum aestivum
  Clone ID: PAT_TA_53130
gtgttgagcaccagacgcgatcacacatatgcttgcacgggtaacgattgctagtgtccgtcacacacgtgcgggacagccgcctacaagagataggcctgattacacgacgaggatacatgtacgactggcgcgactagctcgttattggcatgctctaacgtgcgaaaggaacgctttttctaaatcgtgacccgcgatacttcactgtggccggtcgatccgtcctccatcgctctaacgcccgtccttgtttgtttttgatgccaaaaacacataaggaatgctcacttctgttgatggatcaccagccggtactgcggtcctagcacgggctgcgcacgttgccacatccgcacttggaggggatctgcctgtggcgccgggcgtgaatgttgcccgcggacgcttagctggccctttttttggctcactcgccgaaagttggctccccttttggcggcgcatcactgcccgttctgagtagcgatcctgctgcctttccttctgtacgacctgctcgcgccgaccctgcggtgca

SEQ ID NO: 53131 - DNA, 636 bp, Triticum aestivum
  unsure (1)..(636): unsure at all n locations
  Clone ID: PAT_TA_53131
atgagaacatcagacatctcatttcctctttccccacatcccacataaaccagagcttcagaattggagtaccgcggacattttcaaactcaataagacggtatagagatggtaccaagaaaaaaatatagacaaagattttcccacatccatgacaacagagcagtcagctaaccaccttagaaagtgcctgactaatgacattttttccacaaccaaaaacaccaaatagcaccatgttcctccaaaaactgaggggagtgatactgaggggagccatttcaaattagaaaacactgggatttaatggcgttggaaggaaatgaaaaatcaacatatgtcatgtaagaagaggtgtccacaccgagctttgatgcatcaggtcttcgtgtacccacatgccatatctgcagctcattaacttccaaacattaagctagtaaattattcctcaaaaaagttataccaaataacttccttgcttgaagcatatttaattacttcttgatgccctgaaatttcagctctagaaatgtatcctgtaggctatgttgacccgctcgagcgatgtaatttactttcccatggaaccagattgaagagcgacatggtggttcatcnaattattctcaaaga

SEQ ID NO: 53132 - DNA, 552 bp, Triticum aestivum
  unsure (1)..(552): unsure at all n locations
  Clone ID: PAT_TA_53132
agaatctcgaaaaggcaattgatgaactttagctcgttgacaagcatcacaaatactagactgaagcgagggtgcacaagcgaatttatttgatctaaggactgactcaacgacttcttgtgaagggtgacctaatcttcgatgccatagttccggggagagcttgacagcggagagaactcgaggacttcggacgacgatggatgatttattgaggcttggcaccgggtaaaggccatggcgacttctaccgcgaagaagaactgtcttggttgctcggtcctgccccgtttgcagcatgcaccttgtccttgccgccgtagcgctcgtggatgccgaggcggtcgaggtcgctggtcaggtggtcggtcgcacctgtgtcagcataccagtccatgtgcacggtgtaccccgcggagccggtgttggtgttgacggagttgcaggagcgctcgcactgctcgtcggtctggaatgcatggntgaaaccattgcggcagtgaagggcgttatggccaaacttgctgcacacctgacactttaggttggagc

SEQ ID NO: 53133 - DNA, 432 bp, Triticum aestivum
  Clone ID: PAT_TA_53133
cggacaaaacctatccgacgggtttttttttgtggaaccaaaaaaaaaaaaaggggggcccttttttccgacgtccctacacaagggttacatttaaaaacaacagcaggcatcccagctttggacttccggcatccccgttacagtttacatttgagggggggagggcccccccgctgaaaccaaactttacgggggagcaaagaaaaaaaaataaggggggtaaagtaaccgcctttaggcatttaattaaaaaagggcttgaaaaaatcaagggttagggggaacttccaatccttgggaccttggatggccccaatatacaaaaatacacaccggggcctgaatcaaaggggtacaaaaatcgggcccccaattttgttttgttgggggaaatctaagagggggtataacttgggcccttgggggggg

SEQ ID NO: 53134 - DNA, 504 bp, Triticum aestivum
  unsure (1)..(504): unsure at all n locations
  Clone ID: PAT_TA_53134
aaaacgactcctaacagtgatgacgtatcctatagacggcaacattgacctgacaggaggtccaccaacacgacccggtcgatccaatgaccacagaaagaagcggcctcaacactgctcgacacaaataaaccgaagcttgacaaggtttcaaagacgactaggacagctttcacccccaccaaatgccngtagcgtctgcaccatttaacatgcagtacaagaacctgccaccattgcatttgttcttggtacgcaggctctgtcaccactggcgcccgttggattcttcttttgcacggacttggtaacaaccaccgtacccgtctgccttatgtcccgcacagtatagacggccaggggagggtactgggcgaaggtctccaccaccatgggcttgcaggggatcatcttgacgaaccctgaatcacgcgctcttgaggaactttggagcctcctcaatctgcttgccataccgccagcggatcttgggctggatctaaa

SEQ ID NO: 53135 - DNA, 399 bp, Triticum aestivum
  Clone ID: PAT_TA_53135
agaacagaaaccaaaactgttgaaactaagcactgtcagtatcccaccactcaaaatgcttactccaaactaaccactgcagaacaagggcatcacactgaatcagaaaagatgttttaggggggaacaccacaactctactacttattttttacaggaaacatgtggtagtaagaagcgcacgatgatgccatggtacatgtggttgcaggagtgaaggaggccggagtgtcttttccgagcacaatgttcttgtagaacgccaaatggcatgggggaaatcctcttccaatggtccttggactcgacttgatcaatggcttcgctttgaccatgcagattgcaccgtaagctctgatggaagatcgtgtgaagttgacactagacaccatttgaaga

SEQ ID NO: 53136 - DNA, 510 bp, Triticum aestivum
  Clone ID: PAT_TA_53136
ggtgtctggaaatttttagtcggtaatttaaccaaggttcaacggagtctatatacacaacgggcgaaacaggcagaacaacaaccaagcagaaacacaactatggtgccgtttacgtccattatgctgtcttattcaggccggaggctgcgctgctgctggtcgtctctgccggcttcccccctcagtccagccaggtgtcgtcgctgctggtgccgtcgccggcgaggaaagggtaaggagggtcttcgccctcctccatcgccagctcctggtcagagacgctcgcgagggcccggatcatgcgcttgatgtcggcgggctcatccaggtagtacttggccttgctgggcttttggccgatggtgcaggcgaagaccgtcgcggaagggctcaggtaggggccgtccaccgcggtggtgatcacctcgaacatgtcctcgtcggagcggtcgtccccgacgcacaggatgaagtcgggctggagccccagctcctgcattgtcgaca

SEQ ID NO: 53137 - DNA, 684 bp, Triticum aestivum
  Clone ID: PAT_TA_53137
gaacaacaaaacaaaagtaaagatgtttgcatacatttacacgctccacagagccgcatggatacatgcaggccggaatgtgtgcttatttacgtacgtacgtaacatttgtagacgtataaatattcaaaccacacaaacataaacacacgcacgtacgtatgcatgtatgatcacactcactcgcacgtactaggcttcggcgtcaagggtgaggaacgcgaacgggcgctcgccgttgaagttgcccgggggattgtagttgcaggtgatgaagacgccccggttccccgtgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctgcagccggcaatcgccggcgcgctgcgccgcccagtcctgcgcaaacctggccacgttgttgtcccatgccacggggccgacgccgttcacggtgcgggcgcggttgtgcaagttgacgaagacctgcggggtgttctgcgccgagacgtcaatcaccacggtcatgactatgggcagtgcaaa

SEQ ID NO: 53138 - DNA, 560 bp, Triticum aestivum
  Clone ID: PAT_TA_53138
ggaattgagtgcaatttttttagctccttagcagagttcacatgtagttacatttctctacttcactccacaaatgtcccatcaaacctgatttctatagtttttttccagctaaacctgatttctatagttggtagctctcttacgtactgtacatatttaaccaaacaatgtataataactaagaaacaagcccaacatggcatgccatatcccaaaaccactccaaaccgaacaatttacaacaccagctgctgctgccactgccaacatgaccactatatacaaaagcgcgacgacggcctcttgccgccggctctgtccagcaacccacacatgaccacctttttgtgctcctccgcgcacaagtagtccagcgccacccggtcgccgagcctccggctgctgccgccatcggcaatgccgcccctggcgtcggtccgtgcagccccgagccaccgcgcgccgtacatgcacgagcacaagaagagcaccgcggtgacgcggccgaagaacacgatcacgcccagcgtcgtggccgccgtccacaggccgcctgc

SEQ ID NO: 53139 - DNA, 284 bp, Triticum aestivum
  unsure (1)..(284): unsure at all n locations
  Clone ID: PAT_TA_53139
caaagtgtgttttttttttgtagattgtatttatttatacaatagttctatcatttacctttagcattcggtgtaaaaaacacacaaattttggatcaaacttggttcacccaacagatatcttgaggcctaggtatgtgtatctgagggagcggggggcactanataccaattatcgcagggaggcaaccacgcacagatgcttacttgccaccaccgatttccttgacagcgcaaaactgaggtagacccgtggggggcgtggggggcgggggggggggggg

SEQ ID NO: 53140 - DNA, 150 bp, Triticum aestivum
  Clone ID: PAT_TA_53140
caagataaatagacggtattattccatctgcaaaacaataatgtacgggtacataaatgatagagaatcatactaaatgcgcacagggtgatgcattcacttgtgctatacagggtcccataaccaagacgcgggggtgatttttactta

SEQ ID NO: 53141 - DNA, 239 bp, Triticum aestivum
  Clone ID: PAT_TA_53141
aaaggcagacgagccttttattaatgccgcacaaacaagcaaccatacaccgccgatacacacaacacgccaacagccatgaccgcacgtccgttctttacttcaccttggcgagcgtcaccttcttccacgtgggggggacctgctccagcgcccggcgcgacgacccctcgggcgaccacgcgcgcgccgccgcctgctgtaggtccccggcctgccgtcgatcggtgcgccccttg

SEQ ID NO: 53142 - DNA, 434 bp, Triticum aestivum
  Clone ID: PAT_TA_53142
ggagcagatcattagtgttggtgaacaaatgatttttactcaataataaatctcactcctacaataaatagttccacacaactaacatcgaactcgtgcacttacagtaaataatgaacaagcactaattgaggacatgacacttcttcctgatctctccctcggccccggtgagtacgtccacgtcgcccatcttgatcatggactcgctgaagtccctgaagaactcgctgtcgaacttgcctgtggcgatacgctggacgcagtccttggtggtggcgtcgaggaggagcgccgcgtcggagcggaagagacccctccgcttggcgacgtggcggtagtagctggtatcagaagtcttgaagctaccagggtccatctcagacagcatagtgcggtcatcaacgctcttgcacttgagcctcagcttgaga

SEQ ID NO: 53143 - DNA, 549 bp, Triticum aestivum
  Clone ID: PAT_TA_53143
gcgtgaagtattgacacctaaatatttattcatccctgcaaaattacataacgagtatctagcccatgctgtttatacattacacctggtaagttacataacagatacgcctaggagagaccacaggtgagccactaaagatacaactttcttttacgcaatgtgacgcgtagaatctgtaacttgttagtaagctccaggagggcaaattctgctttatatgctaagaaactcgatgtcctcctcagcaaggaacgtcttccctctgttagcattgttggctctccgctgggagggtggagggcctcgcttacgcagaacaaatgcgaggtagagataggacacttcccactcatcctgcgatagtgtgctttggaccgatcgtccatcaccaagagcacccagccttcgcatgagatcagcagattcaggcttttgcaggtactcatgtacaaattcgtggaagttcttcattagaaccagctctaaatcatactcctctgccagtagtttgaagagatggaatggaacaacccactccgggcaatc

SEQ ID NO: 53144 - DNA, 226 bp, Triticum aestivum
  Clone ID: PAT_TA_53144
ggaatacacatatgttccattcattatttcatacagcaggaaaacgccatgcaaggccatgctattgtgcctttgaggatacacatcttctacaaaacactaaccatgtactccatgtactatatattcttggcagcaagtcccctttgtaaacaaccttcaccgactctttataagcacttgatgtggacaatgcccggaccagactgatgggactgtggctggg

SEQ ID NO: 53145 - DNA, 252 bp, Triticum aestivum
  Clone ID: PAT_TA_53145
gactggtcccgcgcccccggcgccgtccgggccaagtacctccgcgcgatcgccgccaagatgattgagcggaaatctgatctggctaggctcgaggcacttgattgcgggaagcctcttgatgaagcggcatgggacatggacgatgtcgccggctgctttgaggtcttcgcaggtcatgctgaagccttggacaaaaggcaaagtgctgcgggggctctgccggggaatcgtaagtgccgtcgtgcgaag

SEQ ID NO: 53146 - DNA, 203 bp, Triticum aestivum
  Clone ID: PAT_TA_53146
cacgcataaaaacaaagctactgcctcacaaatgatccgccgccgtacaatcctaagcaacttaaaaaaaatgcagattgtgatggtacaaaagaatgtgtgcgtgaaaaaggtcaggggccgtataaaccccaacaaatggtaaccctgtgggaccaacctgatgcagcatgtgggtgggctactactggttgtgggggtgg

SEQ ID NO: 53147 - DNA, 141 bp, Triticum aestivum
  Clone ID: PAT_TA_53147
actcggttgcagatggagtacagagccagttcagactgatgaacaaacaacaaaccggtctgaaaacactggcgcgagagactgaaagcactgactggagcattgggccattcgcgcgcgcagacgggcgggcttgggggg

SEQ ID NO: 53148 - DNA, 283 bp, Triticum aestivum
  Clone ID: PAT_TA_53148
aaaagggctgaagagattttatttgattttattgagaaaaaacatacgtgtacaaaagacagaatgtcaaaacaaatactacacgaaaacatacatacgttgtgcattgcaacaggaaaaaaatatatgtaatagactgaaagccacataatgattcacttaggtgcgatgagtttaattaagtcatgcatggcaggtagcaagctagctagctccggcccacctttgctggcgtgaggtcgttggcgggggggcgcggatgttgctgggaggaacctccttg

SEQ ID NO: 53149 - DNA, 461 bp, Triticum aestivum
  Clone ID: PAT_TA_53149
atcatgttcaacagtatgcactgactatacatcatttacagaaaataaaaatggccgacagtatgcacttggccaaattggctcgttgtacttcgccagatgagtatcaaatctctctatttccccgcaaaaaataacaatgactgccagtatgaactgaaatacatcatttacagaaaatgtactctgcacgttacaatcgaaaccggctgtgtattttctgtgtcctacactagattatcccgacgcaactatactcggcaatccctctgtccaagtgtgaaaggatcttacaaacccattagcctcacatatggatggcgtgggtcatgaaatgctggcaggcaatcgaattaattcctgcaaccaaactaggtctctgccagctgagtaaattggacaccgctcttgttcttgcgagctggctgggccacatagatgggcacgcgaacgggcaccac

SEQ ID NO: 53150 - DNA, 510 bp, Triticum aestivum
  Clone ID: PAT_TA_53150
caacagacaaaaactatcaacactaatgccccttccgcaagaaggaaaacactgaaaccaaagcaaaagatctggttcggatttgcagacctcataccaaagaagacccaaaattatgttttcattacactgatgttgaggatagtttcccttattattcataaaatctgcacgattgataggacagttattacaactgcacctacagttgcattatgcccaacgacgaaaccgtcacagcaatgttacccctcatcgttgcaggctgcatttcactcagacctcaaacatgacgccgaacctggtagcaagaggaatggatatgatggcagcacccagcgcagcgccaaatatacggtgtgagatggagaacgtagcgctcagctgtggcttcttcagaggaagatggggagacagtgggcggttcgcaacaggagtcgacaggggacgacttgtatgcagggatcggtttccagatggaggcatgttgtggctgagagctcctaaggg

SEQ ID NO: 53151 - DNA, 438 bp, Triticum aestivum
  Clone ID: PAT_TA_53151
aaattcagaaaaaatatgagcactctagtaggatttaaacatatgaatgccggttccaccaaaagaaatctagctgcaggagaggacgaaggccttgacatgcatgacatggatctttctctaagctagtgatctcctcctcccggacgggcaccgacaagtggctggagagccttgacgacaatggtcatgttgggcctgaagtcggcttcgtattgcacgcacaaggccgccactgccgcgagcttggccactgcttttggtgggtagtcgttgttgagcttgggatcgatgcactgcttgaccttgacctcgctcagtcttggcgtgacccaggtgacaaggctttgctgacccttggacatggtgtgaagaacggacttactgccgttgaggagcttgaggaggactaccctgggaggtgggggcgtgtgtctt

SEQ ID NO: 53152 - DNA, 270 bp, Triticum aestivum
  Clone ID: PAT_TA_53152
gaaagtaacgactgtcatttaaaacaaattatccttgtaagagatcaactcactccaacacctttacttagtctattacaaaaaccaaacattctgtttctgaaagcgaatgccatttaaaagaagctcatcacacaattaacacctcaattctttgcataaaccggcgcccacccgacggttgcgaaacatctcggatgccaccagcagtaacctgcgcgcccctgctactgctaccgagagcacatgtggtgtattgttggttgcttt

SEQ ID NO: 53153 - DNA, 337 bp, Triticum aestivum
  Clone ID: PAT_TA_53153
acttggtcccaaaattatactggccaccaacagccacaaatgaacgacgctggtgctatactattagatagaaaatcctctctgtacacatgacaacatatgctcaagtctggaaccactctattcgcaacacctcatcaaggatgtaagcacttcagtgacatctccaattaattgtttgttcatccgtccgttcaacccgtcatcaaccattggacattctgcatgagcaaagtggtatttattagtcttgctctaccttgcctgaacacggaccgaggtcgggaatggaatggggatgtggggtggggtggttcgtaacatgggaatggggggg

SEQ ID NO: 53154 - DNA, 450 bp, Triticum aestivum
  Clone ID: PAT_TA_53154
ggggaactaaagcactagtctatcattatactaaacgcttgtacaaccctttttacatgcggactatttggttactgggacgtaagcggaacattcgtccatacatgacccaccagcgactgcctggggggcggtatggacacgcctccgctagacctggaaaagaaaagaagacccacttaattcacaaactagcccctggtccgccccgtcttcacacaagcattgcgtccgacacgcgtgctccttctgggggccttcaggggccggagcaggatctggtcagcccaaggttgtttaaattctttttcaccagggtgccgggcgagaacaggccggcccctgccccgcgggcgccgccggggtgcccctacgtggggcacaggcggggccaccgctcctaggccacccgggggctctcggtgccgaccccggggaagacctctgggg

SEQ ID NO: 53155 - DNA, 608 bp, Triticum aestivum
  Clone ID: PAT_TA_53155
gtcatgtaattaaggcatttttattttttatatttttttattgcgtgatgagcacagggaagaggggtacgtggttggagaatacatgtgcatgcaggtgcgcgccacatgcacgcgatcggatgtcgatcacattttgaccggccacctgtgcatgcgcagtccaagggcgtggacacggccgtaacgtgctgcacctgcacgccatacacgcccatacgtgcctatccttccgttcccacttcccacatcccgggcgatccatcatgggcatgcatggcattcactgtaggatgcattgttggtcatcgttcagatcgcagcagctgtcgaggggtgacaatcggcgcatgtcctcctcatctttcggtcatccaccggcagcagttacgttcgcccaccgtccgggcgtcccgatcacccgccgaaccgccgcacgctctcctgatctgcagtgatccgccattctggtctctctctctcttcctggtccacatggcaatgcgcgcccgtctacgatggcggcgggtggaggaagaggcagatcgccgagcaatcatcgacggcgtagccccgccgcttgcgccttcaggcgcggacggcgcact

SEQ ID NO: 53156 - DNA, 426 bp, Triticum aestivum
  unsure (1)..(426): unsure at all n locations
  Clone ID: PAT_TA_53156
ggcaaaaaaaaactcttgtacgggttcaacaaggaattcaagatacaatatattaaaggttccagaacccaaacattatctagggcgaaacatcatccaaggtaatcgtctaaataacaatactccttaagatcctggaaatggaccaaaacagtagtagcaaagctatgcggcatctttgtgaagcagcttatcgcttcttggagacacctacagtctttcctctcctgccggtagtcttggtgtcctgaccacggacacgcacgccccggtggtgacgcagaccacaatggttcctgatcttcttgagccactcaaggtgatgcctgagcttgatgtcaacggggttggttacgacctgtgagaacctgccgggcttgtggaccttgttcctgttgaggaaccnttccggtgccttgaactggt

SEQ ID NO: 53157 - DNA, 516 bp, Triticum aestivum
  Clone ID: PAT_TA_53157
gaacaacaaaacaaaagtaaagatgtttgcatacatttacacgctccacagagccgcatggatacatgcaggccggaatgtgtgcttatttacgtacgtacgtaacatttgtagacgtataaatattcaaaccacacaaacataaacacacgcacgtacgtatgcatgtatgatcacactcactcgcacgtactaggcttcggcgtcaagggtgaggaacgcgaacgggcgctcgccgttgaagttgcccgggggattgtagttgcaggtgatgaagacgccccggttccccgtgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctgcagccggaaatcgcc

SEQ ID NO: 53158 - DNA, 425 bp, Triticum aestivum
  Clone ID: PAT_TA_53158
aaagaaaaacgaagtttcaaatggctaaactagaattctggtacataaataattttcgaattatatctactagtgtcatgacaaacactttactgtcgtacaatggttggcaggacagaacaatcttcatgaaaatatgcaccaatcagttgatgaaggataaagagcatctcatgtaacttagtagatcttgttgcaccctgaatcgctgcctaagcttgtcaacatgtggcattaaccattaactggtagtgaacttacaaaaaaattggtgttccacagctgctggattgaagcgaacttgccaaagttctttatcccggcactttccaccattgattttgaaaaaaattgaaactcctactaaagagttcaggcttggaagacaatatgaaggggaggtattgctgactcacgtgtgatct

SEQ ID NO: 53159 - DNA, 133 bp, Triticum aestivum
  Clone ID: PAT_TA_53159
gataggctaggtccaagttttgaacaacaaaacaaaagtgaagatgtttgcttacatttacacgctccacagagccgtatggttgcatacaggccggaatgggggcttatttacgtgcgtgcggggcattggg

SEQ ID NO: 53160 - DNA, 477 bp, Triticum aestivum
  Clone ID: PAT_TA_53160
attggttgcttcaatcaactcattttattttatttttttgagactcttccatagtagagctacatatgtaccccgtactgaaactgcatgcatgcatgctctgttcttcagtcgatggacttaattttgagcaactgacactacatgcatcgcatgcattctggctacagtagttttgatgggatgtactcagagcctcaggtgctgcagcgcagagctaccgtcgaggcccttggccctgttgtgccggaccagctccgccattgtcgtgctcctgtaccgcgcctcgccgtcggcgatgattggcgctagcactctcgtggacgtggccacgtcctgccttcggaagaagcaggccacagagacgcgaggcccgatgctctgggacaccacacggtgctccacgctcttgaacctgtcgttggagacgatctgcaggaaggcggcgacgttgaccaccagcgcaccttgcaccgg

SEQ ID NO: 53161 - DNA, 285 bp, Triticum aestivum
  Clone ID: PAT_TA_53161
gacaacgcacacggggtagctacatacatacactcgatctttctcacatcagagagcatcttacatagtgctactgtgctattgcattacatggctttgataatttttccaaatcgcctgaataatctagctagtcccggcgggtggacagcctatattgtctttgtctgggtgggtttcatgagtgcttgtcgtctggagaaaggccgttgtggtgtggtgcggtctttctgccaggctctgctgtgcgcctaggtggcttcatgccggttttagggtcgttca

SEQ ID NO: 53162 - DNA, 344 bp, Triticum aestivum
  Clone ID: PAT_TA_53162
aaaaagtagtacattcaattcctcatattgtttctgaaggctaacttattcaatcttattacaactgcatgcgagattaacctgaaacttgaatacatatcttctgctgagaattattaaattttgatagcatgcatatattgaaccatatgttgatcatttcagggaaggcttccaggaattaaaacccagcggcaaacttggacttgagaagctccacgaccccggcttccacccggagtgccttggtgagcaccggtgttcgaatgggtgggttgaagcccaaaagtgtgagtggcacaaagacaatgccagagttctggctggtgaaggagacgaccatg

SEQ ID NO: 53163 - DNA, 345 bp, Triticum aestivum
  Clone ID: PAT_TA_53163
gcaactcgctataattctcttttccttccggagaaaaatggacataaattcgacatgatattcttctccacggcaatacaacaataaatcttcaacgattcaggtaccatggcgttgtcgggacagcatgtcaacaccaaaactacatcttcagggtactgttacaagcttacttgcagcatctcgtttacaaacagcacaagttcttctgaattccccatcaccattctaagaactctacaagcgaaatttccagacgcggatgtagttttcaccgtgcgtggtcacgattttcttcatgcccaccgacaggccggtgattggtggacgtttgtgcttgcgaat

SEQ ID NO: 53164 - DNA, 207 bp, Triticum aestivum
  unsure (1)..(207): unsure at all n locations
  Clone ID: PAT_TA_53164
gggtccaaaaccttgggtgggttctcaattaggactggttaaaataaggacaattggggggggacagagcaatagaattacacatggctttttattatttttgggggggggaggaggaaagagctttttgggggnactccccancaaagaatttgatnaggggaaggggcagggcggctaacagggcggtctgggcatgggtggggg

SEQ ID NO: 53165 - DNA, 388 bp, Triticum aestivum
  Clone ID: PAT_TA_53165
acacaaaatgcaccaatctgatcccatttctcaagaacagaagcagatgttacagaagttacaactactccccaaggagattgtcacaaaccaatgtaacccatgcatccacgcaagtacagtgcagtgcatcttagtggaacaccactcctcactgatcacacatccacttgcaactttttcttcttggctctataaacaatggccaaaaccccagcctttcagtgctaccactgcatccaacagctagcatgtgaccatatgcaacttaagatggcgtccaccactatggcataccataaacagtgcttagtttgggctccggccggaattgggctccagtggagctctcctttcctcacgaaagcttagcccacgccttatcttt

SEQ ID NO: 53166 - DNA, 300 bp, Triticum aestivum
  Clone ID: PAT_TA_53166
agtgttacaaggcccgcattgtgggcgttgacacaacactatattgcacaatcctgtgctcgccctcagtacaaaataatcatagggaatcattttgtgtatgaaatgtagtacaacaatccacacaagtaatagagagcaaaaaggcatgaatcctggggtgtcagcacggtgaaagctgagcagagactgatgtactagagatatgaagggaatcacagggacaagggcaggaagataaagcaaatgtacaactacagacacctaaatgactgtggtggaaccaatgatgtttggaca

SEQ ID NO: 53167 - DNA, 554 bp, Triticum aestivum
  Clone ID: PAT_TA_53167
ggtcagaacctgcgcaagcaagcgggagctacatgcaccgggctgcccttgcatgtatgtatgtattgccaggtatagtgaagacggtacgtgcttatgtttttactgccttcctgtatgcatgtatgttctagaccgtacctctgactttttattgtcttcctgtatatgtatgcatcttccagactgtacgtgctagccagtttcgatcagattgattcagagcctcaggtgctgcagcgcagagctgccgtcgaggcccttggccctgttgtgccggatcagctctgccatcgtcgtgctcctgaagcgcgcctcgccatcagcgacgattggccttagcactctggtagacgtgggcgcgtcctgtcttcggaagaagcagaccacggagacgcgaggcccggtgctctgggccaccacgcggtgctccacgctcttgaacctgtcgttggagacgatctgcaggaagtcgccgacattcaccaccagcgcaccttccatcgtcggtgcgtccacccacacaggaaatgacttgttgctgctgctgctgc

SEQ ID NO: 53168 - DNA, 170 bp, Triticum aestivum
  Clone ID: PAT_TA_53168
agctgtcactaatataatctgacaactcgagttttacatataattacatgcatgaattattatatagtaatacaagtagtgcactaaagctagctagctaggaatcaagaacacgaacaacacgagaaacgtgattaaatcctctgagttgatagcgtgctggtcaatct

SEQ ID NO: 53169 - DNA, 147 bp, Triticum aestivum
  Clone ID: PAT_TA_53169
ggaaccgatgggtatcttgcattttattcaagcgtgagactcaaaacacgagccactggcacagaacatatctgccggtgcaacgcagaaccgggcaggagactggtcaggcgacagtgacttgctccgttctgccgaacggggggg

SEQ ID NO: 53170 - DNA, 153 bp, Triticum aestivum
  unsure (1)..(153): unsure at all n locations
  Clone ID: PAT_TA_53170
gaggaacgagcagaccccgtcttatatacttatatacttacccatgcgatgtacaaacttatatacttacccatgcgatgcatgagagcagccccagcatttcaataatttggctcggggggggggcccngaaagaaaaggagtcccgcttga

SEQ ID NO: 53171 - DNA, 254 bp, Triticum aestivum
  Clone ID: PAT_TA_53171
ggaaccaaagctaataatcttaagggacgggggcaaggacataaacccattcgggcctcttgaagctcatgacaacaggggaggaaaagcctactctaccaacaaaatcgccgccttgttccacatggtttgggaaaaacagggtccttttttttacaagcgctgccttgataaaaaatgagtgaggcccccttggctgaaatttggggctggagccgcgggcgaacctcccctgcgggggggggatccttacc

SEQ ID NO: 53172 - DNA, 252 bp, Triticum aestivum
  Clone ID: PAT_TA_53172
atgtcactcgttcctgtcggttggtggcgactcttttttgtatccatattttgcatcaccagttccatgttccaagtcattgcgccaggtgacacagttgagcaacgagtgccagtttgacagacacgcggggggggggggcacacacgcacagatcgagaatgttacaagagggactccggcgacccatccggcgtcttgcgttacatggcgacacctcgcgagcaggacctggcggggctgtgggggctt

SEQ ID NO: 53173 - DNA, 666 bp, Triticum aestivum
  unsure (1)..(666): unsure at all n locations
  Clone ID: PAT_TA_53173
agcgtgttcctatctttcatctttaacggcaatattctcggtgtacaaaagacaatcagtacaagaggatgctcaaagtagaaataaagagcgtttttatcacatacaaatatgatcaataggatggccgtggagcaccgggagggagccagaaccaaacctactgaaggaagcatacttgcaggttgcagcagtcgagttaaagatcgccgctacggacgcatttctgacgaactgatgaagatcgatatggtggacggacacgctccgtggaggagttcaggcgacgtcgtcgacgctgaccaccgcctcggtgccgagctgggtttcacgtggtcgttcatcatcggggttttcgcggcggcactcacggcgccgtgggctgcctactgaaggaagcatagttgcagcagtccagttaaagatcgccgctggggacgcattcctgacgaactgatgaagatcgagaggatggccgcgcacgctccgtgggggagttcaggtgacgtcgtcgacgccgaccaccgcctcggtgcccagctgggcttcacggggtcgttcgtcatcggggttttcgcggcggcagtcacggccgccgtggcggcgtgcatctggcggcgctgcattcgtaagccattgcctncgcagcagcagcagcaagaccag

SEQ ID NO: 53174 - DNA, 398 bp, Triticum aestivum
  unsure (1)..(398): unsure at all n locations
  Clone ID: PAT_TA_53174
gggggtcaaacagggcaaactttttgtttgcccctggaagcacgggcaaaagttcaacccaaagggcgagaatttcagggggggggacaaccacagggatactttggggtttattcagttaaaaccccactggtttgcattttttaccggcacaccaaaatccgcttacgttgaaagacacatgacttaaaaggccaggaagcaactgcacccttgcatgtgggggccctgttttagtgcgccccaaaacgtttggggatcatttggcttatgtgggtgaacctttgagcgcaattactcaggcctttggtttgttcggagctgaacttggtgtcggaagcgcctgtggtgcacttgggccggggctggggtggggccgggggggnggtggggggggc

SEQ ID NO: 53175 - DNA, 540 bp, Triticum aestivum
  Clone ID: PAT_TA_53175
ttttttttttttttttttttttttttttttttttttttttttttttttttttttttttttttttttttttttttttttttttttttttttttttttttttttttgggcggaaaaaaaaattccttgaaaaattttaaatgggggactaaaggggggttccaatttttactcaaaaaattaaccctttttattgttaaaataaaaccctttagggaaaaaaaaaaagggggttaaaaaaataaaaaacactttatttgacccaaaaccaaaaaaaaaaaaatgaatggttaacaaaaaatccccaaaagggggggggggtttttaaacccggtaaaaacttggggggaaaacccttgggaaaatcccaaccctcgtccaaaaatttttaacccatttaatcccccttggcccaagaaaaggggccccccttggggtaaaaaaacttccggttaatccaacggaagatgcccagggggaaaaaaaacgggtttccttcccccccatttggcaccccggcgttttggtttttttcgtttttgg

SEQ ID NO: 53176 - DNA, 505 bp, Triticum aestivum
  unsure (1)..(505): unsure at all n locations
  Clone ID: PAT_TA_53176
gggggggggggggggnnnnnnnnnnnggcagcaanaagacaaacacagcgcngnaacnagggcaaacgggccnncaaaagagacaacagcaaanancaggagggcgggggggganacangccagcgagagaacaaagggaacncncgccagaaggaagggaggggggncaaacangccnncgnacagaagacggaggggggaggggggggagggaggaggaggaggagggaggggacgggggaggngggnggcgggggggggggggggggggggggaggggggggcgggggggggggggggnngggcggggggggcggggggggggnngnggngggcgggggggggggggggggggggggggcgggcggcgggggggggggggcgggngggggcggggnngggggggggggggggggggggggggggggggggggggggcggnggggcgggcgggggggggcggggggcggggggggggggggggggacgggggggcggcgggcg

SEQ ID NO: 53177 - DNA, 641 bp, Triticum aestivum
  unsure (1)..(641): unsure at all n locations
  Clone ID: PAT_TA_53177
gccgttcgccaccgtaccgtacgcccgccgccgatcgagggagatcaaccatatctctgtctgccgcgacctagctagctaggtagagagagcgcgcgcgcgatgccgtcgtcgaggctcgtgccccccaaggacggcgagtggggcggcggcggcgtcgcgctggaggtcaccgtgctctcgggcgagtcgctgcgcctgccgcccacctactcgccgctcccgcgccgcctgcggccctacgtcgccgtctcctcctcctcctccgccggctgcagcacgggcgtggcgcccgcgacgtccggcgcgggcgagcactcgtgggaggacgccggcgaggacgcgcgcctcgtggtgcccgtgggggccgggttcctggagggccgcgacgacgtgcgcgtggcggtgctctcggagtccggctgcgcgcgcctcgtcggcgacacgccgctggggtggtgccgcgtgcccgccgccgacgtgctcgacggcctccgcccgccgcgcgcgctgcgcangctcagctactcgctccgctgcccgcgccgcggcgggccgggacacggcgtcgtccacctcgccgtgcgcgtcctccgggacgtccgcgttggcccccggcccggacccgccccggccgcgca

SEQ ID NO: 53178 - DNA, 726 bp, Triticum aestivum
  Clone ID: PAT_TA_53178
accagacgtgcgacatatagcataccgatctatgtgctgcagttagaggaccttacgacaaaggagaataatggcatcctatgaaccgctcatagcggtccatcatgcttgcaagtctgcttgctcatccacgacagcagcaccgatgaacatgcagctgctacaccggagaggaacatggcatcgtgctgtcctatagaacagtctatgtcgtatagcgcgtttgcgagtgagcgcgaattcgagcacaatctcagcccggcaactcatctaagcagacatagtgcgatagaggtaggcatatgatatcctgcctccactcaaataatgctctgccatataaatggaataggcggtgcataagctactctaatactacctattgcatactatactatcaagaatgttgagtcgacaggactcacaaaataaacctggatcaaaatatgatcaaaaaactgaaacatggcactcgatgtgcacgatccattccttacgtacgagaagatgcgacaatcatcttccgctatacggtgacccatgagacgttcatggcacagcaccgtacactaaactggactgacatgaccgtgattacatgcaagccaaatggattgtacctatgcgtccttgccccagttgacagcattatcctgaagatgagacaaataaagcaaaccatggcttgcgtgtgtgatactatatcagattaccactctgatgcct

SEQ ID NO: 53179 - DNA, 684 bp, Triticum aestivum
  unsure (1)..(684): unsure at all n locations
  Clone ID: PAT_TA_53179
cggacgcgtggngaatctatatatccccaattcgtcgcacatcgaacaagaccgcgtcccaaccgaaaatccccaattccccaccaccgacagcgtcggtgagagagatggcgtcggcgacggagatgcagccgctggcaccgtcgggctaccgccgggcgccggagatgaaggagaaggtggaggcgtcgtcgatcgacctggaggcggggaacggggagacgctctacccggggatctcgcgcggggagaacgccctccgctggggcttcatccgcaaggtctacggcatcctctgcgcgcagctggtcctcaccaccgtcgtctccgccatcaccgtcttctaccccaccctcaacgccacgctctccaactcgcccgtcctcgcgctcgtgctcgccgtcctccccttcatcctgatgatcccattgtacatctatcagcacagacaccctcacaatcttgctatcttgggtttgttcactctgtgcttgagcttcagcattggtgtggcttgtgcaaacactgaaggaactattgtgcttcaagcattggtactgacctcagctgtggttgtctctctgactgcatacacattctgggccgcanagaagggcaaggaatttagttaccttggaccgtttctgttttctgctctcaccatcctggtcgtgataagcttta

SEQ ID NO: 53180 - DNA, 658 bp, Triticum aestivum
  Clone ID: PAT_TA_53180
gtacgaaaatgtagacacatgttacttcaaacattgagccattcatagaaacgtcttgcacgttaaatatcgaacttcagagttcacactaaactagataccgctgagtctagcagaatactgaaacattgttctgatatgctggtaaaagagttgcacgcaaaagcttaataccggcactctaacagaggttataaacgggtaccaaacagatatacataacacataactcccaacattgttctgcgatgcgtttcatagacaattccagtcttcagttcttcaccatgagttagttaatccttcagactggttctacctagccactgtgggtcatcatcctgttgcaccaccacgcccctacaaggtcatcttgcgctgcgggttctggatttcgcgtcactcagacgcttcacttgaccgaacaagtactcgatgctctcactgtgagtggcttttctcttgcacttgtaattccagacctcgggtacaatgtttctatctcccagcctgccactttcttgaatttctaccaaacaactcaccacagccttgtgcaccccttcaccccatgcagcacatagcccttgcagcttgggatcatggacatgaataatctgcttcgggataccttaaactgtgacagacttggaaggga

SEQ ID NO: 53181 - DNA, 338 bp, Triticum aestivum
  Clone ID: PAT_TA_53181
caaccaacaaggatctttgtattagctagctccattattccgccattttacagcttacaaagaaaagagatactccagcttcctccttgtcgacacaacgaacgaataactcagctgcgctgggccgcgccgcgccctacatggtgcaaaaaggattcatatcctacaaggtatgtatcctttgagcttgcgattccgtttgtgagtcggcgacggcggtgtcttctacgacaaagctctcgatcttgtggagcgactcgagagcaatatcaatcggtgtcagcttagagacgtcgtcatggcccagcttagatgcgatctcttcgcggacgcgtggg

SEQ ID NO: 53182 - DNA, 612 bp, Triticum aestivum
  unsure (1)..(612): unsure at all n locations
  Clone ID: PAT_TA_53182
gcaaacgtaggcattcatcttcctcgggtgttctgccacgtgctatagtgcctttgattggttttgcctccagaactgcattttgatctagccgcagaaaccgttcaggagaagagcagcatatactcaggttttctgaggagaagttaagccaggctgcatagggagctggattttgctttctcaatttaaggtacagttgaagagcatttatatactctatccctctcctcatccgagtggtcaggcataactcgtaactttctccgtctctgatataatccaggcaacttcgaacatccttaatgtattgatcctttgatttttctacgacaaaactttgcttattcacattggatgatccaataagtgactttncataagtcggtagtcctggtgacatagcagncatcctgagaagcttcttctcagncttcagcaaccatgaagtgtgtgtnngattatggngcatnccattnncattacttaaagaatatcggngatataatgacagaatatatacatgaccatttggtgngatcgatcgtgacgaggttattagnttagaagaagtttctatcaggagttcttgattcagttccgtcagatgat

SEQ ID NO: 53183 - DNA, 689 bp, Triticum aestivum
  Clone ID: PAT_TA_53183
ctcggctccttcttccttcgagtttcagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtggttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcctaagtactcgaaggctcggtgtgaggaaattgtcaaggaagtctcttcgtacctgaagaaggttggctacaaccctgacaagggtcccttcggacccatctgtggggttgagggtgacaacatgatggggaggggcaccaaccttggctggggcagggcccttcccttgttggggctgtt

SEQ ID NO: 53184 - DNA, 449 bp, Triticum aestivum
  unsure (1)..(449): unsure at all n locations
  Clone ID: PAT_TA_53184
gacccagcgnccgcgcgcctctggggcncccnccncgagcccgagcgggagcgaggggacgaggagcnccngccgccccgagaccccgacggccggcccccnccncgccccgccgcngcgnccggcgccgccacggccccnggagccagggaagccanggccngagcncggccncgagggccccgccgccgncnccggcgggggcggccccgccgccncaccgcccgagcncgccgncgcgccgccgccggcncnggncgccnccaccnccgcnccaggcaacccncggncgccggcncgcnggagcacgacggcagacgaaggangccnggnngngngcgacggangcagnncncacgcgcaaaccagggnnggagccgccagcacnncancccgcccgccggcggcgagncnncccgncccgnaccgccgccnccccgnnancacag

SEQ ID NO: 53185 - DNA, 542 bp, Triticum aestivum
  Clone ID: PAT_TA_53185
gctggtacgtgcgtgtctaggtcgaaatggaggtatcgagcagcaccatgctgaagccggcctactccacgcctcatcttgccggcgagatggtcccgctgaccctcttcgaccgtgccaccttggacatctttgtccccctcatcctcgtgtaccccgcaccgactccgtccaacgatgccctcacggagggcctacgcagggccgtcgcggtgtacccgcacctggctggacgcctcgccgtcgaccaccggggcaggcgtttcatccacgtcaacaacgagggcgtgcttgtcgtagaggccgccgtccccgtcgatctggcgagcgcggtcactgatggcagtttcgtcaccgacaccgatgggctgtaccctgcagtgccgccgccggaggagagcatcggggcggcccttctacagatacagctcaaccggtacaagtgcggcggcctcgcgatcgggttgagcagccaccaccaggccgacgacggctactgcgatggcaccttgctgtgcacgtggactagcgcggtgcaccaa

SEQ ID NO: 53186 - DNA, 436 bp, Triticum aestivum
  unsure (1)..(436): unsure at all n locations
  Clone ID: PAT_TA_53186
cggacgcgngggnngaagaggagggggaggagggcggnagcancnncagcaaaccggggggcccnnannanggacgcnggaacggggnncacancccaaggggacgaacnnncgcaanaanncccccanaaggaccggannanggagcagngggaaaanaacnaccacancagngccanagcgggggcaacaaanggaagnnccnnggnggncangncaaaaggaaccccnnacacncaacagncnnacaaagncagngaancannccccnncaagnggancaacaagaaanggaaagaagganngcangngacancaangacnacagcagggacccgcnggggnggagnnangncaaggaacacngganangcngaacaggnggnagaangggannggcnnaaacccagngaaggggnncaccggcgangggaga

SEQ ID NO: 53187 - DNA, 199 bp, Triticum aestivum
  unsure (1)..(199): unsure at all n locations
  Clone ID: PAT_TA_53187
cgcagggnacccccancaagncgccaaaggggagcacggggaccaaacacaaaccngcagagagcgggaagaaaccggncccacnggnnnncnncnncngcacagcgcgngccagcacagancagnccggcgccgnggccangagaagagnggngngcagcngcgacgnngaccacgacgaccaagaggggggggggag

SEQ ID NO: 53188 - DNA, 253 bp, Triticum aestivum
  unsure (1)..(253): unsure at all n locations
  Clone ID: PAT_TA_53188
cggnacgcttggnngaaagcatatctccctacgaagagagttgtgtgnctctatggctatggcgaagatcattctcctcctcctcgtcctagtacccattcgcatgggagccgncctgatggattgccctgatgtgccgnnactgggcgcggnggncgnctgncacaaggcgtgnggnacgaaactcatgtgtgaccttngnatncgnataatgcgcgaaggggatgnnaacatgnnnncgnnnacacggagg

SEQ ID NO: 53189 - DNA, 562 bp, Triticum aestivum
  unsure (1)..(562): unsure at all n locations
  Clone ID: PAT_TA_53189
gacccagcgnccgcccacgcgnccgcggacgcgngggccgcccccgaacccaaacccnaccccgccgccgccggcgccgccgcagcgcgcggaggcgaccncgcaccgccgccaagaggcagancnncgngaagacccngacgggcaagaccancacgcnggagggggagnccncggacaccancgacaacgncaagggcgggggccaggacaaggagggcancccgccggaccagcagcgccncancnncgccggnaagcagcncgaggacgggcgnacccncgccgaccacaacagccagaaggagggcacccnccaccnggngcnccgccngcgcggcggggccaagaagcgcaggaagaagaccnacgccaagcccaagaagcagaagcgcangcgcaagaaggggaaggncggcgncccccaggncgacaagggcgacgaccggccccggggaggggaccagggcnnaggaaggagnggccnaacggcgaccgcgggnggccggcgcgggaggggcaaccacggggggccgggccggccgggggggaggggcgggcg

SEQ ID NO: 53190 - DNA, 371 bp, Triticum aestivum
  unsure (1)..(371): unsure at all n locations
  Clone ID: PAT_TA_53190
gacccagcgnccgcggacgcgngggccgccgcgcgctcgcggacatgggcgcccgcgccgcccccggggacgggctctncnnccactacagcggccacggcacgctcgncccgccgcgccacggcgacggcggcgcggaggaggaggccancgngcccaccgactncaaccncancacggacgnggacccccggcaggggggggaccgggngccgccgggcgcgagcnncaccanngngnccgacncgngccacagcggcggccccancgaccaggagaaggagcagancgggcccnccgncggcnccggccccggcgcgccgnccgcgcgcaccgnccggnnncnncccnacggngcgcnccnggaccac

SEQ ID NO: 53191 - DNA, 261 bp, Triticum aestivum
  unsure (1)..(261): unsure at all n locations
  Clone ID: PAT_TA_53191
gacccagcgnccgcccagcgnccgcccacgcgnccggcgcaggacaggcngggcggcngcgacgnacgnccgggggggcaaaggcnggnagancgagcnganncccanaagnnnagacannnanggggaggcagacgngnnaanccccacnaaggggggcnaannnncngnagnngangggacgggaacgcaaaggggggaacgggnnnnnnnggggaggngcaacngnnngancganggcagagnnncgnccgcnaaggg

SEQ ID NO: 53192 - DNA, 690 bp, Triticum aestivum
  unsure (1)..(690): unsure at all n locations
  Clone ID: PAT_TA_53192
gtcataaacccaagtcggactcgccttcctcctcccccaactactcctcctcgcctccgcgcatcgcaccgcaccgggggtncacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctggagcggatggtgttgctaacatcaatgttactgactgccatatcccccttactggaccaaattcaattgttggccgtgctgttgtcgtccatggtgacgctgatgatcttggcaagggtggacatgagctgagcaagagcgctgaaaacgctggtgcccgtgttgcttgcgggatgatagggctacagggctgagtggggtggtggggcggccagcggggggcaagaggtggggacctgggggggttgggggtgggggggggggggtgggtgggtgggggccggggagcgggagaggctgggggggggggggggcgggaagtt

SEQ ID NO: 53193 - DNA, 322 bp, Triticum aestivum
  unsure (1)..(322): unsure at all n locations
  Clone ID: PAT_TA_53193
gcgcannggcgagaaacgggggcagaacccggcgcgccccaaagagcngcgggcagcgnacgagcacggcaccggcaagcccgacagggngaagaacaagancggagccancgacaaggccgggcgcacnngcngggncgcaacccccaagcaggacggcgnggaagnngccgcngcangcgacgagggggcgcanaacnngcagcccgncggcncancnncgcccgggccaagaaggnnnnagccgaccgggancngagcacacccannngcncgcnggcacccgccgggggcgccaagcgggggcgggaagaagngacaa

SEQ ID NO: 53194 - DNA, 701 bp, Triticum aestivum
  unsure (1)..(701): unsure at all n locations
  Clone ID: PAT_TA_53194
aacaagggggggcgaaggagaccngaagnngcnaggcngggcggggagcccanncgnagnncgggggcgcagggcgcnccacangaagggcnngagcnagcgaggnancgaacaggaccccngcaacaagagngagcngccgcgcagggccaacccggnggagacgagggggcccgaacncanccacgagggcaagaccaaacagcggggggcggccanggggcggggcaggggcgaaggcggggccgacaagggcccggggggccagcgggggggccgcggggagcgcgccaccggcgggcggggggcgggcgggcgggggggcgggnggggggggcgggggggggggggggggggggggggcggcgggggggggcgggggggggngggggggggnggggggngggggggggggggggnnngccgggggcggcggggggggcgggagcgggggggcgggcggggggggggggcgggggggggcggggcgggcgggggggngcgcggggggcgnggggnggggggcggngcggcgggnggggggggcgggggcggggggcggggggggggggggggcggggggggggcgcgcgggggggggggcggcggggggggggggcggggggggccgcgggggcgggggggggggggggcgggcgggggcggggggccggcggcggggggccggggcngggggccgg

SEQ ID NO: 53195 - DNA, 341 bp, Triticum aestivum
  unsure (1)..(341): unsure at all n locations
  Clone ID: PAT_TA_53195
gaacccagccgcgaggggggagagaagacgaacncgccagaaccggccaaagagacaccaaagcggccggagngancagcgggccaaaccaacagggaagagacgaaggacccganngaaagccggaagacagcgaaggaaggaggcaccacacaagggaaacccagngccaggcccagcgcacacanngagganggcagnagcgcnacccgngcagcggancgccggcgganggccaangaggccgccgaggagagcacaagaacgnggagcaagggncgcaaancgncaanggagggncncccaggggcggacgcacacgagaanggcggnaaaaaggg

SEQ ID NO: 53196 - DNA, 561 bp, Triticum aestivum
  unsure (1)..(561): unsure at all n locations
  Clone ID: PAT_TA_53196
cgggaggagggcaaggnggaggnggaggaggacggcaaggngcnggncatcgccggcgagcggggccngcggagggaggccaagagcgagacgcgccaccacgncgagcgcagcagcgccacctnctncggcaggnnccacctccccgacgacgccgcctngggccaggncagggccgccatggacgacgggggcgngcagctcaccgncaccgngcccagggncggcgccgccgncgccgnggccatgccagagccggccgnggccgncgaggtcgncgaggccagcccgtgctgatcgccgactaattaatacggcagacgtacacgtagtatgtatgatctgttcgatcggtccgcagggtatgctctgtggttttgttgtgatgccataaattgtggcgcttggtgtacgtaagtacgtacttccgcatgtctgtggcttgctgttgtgagcgagctgcatgcctgtaatatgcatgcatatttgcctgtactattacttgtcagttgtggtgttcacggtcaaattaatgaagtngtcacagtcaagttaatgaag

SEQ ID NO: 53197 - DNA, 446 bp, Triticum aestivum
  unsure (1)..(446): unsure at all n locations
  Clone ID: PAT_TA_53197
cggccangcagnacgncggcnccacgccgccggcaccgccgaaggcaccaacggcanccaggagccgcacacncggcgcagggacggccgcncgccgcngaaggacgaggcagagaaggggaccaagngccncgaagcggcgancnccagaagagnggccgaggganncacgcnngagcncngcgggagggacagggnggggcngcngncggacgngacgagggngcnccgggagcacggccngacggngacgagggccgacgngacgacggngggggagcaggccgngaacgnnnncnacgngcgcgacgcgncggggcngccggnggacaagaagaccancgagggccngcggggacaggncggccagaccggcgcgcccaacgcgaagaaggngcccgcngccaggcgccggagcggaccgcnggcngcgngggcaagaccag

SEQ ID NO: 53198 - DNA, 404 bp, Triticum aestivum
  Clone ID: PAT_TA_53198
gaagcgataaaccatttgtcttgtttataattagactctgcctatcttatcatcctttaccactagcagcattacacctttgagagagagagagcctttgcattactgcttattgcttacgcggaaacgaatgaatcaaatggttccacacatacacagatgagctatctgggagctcgactgagttcagttcatacacaacagggctagccccatcttatatgaactatataaatgtctaaaacttgacggccttctcaccttcacaaagccccgaccaacaggaagctcatgactgcaatatgacccgcgcggagtccccgggctcgcagaccagcccgcgacgatccccggggatcttgctcaccagctctggctgggccctgtggtactcggcgccaacg

SEQ ID NO: 53199 - DNA, 549 bp, Triticum aestivum
  Clone ID: PAT_TA_53199
gtgattcacgccacacttggggcggcccttgtgttcacaatatataggattacatgccttggtaatcaaggtgaatcaaagcaaatcctcaaccgaatcatacaacaatatttggtgggatattgtgctagtttcctattacatgaaatacagacaaaaggaatacgttaacaccccccccccccccccttagcttgtgcgtcgcacggaagcaagcataagctagagcgaaactcagagaagagttgtgagggcaatccttttgtcataatgtcagcgtactgatgcgaggatggcacatgaaggacccagacctcaccaagcgacaccttctctcggacgaagtggatatcaatctcaatgtgcttggtacgacgatgctggaccggattagaggccatttagacagtactaaacgttgtcacagaagacaactgtcgtagacgtcagaggtgatggagctccccaaggagctgacggatccaacaacactcaacaacaacatgagcaaccgcgcgatactccgtctcggtactggtgcgagacaca

SEQ ID NO: 53200 - DNA, 511 bp, Triticum aestivum
  unsure (1)..(511): unsure at all n locations
  Clone ID: PAT_TA_53200
gccaggcggagacggagaagagggcgcggtcctgccagcacaggaagaaggtgcccttctcctcgcggaccttgaagccgtcgcagcccagcccctgcgccgcccggcgggcctgcagcagcgcgtagtagctcagcgggacgcgcccgaagccggcgccttccatgcgcgccgcccagcggtccagccgctcgtgccgctcgcggcggtccgcgccgtcgcaggccacgatgttcttgatctcctcgcccaggagccaccgctcgacgcgcgcgcgctccacggacccgcgcgccgcgcccacctccaggcagtcgaacagcgccgcgtagtagttgagcgccttcacgaaccgctccgttagccccgccgtgttgtggctcggctcctgctcgcaaaccaccatgaccttgggcgacagcccctacagcgcgcccagtaacgcgttcgtccgcgaggtggacggtgacagtagcccctacgagtgcggtctgctnctacgtcgattctt

SEQ ID NO: 53201 - DNA, 140 bp, Triticum aestivum
  Clone ID: PAT_TA_53201
gacaccaatagcataaacttgaccttaatatcagtgcggatcgggggacattgtatttaaggaaaattgaccggggacgatgcaaggctcatactggaactgacactgcacccgtgggatggggaatggttcgagaacgc

SEQ ID NO: 53202 - DNA, 293 bp, Triticum aestivum
  Clone ID: PAT_TA_53202
cggggaaacttttttcgggcccggttcccagttccgggccataacaaagcaaaagctcccgggcttgcttttgggcagggaaaggccctcctaaaagtccccaggctttttttggggatccaggctacaacccttttccggcctataaaccggccggctcccaaaaagccccggggccccccttttttccaaaacccaaaagtcccgggcggggcccccggcttttttaaaactgcggcggggcccccaacccccgaaaaacgtcttgggggggaactttccctattactgga

SEQ ID NO: 53203 - DNA, 493 bp, Triticum aestivum
  unsure (1)..(493): unsure at all n locations
  Clone ID: PAT_TA_53203
cccacgcgtccgcccacgcgtccgcccacgcgtccgcccacgcgtccggtgatgaagaactacggcgtgacctgcgacgccgaggtgctcgacatgctcgacaccgccgcgcgccagctcgagctgaaggtggtggcgaaggtgtactggggcgacgccagggagaagctctgcgacgcggtggaggagcagaagatcgacaccatcgtcatgggcagccgcggcctcggtaccatccagaggattcttctgggaagtgtgaccaactacgtgttgtcgaacgcgtcgtgccctgtgacagtcgtcaagggagaccgttaggttcgccatcgatgtgcatcaggatgcgcttaatcgatctctgctccgatgctgcgtctgaataaagtatggagcctattgagttaactgaataccgtangatagggagattactggaatctggggtgggggtgaacatgtggatgttagttgtattaagtgtttttcagtg

SEQ ID NO: 53204 - DNA, 760 bp, Triticum aestivum
  unsure (1)..(760): unsure at all n locations
  Clone ID: PAT_TA_53204
cttctacaggaacaatacaagcactccaccagtatcctatcttcaatctactatcacccatgtccattatgtctcccctcattcggcattgtctaccttatggcatgtcaagtggaggctcatcaccactctaatactccttcaaattgtacacaatcttttctttcatcctcttcgaaaggtccctggtcctttctttgccagagccagtagcctttggagaatcatcaaatattttcgcggaacctggcacgatgatattatggatctccaccgacggtatggacaggttgtcagaatctctcctggagaagtaagctttacagatgaacatgcaatcaagaacatatatggtcatggcaagcatgttgcaaagtccagcttttacaacggtttccttgtaccgaaaatgacgatcagcttcttcgctacaagagacaacaaagtccatcgattcctccgatcacgcgtcgcaagtacatactccatgacatcgatcctctctatggagtcattgatccaggatgtcttggacctcaaccttaagaagctgggcgaacgggcagacgagggcaaaaagtttgaagtcgacaagactgtcaactactacacctcggatgtggttagccagctggccttaggtggaatggtcggatgtgtagaacaacaaanagacattggangtattatccagtctgtgcatgatgggttctacttcatgggtaacttgggggtactaccantgcagatgttctggatt

SEQ ID NO: 53205 - DNA, 800 bp, Triticum aestivum
  Clone ID: PAT_TA_53205
gaagtcatcagtatcttgtttgctatcatgactggagcaatgtctttaggtaatgcaaccccttgtatgacagcctttgcagagggacaatctgcagcactcagattgttcacaacaatcaagaggaaaccagagattgatcctgatgacaagactggtaagcagttagaagatatcaagggtgatgttgagctgagagatgtgtatttcagctacccagcaaggccagagcaactgatatttgatggattctccttgcatgtgtctagtggcactacaatggctatagttggggagagtggaagtggcaagtcaactgtgattagtcttgtagagagattctatgatccgcaggctggtgaagttttgattgatgggatcaatatcaagagtttacagcttgattcagtaagagggaaaattggtcttgttagccaagagcccttgctctttatgacctcaattaaagataacattacatatggcaaagaaggcgcaacaattgaggagatcaagagagccgctgagctcgccaatgcagcaaatttcatcgataagttgcccaatggttatgatacaatggttggccaacgcggtgctcagctttcaggggggcaaaagcaaaggatcgcaattgcaagagcaatcattaaaaaccccaaaatacttttgttagatgaagctactagtgcattggatgtggagtcggagaggatagttcaggaggcactgaataggatcatggtggacagaacgacgcttgtggttgctcatcgtctaactactgtcaggaatgctga

SEQ ID NO: 53206 - DNA, 637 bp, Triticum aestivum
  unsure (1)..(637): unsure at all n locations
  Clone ID: PAT_TA_53206
gacccagcgnccgcccacgcgnccggcacaaacaagnatactcatcagctatggaatagnatacacgangnngccacaagnnatnnngagccatctcggttccattggcgaagttgcctcaacatggctctctgaaaacggttatctcagcacacaatgcccaccattgcctaaaggcaacatcaactatgacatttatatgggctatcccgagatgttcgcttgggacaagaaacgttgcgttgcctacgtcagcaacctatacaacgccactgtcagtacttgggatccttacaagggtgttgttcttgacaccattgaattcccaggtctcagtcacgctggtgattcagccagcccgaacccgctacatgctagcggaatcatcctgagacctgatgcgtataatcctcacactctcgaagtcgngattgacaatggagacgctttctacagtgatggtttcaacgtgtcgggacccgaccacttgatgactattgatctcaagacgaaagaggttacgaataagttgcgtgtcaacaacggcctttatgccggctatgcgggtgccaggcttggacctggtggggacacatgtggggctgggaacctccgcctcggcccttctgcgggggtc

SEQ ID NO: 53207 - DNA, 390 bp, Triticum aestivum
  Clone ID: PAT_TA_53207
cccacgcgtccgagccaagataactgtaaaaaaacgaacttccgcagcatccatcatccatccatctcttcgccccgcaccaaaccaaaaccctcaccggctcgcagcgacccactcgccggcgcggatgggagcacccagcgtcggcgctctcgccgcttatccctaagcagtccgcgcgccacgcatctgattagacgctcgttgcgtccccagagatggcgacgggatccatggaggcggccctcacgagcgatccgacgatcaagctccccgacgacctcctggtcgagatcatctcgcgcgtgccctacaagtccacctgctgctgcaagtgcgtctccacgcgctggcgggacctcatctcccaccccgaccaccgcgagaagc

SEQ ID NO: 53208 - DNA, 722 bp, Triticum aestivum
  Clone ID: PAT_TA_53208
gactccacgcccgtccggcccgagtagagaccgaccgggcgctacctactcctcgtctccgatgcctctcctcctgcttcaagaccttccatttgtcggcgtcgccacaccactgaaccgtgaagtcccaccggcgtgatgtccatcgcgtgctgcttgccggtggtggagtgcgtgtactgcctggcctgcacgcggtgggtgtggcagcgctgcctccacaccaccggctacgacagcgagacctggggcctcgcctcctccggcgagttcgagccggtgccgcggctatgccggttcatcctggcggtctacgaggacgacctggagaccccgcagtgggcgcccccgggcggctacggcatcgagccccggtgggtggtgcggcggaggacgcccgagcacgcgcaggggcgcgccccgacgtacctgctgtacgtcgatcaccggcacgcggacgtcgtgctcgccgtccgcggcatggacatggccaaggagagcgactacgccgtgctgctggacaacaggatcggccaggcgggcttcgacggcggctacgtgcacaacggcctgctcaaggccgccgtgtgggtgctcgacgccgagtgcgacgcgctgagggacctcctggccacgaaccccggctacacgctcacgttcgccgggcattccctcggctccggcgtcgcggccatgctggcttttctggcggtgcgccacag

SEQ ID NO: 53209 - DNA, 204 bp, Triticum aestivum
  Clone ID: PAT_TA_53209
ggggagaccctttactgaacccgaatccaaatggtcaaaaacatacaaaattaccggaatctgccaaacccgggggatacaaaaaacacaataggccccatactttattcaaaccccgcaacggggcaaaaaacgatgaaacccctcccgaggcccatggagggggaacctaacgggaacacttgacaactgggacagggcccc

SEQ ID NO: 53210 - DNA, 554 bp, Triticum aestivum
  Clone ID: PAT_TA_53210
aggcaacagccctgaatactcttgtttttgcaaaaaaagaaaaactccaaatctgacactttgaactttaattttgcacccccccccccccctttgggggaggggcaatgtccactggaaaactactccatccctcccgattcctgtttcctcccaatcaccggatcgggatcccattatttgaaactagctaacaaagcttctacaacctaaccaattcaacaagggtttggaaaaaaaaaacagggcattgttgccccctgggggaagaaccaacaaagagaatcaatggccatgctgcttcgagttcaaaagcgttttcctcaagctctccattggggactggatcttatccgacattttttgggaaagccatttttgggctgccttgtttaacccctccggggggatgggtggccagccctttttttcgaagggtgggtcttgggggttcatttgctgccacctgctttaaacctgccaaataaaaatctactgggtctcccacaaaaatttgtttttcctttccccaaaaagggaatgggggaccgggt

SEQ ID NO: 53211 - DNA, 564 bp, Triticum aestivum
  Clone ID: PAT_TA_53211
acctaataataaacaaaaatgggtgtctacagaagaataacatgtatatctttacctaataataaacaaaaatgggtttctgcccgtacgtcgtcagcctttttgcagaaaagtccctccatttattagaattcaacccgccatcctattttaagtgggtatatcagaaaatgcttcatttttacaaaaacaaccctgcattagttacaatcctacccgcgatccttaattaaactgcttcaccgcgttctccaccgccgggtaccggccaccacttgccgtcggcgtccacgccgtaggagacagcgaaggggtgatgcgtcgcggcggaaaaaaaggtaggaggcggggtcagcctgctggtttgccaacgccggagaggctcgtggcagggagcttctctcctctgcttcaggcacaagtcggttgaagcgctcgggctgcagagctacggggcgggggccgaagggtggcgaaggcgctggatgggacttggtgcaggtctccggtgagatggagatggcgtggagggggtctagatgccggcgggtccttggccggcgg

SEQ ID NO: 53212 - DNA, 702 bp, Triticum aestivum
  Clone ID: PAT_TA_53212
ccttacaaattccgctttgagttgggcgtaacagaggcgaagaacacctggaacaataattccaccagaccaagaggcagtctaaagcaatcaaccgtagtagtactatcttgaacggttgaagtgttgaagcacaatagcaaacgaagtcggggcatccccagcgtcagtggaatttccacgtcgcacgcagagatgggacgtttcattaatccgctgccactctctcagctccgcctatacatcacacggcacaatctcaaaccacggataatttttctaaatcaaagcccaaaccctcgtcaggttgcatcgaggctgccggcagagcacacccaaccagccccaatcagcgtccgtccgattatagtacagcggcgatcgtcgcgcagactgcagacataaaactcactcccggcagcaagctcgctcattgcgcgcgctctctgatgacgtcgaagcccatctcggagcgctcggtggcctgcacctcgtagtggaccccctccagcacccgccgcaggccttgcttcgacgtcgcgtacagaatcttggcccttatcctcgacgccgccggcgaccatgcgatgaagaagatcttgctcttctggcagttgtcgacggagacgaagtcgaagtcgaagacggcgtagcggcagtcgtcgccgggcagcgcggcgacgagctcgtcgtacccctccc

SEQ ID NO: 53213 - DNA, 657 bp, Triticum aestivum
  Clone ID: PAT_TA_53213
ggcctatctaattctgaatagttgcaatctcaatctacctatcgccctaacattactattctacatagcacgaagtaagtcatccataactgaagatactttgataagctcttcatcctggaaagggcgaccaacgacttgaatagtggatggttgggatgagaacaattcgggtttgtagagttcatggtttggcttatcgtaggggttcgtctccaacggtttgtagttggaggcaaccgggtcatcctgagggttaactttgaagttggccaccggcaaaataacagacgggtagtccaaaagattgaacagtgacgtgtacccccagtagacattgaagtcgtgaggatatccaacagcgggagctgtagggcagattagtgcatcgacaggacgaccagtgctggttagtttagttggggcatcccatgcgtcacggaacttttcccgaaagattctagccttgacattcaactgttgtgattctgcagcgcttatctctttacttccaaagaccttgatcaagtcttcgaaagcagggatgagaggctcgcctgttgcctcgagcgtagacagtgtcccgctgtgcccagactggtagtaggtgtcgaacgttgtctggatggcgtcccagcatcaaatggtacgtcaaac

SEQ ID NO: 53214 - DNA, 481 bp, Triticum aestivum
  Clone ID: PAT_TA_53214
ggggaaactaaaaacaaagttgaagcccctggggcctgtaacaaacaattggccaagggtagttctcaaaaatcatcggaacattttggactagggggacttttccaacaggcccaaacacattggctggttacttgggtttgaacaacttggccattatgcttttaaaagccggggcgctggcgctgcacctttgatcggggaaacacgacctcccttccttgggtgccttgcacaactgcgggtccatcggcaccttacccaagaaagggacccccattttatgggacattttttccgcgccccccttgctggtgacaaacacctcgttggaggccacgaccgaaaaaaactccggagccttctccttgatataaaagatcacccactttggggggaatatctccccggagagacctgactttacaaatttaagggctgaaaaccccttcctcaagccactcatttggttcacaacccc

SEQ ID NO: 53215 - DNA, 413 bp, Triticum aestivum
  unsure (1)..(413): unsure at all n locations
  Clone ID: PAT_TA_53215
aagagcgacncggnngacccnnngaacagcgagaaccangccggggagaaggangcnnnggnaacngnggcangaaaagaggggngngcgganggnggcganaannanaagggagnncaagnncncagcanngncaaaaaggangaggggggggaaagngnnganncnannaanccggggacagnngcggggnanagagaggagaagggcgccncnggnncnacnncngcagnnacggcggngcgagcaccnggcncccgcncancnggggnccanggngngaccaggcanaggnggagngggaaanangaagcncannngngggacagnacnngcagagnagaaggacggagaaggaaagggaagcaagnnnannnaggaagnnanganacngagcaaaaagcngccagggc

SEQ ID NO: 53216 - DNA, 207 bp, Triticum aestivum
  unsure (1)..(207): unsure at all n locations
  Clone ID: PAT_TA_53216
ggggacgcgcccggnagcggcgcaaaaagcgcggcgggggggggggnaacgcgcagcgggaccgcnacacnggccagcgcccaagcgcccgcnccnnncgcgnncnncccnnccnnncncgccacgnncgccggcnnnccccgncaagcncaaaancgggggcccccnnaagggnnccgaaaaagngcnnaacggcaccncgacccc

SEQ ID NO: 53217 - DNA, 395 bp, Triticum aestivum
  unsure (1)..(395): unsure at all n locations
  Clone ID: PAT_TA_53217
gacccagcgnccgggcgccgcgcccgcccgccggccagccggcgcgaccagcnncacgagnggcggccggggggcggcgaggaacccgcnngagacaaggaaccnggagaggaacggcaggancaccngcangacgnncccgcgggacgggcngcggagggaccngaacgngancgggnncgggcngancggggggggggggccgncgagcancccgcngancaacggcaacagccngacggggcncnngcncnccagcagcggcgaggagcacgcccacnnccccacgcccccggcncaccagacgcagagcgggcgggggngggngacgnggcaccngggacgggacaacgcgcgcaccngcggccagaacgggggcaagggcaggaccgagg

SEQ ID NO: 53218 - DNA, 425 bp, Triticum aestivum
  unsure (1)..(425): unsure at all n locations
  Clone ID: PAT_TA_53218
agacagacaggaggagcagaagcacaagcaaccagccgaggcgcgncgncccnngnagacagnncgaaaggcgncngganccancanccancccgncncgccagcagccgaccanggccgcgcaggcgccgccgccgccaccgccggagcagaagaagaggggggggagcgacgagagcgagngcagccacnacgcgcccgagngggcccngcgcaaccnngcgccccgccgccccaaccccnncacggnccagcccngcnccccccncagcnaccnccccgccggcnccccgcgagcagncgggccgncggnggcgacgccggagcccaacaggnccgggaccgagcaccagcggcagcacgaccaggcgcccggcgacaaggccaagggcangngcgccgaacacggnggggacgcagagacc

SEQ ID NO: 53219 - DNA, 330 bp, Triticum aestivum
  unsure (1)..(330): unsure at all n locations
  Clone ID: PAT_TA_53219
cgncncattttcggtccnngcntgtcgtgcggcagccgngaccgcgtgcgctcctcgcagctgccgccgtgtgttgtcgccgccggttgtggtggtggttgtcgtggctgtcgttctttttcgtcctcctgtgctgcgngatcgtctgtcngctcctttcctccgtcgtcttcctttttctcttcggcggggggtgggctctgtttttcttcttttctttttttttgtttgttttgtttgttttttttttttttttctttttttttcttgttctttttttttccttttgtgtttttttttttgttggtttttgttttgtttttttttttt

SEQ ID NO: 53220 - DNA, 376 bp, Triticum aestivum
  unsure (1)..(376): unsure at all n locations
  Clone ID: PAT_TA_53220
gacccagcgnccgcgctaactcgnngcacaagaannccggccaccctcgccgncncgccgccgncaccaccgcagggaggaaagagaaaaaaagagagagaagaacncgncgggagggcncgagancngngnncggagaggggaanncnngagggcggaancggaacaagcgggcgcgcncgggancggggnnaccaggcggggggncccaggaaccnnnagngaaggggcnaanggagncaaagggnggcaaaaagncnagcagnagnagnncccggagggacgaagcnccccncggcnacagcanngaagacgnncgaccngcnggaggcgccaagaagnncncngcngcanacccgaaccgcgcgaagaagcc

SEQ ID NO: 53221 - DNA, 555 bp, Triticum aestivum
  unsure (1)..(555): unsure at all n locations
  Clone ID: PAT_TA_53221
caccaccgccggagggagggagcgccagccanggccgccaagngcnacccgaggggcagcgacgagnaccccgcggccggcgccaaggccaggcgcaagcnccgcggccccancgccgagaagaacngcgcgccccncangcnccgccccgcgnggcacccggccgggaccggggacggggccaccaagaccggcggccccnncggcaccangaagngccccgcggagcncgcgcacggcgccaacgccggccccgacagcgccgacaggcggcncgagcccancaaggagcaggggcccaaccagagcaacgccgacaggaaccaacacgcnggaggcggggccggcgaggacaccggcggaccagagggggccnggcgcccggggagacgggacaaggccgaggcagcgaggggggggcggggggcgggngacgcgcgggggccgggcgccccgggggggggggggcgccccccgggggggggggggggggggggccgggcgggggggggcgcgngggggcgccggggggggcggggggggggcggcgggggg

SEQ ID NO: 53222 - DNA, 523 bp, Triticum aestivum
  Clone ID: PAT_TA_53222
gtgccaggggcctgtgtcacccgactgtactggcgtttacttcacctgtattgctgtatcgacaggctttggcttctgcccctctcttccatcccgttctcctcccaaattccagcaatggcagagccgattccagcggattccagcatcatggtcacgcctccagtctatcggagacgcaatccctccgaggaatcacgcggcatctcaaatgcaggcggcaaggatcatggagtggccagctctacaggggagactagccaggccgccatttctgcaggcccaccagataagcttgacccggagtcggcaaaggcgtgcctcgaggtggagaagacgcaccccaggatcctacctcttcttgggaaagcatacttcgcatgcgtcgtatgcaagtcacatgttcagcaaccatttcaagtggtggatccaaggacaatggtgccaaacctcccatcaaagccgacgccggcgaccctaacatgacaggaacagaactggaagatacacttaacagggggac

SEQ ID NO: 53223 - DNA, 265 bp, Triticum aestivum
  unsure (1)..(265): unsure at all n locations
  Clone ID: PAT_TA_53223
cggacgcgtgggaaagaatacatagtcatggcagccttgtcccaggtggcgaactttccgccgcactcgcttcacgtgggaggctcaagaggccgatgccngganctcttcccagccgctcatcaacgctggcgcctcctgccctcgccccaggcgctcctccccgcgctcccccgcccgccctccttctgctcggtgctctcgcgcctctcccggcggccgctcgcgtcctcccctctctctctccccctgtctccactggctg

SEQ ID NO: 53224 - DNA, 541 bp, Triticum aestivum
  unsure (1)..(541): unsure at all n locations
  Clone ID: PAT_TA_53224
cgcgcnccctccccncccccncacgcccaacggccggaggcggccangaagggggngcggaaccgggaccnggagcggccangggccggnggnacgagancgcgngcnncccgncccggnnccagcccaaggacggcgccaacacgcgcgccaccnacacgcncggccccgacggcgccgncagggggcggaacgagaccnggaccgacggccgccggggccacancgagggcaccgccnnccgcgccgacgacgccggcgacgaggccaagcncagggncaggnncaacgngccccccnnccnccccgncnnccccggcaccggcgacnaccgggngcnccacggcgacgacgcccaccaggacgcgcccgacggccagccccgccggaaccaccacnggaacnngngcaggcaggcgnaganggacgagggcgngaacgaggagccggnggagagggccaagggggaagggggcgacgggagcaagcngcggaggacgccgaacccggaacccgcgccggggagccaggacgccccaaa

SEQ ID NO: 53225 - DNA, 545 bp, Triticum aestivum
  unsure (1)..(545): unsure at all n locations
  Clone ID: PAT_TA_53225
cgggggccccacngcgcgcaagcgggggancaacgaccagccaccaggnggcgncccaggcggngaccnggccaagggccagagggcngngngcaggancgccaaccccaccagcggcggcgagggggggggccgcancgnccacangnnngaccccgagaacgcnaagcgggccnnggggggncgggggccccngggccgggcaggggggagggggaggcggncgggggggggggggggcgggcggggggggggggggggcggggcgggggggggggggggggggggggggggggggccgggggggggggggggggggggggggggggggggggggggggggggggggggggggggggggggggggggggggcggggggcggggggggggggggggggggggggggggggggggggggcgggccgcgggcggggggggggggcggggggcggggggggggggggggggggggggngggggggcgggcgnggcgggggcgggggggggggcgggcgggggggcccggcgcggggggggggggggc

SEQ ID NO: 53226 - DNA, 435 bp, Triticum aestivum
  unsure (1)..(435): unsure at all n locations
  Clone ID: PAT_TA_53226
cgccccgcanccgcccacgcgnccgaggcgaggcgacccccaacgcccagncncnccaccgggaacacacccagagaccancacgacaagcggcaaaanaggcggacaacgacncncccgncacccnccgaacccgcaagggcanccgcaacccgcggcngggccgnnagcaganggncgngggcgggggggaccccaaccgngccaacancnccaaggaggagcnccgcgagaagcncggggcccncnacagggcccagaaggaccaggncggcggcngcgggcngcggacccaggggggggggggcggggccaccggggggggggggggggggggcgggcgggggggcggggggacggggggcccggggccggnggccgcgcggggggccggggccgggggccgggcggggggggcggggggggggggggggc

SEQ ID NO: 53227 - DNA, 404 bp, Triticum aestivum
  unsure (1)..(404): unsure at all n locations
  Clone ID: PAT_TA_53227
gacgncanagcncnncnanagnggcaccaaaanncaanncacnggccgncgnnnaacaacgncgngacggggaaaacccnggcgnnacccaacnnaaacgccnggcaacacaacccccggacaccagcgggcgaaaaagcgaagaggcccgaaccgaacgaccnagccaacagaggcacaaaccgaagggaaaaggggacacgcccngaaacgagacaaaaaacacgagagaagaggaagaaacacacaaaaagaccaaggcgcaggcgcngcgggcgggagcccggggccgggggggggcggggcgcgcgggggggggcggggggnggggggggggcgggggggggggggggggggggggggggggggcggggggggggcggggggcggggcgnncggggggg

SEQ ID NO: 53228 - DNA, 395 bp, Triticum aestivum
  unsure (1)..(395): unsure at all n locations
  Clone ID: PAT_TA_53228
acaccggcnacgcccaccccacggngganggagggcgncgaggagancgncancgccggcgccgggcncgccggccncgcgacggcccnggganngcacaggaaaggggngaggaggggggggcnggagncgncggcgacgcngcgggcgncggggnacgccnncaccacanggaccaacgccnnccgcgcgcnggangcccngggcgncggggacaagaacagggagcaccancngcnnnacgagaggcnggnggccnncncggcanccacaggcgaggcngccgcaaaacngagcccaaagangcagggcaaaagcgggccccacgaganacggggcgngaagcgcaacnaccggcnggagacgcnggagaaggagcnggcggagggcaccaa

SEQ ID NO: 53229 - DNA, 446 bp, Triticum aestivum
  Clone ID: PAT_TA_53229
cacactattatgtgttctggcagttatcagatttctgggtcgtacgatacaacctgctccagaattccggggtgcagttcccaaaatgaacaagcttttgccagggttccatgggggtcatcacatcacttagagctctaaccagactactattatcaagtgggggatctttctaatgttttcagtccaagtttagggttgccttcatcactgcatcaaatgaggttggcagcctccaatctttctgtttcctgttgaacggcctccctttcccagctcggttctcgctgacgaccgcgagcttccaaacacagtgttctgcctgaatgtctactgcctcaagcctgaagataccatgcatctgatccgaaataaggccatcaccttgagcatggtgttgagccctaattgccatatgttggaagggatccaaatcacccggggcc

SEQ ID NO: 53230 - DNA, 461 bp, Triticum aestivum
  Clone ID: PAT_TA_53230
cccccaaaaacttttagcaaagcaaaaaataaactaggtcaccggggaaaatggccattaaggaacagggaaacttttccaaaaaaagaccaacgggttcgaccctgaatttaaaggcctagatggggttttgggcacgggaacgaacccaagcactggtccgtttacttgaagcactgggggcccaaaaagggcggcccctgaaaggggtaaagggccccgaacaggggttccacccgcttttttggggcctcggaagaaagggcaacctggggccacccggaaagctccagggaaaaaacccccttaaggacaaacccaggggtggcccgcccaaggaaaagccacacccccttgaccttgaagggggcctaaaaaccaaacacgagcattttgccaaaagcatactgggggcacaaatccatccgctggaggaacccgccgaccttggtcaggggcac

SEQ ID NO: 53231 - DNA, 715 bp, Triticum aestivum
  unsure (1)..(715): unsure at all n locations
  Clone ID: PAT_TA_53231
gaagtacgttaggcataccatatttttataaaggcggaagacaagtacaagagaatgcaacttggtgcaaacaagagtatggtttaaactccacacccacactaatcaagagattagccacccgcaactgttacatgtaaatataatgttgccctaaaccatatatatcactcagtgaacggaaaaaggtcaccacttcacaagttatcaggcgagacaacattatacgcaccgtacttactccatcgacacttggacacgggggatacaaatcaccaacaagtcagaccgccggcgcgtggtgatgccggccgcctcggtcatgtccatctcctcgggggccatcccctccggcagctcccagtcgaagtggaacagcagcgccgccagcgcgagctcgacgtgggccagaccgaacgacatgccggggcacatcctcctgccggcgccgaacggcacgaactcaaagtccgttcccttgaagtccctgccgtccatgccaccttgttcctggaacctctccggtatgaactcctccggcgcatcccagtgcgccgggtccctgccgattgcccacgcgttcacgagcaccatcgcgccctgnggcacgtcgaacccgagcacttcgcacgggctgcggcactcatgcggcaggagcagcggcgccgcggggtgcagccggagcgtctccttgatgacgagctgcangtagtgc

SEQ ID NO: 53232 - DNA, 266 bp, Triticum aestivum
  Clone ID: PAT_TA_53232
cattccaaaatgctgattttacaaagcccaagccttacatggcgtattgtacaactcaagatagatacagtatgcctctgatttccagcaaagacggctactcttcccggatcacgagcatgtcactaccttttatgatgttctaatcctgatcttacgcctacgttgagggggggaccctaaaaccagcagactaccggaaccgtcgttggttaagaatttgctcaaccttcttcattatttcaatggttttgttttgtcctata

SEQ ID NO: 53233 - DNA, 628 bp, Triticum aestivum
  Clone ID: PAT_TA_53233
aaatgagtagccatctcgaattaaacgagatccagatacaatgttcatgctcaaagctggcactaaataacaattattgaggtttataactaatcccgtgggtagatgcagaggtagcgtgccgacggcgatcacatcgaccttggaaccattcccgacgcgcatcggcacctcgtcttttgccagtctccgtttattccgtagttccttgggtgttgccggccttcttcttgtccgctaaatatttggggcagttccgcttccagtgaccacttcccttgcaataaaagcactcagtctcgggcttgggtccattctttgacttcttcccgggaactggcttaccgggcgcggcaactcccttgccgtccttcttgaagttcttcttacccttgcccttcttgaacttagtggttttattcaccatcaacacttgatgttcttttctgatctctacctcagctgatttcagctttgaatatacctggggaatggtcttttccatcccctgcatattgtggttcatcacaaagcttcttgtgcttggcggaagcgactggaggattctgtcaataaccgcgtggtccgggagattaactgccaggtgaaacaggcggttgtgcacccc

SEQ ID NO: 53234 - DNA, 208 bp, Triticum aestivum
  Clone ID: PAT_TA_53234
aactatataggggaacagagcacatgatcagttctgaaggaaatagggcagggtagtattgatggcaaaactcatgatagcagcctacaccgaatatgttgggtgacatgaataaagacccagccgaaactactgatagagagagcaaatgctactgataagagcacgatggattttaactggttgtgctggtgtattaccgatactc

SEQ ID NO: 53235 - DNA, 366 bp, Triticum aestivum
  Clone ID: PAT_TA_53235
tatattctataggtcacagcgggatctctttcagaaggcacgactccacacgcaacatatgactgacagccggccaacacggcatcgtgtgactcttaaaccattctcacgggcatgaactaccagagtgcgacaggacttatcctaggtcggccggcgggaggattccctgcatgatattttatggctgcttaaatgtgaaatccttactatctatgtgcactacgaatatacctgaaagaccgttccaactgatctacataggacggctcatcagctagacattgtaccaacagcgtcgacgtccacaaaagaaacgcatgcaacgtttgttcatgccacgtgatgacacataaccagcggcca

SEQ ID NO: 53236 - DNA, 710 bp, Triticum aestivum
  Clone ID: PAT_TA_53236
ggtactccacaagcacttctctctgaagaatccagatgctcctgtacttatagatatacaaggacatttatgctccaattcttcctatataaagccaaagaaaaatcccaccgaaataatgtacaacataccatttattcgtcgacaaacatgggctggcacacactgatccaattttgccgcgcaacaaggggtaacaaactagagagaaaggtcagccaggtcaaatgatcttgaaaccgccttgttccaggactctcctctcttcttcctgtgggcgtcatctaacttggggcggaaaaccgttgtgttctccttgtgcaggcctgcgaatatctcctccttcgtccagactccggcagctaatcctgctgcgtatgcggctccaagggctgtcgtctcggtgtcggctggtctgacaacagggctgcccagcaaatcggcctggatctgcatgagaaggttgttaacagtagcaccaccatcgacacgcagcaagaattccccttctgcactcttgacttctcctgcctccccagcattcttatgcatggagctgagaacactattcacctgaaagcacatactctcgagcactgctcgagcaatgtgccccttgtttgggaacctcgtgatccgatacaaatcccccttgcggtatcccttcaccatggggcgaacaatccattgaaagctggcccaaagtaaat

SEQ ID NO: 53237 - DNA, 619 bp, Triticum aestivum
  Clone ID: PAT_TA_53237
ctgaatccgagcaagcaacagtcttaaggtaagaacacagccagaccttacccggcaaacagattattctgcagaacatgtacctacgccacaaacaagcaaaaacatattcttcagattccctgcaccgacgaacatactactagattgaactgtacaagccacaccagctggtgctactgcatctctgctgctttggcagaaggagcgcctattactttccaaagagggatttgatccaccacaggccgccgtccttgggggcgtcctggctctccggcgtcggctccgggtgcggcgtcctccggagcttgctcacgtcgtacccttcccccttggccctctccaccagctcctcgtacacgccctcgtccatctgcggctgcctgcacaagatccagaggtagttccgggagggctggccgacgagcgcgacctggtaggcgtcgtcgacgtggagcacccagtagtcgccggtgacggggaagacggggaggaaggggggcacgtagaacctgaccctgagcttggcctcgtcgccggcgtcgtctgcgcggaaggcggtgccctcgatgtggccccggcggccgtcggtccaggtctcgttcagcaccctgac

SEQ ID NO: 53238 - DNA, 696 bp, Triticum aestivum
  unsure (1)..(696): unsure at all n locations
  Clone ID: PAT_TA_53238
aaaagcacgatggtaacatatttcctgtagcctttgctttccgaatggaggattgccattgttatgtacaaagtgtatgttcatagaatggtttaagtacaaaggaaggctaaaaccattcctggagatatctcccaagtctctgcaagaacaaactaaaactactgtttcgaactagtgggggagagagagagagagagagaggctgggctgtatggccaattgtgcaaactgcaagaccaagtagatgtgtgcaatcgataggaggtcatcacttcttaccgaatccaaatatggatttgatagcattgatggcgctctcgttgataaatgattcatcgtacttgtttagtagggtggcgaactcctccgagttcctcaagtttgctaaatccgggtcggtgcgaatcctcttgaagtcttcatagcctgctttcatcgcttcttcaagtgcagaaaggccagcttgtatccggtcgagcttcgaataacagcacgcgacattgtagctggctacggaagcttcatcaatctctggttttgaccccagcaccgactcaaacttctccaacgcctnctcgtatttttcatccttgtacaancttagccccatgcgaagggcatcttctctttggatcttctgctccatctttcttctggtaattttgcatctgaatctctctgagtttagggctg

SEQ ID NO: 53239 - DNA, 286 bp, Triticum aestivum
  Clone ID: PAT_TA_53239
gcagaattgcccaaatggattcatggaaagcaagggtattcacagtttcacataagcctaatcgacgatgctgattactccttaggagtaattacagttactatttacaaatgtacaaagctactaagatgcagtggcaacgccttgatcaccacccacccgcaaaccaggatcctaaattcagaaatgctatgcatttccagctaggccgtaagaagaactgctactgatgatgagataaacagaggaaggtaattaagagaagcaggcgagatatttaataacc

SEQ ID NO: 53240 - DNA, 494 bp, Triticum aestivum
  Clone ID: PAT_TA_53240
acaaaaacaaacaattgaggctatcgtcatgaaggggagggggtttaacccctctgttttattttgctggtggggggccagccaagggcccgcctttttggaccaaaggatggcattcgggcttttaaaaagctaaaaagcgagggcggtggaaaaatccaacggggggggagtcatagatcttcagccttcattttttatttttggccagtggcgcttcacatggagaaacaactgggggggccttaaggggattcggacaaaaaaagcttttgggtgaatgcttatacgcctttttgatgaaaaagttaaggggggtttttatttgaacaaagccgtgggggagactgtggaaaatagccgtatcgatacgggcttggcggaacacccctttttgtacaaggttatttcccgaacaattttaggcatatctttctggcgatcctggtggacgatcaaaattcacaatccctgcgggcagactgtggggggaa

SEQ ID NO: 53241 - DNA, 485 bp, Triticum aestivum
  unsure (1)..(485): unsure at all n locations
  Clone ID: PAT_TA_53241
cccacgcgtccgatgcatgtcttttcaaaactcatgaaaagtttggtagacttgcatctttagaccatctactcagccgcttttaagggccccttaacttacaccaaaccttaactattctgtcggttgtacattgcacagattaggtggttgcagtgcaacctttttctacctgatgcaatctagccatgtgtgttgattgatataggtcccagctgcagtaagtgttttcgtgtggaaagcggttcagctgtgcagggagagccgtgctagacgcatgaatggtaacctggagtgtgtctgtgaggccaatattgagtggtcaccgacgcagctcatcttctgcgccttctgcggcctcctgngcggtacagtcggtggtcttcttgggtctggagggggtttcatcctcggcccactacttcttgagctagggtgcatccctcaggttgcaagtgcaacagcaacatttgtgatgatgttct

SEQ ID NO: 53242 - DNA, 746 bp, Triticum aestivum
  unsure (1)..(746): unsure at all n locations
  Clone ID: PAT_TA_53242
cgccgctccccacgtctacacccaacaggctagggtttctccaatggcggcggcggcggcggcgggctcctccaggcgcgggccgatggacgacgacaagctcaccttcgagacctcggcgggggtggaggtcgtgggaagcttcgacgcgatgggcatccgcgaggacctgctccgcggcatctacggctacggcttcgagaagccctccgccatccagcagcgcgccgtcgtccccatcatcgccggccgcgacgtcatcgcccaggcccagtccggcaccggcaagacctccatggtctccctctccgtctgccagctcgtcgacaccaacatccacgagtaagcccatgcccacccccctccctctgctaccctcgctctcgctagatcctcaaactttcgtcttggattgccgtcgcccgatgccacaacctgtctcgttagcctagatccgttccagtcgtgttctcgattttgtggcggcatgtgtgattttgcaatagatttgtggggaatctgttaaagcatccgcatgctaataaactgttaaaattatatccacaaacatatttctggagtagtttctttataactgttactaattactaaatcatactagtatctttgtatttttagttctggtaaactgtaaaattcagatctncctgtactgttcttacactntgctttacacttggatagtattggtattaactagtgtcaaaaagcgtcttacataggga

SEQ ID NO: 53243 - DNA, 788 bp, Triticum aestivum
  unsure (1)..(788): unsure at all n locations
  Clone ID: PAT_TA_53243
ctcgccggggccgaggagcagcaaggggaaggctgctcgagctcgaccaagaggtgcggcaacttcaacatctccgaaccattctggctctctaacagtgaggcgcaaagatcatgtggcccccaggacttcgaggtcgcctgccataacaagagttttccaggtctacggagctctataccctcggcctcgggcctcggctttgcaatcatcaacatctcttacaaggaaaacagtttgcgcgtcgttgatcaaggcaatctggaagtactgcaagcctccaacagctgccatggaacgatattgaacacctccgtcaagctggcccaaccgtttaggatcaatcccgtcggcctgagcctcatcttgtacaactgctcggaggagggcgcagccgcagcggcgactgtggcacgtcgggatagagacctggtaaagaccggagtgagatgccggaacgagagcaaggtgcttgtccgcacgggagtaccttacgacgcgaccggggactacggcgggtacgctttgaaggcctgtgaagctgtcgtcgtgccggtgatgggcttgtcgggcgaggcgaacatgagcaactacaagcagctcattaacgatggcttcctcttgacatgggatttgccgcaagctctgcctctccctgcacctgcacctcttcatacgcctgcacgtacacggcgccgtaaaatggcaacgggggacgattcttaaaatagttggagcaggactaggntggtgctgtactcatggcatgtctcagctgntttgtctgg

SEQ ID NO: 53244 - DNA, 729 bp, Triticum aestivum
  Clone ID: PAT_TA_53244
ccctttctctcaaacaattcataaaatctgtgtgcaaggcaagagacagcctttgcttcatatcatagattgatttgtttttttcttttctcttaacaagtcttgttgcacttccaatcagtaaagcaactaccatatacagagagctcatcatggctcgttcaaggagctcaatggcccttggcctgggactcctttgttggatcgccctcctcttctctcctctggctttcgttcagactgtccaggccgacgacgtcgacagctacggcactgtcattggtattgatctgggaactacttacagctgtgtcggtgtgatgcagaagggcaaggtcgagattcttgtcaacgatcagggtaaccgaattactccttcctacgtcgccttcaccgaggatgagcgtctcgttggagacgccgccaagaaccaggccgccgctaaccccaccaacaccatctatgatatcaagcgtctcattggccgcaagtactccgagaagaccctccagggcgatatcaagcacttccccttcaaggtcgtcaaccgtgatgaccgtcccgtcgtccaggttgaggtcgatggtgccaagaagcagttcactcctgaggagatttctgctatggttctcggaaagatgaaggaggtcgctgagggctacctcggtaagaagggtacccacgccgttgttaccgtccccgcctacttcaacgacaaccagcgacagg

SEQ ID NO: 53245 - DNA, 568 bp, Triticum aestivum
  Clone ID: PAT_TA_53245
ccccgtcgacccagcgtccggtgagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctattggaagagggttgcggtactaacatgtttactggcattgtgggtaacgtatgtgggttgaaaggcctacgtgctctacggttggaggatctacgaatggctgctactgatggaaaaactgtcgcaggtgcccccttgtggttttcaaggcttgagacatctgtttttcctcttttggtctcttctttt

SEQ ID NO: 53246 - DNA, 773 bp, Triticum aestivum
  unsure (1)..(773): unsure at all n locations
  Clone ID: PAT_TA_53246
ggcttactgtgactgattttgtaactgacctacaaagacaatgtccgaccagcctgcgactgtcgctgctcccgcggctcggtccgacctagcgtcggccgttgagtcggctccggcgccgcagccagagttagttcccgctgctgatccacaggatggcgacgagagtgaagctgattctgctgttggtgatgatgccgcaagctctactgcttccatcacgtcgagcattctcgagtaccgcacgattcagggccgtacatttcacagtgatagacaccctaccgagtactttactcccaacgatgagcaacagtctgcctcaatcgacattaaccatcaagccttgacgctgcttttgggcggaaagctcttccttgcaccggtcaagcccaacgtgcaggtatgtgcatgtatccttggtcatatgacatggcttacttacagcgattagagagtacttgatgttggtaccggaactggtatctgggccatcgactttgcagacgaataccctgaagctgaagttattggctctgacttgtctccaattcaacctacttgggtccctcccaatgtcaagtttgagatcgacgacgcctcgctccgctggacgtgggataacaacacttttgactntatccatatccgctacctctttggcgccattaaggactggacttcccttttccaagaggcctaccgctgttgcgctgcagatggttggatccaatctggtgaagccgacgtgcatattcgcagtgatgacggaa

SEQ ID NO: 53247 - DNA, 782 bp, Triticum aestivum
  unsure (1)..(782): unsure at all n locations
  Clone ID: PAT_TA_53247
gtcgagccagactgcatcctagggcatggactccctcacgccgccggcgccgccgcatccgcagaacaccgaagatgattgtttcccaccaaagaatgcattgtgtaggcatgatgaagagcaacatgtccagaaccgtgatcggatcagcacactgccggatgatattttaattgaaattctttccctaatgacaataagcgaggcagcaatgactggttttctttccaccagatggaggcatgtctggaaaaaagtcgaccatctcatccttgattcctatacttttgggatgcaagagttagagaagtcacgttaccatgaaaatcctcttttgtggaatgatgtggctacaaagtttgttcacaaagtaaatgggcttttgcacagtcgtcatggtaacaaaatcaaggaattaattatcagattcccattaacctcaggccatgcttctaatctggatcactggattgagtctgcaattgtagcctctacagaaaagctcttccttgacctggataacaagtgttgcaaggaaggttgcacaatttgtgtgaaaggcatgaacgctgcttcagagccatatgactttctcttggggcctttttttaatggtagagccgactcgttggacgaattgactcttttcaattgcagtataggaacaatgcctgcaaatattggtgggttctcatatcttaaatcccttctactcgcccgtgtgtcaattgttgatgaaaccgtttcaagtattatgtncaactgttgtgctcttgaaatat

SEQ ID NO: 53248 - DNA, 715 bp, Triticum aestivum
  unsure (1)..(715): unsure at all n locations
  Clone ID: PAT_TA_53248
gaatccagctaaaaagaaatctgtaagtaatccaatcttaagaagaagagcaaccagatgaaataacacattaagcttcaacaaaaaagctcaaatcacaaagcatcaactagacaaggatgataacaccaagcgaaacatcaacttgatgctaacgattcagtttgacaagtaatgaccactgaccacgataggttttcttcttctcccaaacataaccaccgatccaagatgttcaccgacaggttaaaatggtgcacttcttaccatcctactgcttgtttttctccaaaatattagcatgtcatgtcaaatcctgaggtgatagctgaggagcttcattcgactgggtcccaacggctccaagtcagcaaggaactcatgctctgggagattcgctggcaaagtcaccatctggccggtgagttccatgctgtggcggaatggatatgcaaattcaattaaatccaagaataaggaaaactggcacgattactatgctgagaaactagacgcttttgtcctgcccatacacttgtgtggatgaccttcagaaatagttggttgaccagttcttggattgaaaataaagatggcaccattgattggtttggtcgggttaccctcgaaggttttgtcaatggtaactcgatagacatttgtcatccacaaaacgtatgatttgatttctgaatattcctncgtagttctgtta

SEQ ID NO: 53249 - DNA, 195 bp, Triticum aestivum
  Clone ID: PAT_TA_53249
aacggggggtggtttatagataaagcccgcccattacatagagacgcacatagtgcggggcccacaatttcagttcaccactctgctctggtcggggaaccgagggggcccccggcctcaacaccctggactgggggcgcccccgggtcgctgggccctggggccccgcgccgcgacggttggttgaacgtctcg

SEQ ID NO: 53250 - DNA, 386 bp, Triticum aestivum
  Clone ID: PAT_TA_53250
gaggcttgacactgacgagctgaaactattaccacaacagaatgttcccaacaggcaccgatgcggtctcgtttccagtgaacatcagccgctcacgatacgatccttgctgaccgggtgcgggaaagccgggtaagtatttaccgagcaaggctattctacctccagcactcgcgctgctcaagctgtgtgcaacgacggagaccctacatacaactaccctgacgggctgggtgggaagggtggcagctgctggtcggcaatcttcgtcctcgctttgggggtcggaccatacgcctgggcccctctcttgcggtacacacactggagggaattgggtgttctggtggttctttgtggtgctgctttgggtgccctgctggggg

SEQ ID NO: 53251 - DNA, 666 bp, Triticum aestivum
  Clone ID: PAT_TA_53251
ggacagtaaaaaatatacttacataaatatgtctgtactttttcagcacaatatacaatggtcaaaatataaatttttctgataaccatgaacattttgaccttattcattatgtattcgatatacttcagtttagttgaatttctttatgaagccgattatgagcgcactaatttcctctggcttttcttcatttatgaaatgccccacatctttcattatcaccacgtcatctagtaatggaacaaacttcttgagaccacctttgttaatgaaaacttttgcccctgcaatattgtatgttagatctaagttgccaactgtgaacttcgttggcaccattatctcagctcccgtccatggcgaagttaactcccatgtcttattcagggcacggtagtagttgaatcccccggtgaaaccagacttgtcaaactgggtcgtgtagtacttgaggtcctcctctgtgatccagctcggcaagggcacctcatcatctggtgagccccacccgctcttctggatgaacagtgggccaggagttcgatcagcgaaaaactttcttagcaccaactctgtaccaaggcgtttgaattctgcttcaattgccccaggctcctggaagctgcagatgtaaaagtcgtcgccgtagagagccctgacagc

SEQ ID NO: 53252 - DNA, 597 bp, Triticum aestivum
  Clone ID: PAT_TA_53252
atgcatcacactcacaaatattatacacggccaaacaatcaaactgcaacaaatgggaccccagttgtctgtgaacaaatcaagcactctccgggacacgatggacctactaatttgtcactctttggaagcttcagcagtgacgtatgccaggaactccaagaggcggcggttgtagacgcagggcctctccaggtgcacgagatgcccggccttgtctatgctctgcagcatcgtctcctcaccgagctgctctttcattgtcctggcgagctctatgttgaaaatgttgtcgttgtgtccccagagcagaagtattttctgcggcgcaaggacaagaaacgtttgtcagcaaccttggtactactggtaatcacgggaattgcttggtagagttctttcttcgctgcttatattcttcacggatggatttggtggctttggtgcaccaactttgtactgtatgcggtaagcatgttttgtaaattatgggctggtttgtgttcctgtcaagtcgaacaggccatccgcttggggaagagcattgaaagccttcagcatatcaccgccgctcatgaccctgtggcaaaacgggca

SEQ ID NO: 53253 - DNA, 769 bp, Triticum aestivum
  Clone ID: PAT_TA_53253
atgttcaaataatatgattttgatttgtagcaaaccaggagaattaagctagtaccaaaacaaggtctgactataagatgcatcaagttcaacataggtctgttcaccgattctgcaacactttacatttttttagggagtgaataggtcatataatatggaacttcacggtggatgggaccttgggaaccaagtgtgcgtaagccatctctcttgcataacgacgtctcatgtcatcttgcaacttatcttcgttggacctggccaaccatggctccatggcgcgtgtatcgatttcgaatacatccaacgcgggtgtgctccttaggagaaagtacacgagttccatcagttcgaattccccactaaacccaccaattataatagtgtagagccttgcaagtattaaatcctcgggccatgtgatgttcaactgagtatgttgatgaagcttgcaacaaccatgtaggccaaaatattctattagaggagctgatttgagaacataagccaccgaggaaatgccttctttccaaggtttcatgagaactaacataactgttgtcaaaccagccaaccttgaagcatgctgcaacacacgatatacctgtaagcatgtaggaaactggattaccaaaaattctagcttgggaagcttaggaaatgcacttatgaagtctaagggcagtcattcttgttcacaaaataaacatggagcatttcaagaaattgtgcatgttcgcactcaatattgatcttgtagcccatg

SEQ ID NO: 53254 - DNA, 704 bp, Triticum aestivum
  Clone ID: PAT_TA_53254
aagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggaaggcaaggagctggagttctacatgaggaag

SEQ ID NO: 53255 - DNA, 710 bp, Triticum aestivum
  Clone ID: PAT_TA_53255
catcgatccccacagcccctccctccttctcgctcctcgccatggcccattcccacggcccctccctcctcctcgctcctcgccatggcctcctactcccctccaccaccatacgtgcacacagacggcggtgccggagaagagcagctccagtcatggtggggtgcggctgcgacggagatgaaggagcacagcagtcggggacaaggggaaggagcaggtcgacccgaatccatctctctgcaagaggactagaggagcaggtggcgagggaaaccggcacggtcagcggcggcgctgcacagggacgtccacctccggttttctgtcctatctccgattcccttccgtttaagtgtgttatttttcctcttggcccgatcttctcacatgtttggggtctcgtgctgtagggataagatctgaaacgggaggtgtggtataatgcataggtgtataatcttggctatatctatgctggagaatgtcgatttaaagcatttggttctgatggatcatattattggttctctgttcaactgaagatgtctttagataggactaaggtgagttgagttgtggcttggttggagatgttgatgatggttgagacgcccgctggatacacccttttcaaggttctgaacaagggcaagctcgaggtcgaggggtatatggaccacaaatgatgtgatatactggggtattgg

SEQ ID NO: 53256 - DNA, 606 bp, Triticum aestivum
  unsure (1)..(606): unsure at all n locations
  Clone ID: PAT_TA_53256
cccacgcgtccgcccacgcgtccgagcacaccagcctccgagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactntg

SEQ ID NO: 53257 - DNA, 579 bp, Triticum aestivum
  unsure (1)..(579): unsure at all n locations
  Clone ID: PAT_TA_53257
cgggttcagntnagatgagcacaatggccgngccgagggtgtatgccggtcattggctccgttgtgtgctggtagtggtgtgtgccttgtgctgggcatcatcctctgttaggctcgtggcgggacaggccgggcagctgagcgtggacgcctcgccgcagactgcgaggaagatgcctgacaagatggtcggcatcttttttgaggagatcaaccatgctggtgctggtgggttgtgggcagagcttgtgagcaacagaggttttgaggccggtgggcctaatacaccatcaaacatcgacccatggttcataattggaaacgaatcaagcatcatcgtgggaaccgatcggacatcttgtttcgaacgtaacccggtcgcactccgaatggaagttctttgtggttctaaaggaactaatgtctgcccatacggaggggttggggtctacaatgctgggtactggggcatgaacattgaaagaaggaagggctataaggggagcctgnacattagggcttgagatgcaggaggcttgaccattggtttggggagctgtgacgggctggacaagctcg

SEQ ID NO: 53258 - DNA, 445 bp, Triticum aestivum
  unsure (1)..(445): unsure at all n locations
  Clone ID: PAT_TA_53258
gacccacgcgnccgcgngcaggagcccangccagagacgcccccgcgggcagggnnacngnnccggcncccccgccgccgcnnggncncngcancacgggnncaccagaaagacaggancaacagggcagcgccncccaccnncgccgccggcgccgcccanaancgggcaccngcaccncgacggcgcccccccacacggcgggcgccgngaccnggccaggaagcacggnccggacgngangcaccnccggcngggcgccgngcccacccncgncgngnccccnccgcgcgccgcagaggcagngcngcgnacgcacgaccacgggcnggcggcgcggacacgcaccaggggcnccgacagcaccangaacggagccagngacagcggccgcgcgccacacggccagcaccggcggcaggcaaggaagccggggaccacccac

SEQ ID NO: 53259 - DNA, 755 bp, Triticum aestivum
  Clone ID: PAT_TA_53259
gctgaattgaagttgttttggtcttatagaccaccacccatacaaaatgagaatcgaaacctgttacttttgcagtcgccctgcttaccccagcaagggtatcacctttgtgcgcaacgatgcccgagtctttagattctgccgcagcaagtgccacaagaacttcaagatgaagcgaaaccctcgcaagctcaagtggacaaaggccttccgtaaggccgccggcaaggagatgacggtcgactctactctgcagttcgccgcccgccgcaacgttcccgtccgctacgaccgagagctcatgggcaagaccctcaaggccatggagcgcgtgtccgagatccgtcaacgtcgcgagcgcgtcttctacaagaagcgcatggctggcaagcgtgagcgtgagcttgccaccgcccgcaagctcgtcgctgagaacgagcacctcctgccccgcatgcgcggcagcgagaagaagcgcctgcgcgagctgggcttgaccgaggaggatatcgaggagatggagcccgagcgccagaagtccaaggctttcggtggcgagaagaagagagtcgccattgctctcgaggtcgacgacgacgaggacgatgacgaggagggcgagagcggcatgtttgacgatgaagacgaagaggatgacgacgaggacgacgatgatgagatgggtgatgtcgacatggaagactgaacgaaaaagtcattgacggtggataattagaaaagttgatgcaacatgt

SEQ ID NO: 53260 - DNA, 619 bp, Triticum aestivum
  unsure (1)..(619): unsure at all n locations
  Clone ID: PAT_TA_53260
gcaacaacngaannggagaacgaaaggccncnctggaaacanggaagaaaagctccggnnggcacaggaagaggctgccagactgaannnngagnnggangagnnggcagcagccccaagagagaaagagagaggacncancganggcatncaagaatnngagggggagaggggcaaagcaaaggaagagaangacaaacngnnngaancacagagagggancagagangagaannccaggcngagggaaangcngaagcangcagnnaangaagccaangnagcaaaagaanccccggagaaagccagggnagaaaanncncagcnncaagaagacangncngagaaagagaanaccnnaaagagcancgnccaagaanacgagnccccgaaggnaagngaggcngcngcacagagnagcannagagaanngaaggacanganngangcnangnncagnncagagncgaccaaaaccncggcagaagcancacccanagangccaagggaggcaacaggaaaggaagaaangnggcagcagaaaanangnacccngangcngaaagcncnccnngnncaaagganannaggagncccgcaaggcagcaaaagaggacg

SEQ ID NO: 53261 - DNA, 651 bp, Triticum aestivum
  Clone ID: PAT_TA_53261
gttatgattgcatttattagattgtagactcaatttgctttggattgcattgtgttacagtaacatgttatgttacttcaaacacctctcttgtcattaactacatgtacataagcaaatttgtcttgaaatgcgctatattactagctaagttaccctacctatgaccagcctaataaacgacgatcggcgtgatgaaatcagcaagggtaatatgccttgaggtgcacttgcaagcatggggagtccttccaaaccctagcgtgcatcttgagcagctccttggccttggccctggctcgctcgccggcgtccacttgtagaaccaacagcagcttcgccaccaccccgacggccagcatctcccgcagcacggctggtgtcggcgaatgcattgccacggcgtgcaaagcgcgcaccgcgctctcggttgtggtcagtgagacccgcatagccttcttggccatgatggccagccccgccgggtgcgccaccaggtccgaccgcccctccgcacagccgcagaggtggtcgatagccaccaccgccagctcggtcgggtgccgcccaccgtcgtcgaggagcagctccaccagcacagtcatcgcgccggcctccgcggccttgacgcggttccggccccacgggcac

SEQ ID NO: 53262 - DNA, 532 bp, Triticum aestivum
  Clone ID: PAT_TA_53262
cttggttaaccttgttttattaagtgacctctttttcaaaagttggttctataacattgatgatgataatagcctgcctgtccaaatcattcgaaagcgtcccgtactgaacgctccggaatgagaatgacaaaaggtcaacccggacttgctcgttgggatacagataattgggaaacacaaatcattccgtcaaaaacaacaggtcacatccaactctttctttcttgggtgcgcgcgctctgcatgacgaagaaaaatgctttctctctatagtatcccaacgccgtggtatgccttcgaatcaaaaacacccataacgcccttgtctcgtagaccttttttgctttcgctgtcttagtagcccgcctccgcgcgtggacatgttgcatcaactttttctatttatccaccgacaatgacttttttcgttcagtcttccatgttgacatcacccatctgatgatgggcgggctcggggagatgctgtaagggttgatgcgaaaacatgccgatctcgacctgctggggg

SEQ ID NO: 53263 - DNA, 632 bp, Triticum aestivum
  Clone ID: PAT_TA_53263
gacgggtatatgttctccacagcttgttggcataggaatcttgacacggggcattagcactaactcgacttttattttgttattatatacaccacagacggcgatagcccctctaaaaatcaacagacacacaacaaccacttgtgcaaaagaaaaaggcccaaatttctgttcacatctagccaaaatggaaaccacctacaagacacgagaaggcacttacacttgatatatgtaccatataggcaacacaggcaaaactaatcacaattgcagtcgcaagaatatacacatgtgatggtttctttttatattagatggaaaccggcgagtgcaatctgatctgtgcaaatgaccacaggagaatacagtgcccagcctgaagatcatttcaatgccggccgagtaccaaattaatcatttctcatgactgcagtaggaccaaatccggcaacccccatccatcattaacacaccgagcgccatgctactctggtgaagcattttgagaatcgtcttcacaaatatttgacgaggactggtctggattgattattgcaggcatccattgctcaggaatcacaataaaataagcagacattgctttcctaaaccgcttcttgtactgcatc

SEQ ID NO: 53264 - DNA, 549 bp, Triticum aestivum
  unsure (1)..(549): unsure at all n locations
  Clone ID: PAT_TA_53264
aacggggcccaacacccggaaggnnnaacgggcacagggcggggggggacacacgcgggccaanacacccaaaggncaccaaaacggggggggggggggacagannnaagggccaangggcancaagaggggccgaaccngggagganaggggcaggcccccnggaacagaacaaccaggaggaccgccagggcaagagccacgaaagacccaccagccgccanccccgggaacgaagggcngggagagggggagcccggnccagccccggggacggccgggggggggaacagggccgggaaaaagggggggagggggggaaccagcggcagcggggggggggggggaggggcgcaaaggccgacaaaggggaggcnggggggggggcananagaggggaggcccgggngggngggggcgggggccgngcnnggngcgggggggcgggggcccggggggaaagggngggcgngggggggggggggggcngggggggggggggcgnggcgcggggggggggggggggccgggggggggcggcgggggggg

SEQ ID NO: 53265 - DNA, 528 bp, Triticum aestivum
  Clone ID: PAT_TA_53265
aaaccgggggcaaaaattggctaggggggaagagagctaatttatggggcacaacgcccacccccggcaagaggggggggggggattcccctattcaccacactagggtaaaggggggccgccagaaaagcacacagggtattcaggccaggttattaaaacacaaaaaaccgattaccggggagtttttcatcggggggtcaaggggggagcccaaaaacagatctaacccccagcacggaaaaaatttgggaatgggggaacccagcttccaaaaaaatctttttccactaaaaatcctttgggtaaatcccctcggcccccatgaaaaaaagaacaaaaaaaaccgggggctcttttggaacaagggcatcgggcccaaacccaacccccatatcaacgattataacctttccaccaacatttgggggagggaaagcttccttgcaattcttcaggaggtggacacaggctttatcacaccaatggggaaaaatgcactttaggaaaagaacatccgccggggga

SEQ ID NO: 53266 - DNA, 645 bp, Triticum aestivum
  Clone ID: PAT_TA_53266
ggggggggtcaaaaggtttattttattccatggacccaagggggttaacaaactttggataagcctttttggttggaacggggaggggggaaacccgatttggtttttaggggttccggcacgctggcccaaacaaggttttggccagaaaacaggtttgaactttggggggtccaaaattggggtaacccttggtttttccagaaaggtaaaggtttttatcagacctttactttttgggctttttaggggcagctggtgcctgggggggagctgcagccggtgggggtggggcatgatcttttgggccctgggccaattttttctccctccggggaattttgctttccctggttgccttggttttggggcgcttggccttaaactgggcagagggggtttttttttttggcttttgagccttggacttgggggtactttgcatgggggccctgttgttgttggacatgtggcccttggccttgaggggcctgtggtggaacatgtgcttggaggatctttttgggctaacggagcttggggcggaaggggcctgggggcacgggtggtgggggtccccaggtttttggggggggggccttgagcccgcctggggccccgggcgcgggccctgtgtgggggggg

SEQ ID NO: 53267 - DNA, 631 bp, Triticum aestivum
  unsure (1)..(631): unsure at all n locations
  Clone ID: PAT_TA_53267
ctctcttctcctagcttcttctgaaaattgttgatcttgccagtagtcatggatcctaatggctcctaccctaacaaagttagatctagtgaaagtgatgcctacatttctcccttgcatgaagtattgagaggcacgacagccatgccagtgttaaatgatattttggcctttgagtcactaccatcagattcaccttccatggtgaactcctcacttgcacccaatgcaccacttgaacctaccatgatgttagtcaatgatagttccatgatgccacaccaagagaatgtaggcctagcaccactaccaccacaattgtctgatacaattattaatcctctatccatggttaataccatagtgccccagcccaacantgaggaaatccatcaagatgaacatgaaatgttcaagcatgaagatttgctttcaaaccctgtgggggattatgcggactgctgtgatggtacctatgcctggggcgtggggggggggtggtgggcggtggctggctggggggcgggtggggggtgcggttcgtcggttcttcctcttttcctgttcgtctgttctctttttttcccctttttttcttcccctctccgttttcccccntctcctccttttc

SEQ ID NO: 53268 - DNA, 436 bp, Triticum aestivum
  unsure (1)..(436): unsure at all n locations
  Clone ID: PAT_TA_53268
gacccagcgnccgcggacgcgngggcggcaaggncgaaaccaagggggcgccgaggaagccaacaagngagacaagaanccggcaagaaagngcgnccagancaaggagancnccaccggcngcgacgnccaanaagagggacccgacagaaannngaaanngnngnganngaaaangggannnccagngcnccaggggggggaggaggaaangngggagnaganncaagagaaagaaagcagnaacnaacnccagnagcnnagaaggaacnncgcngnnnnggaannnccagnagcnnaagnanngcagnagaaaaccaanaaaancnngcccgagngangnnngcnnggnnccnangaaccnnaancnngaangngngncncngaancnnaancngangggcgcnacnangaanaaggncagccgnngcngacc

SEQ ID NO: 53269 - DNA, 619 bp, Triticum aestivum
  Clone ID: PAT_TA_53269
gctctctacttgtgttcgccttgtacgaggtctttggcaagcccgagcgacctatggtcccgcctggcctctttaaggacacccgcggctttgtctgcatccttctaatcagctccataatgggcgcgatgaatctttgtctcacaatcatttaccctcagcaagtcattaatatcttcggatccaggttgaaaaactgggaagagactgcatggatgacagcgactgccgcattcggtacatgggctggtattatggttctgggaaacttgttccatctcatcaggcatatccgctggcaaatacttgccggggctatatggctcacggctttcctaggagctatgtcatctatcaatcgagataacaagaacgcagccatcgctttgtcattctttgccggccttgttgtctcctgggctcaggacatcaccatgctcatggttcagtttatcacgacagatgaagatttgggtgtagctttctctgttgttgctgcttcccgccccctttttggctccattttcaccggcgccttcatatccctctacagcaaccagtgcccaaaacaaattggaagccatctgacttcagccctgcgaggtacggacattgcaca

SEQ ID NO: 53270 - DNA, 597 bp, Triticum aestivum
  Clone ID: PAT_TA_53270
ccttgttctcattctcccacggcatgctaggcgtctctgaccggcgatgcagatctccggccggcccgagcagtaaggctcgttcttttttggcgggcgcgagctgaggggagctggccgtgtgcggtggtcacagaagagactgcagaagagactagggagaggatgtactcgcctggaggtgaagacgacggtttgtatggggaacatgggtgtgaacaagatgaacctgtatcggttacatcgaggctgtcagtcaagcaggttgtgacagtggtgcaatcgttcggtgagtacaagaggtggctggtgtcggaaataggatttgggggtatgctaaagctgccactgatagcaaaaattgatctgaaattgagcttgtgggtaatgaggaaagtggaggttgtgtctcgtatgattgtaattgataaggatcggaaacttctattcactccagaggatttccacaaggtatttggggtgccgtgcggtaatagggatgtgcgtgggagggatggagacatcagcatacgggctggggagggcatgaaggatatgatggggatgaacagatgtgctggtgacaggctggaggct

SEQ ID NO: 53271 - DNA, 670 bp, Triticum aestivum
  Clone ID: PAT_TA_53271
ctcagtgatgcctcagcaggaaggctaatcgcagggaggtgcgacatgggtggcctaaaaagctaatttggtgccctctctctttgcctcttgtttcctccagcaccttgattttgatggctaatatattgactttctaaacatctttaatttataaggaatgtagtagttatatgcttttcatttatgatagagagattgaacctaggtgtcttgcttgctgctttgtaatataagcatgatatttttctgccgactttgtggacaggctaacaatgaaaattttatctgtaaaatatggtgatccctatagtgctatttctgaagcttcgctgtgcttgctttcccccaacaagcagtaatccaatcacgggtgcatcaggtactatatcatgtgagaaaatcaaactgctcattcataagacaggatttccgctcacatttatcatgcttcgacactcacaaaatatcttgtgagcattaatgcccgcaagcccaacctgaagagagtaagcatctcttcttattctccctctccctcaatttgcttttttgattgtcttgatttggtattgtgatatggtagttgtatacttctgagtgttattccattattatatcctctgaaatgttaaaacctgactagatctggatattggatgtattatta

SEQ ID NO: 53272 - DNA, 376 bp, Triticum aestivum
  Clone ID: PAT_TA_53272
cccactcgtccgggcaaccacgccacccagcgccaccaggatgtcgccgcaccaccaccgagcttccagctcttcccgtcccaatcccctcctccggccggccgctcctccctctcgtcggtcaaaggtgacatttttagtagccggggtgatcgattcgtggcggcggtgctcgattcgtgggggggggtgctcgatccgtggacagcggtgctcaatccatgttggagcagcgggagaaggaggccagggtggagatcgtggtgcgggagcgggagctcggcgagacggtggcggtggcgggggggcagctccggtcgtccacgctcctcgtcagcctgcatgacaagagcttgctctgcgggcggctgggtgg

SEQ ID NO: 53273 - DNA, 221 bp, Triticum aestivum
  unsure (1)..(221): unsure at all n locations
  Clone ID: PAT_TA_53273
ggaacaccgcgnatctcgctcgtgaggccgtcaggaagtcattggtgctgctgaaaaatggaaaatctgcctccagcccattgttgcctctcccaaagaaggccggtaagatcctcgtcgccggaagccacgccgatgacttgggcctccagtgcggaggatggaccatcacatggcaaggacagaccgggcacgacanaactgcnncggacgacgatcct

SEQ ID NO: 53274 - DNA, 284 bp, Triticum aestivum
  Clone ID: PAT_TA_53274
atagccaaaaaatttttttcttatggggggaatgcccatcaccccccaaattattgatccatcagttggcgggtccatgaaaagggtctcctacaaaagggggggggcatgtcggccctggccggggccttggggtccaacagtttaatttttgccctgccgttctcggtttcttgttgccagccgcctcacctggagtcttgggggtcttttggtccccagcatgcccggggctctgcggctcctcccgtgtggccttggcaaccggtcgcgtggcccgcccc

SEQ ID NO: 53275 - DNA, 284 bp, Triticum aestivum
  Clone ID: PAT_TA_53275
aaacatggaaacaacaacacataccatttaaacaaatatggttctattgtttcacaccctcacaacatattctcactcttatgttactccattgatacttttgtttccaaaaaataaaatctattaaaatttctacacttgagccagaacctctcggtcttcaaccattttggcgctggtggaaatgtttggcccgagaatggtaatcatgggatgtccaagtccatgggaagatcaactttggggttggttgttgctttctttggggtgggaactgatgtgac

SEQ ID NO: 53276 - DNA, 515 bp, Triticum aestivum
  Clone ID: PAT_TA_53276
aggtaggatgttggtaagtttataggtctatactattgaactagtgacgccctcaagagatgctctctagtttaggccttgaagttttgatgcaatccctgaaaaccttaactcccattcgacactggcttgttgggctaagtcatcatgcaatcctaaatcaggccctccaaacgcttgcaactttaacgtgtccagatcatcttagctcccctccaggctcaccgtaacaacaaccctggtcatttccttcgcccgtagtattcccatctacactacaatggtcggtccttgaccctcgttccaacttttactgacaacaccacgtccgtccagtttctagtttcgatattcattggaaagctacaatgtttttccaatttcagacgatacttatttgttgacatagttgctgacttgccagtctcgaggaggaggcaataagcaagcttgagtattgatactttgcgagctgcgtgccggacaggtatgatgttgtggctgtgcgggttatc

SEQ ID NO: 53277 - DNA, 323 bp, Triticum aestivum
  Clone ID: PAT_TA_53277
catggcgagcacccacaaactgattctgtactgacttgacgtgcacaactacaatttgtgcgtacactgtcaatctatggaatctgcacaactatgcacaactacaatacatgcatcgcaccatgtccgccacagggggggcgtacactgtcaatctatcggcgattccattgtcaacacttgcaacattttgcaccgcaaccgaattgttgtatataacatttgcatctccatcctcttgcatccccacacaccctatggaatcttgcgcaccatgacatccaatacgaatcgagccgtgaggagactattgccttgggtca

SEQ ID NO: 53278 - DNA, 469 bp, Triticum aestivum
  unsure (1)..(469): unsure at all n locations
  Clone ID: PAT_TA_53278
gaatattgtaacatcaacattacgtcatttgcattaccactagtatgcactgttcaaaccaactcaacaagaatactcatctttacaataaaaaagtgtgcaaggaaacaagcttcccaaaatttgaaggataacatatatacactaaccctactactgtactgaaaatcacccttctagtattaactaacagagttccttccgaaagaaaacaaacattttatcaatccggcacatgccaatagcctcacagccctaaagacatgggggataacaattgggacgcatcaaaacagcaacttgaataagaggatataaaattactacaacacaaatacagatcatgtgtactaacataagattggcaaccttttactggcagtcggtacatcctactgtcccatcccataccatctaccccttgccgcccttctctcccgatccaacatnggatgcacaagcctgcctg

SEQ ID NO: 53279 - DNA, 434 bp, Triticum aestivum
  Clone ID: PAT_TA_53279
gggggggggtcactttcatttctaacagtttttatgtccaaaattctataacagggtttgggggtttgtcccattcacgaggaatagctcgggcgcgcaaaattctcgatcctttgaaacacatgtaaataaagttaaaaaaaaggcaaggctcgcctaacccagccaatggggcatgtaagttcttggtcctttttgggggtaaccaacaaactcttcctaacacgtgctggaaaaccccaccccttgtccttttagttgcccaaccccttggcaattttggggcgggcgtcttcccccaccgccagcgtttcccggattgggttcggctgagggaacccctcttcaaaggggttgttttcccacctctctatgggtttcccctttttcacttgccgctggaaaacccgccgggtgtggtgatttttggcaac

SEQ ID NO: 53280 - DNA, 660 bp, Triticum aestivum
  Clone ID: PAT_TA_53280
ccgaagatcaaaagacaaaaggaaaaacagcagccctagaagctgcagcacaacactccttacaaaccacactaggcagtggagctccgactccgacgatgaactactaaggaaactgggcaggggtggcgtcacggaggatcaccgaacgaatcacctgtcacgcatcatcgtataccactggtcccccaccacggcttcgatttcacatcaacagacagtcgaggcactcccacagacgcgtcgaagaagaagagtcggctaccacaaccagggccacgcctctggcattgctccccactgtcatcattgccacagaagccaccgtgcacgtccagtcgtaggaaggcaccacaaggatcaaagtcttcaagacggcaccctaaagaggggaacgacgttcaagacgacgctaccgcccgaccatgcagcaggatctaagttttcacccgaagtacttgatccggaagatccggctgtgagattcccgacgacgcctccaaggaggatagcgacgcccacaggcaccgtcgccgcggccggccagcaccggccaggctttcacccgggcagccactcccacgcagcaggccgaagtcgacccttgcctccactggaccgcacaccccacaaacaacaagcgcgtcatcgctgtgcagg

SEQ ID NO: 53281 - DNA, 638 bp, Triticum aestivum
  Clone ID: PAT_TA_53281
gttacctgaagctccatgtgacatacttaagttcagttcgtgtgctacaagggtagcatttttgacagcaatagcagggaaagtcagggcttcctgacggatagatggggaggctaatacaaggtccctacgtggtttatggaggaaggacggcgagcaatttccatccagcactgttgatgcagattcaccgtccctaactacagaagcctccatggtgtttgcttgcactgttgcaacttaacatgaaaggaggattcgtccagcatgttgatcctggaattgagagatgcacttcgttgtggccgtcgcaacgatcgtctgggcagatgcagtccatcatggtgattctccccgtagatgcatgtcgtctcggctaagctcagatatgctgatgggggacttctctaaatattattcttcaactataccagtgttgaacagtaaaatagcggctgcaagcaaagaaaaaaattgctcttgaaactcccacaaaaaatctaactaaagcttcagcatgataaaaaaaatactaaaaccacaaactgtattgaaacaacaataaccaatctgatacacgctggcaaaaatagagagcaagggataagatacataagtaatattctgggaatacttta

SEQ ID NO: 53282 - DNA, 655 bp, Triticum aestivum
  Clone ID: PAT_TA_53282
gatctgccgtgcaatgattgacgaactgatacatgagctagcacatctggccaaccaatttggtaaaatgcgtgatcgaggacactgtttgttgcatcagagagaatgaaagcccaaataccctagcgttctagataggacacatgctgtcgacgtatttcattggagatgctatgcaactactgcgcgtcatgagcactatgactttacattgaatggaacaaccatgcctggactaagaacagtgtcacttaggcgcacattcactatcattgcaatgctccgtggaatcaatgctccatgcttgttactagaggcttccaccaaataaacacgcatgatgtctatccctcacgctatctgaagtttaaagctaattactgatctaaatcagctgaatagcgctcatggtgatcaccacggcagaaaaagctgctatgtattaccataaccttctgaaatggcctcttgtgcatattaacatgctaatggactggctaactgagaaacttcacccggacacccgagatggccctgaccctcttgatgacggcccagatgaccccctcgtttcactccagcgaggtgagggagcccatgtaccggtagtaggcatagccatctcctgtgggctaccatggatccaccatgacta

SEQ ID NO: 53283 - DNA, 503 bp, Triticum aestivum
  Clone ID: PAT_TA_53283
acgggcaaagggatactaaaggaaaaatctttagactttttacactaaggatgggaaccacccaaaaaaaggactccatggaagcaaaaactaaaaagttccagccggggggggtacaggaaaagccaagcaaaaaatttttttaaaggaccccctaaaaaaaaaactggggggggggaatcggcccctaactttttagaaaaccatcccccatccaaaattcaaaaaggcaaaagggttttcagggccccaaaaaaaatttgaagcctaggcactctggggggaaagaggggtgcaaaggggagtcactttagggatttttaaaaaaaaccagccttgggtggagcttttccaattccgaactttaaaaagccggaaccttttttcaaaaaatttttccttggggagccgaggacaacggggagggaacgtaaaaaccaatttcggggagcaccggggtagaaagcttttaagtttcgcccccagccggggcatcggcaaaa

SEQ ID NO: 53284 - DNA, 692 bp, Triticum aestivum
  Clone ID: PAT_TA_53284
ggtgaaaaataaatacatctggcgcgagcttccactgcttattctcacctcttacgaatgtactcgtacacacaacacttgagaattacaatgtcatacgtggcaacacttattattacattagtatcgaccccaataatacctatcgggccactagtaatgcataaaagtgttatattactaaagaggtaatcttcatgggcaattggagttcttccctggcccccgatagtagatgtaagtacccatgtcgctagacataccatttttgcattatagcagttctgttgcttagctatagtcttcacatcacttggtggtttgagattattggacgaatctaccacttgtatgttcttgatataactagccttgccaaacccttcctcagggaagtgtccactacccatctgtgtggaagtttggccggcatcgggtgagaatacctcaccgccccattgtacagtagatgcactatcagccaagtatgagaatatcaatgatggccaataacccacattattcgttcccacttgcaaccaccaattgccactctttgggtccttccaaactaaaatatccaagtcatattgtgtgcctccataggtggagaccggggatatggtaccaccaagggcattctgattattcgtttggacgaaccctgagcactttaggttggaacatcctgt

SEQ ID NO: 53285 - DNA, 719 bp, Triticum aestivum
  Clone ID: PAT_TA_53285
aaagcagttcacaaatgtttctgccttgcaaatttctgagatttcagggcctacctattaagttgcaaatattcaaggacaaagcatccatgcggccatgtcagtatgcaagatttttaacaattgctttgtcatctgctggagaacatgaagaattcgtttcggtacttccttaccaaggagaggccaagtgaagtatatatatgggtagggcacagtttcaaaaaagaattttctttgtatagtattgttgccctgtatccaaatccagctcaacacagacgaacaagacgccatgcaaaggctgcagatcaaccgattttcctacccttcactgctgcaaaaacttgttcaatgcagttgtgtccaatgctgaaaattcactcgcagcagcaagcactgcaagtccgagcttcatggcgtcattcttgctttgtgcctcaatattaaggggaagaaccggatcatggagggatagcctcaacataaaccagccaccatatccagaaactctgacgccttcatgattcttcggggctttgtttagatttgggtctttgctgatcacactctccaaatgtttcaagattgactctccatagtcacggaaggaccctcctttcaaatctgcatgattttgatcaatcttcaaccttatctccactgtcacagcagccttctcaaggccctcgaccaaatcagtcaaaactttactaccg

SEQ ID NO: 53286 - DNA, 520 bp, Triticum aestivum
  Clone ID: PAT_TA_53286
cgctcaagcccccaaacgccgcagcgccgccactccacccgcagcggcaaccatggcgggcggcaagaacaagcgcatctccaaggggaggaagggtagcaaaaagaaggccgtcgatccgttcaccaagaagcagtggtatgacatcaaggcgccgctgctgttcaccagccgcaacgtcggcgggacgctcgtgtccaggacacagggtaccaagattgcctcagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaggtctcttgtgaggaagtggcggacactcattgaggctcatgtgggtgtgaagaccactgacaactacatgctgcgcgtgttcaccatgggcttcgcgaagaggcgcccaggccagcggaagcgcgctggctgtgcc

SEQ ID NO: 53287 - DNA, 361 bp, Triticum aestivum
  unsure (1)..(361): unsure at all n locations
  Clone ID: PAT_TA_53287
gacccagcgnccggctnctacaaacaaagaggcgagcaaagggggggccggcaaggcccgnngctcanggcggggacaanggccggacgggccgncggggcgcgcgcgggcggnannggancnacgggggccagaacggnnacgagggcccgcnggngcaggcgngcgcgacggggaacnacangnnngncaacggggggggncnnnncaccnnnnncaggggnnanaagnngnngnngnccggggngggngccgggggggggggagcgggggggggggggggggggggggggnnnggcgggggcgggccgggccgcggggggngggggggggggggggcggcggccggggggnggggggg

SEQ ID NO: 53288 - DNA, 777 bp, Triticum aestivum
  unsure (1)..(777): unsure at all n locations
  Clone ID: PAT_TA_53288
cccacgcgtccgcggacgcgtgggatggacggatacctcagctacctgtccctcgagtatgacttcgtctcggacaccaatcctgcttgggtatcttcattttggaagcaggaatcctttcctcataagatggatgagctgtaggatttgattctgttcagcttgaattagtttttcatcatcatgttctttgtattaggaattcatgccttccagctctaattttttcgcattgttggtgtatgctgggagtcacattattatgctgctagcaaacagtaggattggaagtcttactctgtagtgaagtagctaccaagcagcgaggccatcgagtgacacgagaccgcgggacggcgtgagaagaagcagggggtgtctggcgggatggagaagaccacagggaagtgtggcgatggagtgcaatcccgaagaagaagaacattgcaaagaaagaccctggccaagtgccacccaattctctttcaccgacccatctaatggccatcaattcaattggtccaagctgttgtgttgaccttcccattgatccactacatcctcgctcagctggttctgctatgtttcttctccatggcattgctggttgccggcgtgcctgacatcgcgccttatgtgacgtgacatgatgctcctctacgtgttcttctcaccccggnttccatgaggagagatgttgttctgtggttctgtagttctactccatagcaatgatggagtcgcctccatatggatagcaattatctcgggatcatg

SEQ ID NO: 53289 - DNA, 621 bp, Triticum aestivum
  unsure (1)..(621): unsure at all n locations
  Clone ID: PAT_TA_53289
gacccagcgnccgctnggnaagnccacatacatanccatactgcgggggcctatagcaccnnctagnnggcaaactctctgcagactgagacatgggttttgatcgtgccaacacggctaactgcgtcgccactggccgcggacgcaccgtctgtgtgaccggcgccggcggtttcatcgcgtcatggctggtgaagggcggctggagaagggctacgccgtccacggcacggtccggaaccctgatgacgtggcaaggaatgcccacctgggagccttggaaggggcggcggagcggctcaccctcttccgggtggacctgctggacaaggagagcctcatcgctgcattccgaggatgcgaaggcgtattccataccgcatgccccgtcaccgatgacccggaaaaaatgatcgagccggcggtaaacgggacgagaaacgtgatcaacgccgcggcggaggtgggcggcattcggcgtgtggtaatgacggcgacgatcggctccgagtacatggatcctggacggaacaccgatggggaggccgacgagacatgggggggggacctggggggctgggggaacacagaggactggggctggtgtggggagacgggggc

SEQ ID NO: 53290 - DNA, 394 bp, Triticum aestivum
  unsure (1)..(394): unsure at all n locations
  Clone ID: PAT_TA_53290
ggnagtttntgctttntgtttagggctcgaggaaacaaactatcacgcagtattgtgaatttgaaatggtgctcttctcttccaaaaatgcatagcaaaatttcagggacctgcagatagtttcttgagtaacaaaatttaggaggcctgactaattttattatgatagttcagacatgctgccaatgaagttcaccctttacagaaaacagcaagttgtttactcatgtgttggtctgttattagactgtagggataaggtaccttttagttgttactacaccaaggntaaagctttggtcgctttgcataggtgcgccgtttgcttctacaatggacagatgtggctgtggttgcgagaggacgccagaggcgtactgctgtggaagagaga

SEQ ID NO: 53291 - DNA, 440 bp, Triticum aestivum
  unsure (1)..(440): unsure at all n locations
  Clone ID: PAT_TA_53291
gacccacgcgnccgaggaggagggggncccncaaggacacggggggggaggagacggcgnncancgncaaggccagggcggaggaggaggcggngangggaccgaagggcgccgangcgaccccggacccggagggggaggacnngnacgacaaccgccccnacgacncagacganganccagacaccgngngcgccaagcgggcggcanggnacgaggagcaggncaggaagcggcangcacgcccgcccngggggaaggangacgccggcggcgcggcccccaagaagcanggggaggcngncgcccggcacaacgggcagcaggccgcggcggccgaagggggcgcnccaggggcgccgagcccgcgaaccagacacgacggagggcacccgccccccccgcgcccccgcgcccccggcccgggggggggggcgggg

SEQ ID NO: 53292 - DNA, 564 bp, Triticum aestivum
  unsure (1)..(564): unsure at all n locations
  Clone ID: PAT_TA_53292
gacccagcgnccgcgcaagcaacgcacgcaacaaggacgcgagcgacagcgaagcccgagccaaccnnggcaacgggcgacaancncncncnnncncncncncncncggggancaacgncgaccgagcaacnacacccagcngcaaggggcaagcaagcnagcncgacagnnagcaagggaggggaaggggnnggggggggagcgcgncaagcccgccnacaanggcggcgccgcgccggcaccanccaccgagnacancccncngnccancnncgacaaggggacgnncaacangcaganggccancancnacgccnncgccgcgccggcgccanccacggccgccancgagaagggccccgccacggnccncgcccagnaccgagccnncgcgggccagcncggcgaggcgcccgacggcacgccgagccacaaccacaacgaccgnggcgcgcgccnggnngaggcgaccgaagacgccgaccacaacgacanggcgccagcgaaacccacgccggagcngcacaagcngcaccccgaccaagagacggagcacgaggagg

SEQ ID NO: 53293 - DNA, 533 bp, Triticum aestivum
  unsure (1)..(533): unsure at all n locations
  Clone ID: PAT_TA_53293
cagcncaccctcggggggccgcgggaccnggcgcncaacgccncaggccgcccggacccgcggnncgccggccacnncgaccccnacggcccgancnacaacgaccgggagcgagcccagannnncancncagacgncggagngcnggccgngncannggcncngcngaagcgcgggggggggngcgggnncnggngggnggngcgggncnacggcgngccgcngcngancgngaacgcnnggcnggnccngancaccnaccngcagcacacccacccggcgcngccgcacnacgacncgacggagngggacnggcngcggggggcgcnggccaccanggaccgcgacnacggcanccncaaccgcgngnnccacaacancacggacacgcacgnggcgcaccaccnanacngcaccangccgcacnaccacgccagggaggccaccaaggcgancaagcccangcagggggagngccaccagggggaccccacccccgacgccaaggccacgnggggcgaggccaagggggg

SEQ ID NO: 53294 - DNA, 490 bp, Triticum aestivum
  unsure (1)..(490): unsure at all n locations
  Clone ID: PAT_TA_53294
ggccggggcaccccncnccccggcggagcggacggngncncagcncganncggggccggggcnccccgagaacgggggccggaggcggannnggncgccaagggccgagcnnncccgncgggcgggngnnncgggacacaancccagancgnnnnggcnnccggagaaggcnncgggggggggggggcgcnganccgaagcggaannggcggcccnccaaccgncgccgccgganaggcgcccaccnggagggcanngagggcngacgccgaacaagnacngaaacnnnncccggcccnggagcaancngacgacgaaacgcngggcaaacggcggcggcngggagcgcagangggggcgggggccccgagcanggaggggacggaggggnggggccagacgacgcngggcgacangccggagagcngcgnggcgccggagccgcagaaccaggacccggcggagaaangccacgggggccggcagaacc

SEQ ID NO: 53295 - DNA, 404 bp, Triticum aestivum
  unsure (1)..(404): unsure at all n locations
  Clone ID: PAT_TA_53295
ggcgacgccaaacccccccaacggggccaccaaaancaaaccaacgggccgccgngngacgggggggggacggggaaaacccgggggncccccaacaaaagcgccgggcagcacaccccccnnccgccagcgggcgnaaaaccgaaaaggcccgcaccgaccgccccccccaacagnggcccagccggaagggcgaaggggacgcccccggaagcggcccanaaagcgcggcgggggggggggcnacgcccagggggaccgcnacacgggccagcgcccaagcgcccgccccncgcgcgngcgccccnncccgccccgccacggncgccggcngcccccgacaagcccaaaaccgggggccccnccnagggcaccgannaagggcnnaacggcacccgcacccc

SEQ ID NO: 53296 - DNA, 450 bp, Triticum aestivum
  unsure (1)..(450): unsure at all n locations
  Clone ID: PAT_TA_53296
aagagcagcangaacagagagcgagaaacaaggcnaggaagggagnngcgggcaggggngcngnngcncncnncannggagcgnncgcnncngnnccnacgagngngcaanccancggcgngngcnacggcgngancggcaacaaccncccgncccggagcgacgnggngcaggggggcaggnccaagggcancaacggcangcgcancnacnncgccgacgggcaggcccncncggcgccccgcaaccccggcancggccccancccggacagcggcaacgaccagcncgccaanancgcanccagcacccgcaacgcggcggccnggggccagaacaacgggcggcccnacnacccggcngngaacangaaggacaacggcgccggcaacgagggacagggcggcgccacgcagagcangcggccgggcangcggaaccngaacgcgg

SEQ ID NO: 53297 - DNA, 733 bp, Triticum aestivum
  Clone ID: PAT_TA_53297
ctggtaccacacacattattagtaatttagtggttgcaagagcttagcgatggtgctcacgacgcttctcctcctagggctcttggtcggcctcgctggctccagccctccgccggcgactgtggtctgtgctcacggcacgttcgactgcaccgtctccaatgcgtacggctccttcccggaccgcacagtctgccgcgcggccaacgccaccttcccgcgcaccgagaaggagctggtcgcggccgtggcagccgccgcggcggccaagcgcaaggtcaaggtggccaccaagcactaccacagcttccccaagctggcctgccccggcggcagcgatggcaccatcataagcacggagcggctcaaccgggtggtgagcatcgacgtcgccaaggggttgatgacggtggaaagcggcatggtgctccgggacctgatcaagaaggccgccgccaaagggttcgcgctgccgcactcgacgtactggtcagggctcaccatcggaggcctgctggccacgggcgcgcacggcagctcgctgtggggaaagggtggcgccgtgcacgagtatgtcgtcgggatgaggattgtcacgccggcgccagccagccaagggttcgcggtggtacgggagctcagcgccgacgatcctgacctcgacgcgggcaaggtctccctcggcgtccttggtgtcgtttccccagttacgctggccttgcgggccatgttc

SEQ ID NO: 53298 - DNA, 247 bp, Triticum aestivum
  unsure (1)..(247): unsure at all n locations
  Clone ID: PAT_TA_53298
caacaaagaagagcggggnnaaangngagaaacnnncagngagcgccnncgcaaggcggagaccagcaacaannanggggaagcncaagnnngcngaacaccnnaaagaggccgncaccnacanngaacaggggcgggggggggggggcccagagacggncaccganccagccccccnngngaccaggaacanggaggacnncaccaccngggnggannccncgaagancaagaagaagaacangga

SEQ ID NO: 53299 - DNA, 602 bp, Triticum aestivum
  Clone ID: PAT_TA_53299
tcgacccagcgtccgggaagaagttgcttgtaccaatgggtcatggtcagggtcatgttatcataccaatattgctcttcttttcatttgcaccttactacatcactttggccgaatcgatagatctgggtggcactctacaaacaaatgagaaggatggtactctttcaagatccaatccttttcagctcaaagggagagggaaaactgatggaaaaggcaacactaaatctcattatgcaatgtggcacacggagccaggaaaattctatggtcttcgagctgaaatgagtatatggggttcacctaatcaagaaaactctcaagaatccggatcagccatacagatctactgtcaagaaggggaacactacagcttaattgaagttgggtttcatgtttccccctctttgtatcataaccgagacgttcgattctttacatacacgacgagggacaccaaatctgcaggctgctataacttgcagtgcccaggatttgtgcctgcaagaggagctgcactagtgcctgaacaagctattactgccccatgaatggatggacaaggcggtcactacggcaggcttaggctaaacaaggat

SEQ ID NO: 53300 - DNA, 676 bp, Triticum aestivum
  Clone ID: PAT_TA_53300
gcactcaataaaaagataatgctagtcatcttatatatatcatcaaaaacttgcctgcaccaaatttgtacagaaacaaaagacaaaaacaccttaacgtgagatatgattttctaatccggcggcagcaccactcccttgataaatcacgagcttgtgctctagatttacatgcttgatcattctcttccccgtcggtctccgcctccgctccccagccttgttgtcctcctcccctgacctccttggcttcaagtaagtctcgtacaaagttttgtcactttgtctagatttttggccctaaatcatgggcgtcctcagtacacgcacctatggcctgagctgcagttattttatatctgctattttgcgttgccagcgttcatgtgtcacctccaactcatagcagccagagaggacattagcgacctccgtaggtaaattgtacaggaacatcggtttctctttcttcaggacaactgactgataaatctcatctggtgatttggcacaccaagtctgaacgccactgaacatctcaagaaagctccaagcgaaaccccaatgagtcagtctcgtaactaattgggcctctgatgtttggtcgccaatgttctggggcatgtaatttggagtcccaagtctttggataagatctggatttggcagcggaagt

SEQ ID NO: 53301 - DNA, 420 bp, Triticum aestivum
  unsure (1)..(420): unsure at all n locations
  Clone ID: PAT_TA_53301
cacgaannagnccgcagcnganggagancgaccggagnaagagcnacaggacgnaggaaccccgggaaacanggaagaanagaccgggcgggggggcaannggcaaaccnnanaggggacaccggcgncngancggggccggggaacaacccgaanggccncagaggcacgagcccacccngggggggcgcggggaacagggcgaaganggacgggcgcaggggcccggcccagcagggcgagccnaggccgacgnggacgaacaggaacaggaagaacgccngcgcgaaggagggggaagacaggncgannncggaggagggacacccggggcgggggaccgcgaggggcacgggcgacgcacccgacggaggcggacgcgggggggggcccgggaaggacgggccggggccngggggc

SEQ ID NO: 53302 - DNA, 421 bp, Triticum aestivum
  Clone ID: PAT_TA_53302
caataaagatcacttaaattaattggtgaacaagtaaggaggaaatggggaatacaatgccacgacttgcaatcatcaaacgggcacgcatctaacttgaccaaggtgcccatggccatggagttgtcaggacatatcagcgtgggggcggggtaagatgcccttgtcctgaaggctggtgacagtgtcgtagacacactggctcgccggcgtgatgctgacaccgagctccatgatcctccggctgctgaaccggcaccccttcttcatctcgcccgccccttccttgctcctcatgggcacggggtactccgggaagaacttggcgaggatacgacacaccttggcgcggtgcaacgtgcgccccgcgcagaggtaccgaacatgcgcgtgaggcatgtggtacgcacacacgtgcgcg

SEQ ID NO: 53303 - DNA, 446 bp, Triticum aestivum
  Clone ID: PAT_TA_53303
gggttggggggttttttttttaaatttttaatctgaaaactcatgttacgtactgtgcaagataacatgtgtgtgcacacagtggcgctgttcaattctcaaagagaaaaagaaataacattattttgtttgtgccaccctgtcaatgaatcaactgagggggggggcactgtttcttgggcaaattaacagttgggccacctactgcatggaataggagcgttctttgaacgcctggaggttctattggaataggggtgcgaaggcgtggacgctgcgcggggcgaaggtgggcggggcgaggaaaagcatgcactacgtggggaagaaggccggggtgaaagaggttgggctgggggggcgcggaggctggtgggggaacgggggcgggggcgcggtgtgggggtgggggggggggggctgggggggctggggcgcgggggtgg

SEQ ID NO: 53304 - DNA, 267 bp, Triticum aestivum
  unsure (1)..(267): unsure at all n locations
  Clone ID: PAT_TA_53304
cgccanaaacacgaaaggggcnacaacaacaggacacggacggggggagnagacgccaaggcaaggacagacgcacacacaacacacgcgggggggggcacggccacggacaccgacgacgacagccggccaaaccnaagccgacgacggggacacagagaaaaaggaaagacggaacggaccaaaggcacggacacgcnacncnngcgggcaccacncagcncnacnagcacgggcacgggaanagaggagcggnngggggcccaa

SEQ ID NO: 53305 - DNA, 592 bp, Triticum aestivum
  unsure (1)..(592): unsure at all n locations
  Clone ID: PAT_TA_53305
ggggggggggggggggnnaagagacagganccaggaggagggnnnnacaaaaacancaccacaacaaggacgaacaaaggaaacggcngcgggnacagaggaacaccnaccacncgaagagacancaccaccnacagcgaaagccgccggaccccagggggggggcgancacnacaaagaaaagcggccaggacnccaggggcaaaggaaggagagggacaacgggggggaggacgagaangggcgggaaaaaggcaaggcgccggcnangaagggccacagggagggaaacagagggggggcgaaaggacaggcgagggcacagcgggggcggaggaggccggggagggggggaggcggggggggcgcacaggccgagggggggggggcgggcggggggggggggggggggggaacgggggcggggggggcagggggcgggcgggggggggcggaggggccggcgaggcgggagggngggcggggggcgggggggcggggggngggggggggggggggggcgggccgggcgcgccgcggnggcggggaggggggggcggggggcggggcggggggggccgggggggggggg

SEQ ID NO: 53306 - DNA, 212 bp, Triticum aestivum
  Clone ID: PAT_TA_53306
accaaacacttgcaataacactggttgaagacgggagtacatgacaggcgccaacatggctggggtgatgatgacacatgttgtgctcgctcttattccgggcagaaacaccggggaactactactggatgtggagcctgacatgaatgaactatgggacgagcgcaccggtgcggatgggtgtggggatgataagggggaagacgagccca

SEQ ID NO: 53307 - DNA, 615 bp, Triticum aestivum
  unsure (1)..(615): unsure at all n locations
  Clone ID: PAT_TA_53307
ggggggggggggggaggggacaaaaggganaagaggaggcggccgggcatanacanagccaccganagcanncacatacgagcatgcnnncncgagccaggggggnacatgaacanggacatacacatattcttaggaacaaataagaaagataaatggggggggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttgttgacctgctgcacctcgttgatcacctgtgtggcgtgagtgcacccgaacataggcagcttgcacattgggcaatgccggccatggtggggcccaggagatgcgttgggctcacggaagatgaacccaaccttgctggactgggggcaaggcgcccactgggggcgggtgcaggggggggcctggttgaggaggggcttggtgctgggcgggggcggggttgacaggggtgtgggactggggggtgccctgggtgggg

SEQ ID NO: 53308 - DNA, 623 bp, Triticum aestivum
  Clone ID: PAT_TA_53308
ctcatgcgaggagctgcattgcattgcattgcattacattacattacaagtgaggcgcgtcccttctcttcattatttaccccttgaaccacaggcggaggcggaggcggcaatacatacatgcatacatacaagttacagatgattatttatctccttccttccttccttccttcctacagagtgcagtcaccatcgtcacacagcagccaagccaagccaccacatgaaggcgcccgtctgtctgtctaacaagacgatgatggtgtgttcttgccctcctcctcatggtcatcctcatcatcctcattatcatgggcagcagcagcagcaggaggaggcttggccatctgcaggtagccctgatgggtgcacacgcgctccggctcacccttgaaccacaggttccgcagctcccccctcttccaccccagcgacatcagcgtccctagggtgaaaggcacgatgtagagcagcgccggctgcccgtgcccgtccatcaggttcagcgccacgtacgtgatcaggagcccggtgccgtaggccgacgccgaccacaggaagtagccagatcgcaggctcttcttcgcagcccaggcataccttaacgcaaatgcaacaac

SEQ ID NO: 53309 - DNA, 492 bp, Triticum aestivum
  Clone ID: PAT_TA_53309
cccggggaaaaaacaacttcacattgttgggccccggtttttttttttcaccccgggccacattgaaccaggaaggggaaacacatcatgttcacaaagggggccttctaaacacatcaaaggggggactcgaatgagcagaccctcgcctttgggtacaccttccccggctggcagtggtggccctcctttggggcccagggcgagtcgtttgagcagacccaaagcccctcgatggggcaacgcttttcaacgatgaccgggctcccattgttccccagcccctggtcactccattcgctcgagaagatcccatcagagtcggacctgccctttacctcaaaaaatttgctggccttggggttcttgacaatggctccttgaaaggcaaagttggggtttttgccccagtggggcatggcaccgaccttgcggggcgccctctgttgaagctgttggggcacatgagggggtggtgggggggtcaccctt

SEQ ID NO: 53310 - DNA, 160 bp, Triticum aestivum
  Clone ID: PAT_TA_53310
gttggcatgataagatcctgttaagaaacattgttccagatcggtgcaaactggggccacagcgggaaacaacagcaagaagactgcaggctttggcggttactgtacccacccggaaaactggggggggggggtttgttggtgagcgctggctgcgcca

SEQ ID NO: 53311 - DNA, 302 bp, Triticum aestivum
  unsure (1)..(302): unsure at all n locations
  Clone ID: PAT_TA_53311
ggtgggggggggggggggcaaaaggggatncaggggggacancggcnacaacaccaggggacaagggcacanccaacaagcaggcagggcnccacagaggcanaccangagccacgggcnactgcccaggaaagaaaaaaancagaggccaccagcgaggggggggggggcgnggnagcacacnccncggnngaggggcngacccccaccggngggccgacnggggggcgnaggcccggaagagggcggcggggccggcgccggcgaggggagcgacgaggccgccgcgggggccggagccg

SEQ ID NO: 53312 - DNA, 631 bp, Triticum aestivum
  Clone ID: PAT_TA_53312
gggccgaaaatttgtttctctgaagggtttatcacatgacaaaacatgggctgtaaagctttttgttcacctgttcatccaaaaggcattaatgagttgctgagtccgtgctacggagcatgattacatttggtttcagcgcatcgagttaaatgaaaacaccatggtgtgaaaatcactcaggcaggcattgccaaactgcagggggtttgtaacttcgtaaaaacattcgtcgtcccgtgaggcactctacacttttgctcaagtctagttatacagcaaaaagcgaggataggaacaggatcctgaatcacttgaaggcagggcaaaatgaagggttcgccatgtcaccggcaaaaggctgcacaggagtaggggaattaggcccaattaaccatcaaaagacaaattttttcaccatcacatttgcaaagctaccacaggcaacatactaaactactttgctgctgaattggatgctttctggatctccgttgttatcgcctcaacaaggtctgatgccttatactcaactccaaagcattttactgtctccaggcatggatctagcaagtacatgttatgagaactctctacaatataatcctgaccaacttcaccaacttttttg

SEQ ID NO: 53313 - DNA, 675 bp, Triticum aestivum
  unsure (1)..(675): unsure at all n locations
  Clone ID: PAT_TA_53313
ccggaatcgcaattgcgggcacgacccacgcgacccattggaggtaatgtatgggggtggagagggctacgtgctgtacaacaggaggatctacgaatttgctctacttgttgaaaaactctacaaggtgcaggctcatggtgttcaagaggcaagagatggggtgcacaagcatatgctcggtgtttattgagatggactataaaaccataattattattatgcgctaacaatcttgggagtatcgtgtactcattgaatacctggtggacttgagcttaccgaagatgatgaaatcagaaactaacttccatttattctcattgtgagggggggggggggtaaaaaaagagcaatctttttctttttttcctnnggcggggggggggggggangaggcgagccactctctattttttattttttttttttctaagnnngaagaaagtgattttatattacccccccccgccgcccgcccggaagaggagaggatttntattgtttttgtnntccccaccccccccccgcccctttttatttttttttttttctttttggggggaanaagaaaaanggggaanaataaattntcccccccccccccccccctccttttttttattggggagagagaaaaaaaaaaaaaattttttttttttttttttttttttt

SEQ ID NO: 53314 - DNA, 580 bp, Triticum aestivum
  Clone ID: PAT_TA_53314
catatgtcacgtcagtttagatataagaataaggtcattaattttagcaggctcatggtgaagaggatattcaacgtgcaatcatgtgatagacccgtgaagctcctcaaaaagagcgatcaacgcaacctttgcaacatttacaaagaggggaacaccgctccaatcaaccatgcaattgatttgttgaaagcttgcagcgagacggatgaggtgatggtagagaggacatggattctcattaccttggcgacaatcctatgtccatgcactcagaatatgatcaaccttgaatacatggcttcccttgaagacatggcttcggtgcacgagttcgcttgggatgagcagtttttggaagcaaccatggaggaggttgtagtgttccaagataagaagcaaatctagcaaacaacgaaaaatcctccagagttttagattagctcgtgtctacatatgctcgtgttccagagttttgttgcatgcattgtatatatgctatagcacacaccactattttcccaatgtttttttgctctatgtttttttatcgcagatcatatatatgggtcatcttgat

SEQ ID NO: 53315 - DNA, 738 bp, Triticum aestivum
  Clone ID: PAT_TA_53315
cccacgcgtccgaaaccgttgagttcaagcccttccaggaccagaagcccggaacttctggtcttcgaaagaaggtcgtcgtcttccagcagcctcactacagcgaggccttcatcaccagcatcctgctgtccatccctgagggcgtcgagggctccaacctcgtcattggtggtgacggtcgctacttcaaccccgaggccatccagctcattgccaagattggtgccgcatacggagtcaagaagcttatcatcggccagaatggtatcctctctactcctgctgccagccatgtaatccgcatccgcaaggctactggaggtatcctcctgactgccagccacaaccctggtggccccaagaacgacttcggtatcaagtacaaccttgccaacggtggccctgcccccgagtccgttacaaacaagatttacgagttctccaagactttgacctcatacaagattgccgacattcccgatgtcgacatcaccactgttggcactcagacctacggcgccctcgaggtcgaggttatcgacagcactgccgactacgttgccatgcttaaagacatcttcgactttgacctgatcaagaagttcttctccagccaccccgacttcaaagtcctcttcgacggtctccacggtgtcactggcccctacggaaaggccatcttcgagcaggagcttggattgagcaactccacacagaactgcatccccagccccg

SEQ ID NO: 53316 - DNA, 558 bp, Triticum aestivum
  Clone ID: PAT_TA_53316
gaatcctcaaaacccttccctttatattcttgcaagttgcatgctttactttccgctgccaatatactctttgcatgcttgcttgaattgtgtgatgattgcttgacttgccctaagataggtaaaatctgccaaaaactaaaattgggaaaaagttaagtttttatttggtcaagtagtctaatcacccccctctagacatacttccgatcctacaataagacttgatgttcttcgacgtgaatctgagcttgtactctgacagtgatttgaacttgcaccacctgagtctggcccaagtatcttgagaagccttgagatagcctctcgtttgccttgcagctgactagtgatgccgtgtatcctttcaaaaaatgcatccttgttccatccgccagggttagtggtggtgacctggctcgagctcctgttggagcatgcagtagtccagctcgtcgaccacatcatcggcgtcgtagagcagctccttgatacgagcgagggatcgggacagcggcttgttcccggtcgccctcccctgcacggcagaaaccacca

SEQ ID NO: 53317 - DNA, 673 bp, Triticum aestivum
  Clone ID: PAT_TA_53317
gttgcaaggcacacaaaatgaatagttgcttgttgtatacaacaaaagtggcaccatataaaaccagatgggtgttgatcatcaggctgggccatacaaaagaagtttgcttactcgaggaaatatcacatgtccaaattgccctggttccctagatgtacaaactgtcacccttatgcctggaaagcacctttccaatcatctttatcagtcaccaaacaccatcataagtcttgtatttgagtgcattgtcaatcttcatcaatgactataatgccacatgatgcttgatgcttgttctaaaaatgcataaatgatttatcagtggaattgactgaacgtgcaaaaataatagtaataatcatatatgagcttcataatatacttatttattactacggggaggtagcactgcagtgttttttaagataaatgcacaaatttgggagattagagctgattcagttcaaccaagttgccatttcccagtggccagtgctcatctggacaacctgaaaaaaagaaggaaaactgtataatagaagctatagaacatacacatgctgcatgtaattcacagtaagtgctcagcaatgcaataccaaatcagaagagaaatttcttcaaacaagtcatgggacaatgtgagtaaatatactccatatatctactg

SEQ ID NO: 53318 - DNA, 434 bp, Triticum aestivum
  Clone ID: PAT_TA_53318
ggcaacaggggaaatttattggttttgcttcaattcccgcaaagaaagaaagaattgaacaaaagggatttttttacccgtttgggcccagtctaccaaaccacaatcacattaccagaacctggccagaactacttttgcacaaagcccgggaaaaaaccaagtaaatttattcaaaacattccatggggctctcaaaaagaacgggctggtccccttctggacttttgttatttgggagaatgaaaacttgaaataccagggggcgattaaactggttttctcagggctgaaatatataaaacaattatgccctcttgattcttttccgaaaaacaaaaaggtatccccccagcgcaagcagcgagatccaagtgaactttgaaatcttcttttttatcatcagcagtaatgcggagctcaaaactgttttt

SEQ ID NO: 53319 - DNA, 568 bp, Triticum aestivum
  Clone ID: PAT_TA_53319
gatgataatttgcatgccattatataaacagaggagatgcttttacagtacaatcggcaaaattggctcaaacttgtacaacttgcacaacagaaagtaagctcagctaagtcggctcttaatacaacatacaaagagcgaacaccacagtccagtcctgaacatgacaggaactagctagcagacaagcacataggcggacatagaagatgcgaggcacaatgagccggcactgaagctaaagagctctcaggtctactgctagcatgtttctgccctaagagtgaccactgcagcgcgccacgccttaagagacaacagctacaggtatggtcctctgaaaccacaagtatgctctgaaaccacagcatggttgccacgcacatattctgatcctatatcactgacccaggttctgtcatcacctgctgcacagcaaacagtaatgcaccttccttctgcatctcctggatgagttgcgcggaccttggtgtccgtgagacaacaaaaccacagagtttaagtggctgagcttctggatttgagcagggctgtccatgatcagctg

SEQ ID NO: 53320 - DNA, 538 bp, Triticum aestivum
  Clone ID: PAT_TA_53320
atccaaacaaacccaataactcatgtttgtgttacagtctgttccactttctttttcgccgattctacggtcaacaatattagtaggagtacattaccctaagcagagtaatcagtttagacatctaaatggattcgagttgcaaattacgaaagttcacacggaacaaagatagcgacgagctttttcattcctgaatgctcatccatcgacagcacaaagctcctcgcctcaccacctccggaactgaatggttggttggtacatccatcagcagcccaaaagctcgtcatcaactcttgaaaaattttctccgactatctgttagtcctttggatagtaattgcaatgccaaatgtactcaagaacttcagaactttgcaaactctgttatcaacctcttcacatttgacttcgatagtcttcaggtatcccgaaatagcagctggtttctccatcaaaccaggattttcttgcacttgcattccatatataggtatttcttgctcacacaattggagtgtgaaattgtcaccca

SEQ ID NO: 53321 - DNA, 652 bp, Triticum aestivum
  Clone ID: PAT_TA_53321
ctgtgcttgaacatgtttattgagagacttatgatgcttcaatcttgcgtccctttctgtctacccgatcatcacgaggatcgaagcctccattaccccacagagcccactcgggggttggcgcccccatgtattcctctggggtaaagtttccagctccacgctcctcgagaagttcaaagaacttcttgtagtcgatcaaagtgtgccacttttcatcgacataaaacctctcgctagccaagagaatgcagcagctgtgagcgtgctcggcagcgatgccatactttagccccttttccttcaacctcttctcaagagccttgacaaagtcaacaacctcccaataaaagggaacgttggacatgctcaggccagcatttgatgaagttgatgtgccacagtatgtgacgcctttgacttcgacgaagcatggcaagccttgttccacgagtcgcgcatatccctcagcctcctcctcgacgttgaaacccttgacgagtgtcaatcgaaacacggttcgatggctgaagcgcttttcacgaagaatgtcgaggcagcggttgaagcgctcccagaagtctcggtggagaggcctgtcgattcttcgtagcgattccttatcagctgcatcgatagatacgtagagctg

SEQ ID NO: 53322 - DNA, 379 bp, Triticum aestivum
  Clone ID: PAT_TA_53322
acatcaaacattaccgtctaaatttgttgctcttattacagaatgacgctaatcaatggtacataaggcaaagagatggatggaaacacacaaagacacttaaaactactccgtatgtgttaggcagagaatatcacaaccatagtcatataaatgacagaaaaaggcgaaagaatagttcgctttgcgctaaaagaaaaaagaaaaaagaaaccgtttcgaaaaaaagaatgacagaaaaatactgacaatggaggtatcatatcgaatacagatatcgcaccatctatgtgaccttcttcaagaattgtaccttctcaaactctggggtggcataactcttgtccacctcccatgcatgatgagccatcatgttgaa

SEQ ID NO: 53323 - DNA, 613 bp, Triticum aestivum
  Clone ID: PAT_TA_53323
caacataacaatattaagaatgttttataatgtagtactaattcatgctactactgtgcctgctccttcttctcaaaacacatcaattgttgactgattgggttgcttggttggtagttggtagttttaagaacgctcaattttcaatactgttgtactcagtaataatctcagaatctcagaattatcgtatgcttgcatccatctcttaagttcttagtccaaacaccacacatcgtgttgcttatttaggtcttgacatcgggctcgtcacggccgacgtgctccttgaacttgaggagctcagtggcaaacttgacctcctccttcaggaagtcttgagcatcaagctcgtactttgaggggtcgctggtgtgctgctcaatgtacaggcggatggtagctccagatgagccagtaccagagagtcggacaacgatacggctgccggaggagaagccggcgtacagaccctgcttggaggcaacggagccatcgaggtcggtgtatgagaagttgccagccttcgtaaccttgcgtccctcaatagtgctgccgacaaagttagagtcagcaacaagcttctctagctcgccaataaccttgttggcac

SEQ ID NO: 53324 - DNA, 548 bp, Triticum aestivum
  Clone ID: PAT_TA_53324
gctagaaccacgtcgaagcggaaaaccaaacagggcagtgagagagagagagaggaaggaagtacgaaggacgccgcgatgcgttgcgccgtgctgctcctgcttgtcttcgcggcggcgcgcgccgctcgctgtcgtcaccgacatgtctcctgtacagaacggcaacattagagctgggtacgtccaactctataactggtgaacggcacggtggttaagggtggcaaggctatccccaagtgggagacgtatggcttcgtggaacacatcaagaacggacacaagcagggcaacatgctgctggtggtgccacagggcgcctacaccatgcgcctcgtctacgatgcctccattctgcaacgcatgcccgtcgcccgggtctactactacgccatcaccttgagtcgccgcccgcacctgcacgcaggccgagcgtcttaacgtatgcgtcagccacgagttcggcgagctgcccatgcagaccatatacggcagcatcggttgggactcctactcctgcaccttgaagggcaatctcgacggac

SEQ ID NO: 53325 - DNA, 669 bp, Triticum aestivum
  unsure (1)..(669): unsure at all n locations
  Clone ID: PAT_TA_53325
cggagttcaagtggagttgattcaacttgcctctcagctcaagggtgaccatgtactcaacagctatccggatattggcaagacgatgagtgtaggcgaagcaaaccgctatgcagaggatgccgtctcccgattcctggaagccggaaggatcgcccttagggcaggtgcaaacgaatctgctctggtgacaatgaggcccgcgctcactagcagagccgcaatgtccactggcatgtcatcagaactctgatggaacagctctggatcctgtgaacagattctgcatcacgattagcgctacatctgctgcaagagtatggtggcatttatgcgatgaatattaggtcttacacatgttctttttatacatatacgccatgatacttcgtatccgaagcttacttcagcggaccctcgtggtttacgctgggatatcagctcaggagtatcgcccaacgatttaccagatgcatgccaacgtccccttgtggataagctgcacaactggtatttgtataatccatagttgggaaattgtaccccttcagctcttctgtacctgcctggaaagcagttgaactgcacttttaaggagtattgtatttgtatgaaggattgtcggatttggccactgtttgcatctatctcctgaatgtctntcacttc

SEQ ID NO: 53326 - DNA, 805 bp, Triticum aestivum
  unsure (1)..(805): unsure at all n locations
  Clone ID: PAT_TA_53326
gcgagaaacacagaagtaatagggagagatttgctgcgtgaggacgagcgaagatgcaggtgtttaacggtaacctctgcaccgcatcctatgtccgacaggcaaacgtgccatggagacaacaaagtctcctgatgctacaagctcgacaccgacgacgtgggggcgtggtgaatgtgcaaacctcgggcccagcacaggcgcaagatcgtccaagaaaccaaaagatagacccacaactagcaccagtggacgtacaaggtggaagtcgacacatggctcaccatgacccaagcgagcttgcactcatgatcgacaccatcagagcagggatgagctccatgggtggaggcgagataaccgtttcgccctacgacaccgccttcgtcgcccttgtcggggatctagatggaggtgatggacctcagttcccctccagcattgactggatcgttcaaaaccagctgcccgatggttcgtggggtgagagctcgtttttcctgatccaagaccggattatgaacaccctagcatgtgttgtggccttgacgtcatggaaccttcacgttgacaagtgcgagaaaggcttgaagtttatcagagaaaatatgtggaggttggccgaacaagaagaagactggacgctaataggcttcgagattagcttcccctcgctcctatgcatggccagggacctgngtcttgacattccttatgatcaccctgccttggacgcaatatattcccagagaaaccaaaagctcagcaagattcctttggatatactgcacagtataccaacgac

SEQ ID NO: 53327 - DNA, 616 bp, Triticum aestivum
  Clone ID: PAT_TA_53327
atgatgtacgtatcttattcaaagggatttagtgtttgcaggatattatgttcttgtttaccttttgcagtagatattatgttacgcgcttgctcgatctagaacaaagttatcgggggtacacgaatttggtaggtagctgtgctcagaaacagagaagaaatggggatcgggagagagatagccgccgccgacagagtcgtcttctttcccctcgccttcctttcgttgcctcctcccataagtactggctaggtttcccattgttgggccggaaaccgggtgctgggcctgcggatccgcttggtgggctgctgggccattccctccagtgcgctgactgtgtgggtgcgagccggggtcgtaacactctcccctccttcagaaacagcttgtccccaagctggtgctcttggatagtgctgatgtagttcctcccggtcttcccaggttgctagcgacgccggttgtgccgtacagcgcaccagcacttgctccacttgagtcttgtcgcgaacatggaggcaggtgtcgaggatctcttctggaatagggcttggagccgcgtcttccggtaaatcgggcaatgcctgctccgtgagaggaagagcgtgcc

SEQ ID NO: 53328 - DNA, 631 bp, Triticum aestivum
  Clone ID: PAT_TA_53328
acatcatatgtataacttcctacaatatttcacgaaaccatgaataccagtggacggagcagaacatcgtcaaaccgaaggaaaatgcaaattaaccagcacgtacggtacacggtgccaagtatcatggatcttcagttagtcgtccttgggctggagcctgagcgcgaaggcctggagcgataggagcactttcttgagccgctccctggtctcgacgtcgatgaggttgccctcctcgtcgaacttgggcgggtccgcgaacgccctcacgtggagctcaggcttgttgatgaaatgaaggtccaggaagaccccgatctggcggaggtggaacgacgccctgcccccgccgaagtcgccccccgcgcaaacaatcgccgccgccctgtcagcccagcagttgtgctcgcccatggacgcccagtccagcgcgttcttgagggaggcggtgaccgagtagttgtactcgggcgaggcgaacaggaagcagtcggcggcgtggaccctgtcgcggagcgcctcgacggccggcgggaagccctcgccgccgtcggtcaccaggtccgggttgaccatgggcaggccggagatgtccacgtggtcgatccgcagccccgggatgcactcc

SEQ ID NO: 53329 - DNA, 547 bp, Triticum aestivum
  Clone ID: PAT_TA_53329
ccggggcaaaccttttcccattatcatcttcatcagcccaacagtcgaatccagaaaaaaaacccagctgggttgggttcagccaagggaccccactgaattagcgcgaatataaacaggagcaaaaaacgacgagttgctggtcgcaggcattgaaccaacaaaaggggaatcggcgttacaagcatacgttccgggatatcaccccaggccaaccgagttcaaaaaatcatccccagggataaaacaccagcaagcctactaggccctaacctacagggaaggaatcccagggtcaatgcctacatgagctttttgtttgggtaaaacaaagccaacaaagcagggggggaagcctgttatgttatcacaatgcctgcaatgtcaccgagttcacagcaaaacccgcatagttgttcttgccacacgttaagtttttttagcatcccgtatataaaaaataagcgtgaaataaaattaaggaacaaggagaaaacccatttttgggggttcaaaagaaattttagcaaaaaaaccccttgacccc

SEQ ID NO: 53330 - DNA, 495 bp, Triticum aestivum
  Clone ID: PAT_TA_53330
ctaacaaacctttaggttaacgtccagtcttataattaacatcagataaaccttgcatacttcctttgactccgcatgagccatagtggtatcgtgcgggcaccttaaaactcattttatcgaccaaaggatgggaaactgctagctgaaaatgttcatcgatctgttgacaagcagtccgccgcccccgtcctacccaagaggacttgtggcggagatcaactgtaaaacttctggaaacacgcgcgggctccacgaccggccaacttttttggctcccaacggcccggtttagctaccaagagcctccggtcctaccggactaatatctccttcacctgcttcttgggcgcctcctcgacgtacttctgttaataggcgaccagggacttggcgatggcctggccgatggaacagatctggtttgtgttcccaccaccacgacacgaatcctcatgtcgatgtccttgaatggcgacctaccggttatcagga

SEQ ID NO: 53331 - DNA, 486 bp, Triticum aestivum
  Clone ID: PAT_TA_53331
acggaaaatagggacgtttttgcagcacaacacaacgactatccaggcatttggccatccgggaagggaacaaggaaagggggcataaaacaagccccacaaggggcaaacaaacacagtttcggacccaaggaccaagattttcgaggacggggcttgaagaaaaccagggcaagggatgtcagcttttgctcggggcctgggtaccgagggggggctctcacaactatgggcaagtcatggtttggtatgggcccaaaaaaaaaaagggcgtttttcgctgggaccgtttcattttcaaagccgggaaccgggaaaaccctgcagtctttgcttatggagcggctcgaaagcagggtatcagggctcaaacgaactcgcaaacttttttttggcacccggaactaaaacttgccttttttatttctgacgtctatggatccatctttctttatcccctggaggaaatttttccccaacccccct

SEQ ID NO: 53332 - DNA, 500 bp, Triticum aestivum
  Clone ID: PAT_TA_53332
gggcaggccctaacaaagcatgaaagtaaataaggctggcagggggcaacagaaacaaactttaggacaaacttttatccttaatggaaaagaaaaattggccctggttttgacaaaaaaaagccccgttttaaagggaaaaaaaataaagtttcctttcccaaacagttccagaggggcaaatttaaaaaggaaactttttttgggccgctccaaataggaactagctaaaattggaacggatttttttggtgtttccagtttagttccaaaaggggaacatttttggaacaacccaaaaggcaaaacttgtttaaaactgattcggcggcctgcactaagaaaaaaactgggatgtcccccaatttggcccggcccttaagttttgggggttaaaaaacaaaggcccactaaaccacttttgttcaaacaccctaaataagtttggcaggggaaaaaagggtcccccctgggggaattaaatcatccacaaaaaggac

SEQ ID NO: 53333 - DNA, 629 bp, Triticum aestivum
  Clone ID: PAT_TA_53333
aattgcttaatatacttacagcaggaacaacaacaacaaaataacattgaaattgcacactacaacctccatcccaaattacttgtcttaaattagtctagatatggatgtatctaacactaaaacgcgtctagatacatccgtagtatgtatacttcagtaaagagagcagtcaccactttgcatcacttcctgttgattgacaaccgtatatattttctaacagcgcttgttcctgtcgaccagacgctgtggtctttgaatctcacagtgaaatatgtaactgtagtgaggctccaggtgagatgtccatgcgcgcaccttgaattttcctcgaggcatcacgcttcctaagaaaaggtcttgtacgctaatcatctcgggatcttcagcttcagtttcagcagaacatgtctggtagtcaccaaaaatcattaaccattcagacgaagttttctttgctctcctaacatatattggctccgccatctgccaagggtcagtgaaactctccccatatactgagatgtttgtctggataaaattcctctgggttgcaagggcaatgctccagaaacggtggtcaaaatttgctttcaatagtccactgaagatggtcgcagtcatga

SEQ ID NO: 53334 - DNA, 637 bp, Triticum aestivum
  Clone ID: PAT_TA_53334
cgaaattgtgaatttttaaaaacgactaatgtaacttcaacacgtgcatgccaccaccttgccaactcttccacttgtatttgtatcgctttaggcataattgtcaattgagattttgcaccgtgagcgccgcttcgttgcaccctacggcaggctcctggtgtagtcttgcgtctaccccagaaagctttctctctaggaagtatagtatgtactctcagggtccatcgaggagtgattcttgaccgttcatgtctccctttaagagccaccgggaccacccagcagagcgaaccttcgcacaatgctgggaccatattcttggtactcggccttggtatggcagtacgatcggaactcaggggtttggccgaggagactgcctccaaaccaaggaccgtgtcgctgtcgcttatgagtgataacagacacatccaagccaccacttcgagcaccaccgctacggacctcacttgctcggattctggcgtccaccagctgcttaatgtctcgctgtaatcggcgaccgaaatctttgtatagtgtgcttcctccagaaagaacaatgttcttgtaaagacctcgtcgtacatcgataggcgactgctgaataacaccgtcgacgaccacagggaga

SEQ ID NO: 53335 - DNA, 504 bp, Triticum aestivum
  Clone ID: PAT_TA_53335
aggcctgaagccaaatggggttattccttaaactctccaaggcacagaccaatacaccaacaaccctatcacactccggtataccataccattccgggtcaaaaaagactaggaacagaaaaagttcggtatgggggtaaaaacagcatgggtgtaaaatatacagaggtatttcttccaagtttaaccatctggggaaaaaaagctcagggcagggaggcgaaggaagatagcagccagccgcgctctgtcgcgagctccacatagcctttgaacttctcctgcgcgttggggatgtcgagggtcaaatcgtccaggccttccttgacgcgagcgaagccgttggtcatctggttgatggttatcagccccttgggggggcactcctgcagcagagccaagatgctagcttcattttgcttctccatcgccatcaccagcgctttcttcaccacttaatggttgaagaagggcatcccgaggtcgcggatgcactggcaggct

SEQ ID NO: 53336 - DNA, 648 bp, Triticum aestivum
  Clone ID: PAT_TA_53336
caaaataataataattgaaactggaaagtttgattttgaagtttttaaattcggcctccatttggcattttcgaagcttaacaatgccaaatgagcaggtatagaagacgtggccgccagcctttccattcccgccaacatccaaatctgggtctgattattctaagcgtcatcattacttgctggagtagtagaaataaacgtcatctccaataatgtgcctgacatcatgatattctcatcctgagctactctgactcactcgcccgatccatcactccttgtcaacggcggcaaccgctcccccgtcttcttcctccggccgcttctcctccttgccgccgccgccgccgctggccttgtcgtccctggccttctccagcgccgccaccagccccctgaggcacgaccccgcgtcgtcctccgcgctcttgggcgtcaggttctcggccacgtccgccggcgtcatgtccacctcccgcagcagcgcgcccacggcgccgaacagctcgtgctcgtccacgcccaggtaggccttggcgaggaactcgaacgccggcccgcggcagtaggacatctcgatgtgcttgtccatgcggccccttcggatgagcgccgggtccagcttctccaggtggttgggtggtg

SEQ ID NO: 53337 - DNA, 189 bp, Triticum aestivum
  Clone ID: PAT_TA_53337
ggagggctagatcatctaccgtgaggaggcatagacttccatcccaccttcgatataatgagacaatctcctataagaagagaagccttatgaatgcacttgggatagtggggatgacagagggcagaggttgatccatacatgggagctggtcatgccccacaagctgctagcccgaggcccagacag

SEQ ID NO: 53338 - DNA, 556 bp, Triticum aestivum
  Clone ID: PAT_TA_53338
aaccccctaaaaaacgggggccatttacttaaaagggggggcttgggggtttttttttaaaaaaaaaaaacaaaagccccgggtttaaacaaccctgccagcaaaaaagcaaagcaatggcataaaacaggagttcacatttcaaaaaagaccctttttaggaacaccaaacgggtcaggggaatttaagcccaacaaattacaagcggattggcacaataatgggggaaacttgccggggttgcaaacttaaaggggcaacaaccggggggggggggaaaagggttatttccacattggaaaaaaccccctggaaaaacatttcaccatgggaggggaaaactttcctttttttgggggcccggaaggggccaacaaaagcttaaaaaatgttggcccatttggcggcattgaaaaagaccccaaacttgaccttttaagaaccctcgggcttttgttggcccaacctttggatctcccccctgagcttcccgacctccttcttgacgggcccaagggtaaaggggccttttttttttttttggaaaagcggacc

SEQ ID NO: 53339 - DNA, 665 bp, Triticum aestivum
  Clone ID: PAT_TA_53339
gattccatgacataggttcataaacattttaaacaccattcatacaaatgtatatatcactacgcagacatctcatacggcacagccacgaaagcgaaagcttctggcagcacaacagataaatgacacccaatccagtcaaatagcataaaaggtttgtgcaccggccgccaatccggcacgagtacttagaataccctaggcaagcaataaaatagagtacaacagatactttggtttaggttcgcacaatggtggtgaacagcatcaccaatacaacccgcaggcgcttcaagtaccctcacggtaaccgccgggatcttagcagtaaaacatgacgcgcttgacgttttccttgagggcggggagaggcctgacagcaacgttcccaaacctggtgctgctgcgcggaccaccctgaggagggccgccgcgtgcaccgctcgccacagacccgctgtcggaggtatctggctccatgtagaaccgagcccggaaggctgctagatgtgcataatatgcaggaggaacaattgacacggagcgggtgcatcgagcatatgtgtagcacaagttgtttgtgagagtttgcaactcatcagcagtaaatttgttctcgtcccacagaacatgataatgagcaggccggcttgttccctgaatgc

SEQ ID NO: 53340 - DNA, 679 bp, Triticum aestivum
  Clone ID: PAT_TA_53340
atacccatagagcgtttacgattttcaatctagacttttttatgtaccaggggtgatatctaactgctattcgtccatggcctcgtctgcctttcgcttgttcattcccttctgtgtcctcatatcttccgagctagtatatccctttctgatagcatatcgctcgttttgttcttcgggggactggagcttatccttcttcatcattggcacatagcgaccgcccattcgcccaacgttgccgccctcgtagacaactacactgttcgcctgcttgccagtgggctcagggcgtgaaacttggcgcgaagggtccttgctgcgttgtgttgaaaccatttgcaggagctggttggagagcaactcatccagcttgtgctctctccagtgtgcccacataccgtccataacaccatagggcccagacttgctcagggcagggtcatcagctagatacacccagtcgagaccgtcggtcttctcagccgctggatcaattggggcatctttttcactgggaaagatacaatcccaaagcaccaagggcacttcatcggccatcacatagttgggcttgcacggattctttgccacatcaagcatcgttgttacgacatcaggcgtctccaatcgctggccggccaggaagagaacagcaaccatgtgccgaatctggtgc

SEQ ID NO: 53341 - DNA, 463 bp, Triticum aestivum
  Clone ID: PAT_TA_53341
atcactaatcatacatgatgtattaatctgggttcaacttagcccttaatccataagtcccttcttgccgtcaccatcagcatccttcatggggttgagacggtcgaggagagagggtttcttctgctccattccaactcctgagtcaccgcggacgtgagaagagttactcttaagggggtcattgtgaagacctccagtcttgacagagtcatactcaccgccatggggcttgttaagtccggcagtgttaggatttcctatattaccactcttagcacccatggtgctagtgttacccatcataccagtagatcccatgcctgaaccgactccagaggtaccgggaattcctccctcgcggctctggtgctggttgtgagcggcgcctgcagcagcagcggcagcacctgctccaactccagtaccggtagagctaccgagccctcggttcttgtgcttg

SEQ ID NO: 53342 - DNA, 633 bp, Triticum aestivum
  Clone ID: PAT_TA_53342
tcgcgatctagaactagggccgccctttttttttttttttttttcaagcaaattgccgggaaattttgggatcaatttcatttagatttgagacgagtagctagggtttccgctagccgaaacacgacagcttaagggtcaagccctaatagaattcagaataccctctccacaagccagaggagggtttataaagcgaattcagagctaaaagtagaaagcaacaggttcatcacgtaaaagcaacacggtaacttttaaaagtaagttgacagcggtctgagccatccagatgaagatctacggctgaaaacgcagctcggcagcgaagcggtaagttcttctaggcttcgttggatcgcagatcgacggttgacatgcatccaggcaaaactcaatgtcactatgcttcatcaggtgatcttctacagttacctggcctgacaacgcatctcctgcaatatttaaaaaaaatagtatcctttaattgtcataaggaacacgtatgtagagataaaaagttgtctgcagccagagataactacataattatatccaaagaataattttgcaatttgtcaataatctcatgaatcataaagaaggatcaatagctatacgtacaaaataaat

SEQ ID NO: 53343 - DNA, 639 bp, Triticum aestivum
  Clone ID: PAT_TA_53343
gaatccaacaaggccacatatcattttctcgacaagtcgtcatacgctgcattacaatttagtcagtctccccgtcgccacaagactagtcataggttcaactgggctgaacggtgtaaatagtagtagtgtcgataccagcagccacccaaaacttcgacaaaggacgccattattctagatagatatcatcgacaaaacacacccatggcgcaagggaagtagtgctggagctccgcagactgctgctcctacaggaagagcgggcgtcgcgactagtacgggacgttcttggggaggttccggatcacgttgctcttcatcccgatcttcgtcctcatcgtctccaccccgctcttgttcatcgctcggagcaccttcagcctcaccatctgctccttggactggaccgtcaccaaacccatgctcttgtagctggaagccagggaaagcgcaagggcacgatctgctgcaaccgaaggccgtggcttctggcggtagtagcgaatgaactctcgggaaccaagagtcgtcacgcgtcttcccttctcgctcttgcttgtgatcacaagctcggatccaccacctcccagttcaatgctgttgtccatgtcacccgcagtaaccagctgcttaccc

SEQ ID NO: 53344 - DNA, 697 bp, Triticum aestivum
  Clone ID: PAT_TA_53344
cccacgcgtccggctgggaggtgcatcgagcgggatctgcgtggagatggcacgggtgctggcggcacgcgggtcacgacacccacgtcgtcatagccgcctggaacctggccgcctccgagaccatgcgccaggccgtcctggctgagacccttggcggctactccttcctccgtccctatggttcagcgacgacgagatctagatggctgcctgctcgcccattttggcaccgccgagctcgaggacaaggaaaggaaaagatcatacccacccacccctggagctggaggtgttggagaagttgatatgcagcaaagaagcggctccaaatcgaactattgtatttattttccaggtggagcagcctgagctccggcgaggttgacctggacagctcggcagcatcaccgacgactcgaaggacaccatatccaaggcacctcctcttcggttgtgagagtgtccaggagtcgtgggtgcagctaatgcctatgtctgtggccgcacttgacactgccctctctttaagggtgcatatcattttttataactctgctatcttttgccaagtctttattatcttgcctagccttgtactgatatgtattggttgatgctaattacccaagttagtgcatgatgttaaggataacctgagaacacttgcctaagtttataagatatgacatgtgac

SEQ ID NO: 53345 - DNA, 227 bp, Triticum aestivum
  Clone ID: PAT_TA_53345
ctaccctaggatgatatcgaatttatcggtcttatcgcctcgaacgtatcaaaagcgatgagagcagagcatcctacgagccgatcgacatgggtctgtaggaggagtttgaggagttcgcgaagaaggacaagacgctaggccgacactcaccaccaaccagagcatgctgtgcctctacagactctacaagcaggccaccgtctgccagtccaacatagcccgtc

SEQ ID NO: 53346 - DNA, 420 bp, Triticum aestivum
  Clone ID: PAT_TA_53346
ggaggaacggcaagatcggtgcctcattgatcaacgtctagattgtgataaagaagtctagttgtatatctattggctggctactcaagcttgatatcaaactttccagttgccgcggggttggaaagtgcccacttgataccattctccatcgtcttgtcccatcttttgctctcagacaactgatctccaaaacggcggaatccatgtggaaggcccttgaagagatggatgtctgtaggtactcccgcttcgacaagctttttgccataaaaaatagcctcatctcgcaaaggatcgagaccagagattccaattgtcgtaggtggcatacccttaacctcgtcaacagaagcatgtccaatgttcaatcgcgtatccttaaaatcaggattcgaaacttttagcagacccgtaaac

SEQ ID NO: 53347 - DNA, 724 bp, Triticum aestivum
  Clone ID: PAT_TA_53347
atcttctccatattaatatctaccgccatattctatttcatccatagtgccatatccatgacaaacaccaccaaatcagatcatttcgtgtgccatgctggtaacatggggacgaagccgtgaccaattctaaattcttaacaagttccttatctcctttgcccagttagcgtcctggtcctggccaagatcaattatgcatcatgttccatgttcatgtcgtcatgtctagaggcagggacgaactgaaaactctgttctttgctttgagagcctctttatcccagttggtgcgcatggtaatgcccagcagcagcagcatctgtaccactatcccgcagattattccgaaccacagcccctgaaagaacacattgtagatcgtcgaaaatgaacgtcacggaaagaagcggcatcattctcgcaatgtattccaccacctcattctcgttgctgtatgcgtacccccatagattgcgccccaagagcataataagtcctaaagacacaccagtcgcgaggcccagaaccatgatcacacgagtagccagacgggcagcttcaggtcgcccagcaccaagctcgtttgaaacacgggtgcttatggctgccccaagaccgaaggggatcatgaatgctaatgaacctgtgttcaagcaaatggacaacaccgatgcttccagtttagggtttgggagaagtccggagagaagtaccagcagct

SEQ ID NO: 53348 - DNA, 529 bp, Triticum aestivum
  Clone ID: PAT_TA_53348
acagcagacaagatggaaaactcacagctgcagcagcgcatgcatgttctgaaataagcgcctccgcatgcaaagatgcagttaaaacaagggtacagcattcacataactatattctctaggggaaaataactcaagaaaaccaaagccaccccctacggaacgctagctactcccacaagctccagtcgctttggggtccgggttcgacgacaatcgaaatggagacttcaaagcagccatggacccacggtaacccagccacaactcggcaaaccatacatatgtagccaagcatcaaaacagctcgggggtatcttcacatcctgtcctccctcctgcggggggcgcaggatatgatctcgtcgaccctcaggatcatctccgcagcctcggttgccgacaggacgatggcctgcttcaccttgaacgcctcgcagatgccacgcttctgcatgtctcccagcccgccgctgatgacgtcgattccaacagtgctgttctccttctggtgctcagctcggagctg

SEQ ID NO: 53349 - DNA, 590 bp, Triticum aestivum
  unsure (1)..(590): unsure at all n locations
  Clone ID: PAT_TA_53349
aaatgtcctgtattacagtatatatttgcttaatttcaccttattacatgctgacatgttattagtgcatactgccatgcacatttattggcaaatctcgcaacgcaacaccttcagaagttatagaagtactgtcacacacacacacccacacacacacacacacacacacacaaacacacacacacacacacgacaatacactagttactgtaccttaccgtgttcctgtagttattgtgccatgtccgtcgagctaatttgatttttacgacgatgtcgcacgtgcatgcttagtttaccagctgggtttgttgacgaccctgcaggatttcctgacctcgccgcggtcaccctccttgaggtcgatctgccccatcttgcccatcccctgcgtgaacgcgtagaagaagtagccctggttcatggcgaacatgttcaccagccgctgcgtctccggcgactcgtacagcgtctggtccgagctcagcaggcccctccgctgctgcaactccttgaagtagacgccgtcgaacgccgtgctcgtccggtcgaacgtcgccgacgccgagtccccgnccttgttgcac

SEQ ID NO: 53350 - DNA, 369 bp, Triticum aestivum
  Clone ID: PAT_TA_53350
aaaaaacaaacttaagggctggggggcaaattaaaaaaagggaagttacattggcgggttccaaaaatgaacaaacataaaagggcggaaagcaacacggccattatgccgaaccatttaacctagctgggggaggacatcgccaaaaacagtcttgggctccccggaaaacttttcggccccgggggggcttttgatcttgggtggaggggcaaacccctcgagggggggaaaaaacttgccggggagggccttgagggcctttttctcccccttggggggcttggaggaaaaaacggtcttgagggcccaccccaagtaggaggccctgggggggggggcgttaataaaatacggccattgcttttt

SEQ ID NO: 53351 - DNA, 688 bp, Triticum aestivum
  Clone ID: PAT_TA_53351
gagcaacaccgcaaagataatattcatatattatacgatagacaaaggtaacatccacaacttacaactatttgtctagaaaatgggatggatactaggaatatataccattattttttttgaaattatatataccattatttgttacacgctgaatttggaataggaataggaataggaataggaataggaataggaggggatagtagtagccggatgccaaaaatcactttgtcctgtaaaaagagcgtggaatgcaaataaaatggtccagcggcagcacacgtacgctgctcggcattttgcaccatggtcacttcgatcgtcacgtgcagacatgaaagcgtcccttttctcaaggccacttgcatcatgctgcattcgttgattctcaaggcctcaccttgccgatcctgaggaagatggggtacctcaccgtcttgaccacctcgcggtcgccgccccacgcgtcggcgaagtcctggaccgtggcgtcgtcaagcagctcgacgccattgtccttggcggtctggtacgcggaccaggacttgatgtaggtgaagtagtcgtcgaggtccatgcggcggtcggtggagaactcgaaggggcccgtgtgggtctcgccgtcgacggggtcgaaggggaagtcggcgctgcggtactcgtcgtccaccatcttccggttggg

SEQ ID NO: 53352 - DNA, 697 bp, Triticum aestivum
  Clone ID: PAT_TA_53352
gacaataggcatttctagtttatttcatatgtatgtaacaaccaacaatagtagtcaaactagtgtcttgaatatcgtatcagtgttcataagaacaatatttgtagctaaacatttgcaacatttatttaaaacaagggagaactgacattatttggtagcaactgtataccggtaacacctttttgcaaagaaaaacattataccaataatagcttaggttttattcttgtgtctacatccaggattttggaattaacaatagtttctccttccggcgcatggttagcccaaacaccgctgtcatatcaatgtcttctctctcaactccaagcggaagttcccagtcaaaatggtacatgaggtttgccaacataagctcaacattagcgattccgaggttcataccggggcacatccttcgtcctgccccgaatggcaagaactggaaatcattccccttgaaattgacatgcatagcgctgccttcatctgtaaatctttcaggtatgaactcttctgcgtcctcccacaagctcgagtccctagcaatggcccatgcattgaccatgacacgcgtcccagcaggaaccatatatccatcaatattgcagtcatccatggcaaggtgtggagcaaggagaggcgcaataggatacagtcgaagcgactcctttatgactgctcttaggtatgc

SEQ ID NO: 53353 - DNA, 523 bp, Triticum aestivum
  Clone ID: PAT_TA_53353
ctcttaaaaactaatacccttcaagcattgtacatatttctaagcttagattacatctgaattccaacaaaatttaacacaaattattgacctgaagtggtgttaataaatgatggagctaattggtgataatcaaagacgggggtaattgaatttgtcgacatcatcaagattagttgtttccttctctcacgaaaaagagagaggctcaaccaggacacggagagtagatgccactgcaagattggcaattctagagatcgcgttttccgaaacgcatactttgcagtgtcatcagtctaaattttgttttcatcgatgtcccaaaggaccaaatccgactcatacttgaatacttcttgtatgcatttgggatgcacggggacttttgctatcttgcccctccaaaaatcgtaccagatcactctgtacacactgttgaaaaatgcgacctcggaggagcagagatccctgagtataagggctctcccttcctgcatcccgagattcttcaagttcaccg

SEQ ID NO: 53354 - DNA, 758 bp, Triticum aestivum
  unsure (1)..(758): unsure at all n locations
  Clone ID: PAT_TA_53354
cccacgcgtccgcccacgcgtccgcccacgcgtccgtgttgtagggattgataaaggataagaaaacatccaagatcaagaagaactcggttgccgtcaccaagttccttgacgatttggccaagattgatttccccggtgccaagctggtgagcgacgcggtggccaagtccggcaccacgcccctctccccggccatcgtcttcatcttggacaaggttgcgcctttcgtccccgcgcccaaggaggagcccaaggccgagcccgaggccgccgccccggcagaggagaccaccacccgcgaggtcgccgtggaggagaaggaggaggaggccgagccctccgccgcaccggcagaagccgcgccggtggaggcagccgcgcctgctgctgaggtagtggaggagaagaaagaggaggagaaacccgccgaagccgccgcacctgccgccgaggagccagagaagaagtgatcggtcgccgccggccggagtccaagagcaacccaaaccaccacctggcttgctagctgctggtaatggaagaaatcattttaagttattgtgaatttgtagtcgctctccgtgtcaaggtagctgcacaaaagtaagcacgtacgtacgacacactgcacttgccatgcataccacgcatgcaaacgtacacgcatgggacatttgttattctttcgatggaccggtctnctcaccgtatgtgtacattttacgtggnggctttcttgcttttttggggggatt

SEQ ID NO: 53355 - DNA, 375 bp, Triticum aestivum
  Clone ID: PAT_TA_53355
atctggcctggtgtcactaagatgccgtggtacaacaacttcaagcctcccagagtattgaagagaaaagttaaagatgcctttaaacattttgaccggcatgctctggacctgttggagaggatgttaactttagatccatcacagaggataccagcgaaggaggcacttgatgcagagtatttctggactgatcccttgccatgtgacccgaaaagtttgccatcgtatgaggcatcacacgaattccagactaagaaaaaacgtcagcagcagaggcaagcggaggaagctgcaaagcgccaaaaaataaatcatcctcccccacattctcgcttgcctccgatccagcatccaggccaatcacaccagatc

SEQ ID NO: 53356 - DNA, 610 bp, Triticum aestivum
  unsure (1)..(610): unsure at all n locations
  Clone ID: PAT_TA_53356
cccacgcgtccgcccacgcgtccgcccacgcgtccgcccacgcgtccgcccacgcgtccgcccacgcgtccggcccagatctctttctccgccgcgccgccaagacgagttccgccccctcgtgaatggtgggaacccacacgatcgccgcctccccctcctcgccgccgcagacggagagggactcctccgcctccttccgctgcttcggcgcttgcatgcagggctggtaccaccgctgcatcggcctcgacccctgagcggccctccctccgtcagcgaccaaccttcttttgattcccccctgaaccatccctggttattttgatcttgagtttttccttgcggagaagagaattcatcagaaaagaaaagagaggaacaagcgattttgattgataggtttcgtttgatttgattgattgaccgtcgctatggctgttgctgtgccgtcgacgctgccgatgaagcttaggaaggttgagctccgcggcaaggcggcggcgacggnggttgccggccgcgcgcgcgtgctggtgacggttaccgtcctcggaagcgctggccctctacggttcttggtcgacgagggcgagtcggtctacggact

SEQ ID NO: 53357 - DNA, 572 bp, Triticum aestivum
  Clone ID: PAT_TA_53357
aaatacgtgacctgcataaaatgtgtcactgacagggcttccgagccgtttgggccatacagaggcgaccagacataccataagtgcttatagctaccaaggcggctccatactcgcacttacagtggccgctcttcagacaaactcaatgccatcagctcctacaaactgggggggagatccatctaaccatcatgggcagcatacgtgcctggtgacttgagcatggactggcttaacgtaggatacatgagaccgacctatatctactgatctgtatttgcagctaaataaaatggggatccctcggtgaagaattctatggatggatggatccatgacctccgtacgtgcgtgcagcgtgctcactctatggttccatatattgtatctcatctagcctgtgcaactataagatcaataaaagtctgggaaactaagttcatccctccttctatacatatcagagtcgagatctaaactctcttatatacatgtggaaaaagaggtattagcctgagaactgatacttcttcagcaacaagttcaaggatgccatgagggctgtatgt

SEQ ID NO: 53358 - DNA, 673 bp, Triticum aestivum
  unsure (1)..(673): unsure at all n locations
  Clone ID: PAT_TA_53358
gtggatggataattatgatcaaaactctgtccagcttggtgagatggcatacctgcaatcgcttgttacccaacattttatcatgtatggagaggattaccattcttcacacaatcgcaatggtgtgtgtcttttgcggcactttgagcacctccaccgtcctgttctcacacttcaatgtcctaaggacatagcaaacaagaaatacttcatggagcaaataacaaggcttcctgacattaaattattggaactgggaataacagcatgtggacattcctttggagccagcttattccatgttatgaggatgtgtactgcaataagagcgctagttcttggacttaatgtcacacttgaagatgaggaagaaactgtgtgcccgtcagattgcatttgtgatcagccaccaagctggaaaaccgaggaactcgtgctgaatcgccttgaagtaatagaaatctctggcttcagaggaactgaacatgaaatcaatgccgtgaaacagatatgcagttgggcaaccgtgctaagaaggatgacagtgaagttccatgactcgatcactgaaaacaaggctgaagtgctctgcgagttgttagtaaccttctctgggctaggattagacatggntnnttattataggatgcagtgagaaagttctttatgctcg

SEQ ID NO: 53359 - DNA, 536 bp, Triticum aestivum
  Clone ID: PAT_TA_53359
cccacgcgtccgcccacgcgtccgactagttctttgtcacgctcacgcccacttcgtgtgtaatatatgccacttctttgcaacggcttggctggattgttcgatcgcggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttaaaaaaaaaaaaatttacccccctttcaaaacaactaaaatgttttaatatggggcccccaaaattaaattagcgggggggatataaaaaacttggaaattgaaaaaacctggaggtacccaaataaaaacccttttaaaaaaaaccccttttcccaaaaggggaaaaaaaaaaaaagccccaaccgaacatcttttccaaaaattggcccgcttaaaaggaaaaaggaccccccccttttaagcgccataaaacccggggggtggg

SEQ ID NO: 53360 - DNA, 764 bp, Triticum aestivum
  Clone ID: PAT_TA_53360
taaaacgctccactctgaatttctcgcgctgctcggtattggaggaactagagatgcaagattgctacattgatgcacgcaggatatcttccaaatcgctaaagcgtctctgcattaccgacttttgttccttccctacgaagtttcacattcggatatttgctccgggtcttatctcactgcaacttgataattttgatggcttgaccccttcacttgaatacatgccatctctagaaacagcttacatttggcttgacaatgattgctatcatttgtgtcgtggtagctggcaggactatgaccttgatgactgcagttgtcatgcttatcccgttgatgagggtgtgcttctccatggtttgtccaatgctgttaatttggagttgatagctgatatttacactgacatggtacatttgcacttacttcctttttttactcttattgttattctttgttcattgtttaacctgcatatacttattctcattgccatggtttgctacttttatctccaccgatgggtttgaatcaatgatttgtaacatagtggcttgattggataaaatttatttacagggctttaggtgtagttctgtatttccttacttatgtctgaaactaaaatatctacccaaacttcctacttattaaatttatttcgtcttcttgagtctcatagttcttttttgttcctttgctatctggtagtttgaaattaaagtatctacccaaagttcctactacccaaaaatatttca

SEQ ID NO: 53361 - DNA, 633 bp, Triticum aestivum
  Clone ID: PAT_TA_53361
gcggtgcctacacttttacccaatcacaaatatggctgccatcgaccagaccgcgttcgagccggacgtccgagcaggagatgacagagggcggcgtagagaaaccgccgcggcaacacatgattgacgcagctaggaccgtcacggctacctgctggcccccgacaagaatgcgaaggccaccgcgttcatcaatcttatgcgggtcacgaacgccgacaaggtctacagggtgatgtcgggtgtggagacctgggtcttcttgctgttcatcaaccatgggtacggagtactctctcatggacgtgatgatgagcagcgtcgagggagtcattaccgtattcgacacaagacaagcagaaatgctgtaccctgggggacggctacggctaggactaccaggtgtaaggttattgcagagacaaggtggtgtcctatgatcaggtcctcaactggagcgaccggttgtatttgatagtggagccgtaagatgagaggaatttcattcaagtgggctagtcaccccaaatcttgaacggacgtgctacaagagttcgcattgacaaccaagagaataagagacctctgacttgctaccgatagtcgagctcctggagagtgacgaggactact

SEQ ID NO: 53362 - DNA, 735 bp, Triticum aestivum
  unsure (1)..(735): unsure at all n locations
  Clone ID: PAT_TA_53362
ccgtattcttgagctcgcagccacggagcatgacgttggaggcgccgagggagatggcgcggcggccgttgaggtccacggtggcgaggaagccgcagatgttgcggttgggtttctcgcacttgatgacaccggcgagcgcctccggcggcgtggacatggtttcctgcttggcgtagcgcgtcttgaggttggactcgccgtcgaggttgatggtctggatgtaggccacgccggtggggtcgctcgtggacacaagcaccatgtctcacggcagcgtctcgttagccacgagacgcaccacgtcgccgacctgaatgtccttccagcgcttcggccggaacacgccgtccgcgagcacagacgccgtgcggttgttctcgttcttgtctgaccggtggcgcctccagtcctcgtacgcgtccttgactgccgtgacgccgagcacgaaggccagcggcagaacgcccgcttccttggagagcacgaggagttgcggcacgaagttgagcaccgccaggacgaggaagtagatgtaggccaccctgtggaactgctcgtagaggttgcgcgggatgaaggtgaggacggagtacttggaggtgtggatggagttgtccgggaacatggccggcggcgcgttggtgcgcggcgcgtcgttgatgtagacgaaccgggcgtcctcgtcgcggaggtcccgctgcgagccggcgcgctcggacgcggatcgnctgg

SEQ ID NO: 53363 - DNA, 700 bp, Triticum aestivum
  unsure (1)..(700): unsure at all n locations
  Clone ID: PAT_TA_53363
tttctatgtgcggcgctgaggacggttctaatttacgatgctacatgatatatatatgtgagacactaaccagctagcaggtagtatacatacactcatgagctcacaaccctctttgccgagacatattgaggccaaataacaacatggacttaacaagtcttaccgcagtgtggtgggccgtggctcttcttttcatcaccgtgttagtcaccaagatttcaagagcaagattcaccaccgttgatctacatcgtacaacagtgtattcatggtaagttcatttggagtgaaggtaacactgttgatcgggccagaggtgacggctcatttcttccaaggtctggagtcggagattagccacggtaatctgtttgagttcactgtgcccatgtttggtgaagcagttggttatggcagagataccgccacccgaactgaacaaatgcgcttccatatcgaagcattgagaccatcaaggttgaggagccatgtttatcccatgcttcaagaagtggagggttactttgcaaaatggggagatgaaggcatagttgatctaaagcttgagttcgagaagttactcatgttgatctcaagcaggtgtttgctcggaaaagaggttcgggagaacatngtcgatgaagtctacacactatttcacgagattgaagacaatggtgtgactttgatcagcttc

SEQ ID NO: 53364 - DNA, 758 bp, Triticum aestivum
  unsure (1)..(758): unsure at all n locations
  Clone ID: PAT_TA_53364
acacaattacatcaagataacaaagcctaaggcgcatcaagatgttctaaacaacccccttccccgttgttcccccccaacctcagtcaaaattacgtctcaggactctaacagatcaatccccactcttcaacaaacccgttcagctcacctcacggtcgacctgaacttcagcactgctttgaatagcttcggctccagttcctttacaaccgccaacatttcaggccaagacttcccagtcttcaccacggatccccaatcaccatggcttctctccaccagtcccagcctgccggcacaatccgcgcaacaacagttacagagtcccgaatcaccgcatcaggactttgtcttgttcgatcagctccctaatcgccatacaacaacatcgctgccacaccagcgtcgtcactcgtctcatctgcaaaaccgtcaccaacaacagcctgcatcccctgctgttcagaatcagcgagtagcccagttgctccaggcttttggtcgtccttcgtctactgttaacaacaaccgccccacgaaccagttttacgcttcttcggccccttcgtcatctaccacattgaacaagcagaaccgtgctgctcgacccccagtacctcttttctcccagagtacaggtagcgtcccgcaacaaaccgcanagatgatgaacgctgcagacgtcgaactcgaagagttcactgccttcgagggcggggcccacacggccttttcctcacctgctgttgcctcag

SEQ ID NO: 53365 - DNA, 657 bp, Triticum aestivum
  Clone ID: PAT_TA_53365
cccacgcgtccgctaaaaaaaagcctcctacttgggaatcttgctccagcgcacgccggccggattgccggcctcccgccgacggcgcaccgcaggaagagagaaccgcagcgagagatcagctcggctcggctgaggatttgcagagggcggccatggaggaggcggaagctcctctccccttccccacggagaagctctccatggatccaaatcgggatgggggaagccgaggcggcgttgtgctggtggccaccggcagcttcaatccccccacctacatgcacctgcgcatgttcgagttggcgaaggatgagttgcagcagcgagggtactgtgttttgggtgggtacatgtccccggtgaacgatgcgtataagaagaaggacctcttgcccgctgctcaccgggttcgcctctgcgaattggcgtgtggaagctcatcttttgtgatggttgatccgtgggaggcaatgcagaaaggttatcagcgcaccttgaccgttctctcgagggttgcgaattctctgtgcaaggacagcttagctgatcaaggtgatgtcagggtaatgctgttatgtggttctgaccttctggagtcattcagcacgccaggggttttggattccagatcaggtcaggcccatatgtaaagac

SEQ ID NO: 53366 - DNA, 749 bp, Triticum aestivum
  Clone ID: PAT_TA_53366
ggacgattgggccacaaaggcaaaggaatgggcttctgctaaatctgttacagagaaccaccagattcagcagcatgccattccaagtagaacagaaattcaccattatggccacaatgatcagtatcagcaaccagctggtctgccgacagaacctttacacccaccaattccacaatcaagtagcgaccagttgctgtttcaaatgtcaggtcaacagagggaaacaaactatttgcaagatagaggtccgatggcgccaccaccgaagaattttggtccatttccatccacctatgagcaggaggtaccttataattattcttctgctcaaggtaatgggaatgctatgcttcaatatccaagcccacaagctcagccatctctgagtgcttcatcagttcaagacggatttcctcgcgggcctcctggtgtgcctgggcatggtttacaacagtcttataggatgatggctgatcccagtgaccaacccttggagttcaatgacagaaaagctcctgatatggcagtacatgagacgataaatatcagatctagtgctccaacagcagtgtctgaacatggcacaattccaacatcaactcaatcatggggcccatctgctccagttggatattttcatccagctccagtaccaccacaagcatcacagatggatccttctttgcatgctggaccactctttggagcactctctggttcgagctatgttccacctgcagcatttg

SEQ ID NO: 53367 - DNA, 757 bp, Triticum aestivum
  Clone ID: PAT_TA_53367
gcttgtactagtacatccagagacaatactgcaaaatgaccgcagcaatgccagctgcttgttcgcttcttctgcttctccttctggtggcgccggtggccgccggtgacggcggtgagtgcgtcatcgatggtgtccgttgggcagcttgggccaactcgaagcagttgacggagggcctcggcatcccggagcacacgttcagcgccttcatcttcgacctctccgtcgggcggcaggccctctctgccgtcatggacatctccagcgagctcgtctggctgcagtgctggcccgggctcaggcccacgcccaccttccttcccgaccactccggctccttcgccccgatcgccccctgcccatcatccgtgcgcaacaactccggctcctttggccagatccactacgccgaccggacttgccagcccggcgaccacggctgcgaagcccgctgccggtacatggagcacatctacggcgccggcaacacgtccggctacctcgccaccgacaggttcggtttggggaacagggtcgtcagcggcatggtgttcggctgcagcgacaatgtcacgatgcgggacgacctcaacggcgcctccggcttcgtcggattcagcaggggccccctctccctcgtgtcgcagctccggctctcgaggttctcctacttcatggagctccccgacgaccccgacaacggcaatgccttcgtttgctggagctggggagactacgccgacgctaagggcag

SEQ ID NO: 53368 - DNA, 604 bp, Triticum aestivum
  Clone ID: PAT_TA_53368
cggacgcgtgggcgaaattaaacgagagagagagagtgagagagatcgtagtagctcccagcctcacgacgactccgctctgctctgccatttgaaaagaaaggttcggagggaggcgctgttttttctgcgctgggcgggcggcgggcgactttgatgtgctacgagctggcggaccaacgtggaccgcacggcagcggcggcggccggacggtgaagggcgacgacggcagcgccggggcggcgtcgggaatgacaatggcgagcccggcggacctcatgtcgggctactaccaggcgcaggagatgtcgacgatggtgtcggcgctgtcgcgggtcgtggcggaggacgacccgtgggcgccgtccggctccggcgccgggccggaggggtggggctgggaggagcagcaggcaatgcccgccgccgcgccggcccgggcgccgatcgccgcggcatcggcctcgacgcccgccgtgtacgccgccgccgggccggcctccgactacctgcgctaccagatgctcctgcagggcaggggcgccgtcgccaaccagggcaaccttctctcgttctacggacggggcgggggcggcgccatgt

SEQ ID NO: 53369 - DNA, 778 bp, Triticum aestivum
  Clone ID: PAT_TA_53369
cggacgcgtggggttacatggtctacgtgcactttggcttgataaggcctatgaagggaagagtctgcacttcaatgccatggcatttccaaaactgcgactgctatcaatctcagatgcaccgcagctcaatgatgttgtagtagaagaaagtgcattgcaaagccttgttcacctatctctcacagattgtccagagctaaaggccctccctgatggcattgagcatcttagaacactagagaaattatatctgcgaggagtttccaaagatctcacaaagaagcttcagaacaaagaaaaaacaaatgaatgcaatgattatcttaagaagatcaatcacgtccgaagggtaactgtttatccatgaagcacttgggaatgagagatcaacgacacttgagagatgtccatgtggtaacatgcagccctcctgaatagtttggagaaaggaggaggctctatagaagagtaagtggcaaggaaatgttgaaaagcatctgtgtacactgtatagaacctgagttagaaacaagggagaagaggagagccttattcggttttgttggctgagatgttgaaaatgcacaacacatcgaaatggatacctcagcaggaatcaaagagggaaccataaatgatctcaatgcagcaaaagtttcagcaatgaaagctgctgaaataggcgagtgttgcctcagtttattatcatcactatttttttccttccgtagtggcactatctcaaggatttgcgtactcatcagcgggttcagtt

SEQ ID NO: 53370 - DNA, 691 bp, Triticum aestivum
  Clone ID: PAT_TA_53370
gctgtcggtgacaggagagcaagtccctcaagttcatgaggaatccgctctcaacttgttaacacaggggtgctcaacaggagaagcactcaataggagaagcaggagcagccgagcgttcgcctggttgcaggtcgacttcaggtcccttctcttcttactgatttattcctccccttctcttccagtcccctactcacagagcttctcattttgtttttctagatttggtttctctatgtctacaggttgtttgatgaaaatccaaaaaggctgacatgggagaattaatctatgcaagtcatgtgattttatttttctataatttagttccagtcaaagataacaagttgagtagtcccattaattttttgcaatttagggcattgaaggagatcagaatgcttttatttgtatttacatcatgttctttattatagaacaaccacagtggagaaaattatctcatatcttttggatgatttggtttaattggctattacgcatgttggaatgaattagcaagtacagaaatgaataactgcagctccttcccgattaggtcgggttaaatgcttcccaaatacaaatggtctcaggaaaaaggcaaatatgcaataattttgtgttttttcaaagtaagtagagtgggttactactaaaccagaggacgggtagtcattgcttactt

SEQ ID NO: 53371 - DNA, 513 bp, Triticum aestivum
  Clone ID: PAT_TA_53371
aagcaagcagtagttttcctgtgtacacaatctacaacggcatttgatccatttttagtgtggtttcttgctcttatgctaagcacaaattcccacaagatttatttgttcagttttctgcaacatccagacgcatttcgcatggcatggcacgccagccaacagattatcagacgtacccgccgttgacccggatgacttgcccattgacccactcggcggcgtcggtgcagaggaagccgaccaccggtgcgatgtcgccggcctccccgagccgctccatggggttcgtctccgcggtccgcctcacggtctcgtcgctcttcccggcgaagaacatgtccgtggccgtggcccccggagccacgcagttggccgtgacgcgcgtgcccttgagctccttggccatcgtgcgcaccatcggctacacgggcgtcttggacgccgtgtaggcggagtaccccgtagggttcgacccggccacggacaacgatacggacacgatccggtcgt

SEQ ID NO: 53372 - DNA, 736 bp, Triticum aestivum
  unsure (1)..(736): unsure at all n locations
  Clone ID: PAT_TA_53372
cagcatctccctcccccatagtcactctgagttgggctgggtgaagagaagagaacgaatctttcagttgagatctctcccctcgcaataattttgggctctctccctctatctaccgagtgttcttgattcagagaggccaagaacagcgcaagaacagcatggtgtagtggtgcctctagtgcattatgaggagtgaggaggtgggatgggcgatggcctgtggtgcaggtggtgcagatggagatgaaggagagacagcggtggcggcctgaggaagacgccatcctccgctcctacgtccggcagtatggcccccgcgagtggaacctggtggcgcagcgcatgaacgtgcccctcgaccgcgacgccaagtcctgcctcgagcgctggaagaactacctccgccccggcatcaagaagggctccctcaccgacgacgagcagcgcctcgtcatccgcctccaggccaagcacggcaacaagtggaagaagatcgccgccgaggtgcctggccgcacggcgaagcggctcggcaagtggtgggaggtgttcaaggagaagcagcagcgggagatcagggacagccggaggccgccgcctgagcccagccccgacgagagggggaggtacgagtggctgctcgagaacttcgccgagaagctcgtcaaggagaggcancangtgggagtgggcgccacgccgctgcaccaccacctcatgccggctcccatgc

SEQ ID NO: 53373 - DNA, 745 bp, Triticum aestivum
  Clone ID: PAT_TA_53373
ctcgccgtacggctacggctacggccacggccaaggaggctacccgccgccgatgggaggaggcttcggaggagccgtggcgttcccgccggggacgcacccggacgtggagcgtgcattccgggccgccgaccgcgacggcagcggcagcatcgacgagggggagctgcaggccgcgctctccgacgcgcaccaccgcttcagcatccgcaccgtccgcctcctcatgttcctcttcagtgacgcccagctcgcctcctccccgcgctcccggatgggtaagcagagcacacgcctatacacccacaacaaaatctgcatctctttcggcactgtttcagcataatcaagtactgatttcttgctgcttccgaacgatgtttgttgcagggccaacggagttcgtgacgctgtggaactgccttgggcaatggcgggtgagtgctactgtcaatttgcttgctatcgtttaactctgaattacagtatgtatgctctcgaatgaaacagagtgtgcgcattcagtttctgaagctctgttttctccctgcatatcttcacattgcttgcagttcgataacaaaatcataaataaattatcatcgaccttgtcttcgttgcataggaatatgctgaatactgcaagtgtacttttttttttatcaaacgagaaggtggagaccctgtttccctgtagggacagctgtttacccaatatgttatgaacttatgatgctcatgggat

SEQ ID NO: 53374 - DNA, 305 bp, Triticum aestivum
  Clone ID: PAT_TA_53374
gggccatggaggcggctgcggcgacgacggcgagggcgcgagcgtcctcctcctgccgttcccgggggcgcagggccacacgaacccgctgctggagctgggccgccgtctggcgcgccacggcctccgccccacgctggacaccacccgccacgtgctgtcctccaccgcgccggccggcgcgcccttccgtgtggtcgccatctgcgacggcttcgacgacgggggtgcgggcttggactacacggagtacttgtcgcgggtgaaggccgttgtgtctcgagacgctgcgggagctgctggta

SEQ ID NO: 53375 - DNA, 675 bp, Triticum aestivum
  Clone ID: PAT_TA_53375
ccacgccctacttcaatcttccttttccgtacgcctctgttgcgcggagatggcgggcgcgaaggacgacgggccggcgatcggcatcgacctcgggacgacctactcctgcgtggccgtgtggcggccgtcgcacaaccgtgtcgaggtcatccccaacgaccagggcaacctcaccacgccgtcctgcgttgccttcaccgacacctgccgtctcatcggcgactcggccatgaaccaggccgcaatgaactccgtcaacaccgtattcgacgcaaagcgacttattggccagcgattcagtgacacatccgtacaaagtgatatcaagctatggcctttcaaagtcattcaaggtcctggtgaccggccgatgatcgtggtgcagtacagggggttggagaagctgttcgttgctggagagatctcctccatgttgctgatgaagatgcgtgaggtggccgaggcctacctaggcacggcggtgaagaacgccgtcatcaccgtcccggtctacttcaatgactcccagcgccaggccacccttgacgccggcaccattgctggcctcaacgtcatgcgcatcatcaacgagccctcagctgcagtcatcgcttatggtcttgacaggacgtccagcagcagtgaagtgaagacggtgctcatatttgatct

SEQ ID NO: 53376 - DNA, 485 bp, Triticum aestivum
  Clone ID: PAT_TA_53376
accgcccacccagcccctcgcccgttcccgagaaattaaccaggacggacggacggacggaggggggaaagctcgcgcggcgtgcaaaccggagcactggtccggccggagcacgggagcagagcccgtagcggagcgccggccggccgcgcaggcggatcgacgagctggtggccgtttcggttgcagagtcgtacgtaaccgtacgtgcgtgccatgaagaagacagacgcgggaggaggcggcggcggcggcggtggagcgttcgtcgccgtcccgtgcgtggacatcaagctcttcgtcgcctcgctcgccttcctcacgctcttcgtcgcattgtggcagctccagccctacggctccctcctcgccgccgcccgctcctccgcctccgcgcccccctgcgccctccccctcgccaacaacactgaggtccactccgccaactcaacgtcctccgacacggccacgaagagcgcaccggt

SEQ ID NO: 53377 - DNA, 547 bp, Triticum aestivum
  Clone ID: PAT_TA_53377
atcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactact

SEQ ID NO: 53378 - DNA, 618 bp, Triticum aestivum
  Clone ID: PAT_TA_53378
gattgtataaatatattatgtgcatgtgcatatacatagccaccgattgcattcacatacgagcatgctttctcgagacatgttggtacatgaacatggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacgtacgcgtcagggtactccttcttgacctcttccacctcgttgatcacctgtgtggcgtcggtgcacccgaacataggcagcttccacattgtccagtaccggccatcgtagtacccaggggatgcgttgtgctcacggaagatgaacccaaccttgctgaactcgaggcaaggcacccatttggagcggatcaggtagtcgacctgcttgaggagggcctccgtgctgagcggtggcaggtaggacagggtctcgaacttcttgatgccctcgatgggccacacctgcatgcacctgatcct

SEQ ID NO: 53379 - DNA, 519 bp, Triticum aestivum
  Clone ID: PAT_TA_53379
gggaaaaaaattcccattcattaattgcccgaacaaggggggcaggcccatcacacgtccccatgggctcccctagagtccaacaaaaagttgacagttaactcacccatacgggcccatgcatacatgtcgcaaaaatatatttcccccccccgggggggcccaagggacaaacatggacccaaacccccagggacccagttctgaaaaaaccccccccagcaacttctttttattatttaaaagcccaaaatcggatgacccccccatcaacgtaaacattaagccccacacaagcccctcctttcatgccccttggaagggttatatattgaaccaattgacatttttgcaattgggggacatccttatggggaagggcacccttaccccccacttgccgggcaccccggaaaccttgtccatgttgatggacctgatgctgggggcgaggcttttgaggcacctgcaccctattttgcggtccgggcttttgggggccaagcccttaaacccctg

SEQ ID NO: 53380 - DNA, 280 bp, Triticum aestivum
  unsure (1)..(280): unsure at all n locations
  Clone ID: PAT_TA_53380
cggacgaagggcaagggggaagccccagcggcgcgagacaaaacaaggaacccggggaccaaagggaaccgcaaaggagggggcggggaganccggncgaacacacaagggcgcaagggaccaacagcaannagagagcaccacggcgccggcacagangggcgganccaggcacacgggccacggccgccggnacacgacacgagacacgagagggnagcagggcccgggcaagacccaaaggggaccaggncgaaagaangccgcgggcacagaaaag

SEQ ID NO: 53381 - DNA, 414 bp, Triticum aestivum
  Clone ID: PAT_TA_53381
ataatcaatcttttcaagaaatggttaatgcattattgtatttaatcatagtcaatttttagcaccaaaggtagcatagaagtgaaaaaacactgcactacgtggaaagaggaaaacgcaccggggccatgccttattgggggagacgaggaagtccccacaaccgggggccgccgggagaggaaacggcccccccagacaagcatgaactgctcagaaagccttcgggagacaccagtggggcaaagggccatgacgggataatggaacgagcacagaataggggagactaaatcctagggagggagattacgggccaccaacgaggttcgggataaaggcggcatggagaacaaacagaggaatggatgcactaatttcttaagcacatcacgctggaaaggcaggagagaa

SEQ ID NO: 53382 - DNA, 424 bp, Triticum aestivum
  Clone ID: PAT_TA_53382
gggggccccaaccaaaaaaaaccaggggggaattccggggctggtcccccaaaactaccccggtacaagatagataacccggccaacttcccaaaagggaaaaggttccttaaaaaacatagcccaaaatacaaccccgcggggttggctggcattccaatccacttgaattttaagcttatttcgggggggggaaaacccctgtcccgccgccaccttacttggccattatgaccttgacaaactcctcgtaattgatctggccggcgccggccacgtccgccttccggataattttgtccacctccttggccggaaggttttccccgagggtgggcataacggggggcaactccccccccaaaatgaaaccgttctggtccttgtaaaacacgcggaacgccttcttgagctcctcctccga

SEQ ID NO: 53383 - DNA, 429 bp, Triticum aestivum
  unsure (1)..(429): unsure at all n locations
  Clone ID: PAT_TA_53383
ggggggggggtaccagcaaacattaatcggataactttcacggggcaccactaacgcatggccccaaccaaaaaaggcgggcaatttaaaccccccacaaccgggggggttctaacaatccgaagctaaaagcaacccgggggggaaggagggccccatcaaaaaaaattccctccgggtttaatggccaagcaagccccaagggaacaggggacatcgggggttttggcttaaaagggaaaaacccgcatgggacaaaacttccattcccgaatgctcaaaacattttgaaagggtctacggatagcaccttccggtttttcccaagaggggcaagaggccccccccccgggatgtttgggatgcttttgttatgcgggttgaccattttgacaacaatggtcgcnatccccccccaaacttttaaaa

SEQ ID NO: 53384 - DNA, 247 bp, Triticum aestivum
  Clone ID: PAT_TA_53384
accacacaaaaggatttttgtccatggataaacaaatttaaaagttttgccattaaaaaataactccttttcccggggggctaatacattttattcgtttttttataaaaaaaaaaaggccagggtgccccgcctttaaaaataatgggtcacgtccagggcccaaccacacaatcgttggggatctccggaaaaactttccatttccgggcgcttataagctccttgttaaccagcggccccagcg

SEQ ID NO: 53385 - DNA, 476 bp, Triticum aestivum
  Clone ID: PAT_TA_53385
gccccaggcaccccggggaagctgaaacccggcggccgggttgaatcacttacaaaaaactgggggccggggggggcccacaaacaaaaaaccacttactttgggggaaatgggcccctccccggaccccggcctatttttttttatgcccaaaagcacatacctagcaacactcgcccccccacaaaaactccccatttttcccccccaaggactgggacttgcttttgcacaatttccccgacgggttttcggccccaaaaaataatccggacgttcacttacaaactgcccaattttttgcccccccccccaggaaaatcatgcccaaaaaagggctttggtaaaaaaactccttttgaaatcagggcccggtaggaacaaaaaaaaaaaacccggaaaactgtcttgtcatttggacaaaattcaaccctatcaacccctcgtcacggaaacttggaaccctgggcttaaat

SEQ ID NO: 53386 - DNA, 477 bp, Triticum aestivum
  Clone ID: PAT_TA_53386
ccgggcaaaacaccctcagggtataatttatggaagggtccaaaacaacccaaaccccaagctcatgcccccccaaaaaggctttttcccctacatcccaacgcccaaatttacaacatcgcccaccattagggccgaccaaaacaaagatcacctcaacccaagaacccttacataagactttccccccttctgatctgcaacttcgggccaaaggatccctgcttaaaaaatcccctttacctttttcggtccgatatcctacaatttatacccccccccccttgacatttgacccccagaccggggcgataacttggtataaaacctggcacaccatccctacctcaagggtcaaggcatgaggtttgttacccccggggacaaaacctggattgttccccctaaggacctcgaaaatgaagtttatggggattttttttaccaggccaaaccctctctttgccctaatgtgcc

SEQ ID NO: 53387 - DNA, 395 bp, Triticum aestivum
  Clone ID: PAT_TA_53387
aaaaacaaacccaagcccagctggtttttatcccccactttacaaaagaggccttccgtgttacagggtcaagtcaacgggacaggccgcgcctaattaacaaaaacaaaaaatgggggggggttggcatttggggccgggaggccataaaaattcgcccctccccgggggcggaaggggggggggggcggttggacaattggtcggttgccccggccggccacggtaagggggcggaaacggcccctttgcagccccgttggcaaaagttggggacccggtccatgcactggaacacggccgggtgcacggggaggggtaacttgacccaaccccggcaccccggggggaacccgccgggcgccgggtccatgcaccggaactggggagagtcc

SEQ ID NO: 53388 - DNA, 673 bp, Triticum aestivum
  Clone ID: PAT_TA_53388
gaacataaattagactgaatgattaatactaacaattttgttcagagacacactagcaaccatacatggagaactagcacaaccactactaagaaaatttggataacatatatgaaaatagttctgcaggcattacttccacattgtcatgataatatcctttgctgctttcagttcagccgggaggatttcagctacgagctccttgaaaacagatgggcaactagatttcagatgctcatacccatcactcgccatcatcgcctccaaattggacggagaagcaaggaactttaaacaagcttttttgagagcatggaaaccatgctgctcggccaatgccaaactagttgccaccatgccggaatcaatgtgactgcacaatttctcctcgcatatcatcttcagcctcccgatattgtatctgtcagccgcaacaaggagatggccggccatcaccacatcaagcacaggaggaactgtgtcggtgtatatgaagtggagcaaggacttgaacacatcagcttccatgtcacagatttcaataggactagctgcataactctcctccatggcaccgaggagctccgccttgaagactgaagaccgagcagcgaggacacacctatgggccgagaaactctgtccaccgacctgaaaggtcaggtctgct

SEQ ID NO: 53389 - DNA, 276 bp, Triticum aestivum
  Clone ID: PAT_TA_53389
cccggggggcaaaacccaactttgttcttggggggggccccccccccaaaacccgggcgggggtaatccccccttgcggttccaattggaaattttgggggtcctgtctaatacctcccccgaaggctgccctttggggaaaaacccccacctttttggcaaatgtcccccccccccatgtaaaaaaacaaataaacagggcaaccccccccaatctgtttaacaaaacagctttcccaactaataaaacagcggccttattctttttcccggccc

SEQ ID NO: 53390 - DNA, 641 bp, Triticum aestivum
  unsure (1)..(641): unsure at all n locations
  Clone ID: PAT_TA_53390
gcgccgagccggggaaactgtcgcaccccgacctcgcggcgtcgctcctcctagaggacgacgacgacgtacctcccctaccgtcctactcctccaagatagcgcaggctccacgacagcagcctgcctgcattacctcgtatccgagctccgcatgccgttgtacctccagcgccgcctcaccatcccggacatcgccgcgcaccgctggtctcggccctgcgccgtggccttcgccgcgctggcgcccgtgctcctcgccacggcatggacctcgcacaacccggcgaaatcatcctcgcaccacgccgccaccacaacagcgacggccgcgcgatcctcctcgtcgacggcgtccttggcctcctcctcgcggccctcaccgcggccacaacggacaccgcgtcccctcctaacgggcgcccgcgtgccgtggctggcggtggagttcctgatgagcgtactctggggctctgggcatacaccctggcgcgcgaactagtggcgctcctggtggccatcgggtaccgtacatggtgggcatgaaggcgagcatgcttggcgtgacggtgctggcatgcggagactcgttgggcgacctagtctncaacgtggcgatggcaacgcacaggggccccgat

SEQ ID NO: 53391 - DNA, 184 bp, Triticum aestivum
  Clone ID: PAT_TA_53391
cggacgcgtgggcggacgcgtgggattgtaaggtgtgtcaaagaagagggtagcacctgatctgcttgcctccagaaacaatggcagtctgctactcatcctcaagtcgactttccttcccaagaaggccaaatggggcgccacgcgccaggctgacgcccccaagccgatgaccgtatacatg

SEQ ID NO: 53392 - DNA, 297 bp, Triticum aestivum
  Clone ID: PAT_TA_53392
gctatcgctaaaatgaccaattcaagcacaaatcgggcatgggacttatgtcaccacaaacagaaactaaagcaagtgataactttcaagctggtgtcaaagattataaacagacttactacaacccaaagcatgaaactaaggatactgatatcttggcagcatacgcagtaagtcctcagcctggggttccgcccgaatagcaggcgctgcagtagctgtcgaatattctactggtacatggacaactgattggactgatggacttaccagagttgatcgtgtacaaaggacgag

SEQ ID NO: 53393 - DNA, 499 bp, Triticum aestivum
  Clone ID: PAT_TA_53393
gggggatggggatggaagcatcgtggagctctgctgatgcggttgcttggttgatatattggtgctaatgttgttgtatttgtacctgttttcgttgtatttacttactttgtttctacatcttttgagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccggttttaaaaaatcaaaattaacaaacccgtaaatacaacgtaaaaatttttttataggggccccaaaataaaattaattggccgtgtttaaaaaacgtgggaattgaaaaaaccttgggttaaccaaattaaatgactttgaaaaaaatccccttttcgcaagttggaaaaataacaaaaaggccccaaccaatcgcctttccaaaaagttgcccaccctaaatggaaaatggaacccc

SEQ ID NO: 53394 - DNA, 344 bp, Triticum aestivum
  unsure (1)..(344): unsure at all n locations
  Clone ID: PAT_TA_53394
ggtaccggtaattgcccgggatcgacccacgctgtccgcgcagacagacagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacattgacgccaacggcaggaaggtgggcatgaagggcgtgtgccagtagantgacaagtacggtgccaacggtgacgggtacaggccagtgtacacgccagaggaatgatctgaatctg

SEQ ID NO: 53395 - DNA, 373 bp, Triticum aestivum
  Clone ID: PAT_TA_53395
gtcgccaccgagaaccagggcaaagttaattccctcagccaacgagagtttacaacaagttagtttataagaaatagaataatgtccacacaacttttcaccatctaattaactggctgctaccttatatgttacaaagggcaaaacgttaaaaggcatggaaaagacacacgctcaagcaagcagatgcgctgggaacataatacaggagattcctcagcgctggtttggatttgcaagagaacagggctaaagcctaaaggcaacaacacataaagacggaactagatgcggacacaaagttaaaagatgactgaaacatgcgacggttagtaggcatctttcggcgaccaagtctggatcgttcgatgga

SEQ ID NO: 53396 - DNA, 415 bp, Triticum aestivum
  Clone ID: PAT_TA_53396
gcaagccaagtatacttatgctatagcaggatgaataagacggacgggtacccagatctcgctgatttttacaatcttaatacccaaggggcggctagtgaagtgcggccatggaaggctcaaaagctagaatccaagagagctcagggacggacaaaagggcaaggaaatgtgcacgcttgggacggatggatggatggtgtgttcgacgacgtggggttaacagcccgtcgagcttagactctctggatgatcaccgagttggcgacgccggcttcctcaatggtcttggtcgcgtcgtcgagcggcttaggggggaacccgacctgcaacgtgtagtcgcttgtttctcctggccttgttgtgtagatgaacgcccgcacgtcactgatcgtgtggtttgtgttgaagggcc

SEQ ID NO: 53397 - DNA, 134 bp, Triticum aestivum
  Clone ID: PAT_TA_53397
ctcattcttaggtgcttcttttcgatgctgcctccttctgaactaaccactctttatcggtagtggctgctggcgctgactcctactgtaccggctccaatgccaatgggtctgtggtctaaacttcagactct

SEQ ID NO: 53398 - DNA, 315 bp, Triticum aestivum
  Clone ID: PAT_TA_53398
ccagaagccccgacgctcaagcccccagacgccgcagcgccgccactccacccgcagcggcaaccatggcggtcggcaagaacaagcgcatctccaaggggaggaagggaagcaagaagaaggccgtcgatccgttcaccaataagcagtggtatgacatcaaggcgccgctgctgttcaccagccgcaacgttggcaagaccttggtgtccaggacgcagggaaccaagattgcctcagagggtctgaggcacagggtgttcgaagtagtattagctgatgttcagaacgatgaggaccaggcctacatgatga

SEQ ID NO: 53399 - DNA, 278 bp, Triticum aestivum
  Clone ID: PAT_TA_53399
ctcgaactgttaagccactagcttctttctacagtgatgtttcaggcatcagtgcatcagtggagtcaaccacaggggaggccatgccacacccgttagatgaaattgagccaaaaaaggatgttgaaccggagaattgtccattctggtgggcgcgttcgcccgaaaatatactccagcaggatacgtatctagcactggcagcttcttttgtaatcctgcggttgctgtatcttctattccaaggatagtttttggaccaaaatgggcatggaaga

SEQ ID NO: 53400 - DNA, 411 bp, Triticum aestivum
  Clone ID: PAT_TA_53400
acgggcgcacgggacgcccgctctgcgtgcacgcccatgatgtcttgcgtcgcagcgtcagcgaatcgctgcatagtattagatgtgttactggcagtaaagagctcgcgctcacgaaacgggaaggcgacctgaaacggcttgtacggaagtaaacaaaccattctggagtggcgtgaaggcatcgactgcactgaccatctgcgagccaacgatcatattgaactgtgtactgtgcgcaccatacccaaccaatgccttggccttggtgcggggctgtaggcagtcacacacgtacggatacacgggacagataatgtgatgttcacgtccaggccaatataagaccagatcattgtgtgcagcgacaaaccaagaagcaacgccagcctgaactctgtcaggtgcaca

SEQ ID NO: 53401 - DNA, 574 bp, Triticum aestivum
  unsure (1)..(574): unsure at all n locations
  Clone ID: PAT_TA_53401
gcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaaccaccgttcgtgttccgtagttctgtatgcccctgtcgcgtgtgttcgaccagtactgtccttcctcgtgcctccacttctaatgaatatatggcgcctcaactntg

SEQ ID NO: 53402 - DNA, 579 bp, Triticum aestivum
  Clone ID: PAT_TA_53402
tgctcaatcaatcctgcatgttcatcgctcccctatttataccctcgaaacccaccctttcctccacaccatcacactccactagcttaaccacaccgccgacactcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatcagcaaggagtgctgctccggtgtgcaggggctgaacggcctggcccgcagcagcccggaccgcaagatagcgtgcaggtgcctcaagagcctcgccaccagcatcaagtccatcaacatggacaaggtctccggcgtgcccgggaagtgcggggtcagcgtgccctttcccatcagcatgtgcaccaactgcaacattgtaaactagtgtgatgtataagcccttgcgacggagcatgcaagggacgcgcttggggggg

SEQ ID NO: 53403 - DNA, 493 bp, Triticum aestivum
  unsure (1)..(493): unsure at all n locations
  Clone ID: PAT_TA_53403
cacacccataaaccagaagcggccgtccaagccaaggcgcccacaggacgccaccaagaactcggagccaccttccaatcgcccgagtccctcccctccatccggccaccggatcgggcccgccgatctctcgagctccccggccgccccctcccgcggcggcgcgcaatgggggcctgccgccgaggacgccgtcaggcagctcggcatcctcatggatcaagtggacgcgccgctgaggaggacgttccagaatgtgcaccaaggccaccctagagaaacaatgttgcgctttctcaaggctagagaatggaatgtttccaaggctcataaaatgcttgtagattctttgaattggaggattgaaaatgaaattgatagtgtattggagagacctatactcccagtagatnnatacagatcaatacgtgattcacaactttgttggacttttaggatacaccaaggagggggtttncaggttttgggattt

SEQ ID NO: 53404 - DNA, 603 bp, Triticum aestivum
  unsure (1)..(603): unsure at all n locations
  Clone ID: PAT_TA_53404
cccacgcgtccgcccacgcgtccgcccacgcgtccgttacggtttcaaccctcacctttccgcgaattccacctccccgaacgagggatctcgccgccgccgtgatccccccgcgcggcgaggaggatgtcgtccgccgcgcggcgcgccagccacccggcgctggtgaacggggacggggagtacgggcgggaggaggaggacgaggaggacgaggagggggaggagggggagggggacgagccggaggaggagccgtggttcaagtaccagcggctgggcgggagcgtgccggcgatcctctccaccgacgccgccgccgccatcgccgtcaccgaccgcgccgtcctgctcggcacccacgacggcaccctccacatcctcgacttccagggcaacctgtcaaaggagatcaaggctcacacagcaaccattaatgacatctgttttgaagatcgtgaatatataggaagctgctcagatgacggcacagtngtaattagctaccttttcactggtgagaaacttaagtttgagtaccattgtcccgtgaaagctnttgcttttgatccttagtatttccggtgcagcaatagttttgct

SEQ ID NO: 53405 - DNA, 290 bp, Triticum aestivum
  Clone ID: PAT_TA_53405
gtgctgaagcttacaagctgtcataataaacatccatcatccatggatcttgttatagtgccagtttaacatatgcaggttctatgctaatggatatacactgtccggttcatctcttccagctacgaccccaagccggcatcaccctatgcatcacggaggaaacgccgaagccttcgctactatatcccccccagccgatcggggggatccaaccaacatggacaagtaaaattatggatttcataggaggtcgctcgcattgtttaaggaaggtgctccacatgcat

SEQ ID NO: 53406 - DNA, 405 bp, Triticum aestivum
  Clone ID: PAT_TA_53406
ggggggggcgattaagggggagaaaaaaggggaaaattttaatttttacaaaatcccccccccatccaaggggggaaaagaaaaaaaaattacggggacacatgcttacccaaacccacggggacaggggggggaaagcataaagggggggggggcaaaaaaaccaaacacccccccccacttggtggactccaaaaaaaaaaaccctggtttttaacgtttactttaaaaccataaaacgtactagggaagagggggggcagttaaaaaggggggggggttgcacttgaagttggcccccaaattgaaaccctcgcgggactggccgggggcaacctaaaactggcccgcttttttttaaggcccccccccgaggaaaaccacggggggaacctcggggggggg

SEQ ID NO: 53407 - DNA, 815 bp, Triticum aestivum
  unsure (1)..(815): unsure at all n locations
  Clone ID: PAT_TA_53407
tgcttactcatggatcattctttcgtgcaatagcctcattgacaatacccctgcaggataatactttggaaccagcgacctctggtctcggtgttaccgcaggaaacctgtgctgctccctggctgtagcaggggtgtcgagttaagagatggcttcacctcgttggtctatccttttagtgttgtttcgcagcttcgagttttctctgtattctcacgtcatggcagagttggtatcatgctcagatatgtttttttccgtcccattattatgtttttgcctatttccattcttcagttgcttccatgtcattcctgccttttgtatatttacatgtgtcacttatttccatgtcatacttgcctttttgtacatgtaattaatgctttaattatctttggtcttggtgtcattgcatgaaacctgtgctgcttgctccctgtccatttcatgaaacctgtgctgcttgctcactggccgtagcagggacgtcgagttaagatggatggctttacctcgttggcctaaagttttgtgttgttcgcagctttgattttgctctgtattttcacgtcatagcagagtgggtatcatgttcagatctgtttttcttttcttttctttctattgntatgtttttgtgtatttccatgcttcagttactgccatgtcatacctgcctttnttgtccatatccatgcgatatctatttctccatgtgccttttgtgtgtgtgtatatatatatatccaattaatgctttttattatctaccattctttcctgcataacttgactcctactctggcaatgc

SEQ ID NO: 53408 - DNA, 758 bp, Triticum aestivum
  Clone ID: PAT_TA_53408
cccacgcgtccgcggacgcgtgggccaacccctcctccatccctccctccctccccccatccatccatccgcagtaaagccttcgctgcgctagatctcgccgcccgccccgatttcttttctcggcctctcccagtagctcgctcggcagatctgcgcctcctgggaatctccgtcgcttccgtccaaaggctcgattcttttcttgctcttcgctgaggctttccccggatcgcacggtcgggggacacacaggatgatgggtcctgcgtggtgggctgtgctgctgctgctggccatggcggacgccgtggcggggaggttcgtggtggagaagaacagcgtgcaggtgacctcgccggagagcctcaagggcaagtacgagtgcgccatcggcaacttcggcctgccgcagtacgggggcaccctgcaaggctgggtcgtctaccccaaggacaacaggcaggcctgcaaggagttcgacgtctccttcaagggccacaagtcgggagcccgccctaacttcgtcctcatcgaccgcggagaatgctttttcacaacaaaggcatggaatgcacaacttgctggagctgcagcaattctcgttgtggatagcaaggacgagcctttgatcacaatggacaacccagaagatactggcacgaagcacttagaaaatatcactattccatcagtgctgataacaaagaaactgggcgaggaccttaagaaatctgctgaaaatggtgacatggtta

SEQ ID NO: 53409 - DNA, 730 bp, Triticum aestivum
  Clone ID: PAT_TA_53409
cccacgcgtccgctcctccccttccggttcgggttcgggttctggttcggttcgggtccgagagtagctagcctagtctagggtttccgtagagaggaggaggagaggaagagagagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgcgggttcggcttcgtcacgttcggcagcgaggagtcgatgcgccaggccatcgaggagatgaacggcaaggagctcgacgggcgcaacatcaccgtcaacgaggcccagtcccgccgctcgggcggagggggcggcggcggcggcggcggctacggcggccagcgcggcggtggcggaggttacggcggcggcggcggctacggaggcggcggcggcggctacggcggccagggcggtggcggctacggcggccagcgcggtggcggcggcggctacggcggcggcggcggctacggcggtggtggcggctacggcggccagcgcggcggtggcggcggcgactccggcggccagtggaggaactgagcctcgaatctcccagttatcgatctatctaccgtgtcgtcgtcgtcgtcgtcttcgtcagcaagttatctttcggtgtcgtcgtgttcctgtgtcagactg

SEQ ID NO: 53410 - DNA, 383 bp, Triticum aestivum
  Clone ID: PAT_TA_53410
ggtggaccaccccttccggcgccgcaccgccgtgtcgcgcacgcggcgctcgtcgagcgcggagccacgctcagggaccggcccgtcctccctttgctgaagctgctgggcgatgaacgacaacaccgtcacgcgcgccagctacggcccagtgtggcgcctgctgcgcggcaacctgggatgctagacgctgcacccgtcgcggggccgcctgttcggccccgcccgctgctgggtgctccgcgtgctggccgagaagctgcgtgatgagtcgacctgcggaggggcggtcgtagtggagacattacagaacaccatggcctgtgtactcgggcttatgtgcttcggtgagcggctgagcgaggccaccggccgagcgatcg

SEQ ID NO: 53411 - DNA, 735 bp, Triticum aestivum
  Clone ID: PAT_TA_53411
cccacgcgtccggactagttctagatcccgccatacaccaccacagccccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatccactgccggtgggccatgctgggcgctctcggctgcgtcttccccgagctgctcgcccgcaacggcgtcaagttcggcgaggccgtgtggttcaaggccggctcccagatcttcagcgagggcggcctcgactacctcggcaaccccagcctcgtccacgcgcagagcatccttgccatctgggcctgccaggtcgtgctcatgggcgccgtcgagggctaccgcgtcgccggcggcccgctcggcgagatcgtcgacccgctctaccccggcggcagcttcgaccccctgggcctcgccgatgaccccgaggcattcgcggagctc

SEQ ID NO: 53412 - DNA, 437 bp, Triticum aestivum
  unsure (1)..(437): unsure at all n locations
  Clone ID: PAT_TA_53412
cggacgcgtgggcctcgcctcctcctctcctcctcccatcccactccatcacaagattccccgcctcctcctcccatcagtgagcgagagcgagagtgagactgagaccagccggtggcctcgcccgtgctccatggtgattctgcgctctcacagggacacggagacggcggagatggcgcaggggcagggcagcccggacctggttggtttccagttctacaagctcatggctgccggaatgtcctgggagaagctggtaattactcgcgcattctctcctagctagcgcaccaagcacgagctcgtccctctctcatctctctgcttgcttactgtttctttcttggcgcccggctgaactgcaggtgctgcctgacaagttcgtgagggggctcaacggccgcgagcttcggngcgtgaagctgcnggtggag

SEQ ID NO: 53413 - DNA, 198 bp, Triticum aestivum
  Clone ID: PAT_TA_53413
atgagatcggcgctcggtctctcccattggtgttccttgctgcttctcctctcgctggtgacggctccgcgggggctcgaggtcggcgacctcttcagccaagggaaaccaccggcggtgaagcaggactgcagccggacatgcgagtccaagttttgcacggtcccgcctgtgctgaggtacgggaaatactgcgga

SEQ ID NO: 53414 - DNA, 590 bp, Triticum aestivum
  Clone ID: PAT_TA_53414
gacttcaatggaatgattacacttcttggaatagagtacgtggcgcacactgtaattccgtatctggcaatctcagcagatgcgcagcaagctgccggatcaccggtgcaatatttagctcacacgtacggccatatatatataacgtacgccgtcgatcaccggtgcatgaaggctgatgagtcccgaactcccgatcgatcaatcggctggcatggcatgcagatgcagaccggctcagaaaagatcagcagatggcgcacgcgttggggccctcctcggtgtgcacgaagtatcacgggtgcgggtggtgcggcggcggcgggcagcacggcaggcacactgggacgagcgtgctcgcgtccctcttgtccccgcacctgcagtcgtccgtcttcttcttctcctcctccttggccgggcggacgaagacctccttcttcttctcctcctccttggcggggccgacggagaccacctgcaccgtgcagaagcacctgcgcagcttgccgacgacgtggacggggtcgaccatgccgacgaccgtcatcttgtcctccttcatgtccacggcgatctcgtcgacacct

SEQ ID NO: 53415 - DNA, 435 bp, Triticum aestivum
  Clone ID: PAT_TA_53415
ggggggggaccccaaagaatcataacttcgggaatacaagaaaataagtcctaacatccccccccagggggaaaccaaaagggggaacaaacgggggttttaaccatggggttgggccctaaaggaaacccaaagaggggctcatgcctgggggggttttttgaatcgaaaaaaaaaaggccctctttggtggggaaaataaaaaggcacaagagttacataacggtttgggggggtactttttccaattttgatcgggggggaccggttttgacaaaaaaaggcccaaagggaaaaaaatgactttttttgggaaagggggaacatccttaaaaactcctttttgccaaagtttttgcaccaaaactgggatgggattggccggactggggggggcgggcgtttctcaacctcgggggttttcatggggggggg

SEQ ID NO: 53416 - DNA, 657 bp, Triticum aestivum
  Clone ID: PAT_TA_53416
aaacccccggcctctgcatcaatcgatgcatgctgccatctttattaattattccacaaaggtctgacaaaaacatacatcaatccacccgaaaccaccactcacacctacaaactcgataatgtggagtgctctcactccccatatctaaaaccgatgtcgtcgccaatccatccacataacgtatcggaaccaacagctgatgcagcagacctaaagcgcacaccacatgcacacgctttagaagtcgccatcatcatcggaccactgacccatattcaggagagagatccgcatcatccttgccagtccggacatccgtcgacgccaccacggcgccaccaccctgcgctcatccgtccagacgcgaagactctggaagactttcatgcgtagcacctgccaaccaggcatgactcggcgtagcatctgtcggccaggcatgacttgacagctccaccaaagctccatgcaagacgaagcagctccacctcctgcctctgccatccagcgctgctccacaaacgatgctcccaagagagaaacggcaccgcaatatcgccatcgtgcgatctggaagaccagatcctagggtttcccccaagcagtgcccaccaccagcaaccgtcaaggacccacacagtgcccaccaccact

SEQ ID NO: 53417 - DNA, 426 bp, Triticum aestivum
  Clone ID: PAT_TA_53417
ttttctttttttttatcgctttttcgtcgtcgttcttcatttttttttgtttgtttggcaccacctggtcgcccgggcgaggtgcgtctttgtcccggaaaagaatatgggtgtaccgttttgggttggacagcacgactctttacctccttgttaaaataattgacgcgggcctgatgctgggggacctggacggggaactttatctgctgattttcaagggcgcgtgtcaagaagtggtgctacgccagccggcaacttttgccgcccttaaagaacatcaaccacgtttcttggtcttgaacctgggggggcacacgtcgtccaccataaagttgaaaaagctctcccccgtgacgcctcagaataagtgatctatggccccttctgttggggtggtagggatccaccctggcctccctgccc

SEQ ID NO: 53418 - DNA, 617 bp, Triticum aestivum
  Clone ID: PAT_TA_53418
ctaaaaagtacagtttaaagacagttcacatagtattacaacagcgacgctacgcgtacgacggtttccatctgatttccgtaggatctcccagctgacccgttggatcccaacatcattttaatctttgcggttcaggagtaccggcaggcatcggatcaaaaatgtcgcacgcatagctattatttcttcaacattacaatgctttctccatttcgccctgtataaatcgcccatacgatcgacctcatcatcatcatcttctgtacatatactactgtagtagtattgatcatcacatccttctcccgccggtcccggtctccctttggcagttgaagtaaacggcggcgacgggcaggccgaggttgtagagctcggcaaagtcgcgggtgctgaagttctgccgccaccccggggcgtacaccgtctggcggcccatctgctggaagagcaggaacaccagccggtggatcccgagcaccggccgcgggccctcgtagcacaccacctcggtcccaaaagaactcctgtcgtcgccgggatgtcggtgaccagccagtgcaagtactccctaaggctgggatcgctggggcttggagcatccggatccacca

SEQ ID NO: 53419 - DNA, 549 bp, Triticum aestivum
  Clone ID: PAT_TA_53419
agacagaaatggcaagctcgctcaaccagaagacgcatattcagtacagagcgatctctccgttccagccaaaacacaatctagccacacagtattaagctaccaccatgtacgattaataggtgccttaaaagcagaaaaacacgaggggctgccaggaaccgagggcatcagtgctccaggtggaaaacacattcagtcaaacgctgtagtttgttcggatcaagcttctggttcgtatggggcttctgttttctgacagtaagcatcttggttgccacatccagactccaaccgttttgcacggcatagttagtagcatcctcctcgctcatgcccatgaagtgagccacatctgcaatgctgattgaggtatatgcagaagtcaacagctcaaatatcctctttctgtagctgtctaggaaggcggacacaaaatccgcgatttcaggcccccactcgaacccctgtgcggaagtatagataccagcgtagtcacggttccagaggcactggccaatcttccagatggcgcccagctccggatga

SEQ ID NO: 53420 - DNA, 630 bp, Triticum aestivum
  unsure (1)..(630): unsure at all n locations
  Clone ID: PAT_TA_53420
gctatgacnngtcgcatgcaccgccgtaccgtaagnccttggnatnccctctagnagacggcaccgccccctttttttttnntttttttttttattttattttttattttatttttttttttattttttttattttttttattttttttttttttttttttttttttttttttagggcgacaaaagatgctttgctaatttcattgcagctcagctgggacgagaaggaaatttacctcacttttttcccaatctcacttactttgagcttttttacaggcggccttttttcaccagatgggtccctggcgaaacaacccaaactgcccgtttcacctacaaaaaaagctttttgatccacaaccaactgcccgtttcacctatgaaaaaagcttcttgatccaacgaaaaaaaagctttttgatccacaaccaactgcccgtttaacctatgaaaaaagctttttgatccaacaccaacaccggacacgtttatttcgaccttggctacgggcataaatttccccctgctgatacgggggatcttttttagcttgccaccgggggaatccaggctcctgtcctcgagctcttgccaacaaaatgaatcgctggccttggccgaaggggc

SEQ ID NO: 53421 - DNA, 663 bp, Triticum aestivum
  Clone ID: PAT_TA_53421
acagtaaaaacttaccgtttttatagattttacgaagcgaacttagcaatgagctcctttagaagattgggacaggttctagttatgtcctccaacccatcagccgccgttatctctttcaaattagcgggtgtcttgatgaactcaaagcaaacttctttcaatccatgacaatttgtgctgctcagctagagtaagaatagttgtcaccgagctcaaatctatgtgttcgcacagcttctcttaacatagtgctttcagccttcggagatcatatctatccgcagctgctagcaggtgttgcagccacaatgcttcctgggcctttccttcctcctccaccatgtctatctccattttgggcagtgaatcggtgtaaataaagctaagcaaggacctaaacacttttggttccatatcttcaatctgtatgacacttgccattttgccctccttcatgggaccaaagagctctgccttgaagatggcagattgagccacaagaatgcaccggtgagcaacaaacacttcactgccaaccttgaatgtcacgtcagtgccctctttggacgagaggaggtcgctgatatgttgttgtagactagaaggtggtaccttgatcaagagatcagtggtagttgcaatggcaaggtcacaacgaat

SEQ ID NO: 53422 - DNA, 628 bp, Triticum aestivum
  unsure (1)..(628): unsure at all n locations
  Clone ID: PAT_TA_53422
aacagtagaacatttttcttttttgagcaaaactgtagaacaatatgcacataatcatacatcacaggccaccatacgtacaaaggccccacaaaccaccgtgcaaaaaccagcccaatgtaagagcgagcgagaaagagaagaatgaatagaccagcctcggagaagaagaacagtcctctccaagcccacggagaaaaaacagaaatgacacacacgtaagtaaggtcaaggtcgcgtccagagcctccggcggcctcgtctcagtccctggtgtgagggatcaagcacccgaacatcttggagtagaagggggtgtgccggggccgcctcgcggccgtgtagctctccggcgacggcatgcggcggcgagggaggttccgcaccccgccgcggcgggccgcctcccggtcatgcttcacccggtcgaacatcaccgtgtacccctgcgcccccccgctctgctcgtcccacgccccgaacttgggcaccgncgtcggcctctgccgccccggcgcgtggttcggcgaggcggaccgcgcccgggcccccgccggcttgtacctcgctttatgcggcttgtggtgcgcgccgtgccccgccgggcggtggtggtggtggccgtggt

SEQ ID NO: 53423 - DNA, 476 bp, Triticum aestivum
  Clone ID: PAT_TA_53423
ggaccaaaacacaaccacaccaatttcacgattaccattacaaagcaaataccacaattatcagaaagttttcgagacacttaacatctgatagttactgacaccaacattggagagtcgactgacaaccatacatagagcagagcaaaaattctgacgaccccaaagattttagcatactgggccattagcacttgacctttttcagcccatgtgcaaagtacaggaaagttggatcagcagctccctccttgtagtacgcgaacaccacgccgccatcataatgcatgctctcgccaacaaagaactgaaggtccttgagcttgctaagaagatacttcgtggcaaactcaacattcttcttgaaaacatctaggtcatccccttcaagcttggcagtgaggttcttgatgtagcgcttcatgtgagagataaactgcttcttgtcaaaagcaggttgctcctgaagacggaag

SEQ ID NO: 53424 - DNA, 497 bp, Triticum aestivum
  Clone ID: PAT_TA_53424
ggcacgaggtccgccggccgaccagggctgccagcggccacaaagcagaagcagaagcaaagctgctgccccgccggggcctctgaaactcccgtgccgctgccaatgttctgtagtggtgctggtaacaacgagctcctagagcatggacatgaggccctcgaggctctcgtaccggaggtgcttcttcttcagccgcctgcgccgcgtgttgctcgcccagtactggttgtggaacaccacgttgtccgtgggcacgtgcttcccgtcgtcgttccggttccactggtacacggcgtgcgtccggttcaccagctgcagggtcgagtggccatagctcgcctgcctgaacgccgagtggtccggctgaggatcactgaacctccatgcgagtgcttgctggttgcctgcgtcgcccaccgtgatgtacacgggggcggttttgtctggcgccgtgtttcggctccccgctgtttcgttggggcgggtgttgggtg

SEQ ID NO: 53425 - DNA, 586 bp, Triticum aestivum
  Clone ID: PAT_TA_53425
gcccaactcttaacacgtcagggatacatatgttctagtacattggtgctatatatagccggcgacccggagcgttaacagcggcgaaggatagtaaattactaattgcgatgttggactagtaataacaaaagaaaaggccctggtgaggcttcatctaccatatatgtatatatattaggaaggagggtgttgtagtcccctccgtcgccagcatacttgcttcatacactcagtagtacatgagctgctgctgctgttgctgctgctgctgctgctgagggttgacactctggaagctcccgtcaaagatggcctggctggcgccggtgcccatacccatcgcggcctgcctcagggcggcgacctgacccatcagggccgggttggcagccatcttgctcagagcaagggatcgctcgtaggagatgaggtcaactgctgacacgccaggggtgtatggcgctaatgccggaggaggcagaggcgcaaatgctgtccctggtggagttggtttgcttccccaagagcacttgatctgcctcccgccaataagttgcccattacccgtctgttttgctcgtgc

SEQ ID NO: 53426 - DNA, 423 bp, Triticum aestivum
  Clone ID: PAT_TA_53426
ggggcaaagaattggctcctagattaaataagggggggcatagacgtacacatacccgtacacatacacatacacatccaatccatttcattccttggtcctccgcctaaaccacccggtggttttacattatcacacaccctattctttcctttcctttccatccacatccttacgtcccattttttttcccaaaaaaaaaaaattttttttaattaaaaagggaaacactccggagacgaaaacaacagcataatactagcgcacgggggcccacgggttgggtttcgttgaaaagaaaagatttttttcctttgcctcgggtggaattctggatccttttcccttggtttaaaaacctgacgatcttgggggggcgcaccacggggttgtcccgggcgatggcgtcccgggcgggggcct

SEQ ID NO: 53427 - DNA, 431 bp, Triticum aestivum
  unsure (1)..(431): unsure at all n locations
  Clone ID: PAT_TA_53427
aaacagcggcaagccaacagcgggggttggaaatcattacccacgggggggggggggtcaacgggcggaaatccaggggacaaaacgcccccagcaaggggaacagctccgtcaacggggggggggggggcttcaaagaagggggagggaatttaagcccaaccaggtctggttcaaaaggcaaaattttcttctggggggacattcttcctataacagacaagccgcggcgggaaccggaggggggcaaataaacaatggtcccgggcaccctgactcgtccctttngagcccccgcgggccccccccnaagctgccggggcgtcccccccttcggccctgttaatcttggttggcttgccctcaggcttggaatcggccccggcccccctctgcttaatgtgccgggcccgggggaaaaaaactcgccc

SEQ ID NO: 53428 - DNA, 678 bp, Triticum aestivum
  Clone ID: PAT_TA_53428
gacgctataatagtcttctactcattcagagattaccacatacggtgctcccttagatcaggaggctacagatagatacacattagcctattttcatacttcatcagtaggcatcatataggggcctcgtacttcaacactggccatcatatagtggcatcataccgtgcataagtagacatcttatactagcactgatgcttaaattatcgatataatttacttccagtagctatgagcgatgcagcattattgcttcactttggtgttgagccttcacccagcttggatgtccgggcctcacccgtccgtggactgtctcgcccccctagagggctgcgttcatgcctcagctcggtgacgcgagggctgtaggccttctcagaaatacaaggactgcggatgcctttcagttccgtgacaggagtgccacctgagctggtgatcttcggactattcaggcgcttgatctcaccgcggcttctggtgaccatgtcgtcaaggatctctgcgctttgggtgcgtcccagtgccacatcaatatcttgcgcagcaaggttgaacggtatagccggtgactcctcatactccgctgcgtccaggtcattgagatgtgcacctttgaaagagcttgggaggatatactgcctgactggaaccaggagcatgatcatgagg

SEQ ID NO: 53429 - DNA, 369 bp, Triticum aestivum
  unsure (1)..(369): unsure at all n locations
  Clone ID: PAT_TA_53429
ggggccaaataataagcattaaggggaaatcaacaatgggccaaaacatggattattggatgggtcacgacacacacaagtttggggggggtacagaccaaaaaggacaacaaaacttccagcccaggggatttggtgggcacccaggactgaataaaaggggggataggggatttctcactatataaaagggactaacttagtcgacctcctcgatcttggggccagcaccgccggtcggaggcggggggtcctcgtccatgcctccgggcatggcagcaccggggccctggtacattttggcgatgatgggggggcagaggccctccagctccttcattttgggctcaaactggngaacctcaccga

SEQ ID NO: 53430 - DNA, 488 bp, Triticum aestivum
  Clone ID: PAT_TA_53430
agcggtggcaaagatgtttctcattaattacccaaatacatagacaaaagatgggacttataatattatgggcatgtgcgtatacatagtcttacgggagtattcacatacaagcatgctttctcgagttatgtagggaacatggacatacacatattcttattttatgaacaaacaagaaagataaatggaaaaggaaaacccaaagcactgtcatagttgacaaaaccgcaatggcactttatatgtggcccgaggtgagtgagctgtttatgccttggcggactcctaccagaccggtggcttgaaggcgattaaattgacgcactgcacctggcgcatgttagtgaatccgatgatgcggacatacacgtcagggaactccttgttgacctcctccacctcgatgatcacctgcgtggagtaggtgcacccgaacataggaaggttagacattgttcagaaacggccattgtagaaaccatggg

SEQ ID NO: 53431 - DNA, 493 bp, Triticum aestivum
  unsure (1)..(493): unsure at all n locations
  Clone ID: PAT_TA_53431
caaaaaattgagccaagaaaccggctcatatatcacagcactttgctccctcaagttacatgtacaacaacttcacgaatgaacaaccatatggtatatcttctacagcagtcagtttctctctaccactatactaaactggacactatcacagtttaacggagctggacagtctaccaaaaatgtcactgagattggtgatggaaaaattgcatccctggaggtggctgcaaaggcctgaaaggtggtgcaccgggctgttgaagcgtgaactgcattgggggcgcaacattcatctgcatttgctgctgaagcatctgctgtgtaggtggttgaggctgtgtctgcgcccttgctaggttcatcatctgcggcggtggcggaggtgggggtggattcatggtgttcatactgtatggcatgcccataattaaacctncaggctgctggacatagtgctgnggaggggcctgggagatattgaattgaagct

SEQ ID NO: 53432 - DNA, 607 bp, Triticum aestivum
  unsure (1)..(607): unsure at all n locations
  Clone ID: PAT_TA_53432
tttttttttttttttttttttttattttttttttttttttttttttttttttttttttttttttttttttttttttttttttttttttttttttttttgaggaaaaaaaagggttttttataaggtcgagacagcttttccccaaaaggccccctattgggggagacccccaaaaccccctaaaggtaatagtttatttaaaaagaaaaaaccggggcgggtggtttacaggaaccaaacgaaaaactggcagggaaaacaaattccccagaggggatagcgacaggaaattatgtttttacttgcacaaaaccgggccctttttcaaaaaatcccccccccccccccatgcaaggagggggggaaacttgcctttcttgaccaaagggggggtgggcccacttttggccccnaaacaagggaaaaagggcctgggggacccggaaaaaacaaaaacctttttgttcacgggaaaactttgggaaaagaggacccccccacaggggagcccctgctccacaacgttgttgcaatcgtatgcccgggggtaaagcttttttccccaagtgggggggtggccccggcccccaaaaaaggggaccccccc

SEQ ID NO: 53433 - DNA, 441 bp, Triticum aestivum
  Clone ID: PAT_TA_53433
accctatcctaacagctatgacagtctcatgctctacttacgtaagactaggaatcctgctagtagcggatgcgcccttatctgtttttctgttttgaaatttgtatttccgcataacatcagccatacaacttataagactgctgcgctaggaacacttcctgcagcgcctaatgagagaacaagcgacgttaatggctttgctcacactgtccgtttaacatgcatgactcctgtgcatgccacctgcattcatgattacagcaacgcgcaacacaagggcgattcattttctggggccatgccacatcctttatacagcacaaggacattcaagacatctgggcacttaaccgacccagccttgcacatagacaaccttacttccaccttgggaaatggctgatatcaacataacctgccgacatgagcgactgaaca

SEQ ID NO: 53434 - DNA, 509 bp, Triticum aestivum
  unsure (1)..(509): unsure at all n locations
  Clone ID: PAT_TA_53434
cttnntttttttttcttctttctttcttttctttttctttttttttcttttttttcttttttctttttttctttttttttctttttttcttttttttttaacacccaaaggggccccgtttcaaattataaaacgggggaagggccctttaccctattccagggtttccacaacaggggccccacgaggggcgcccgaaagaatgatcatataaacaacaggggcgggggcaagggagcccccctctaccaatcataaaaactgggtccacaaagccgggaaattcaagcgggctaacatttaatcaaaaggatgccggggattctatatctttgaagggggggcgaatcacgggttgaatggggcgaatcccacccccgaattgggccctccaaatccaaatgagttaaaaatagcaacattcacttcatgcggctttttttgggtagctacgggatcaaaatcaacttcaggctctgggttaaattggttaacggggggatgcaccc

SEQ ID NO: 53435 - DNA, 312 bp, Triticum aestivum
  Clone ID: PAT_TA_53435
cccagaagaagaaaaatcggattgcaacaacacagtacgcttcacaactggaagctcgccggtctcagtttcttcatacacgagaaagtgaaacatgtcaagtggtatccagactcgtaaacacacacttctagtagttccacagttacaagagcaaaacgaatcgatcactggagatatatatgtactgcttgagaccttcgtactctagcgtggtgccttatgaacagctcaatggccctctatacctggtttcttatagggacgacggccagcgataagctcgatcctcttgaaacacggacgcgtggg

SEQ ID NO: 53436 - DNA, 642 bp, Triticum aestivum
  Clone ID: PAT_TA_53436
agatgacaaccctcaaattgactgaatactgatgaaaggtgtgtcaacgcaccagctgctggggagcaccagcttcagagaatagcaaaaacacaaagaacagcaaatctggatgcacgaggctgctatgaccatcatccagaataccatggagcaccagcaatggagtccaaagcatatcacctttttcgacatcacattgtaataactcaaccagaaaaaatctaggacggagtccccggactttgaactacatccattacatcacatatgtactggcaccatgaccagctagctccctaacactcttgtgacaaggtaaggtaaaacaggattatcaccatgactagttataactcttttttttctttcaccactccccctgcctgacctacttgatatactgcgacatccacttgaacccttcgccatagcccatcttgcggacgatgctgcacatgaagacctccagggggcggacattggactcgctgaggctcaccttgcccttgccagtcgtgaagttgctaagacccatgcggtagcggagctcttcctctgaagccgcataggggatgtcgatcttgttgcccaggatcaggaaggggacggtggccagcgaatcgtctgagaagagggcgt

SEQ ID NO: 53437 - DNA, 701 bp, Triticum aestivum
  unsure (1)..(701): unsure at all n locations
  Clone ID: PAT_TA_53437
cagaaaaatacctctcggcatttcgtttattgccatccatcacgcttacaaacgatactctaaatgctttgtatcgcttgatgctacattttgagataataaaagcgtcctttatcgaaaaaatcacgcttacaaactgagagcagattgacgaaaacagtcatcggcagcgttcgcatttgagaatggggactcgctgtagtacgtgcagtccgttccgtcggcgcggttctatgggtgtgccatcacgtcgagcacgacacaagcggtcagcgccgtggaacagtgcaggttgcctcagttttcagggtacagatctatggtctcggctgaagcatctgtctttacttttgccaaacgagcccctgaagcggttgggacaagaatcagatcagcaaatgaagcaacaagtggaatgacaaccgactttggcaaacagaagataccaaacgaaaacttggagcagtctaaaaatgcagatacatcaccgcaggaggccctctcgactcgctctgcctgaagcacggcatgctggggtctatgccaacatcttgcggcttcaaatcatctgagttacttaagatttgacaaaaacctttccaaagctatctgacaacatggcaaattggcaatgaaaattgagctcagtaacagcctttgnaggttggtgggtgtgcttgtgcaagtggacaactgtcgac

SEQ ID NO: 53438 - DNA, 697 bp, Triticum aestivum
  unsure (1)..(697): unsure at all n locations
  Clone ID: PAT_TA_53438
ccatcctaatgtattgaagtgcaaattccctgcacgatctaacaaaaatatatacatgctctgaagtagtactcctacacataatgtccacactaactaaacaggcaactgtattcatgcttgcttggagatctcttcgatcaccaaaactctagctctatggattgtagcaaggcacaggcccacgtgctcttctagctctatggccaatctcctagagctggaacaactcctcctcagctccaacaccatctcctgcaccggatacttctcatccaccatctccatgcaatatgttgccattgcattctcccgctcgataccatcagagaggcgcacggcgagttggctcaccgtgtcgaagtccctgccaagaacatatgtgccctttgcggcagtatcaagttgctcctgcagctgctgcaaagactctgtcttagaacgtttcagcctcgtgaccctcctcttgaccgcaatagggcagagccccatgagcgcagatccaaccagaaggctaaagaccagcaggtgtgctgcaatcccaatggcaaccgcaccaccggcaatgacaaggcaagtccttgagagcttcttgatgattttcactatcttgagcttctttgccactntcctgtgacttgatttgatggtcttgagcacggaggagtacctgtcatgaatctgtctgaaaatgctc

SEQ ID NO: 53439 - DNA, 410 bp, Triticum aestivum
  Clone ID: PAT_TA_53439
attaacaaacgaggggggatcattttgctttgctcaacggtgcatttactgggttccaaaaaatggccaaatccaaaagacccaagataatccggtagaataacagggcaaaatcttttggttcaaccaaaacacaacccccccaatttcacgattcccattacaaagcaaatcccacaattttcaaaaagttttcaagacactcaacatttgacaggtactgaccccaacattggagaggcgcctggcaacccttgataagagcaaaaatactgaaaacagcataaattttaacatacagggcgattagcacttgacctctttcaacccatgtgcaaaggacaggaaagttggatcaacagctccctccttgtagtaggcgaacaccacgccgccattattatgcatgc

SEQ ID NO: 53440 - DNA, 149 bp, Triticum aestivum
  Clone ID: PAT_TA_53440
tcgcgatctagaacctcttttctgctgcacattttcttttgctgtcatatcaggagtgaaattaggtttgttgggtagtatcattcattgaaaattgctactgctgtaatgtttccacgcatgactgaatgagattactgacagagtcc

SEQ ID NO: 53441 - DNA, 176 bp, Triticum aestivum
  Clone ID: PAT_TA_53441
gcaacatcttagttctgacattcacaacagtgtggggtgtacaggaggggcagggcacagaatgagagatctattatgtggtttgggcaggggctggtggcgggcagcagaaattcgtagcacattggataaggcatgcggggctgaatgcagtgcaggggtggggtgggggggtg

SEQ ID NO: 53442 - DNA, 453 bp, Triticum aestivum
  unsure (1)..(453): unsure at all n locations
  Clone ID: PAT_TA_53442
cccgggaattaacagcaggacaagggcccgctggggggttataaaaaaaaccacccgggggggggttttgggtacccggggctggaatttacattggccggccccacaacctatggtcggccaaacccagttcatcccgaacaaaaaatttgccctgggcggaaagcaaagccccggacaaaagggaagttcacaaaaaacaatcatccataggccattgcttcaacccgtagttaaggccttgccaaactcctcgaaacccgggggcctgaatgcgataaaactgaccccctgcccctggcccaggttgtcaaaccccatgacccggacataggggtaagggtactcctttttgaccccctccacctggtggagcccctgcggggggtgggggcccccgaacataggcggtttccacattggccagtatcggcccgngtagtccccgggggg

SEQ ID NO: 53443 - DNA, 516 bp, Triticum aestivum
  unsure (1)..(516): unsure at all n locations
  Clone ID: PAT_TA_53443
gacgtcgcactgcacccgcgtaccgtaagnncttggaatncctnctagnanacggcccgccctctttgtcttttttttttctttttcttttttttcttttttttttctttttttttttttttttttttttttttttttttttttttttttttttttttttttttttaaaagcccagggcggggcattcccttgcggttaacacaaaatttccagggcaagatcctaaaaggggcaggggcctttggttcctggtaattggggacataacacctttggcgcctaaaaccccgacttttttttccgggccttggtggaccccttcgggggttctgggcccttggccgagggggggggtttcccagagggggccccggtcttggcgggcgatccctcttgcttttgtttgctccccagcccctgggcccctggtggcctggccccttttgttctttcttttggggcggggtggcgccctctccctctggggcgtccctctctcgagttctggggggggc

SEQ ID NO: 53444 - DNA, 357 bp, Triticum aestivum
  Clone ID: PAT_TA_53444
agttataaaagtcgggttcgagcttgtctatttccacgccttgagtgacttatacgtactaacattatcgctcaaattacaatacataaatctaatgcacaaaaattgcacaacaccaatgttccagctgtcctctgaaatattatgttcgaattggagaagttatcattgcagaagcttgtagtacatgcctcctgcatataacctgatcaaggttcaaacaggtggcatatggaggcatgttcttttgacaggaccatacgtttttgcatgccttcgttcggcctttagcaacttccgttgttaccctgtgagacaacaccacccagttgcccaaatcaaatatttgaagcagac

SEQ ID NO: 53445 - DNA, 451 bp, Triticum aestivum
  Clone ID: PAT_TA_53445
aaaaaaaccacgccccgggggggtttttattttatggtcggggggggaattgcccccgggtccctcccccacccaaagattaaaaaaggaacctctttaaatcccccccgggccccagggtggggtccctgatcttgaaactatccacaaaccttggcccttcagcccgcgccctgaagttccccttggcctacccaacatgggcgaaggccctggacctccccccccctagccccgggggcgggttcacaattccgggaacccaagccttctgaaacatcaccccgggggcccccccttttttgacgtccgggaaccccctgggctcggggctcttggccccgcccttgggcaggatccggaaaatgtccccccccttgataactaaggcccccggccgcggggtcaggggggaccatctgccgtttttcctcccccgggggccgggggg

SEQ ID NO: 53446 - DNA, 596 bp, Triticum aestivum
  Clone ID: PAT_TA_53446
aagacattaataccagtggccaatttacagttaaaccatgccgccagaaagctacttcctccgcaaggaaatacaggagcgaatgcacatccctagcacctctcatcttgaggtacacgatggaggaacacatactcattctggctcacatcaagggggacacaccttaagcttatacacatgatgaaatagcggattaaactaagtatcatggctcgatctgcgttaacggcttctgatggggggggctcacctgcagaaaacaacaccgaacacacacatacagcatacaacagtaaacaccgatgcgggctggctagcctggcgtgacaatgatgctgacacataacttagggaaggatgactgagggagttttcagcgcatgatcgtgaaagatactgaagacgcccttttgcactggatgacggcggtgatacctatactgatgcccgacctcaccttctggttaatggagttccacacgcatcttacggataaccgacttggacacattggcgctcagagcgctgacgcccttataggaccccccctagggcgccgaatctagcattgttgactacgacatgcacggctc

SEQ ID NO: 53447 - DNA, 614 bp, Triticum aestivum
  unsure (1)..(614): unsure at all n locations
  Clone ID: PAT_TA_53447
gcccttttttttttnttttattttttttttttatttttttttttttttttttttttttttttttttttttttttttttttttttttttttttttttttttttttttttttttttttttttttaaaagaaaaacctaaaaaaggggggggttaaacggaaaaaaaagggcgggaaaaggacccaaagttggccggccccccccccccaaaggaaaaaactggaaaaacctgggtttaaccccacccaaaaaaggggcccccttccaaaggttaaaaaaagggccaaaaaaaaccccgaaaaccaaaaaaccccggggggaaaccaaaggggggtttaattacggggaaaagaggggacccccaaagttgggggcggggaacaaaagccttttcaattggcccccccttttcggggggggggtttttttgggggggggggcccaaaaacccggggccgttaaaaagcagggggggaaaagccccaccttgttggaagaaaaggaaacccgggggggcaacccggaaggggaaagggggttaaaccaggcccaaaattaaacccctaacgttttaaaggaaaagctggaattcccccccctaaacccatttgggggg

SEQ ID NO: 53448 - DNA, 507 bp, Triticum aestivum
  Clone ID: PAT_TA_53448
caagggccaaacatcccacaggggggaaaccaaaccccacacagaaaacattcaaacagacagacagcaaataaagcccctcgggcaaataacacaaaggaaccctgggcgaacataagggcgtgaaaccaaaaagttttagtactaataaccctaataaccatcctaaccctgggaaaactaagcgccaactttttaaaagcccttctccagggcaggaaaaccctcacgggcctaaaaaaactttccctcctccatgccctaacccacgtaccaggggacaaaggccccctgggcgaacatgaggccaaacttggggccaaggcggaaaaaaacctcaacaaccctgggggagttggaaataatgcaaacagccctttgaaccttggaaaggccaccccctggaacaaccctggggggctggtatttgaaccacacttaaaaccaggggggcaccagcccaaaaacgggatggggcgcttcgtcttgatgggggccacagggggg

SEQ ID NO: 53449 - DNA, 279 bp, Triticum aestivum
  Clone ID: PAT_TA_53449
attaggggatctcaagctgacagtaacactaggatcagaggaggggttcaagcaaagcaccacgagcagcaacacggctcccaagcagccaagcgaggactacacagacacattgaggcggggactctaaggaggcggattcaagttaacagagaaagaagcggttataggagcgcctgccatcgaacggaaaaaggaggcactgaacagaaatggaggggggggcgaaaaaaaggagatgccagtggctctagcagcacgaacgaagccgtcacaaac

SEQ ID NO: 53450 - DNA, 196 bp, Triticum aestivum
  Clone ID: PAT_TA_53450
ccccccttttttttttttttataggcagagcacaagcaaccaataatcagggcaccaaacaaggcttcaaatatacatcccaaacaggggggagccacagagcggagctgagacgggcccaaccaaatggccgcgagcaaactaggggcacaggggtctactacactgggcaagagacggcactagcatggcccgc

SEQ ID NO: 53451 - DNA, 449 bp, Triticum aestivum
  Clone ID: PAT_TA_53451
aaataaaaccccctttaactttaggttaaacaaggaaaaaaaaaggatccaccgggccgaacccgaaatggagcgccttccaaacttaaaaaggggggggtaggtaaggaccccatttgaaagcggggcggaaaaattaaaaaccttcgggagcaaaaacgccccctttgttacaagcttggacacaggctttaaaagccacccgataagggggggcaccaggggcatttccccaaggagggccaaaaggtcccccaccaaatgggaaaacaaaaacgcccccaaaaatttcgggcaaagcgggcaaatgccaaacaagaaaaccaccggaagccaccgggaaaaaaccggggagggaaacccaggccggagggaaaaaaatcccgggagcacaatcttttaaaaaaaaacatcgggcaataaaacaacaaaacccaaaggcatttggg

SEQ ID NO: 53452 - DNA, 478 bp, Triticum aestivum
  Clone ID: PAT_TA_53452
gggctaaaaaagggggagctgtttcattataaaggccggaagggtttctacagaaattttttacaggataaaattacgggtaaattcatgcgtttccaacgaagggactaagcaggaatattttggttggggaagaacatttatcggtcaaattaaaaggggcaaaacggccctttttttgagggaaaaaacccccccaaatatgccgaaaaagagaaatttgaacaaaaaacagaccgggttgtaacggttttacaacaaaaactagtcaccggagcttccaccaaagcccattttagggtttatcacaaggggactttaccggtgggggaaaagacaaccttgctttttgggggcccgttctggttgccctcggccccaaccttgtaaaccacgttcatttcaaacaacaccttgccgaacaaaaagtgcttgccgtccaaccagcttggggttacaggggggatgaaaaaccggg

SEQ ID NO: 53453 - DNA, 555 bp, Triticum aestivum
  Clone ID: PAT_TA_53453
ctccatcccataatataagagcgtttttgacactatattatgggacagagggagtagtaatcatgtaaattgaaaataaaatgcatgtgctaacgcaatatgaaacaacagaaatttcaatatcggtctttgtttatatttccttttagtggatcaacccattttaattgtatatttaatatatgatgttggctcattgatttgtttaatgttcctgatactcaattttaactatatcaaacatcaatctttccttaatgcagaaagcttatgtggaagaaagagtttgattcaagttatgttggcttcatggaggacggtgctcagtggttgattgataacactgacatccaactagttggagttgattacttgtctgtgggagcatatgaggaatgtattccagctcatctagtatttcttgataaaagggaagtcatccttgtggaagccttgaaccttgacatgttgccactggaatatacacattgcattgcttgccactaaagttgcgcggcgctgaaagctctccagcgagatgcatcctcatcaagt

SEQ ID NO: 53454 - DNA, 487 bp, Triticum aestivum
  unsure (1)..(487): unsure at all n locations
  Clone ID: PAT_TA_53454
ctaacctccagatctcccgcgctcccccgccatttgcttccgtcgggccgccgcaaggggatggccccgcgccgtcgtcgatccgaggtccgcaggcaccccctcctggcgccctcccgttccctggcagtccgtcgccgccgggctcgctcttcgcccgcccagcgccgtcggtccagcagtctgctccctttggcgctccacccgcggcgcagtcgttacagccgcagaggcctcccttcaatggcccgccgcccgtgctgccggcgcaggtgcaacgagcgccatttagaggtccgcccgcggcatcccagcctcttccgttcggtgggccacctgctgcggtgtcgcagcctgcccctttcggtgtctctcctgtagcaacagcccaatctgctccattgggtgcccccccgttttcagcagctcacccaccacagtttaccgggctttctggggcagngtctcgatctgcctactctggtgg

SEQ ID NO: 53455 - DNA, 620 bp, Triticum aestivum
  Clone ID: PAT_TA_53455
cacctcctcactcccacctctccctcactccccacctccgaagctccagcggcagccatggcccccaaggcagacaagaagccggcggccgagaacaaggtcgagaaggcggcggagaagacccccgcgggcaagaagcccaaggccgagaagcggctgccggcgggcaagacggcgtccaaggaggccggcggcgaggccaagacccggggcaggaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcgaggtacaacaagaagcccaccatcacctcccgggagatccagacctccgtccgcctcgtcctccccggcgagctcgccaagcacgccgtctccgagggcaccaaggccgtcaccaagttcacctcctcctagacagttgatgcgacagatgtagttggctgctgttgtctcctgttagtggtcgctgactctgcttatgtatctgcaagtagtgggaggagtggtcgtctgtg

SEQ ID NO: 53456 - DNA, 580 bp, Triticum aestivum
  unsure (1)..(580): unsure at all n locations
  Clone ID: PAT_TA_53456
tactcctcctcgcctccgcgcatcgcaccgcaccggggngtcacctagagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatatcttggaaatgtgacagctggagcggatggtgttgctaacatcaatgttactgactgccatatcccccttactggaccaaattcaattgttggccgtgctgttgtcgtccatggtgacgctgatgatcttggcaagggtggacatgagctgagcaagagcactggaaacgctggtgcccgtgttgcttgcggaatcatcgggctccagggctagatgtcatcttcgccgaccaacgtcgtacagatctgagaaccttttcagaatgcagatttgcaatctctattctaaatagcacatgatctttgatcactggttagtgtgcaccattcatgtcaattcctatgtgctactctg

SEQ ID NO: 53457 - DNA, 544 bp, Triticum aestivum
  unsure (1)..(544): unsure at all n locations
  Clone ID: PAT_TA_53457
cacttctctgctccctcgtctcctcgcgcgcagggcccggcgaaagggaagcaagatgtacaccgccaggaagaagatccagaaggacaagggcgtcgagccctccgagttcgaggacaccgttgcgcaggctttctttgacctggagaatggcaaccaggagctcaagagcgacctcaaggacctgtacatcaacactgcaatccagatggatgttgttggcaggagaagaagtttagcggcaaggatgttgtctttgttgcaacaagaaagattgtgaggccacccaagaagggttctgctgttcagcgccctcgcaccaggaccctgacagctgttcatgatggtatcttggaggatgtcgtgtacccagctgagattgtggggaagcgtgtcagataccgtttggatggtgccaaggtcatcaagatctacttggacccaaaagagcgcaacancactgaatacaagctggagaccttctctgcagtctaccgcaggctttggggggaaaacgttgtccttgngtaccctgtgactgaaa

SEQ ID NO: 53458 - DNA, 586 bp, Triticum aestivum
  unsure (1)..(586): unsure at all n locations
  Clone ID: PAT_TA_53458
aacatccgctctttggctccttccttcctccccgctgctggccgctctccaagaccaccgcccccatcgccctcctcctccccctcctcctcccgcaatcaccagcagcttcgcagcaccttcttcctcctccatcctctgccgtttcctccattgggcgtgaatggaaggtcggacgacactggaatgtagggccgggtaaagaaagggagcaagaaacgccagcagagttccacccccctgccgccgcccccgccggaaatctctccgcctttactcgccgggagccccgccctcgatctgatccgatctgattcggattcatttctcgcccggccgcctccttttctaaccgcccgtccgctcccctccgccgacgggagggaggaagggcaagaaatgaagagcctgcagtgcttcaagaatggcgccggggacagcancgcggggaggcggctggagcggcggctgtcgctgggggactacaagaaggccgtgtcctggtccaagtacctggtggcgccgccgggcgccaagatccggggcggcggcgaagagctctggagcgccgacctgtccaagctcc

SEQ ID NO: 53459 - DNA, 499 bp, Triticum aestivum
  unsure (1)..(499): unsure at all n locations
  Clone ID: PAT_TA_53459
ttgcattaagagtgccatctcccggtgctctgtggacgcacaactactccttctagcactcaccaccacacaagaagagattaatcaacactcaggctagctaggagaagagagaggaagcaatggcggacctgatggtgggtttggccaagtcggtggtggtgggggcactgagccaggcccaggcggcaatcgaggaggaggcgaagctgcggcggaaggcggagctgatgaagacctgggtgaggcaggtccgcgagctcgccaacgaccttgaagactgcatcgagttcgtcgttcacctcgataagaagtccacctggtatttccgtttgctcccggcatggatcacaccgcctccacttctggatgaggcggtggcagagatagacgtgctgagggccagggcggaggagctgagcaagtgctacttgcgctacagccacatcatggactctgacccaaagctgntcaagctgcaacagcacgaaacgtctgg

SEQ ID NO: 53460 - DNA, 526 bp, Triticum aestivum
  Clone ID: PAT_TA_53460
gttcagacaaggaagaagaattcggctggcttatcaaatattctccccttcataacgtgaagagaccttgggagcaaagctttggtgataattgtcagtatccagcaaccatgctgttgacagctgatcatgatgaccgtgttgtgccattgcactcgctgaagttgttggctacaatgcagcatgtcttgtgcactagcattgagaacagcccgcagaccaacccaatagttttatgtcgaagatgttgggcgctacatggactgactagttcaattctgtcctggaggtgctgtgtgctgagcacacaagacggtgaaaggtgtaatcctggaggggaaagattgctatcgcttcagctgctgaacagtttttgagttcaagtactacaaattctttgaagcttacaacacttacaatgtttgtgttgtgcaagagcctatatattcttccatatgtgaaaggagtgtgtgtttctgcttagaaaatggctgtgaaaacttgaaatggaccaatgaagctgtct

SEQ ID NO: 53461 - DNA, 353 bp, Triticum aestivum
  Clone ID: PAT_TA_53461
cccagcgtccgtcccactttcctctccagtccacccaaagtccgacgagcaaccacccggccatggcgaccaccgacatccgcctctccatcgggcaccagacccgcttcgccctccgcctagcctccgccatctcctcgccctcccacgccaagggctccgctggcaacgccgccttctccccgctctcgctccacgtcgcgcttagcctcgtcgcggccggcgcgagcaggtggttcaggtcgtgctcgccgacgcgtcgggcgccggcggcccgcgggtcgccttcgccaacggcgtcttcgtcgacgcgtcgctcaagctcaagccttccttcaaggatctcgccgtgg

SEQ ID NO: 53462 - DNA, 241 bp, Triticum aestivum
  Clone ID: PAT_TA_53462
ttttaaatacccgagcttgaaaagtaatagtttttttttagggggacttaaattaaattaactggccgtattttaaaaacaaaaggcccgaaccaaaagcctttccaaaaatttgcccacccaaaatgggaaaaggaacgccccttttaggggccctttaagcgcggggggtttgggggttacgcgaagggggacccctaaatttgccagcgcctaagcgccgggtcttttggttttctta

SEQ ID NO: 53463 - DNA, 657 bp, Triticum aestivum
  unsure (1)..(657): unsure at all n locations
  Clone ID: PAT_TA_53463
gcnnnnnnnnnnnnnnnnnnnnnnnnnnnnnnnnnnnnnnnnnnnnnnccgtccgaagctaggcactagctccgatgagtagctgcttcaacggtggcgccggctggccggagcccgtggtgcgcgtgcaggccgtgtcggacacctgcggcgagacaatacctgagcggtacgtcaagctgccgttggatcggccgtcggcgacgaccctccaaccggcggtctcacatgggggcggcagcctaaacatcccggtagtggacatgtcaatgccggactcgggcgagacagtccgtgccgtggacgcggcgtgccgggagtgggggttcttccaggcggtgaaccacggcgtgagccctgagctgctgcggcgggcgcgctcgtcgtggcgcggcttcttcaggcagccagccgaggtgcgcgagcggtacgccaactcgccggcgacgtacgagggctacggcagccgtctcggtaccaccaagggtgggcacctcgactgaggcgactactatttcttgcacctcctcccgccgtcgatcaagagccacgacaagtggccgtcccttccgtccaccctacgggacgcgacggaagagtacggcgaggaggtggtgaaactgtgccggaaggtatcaaaagtgctgtccaaggggc

SEQ ID NO: 53464 - DNA, 292 bp, Triticum aestivum
  Clone ID: PAT_TA_53464
gcgtccgcccacgcgtccgcccagcgtccgcccacgcgtccgcctccccgccccgccctgccgtccgaggagaggagaggagaggagaccaaggtagggcaggccgttcctccttccttgaccctcgccgattttaccttccggcgttggggatttacgggacctgcatttccgcccagggggaacagattaaaacgcgttcgcgaggggctcctaatctgcctaggtcctcggatgccctcaacggcctctccgatccttcgtacttccgagtttatcccccccccccccc

SEQ ID NO: 53465 - DNA, 554 bp, Triticum aestivum
  unsure (1)..(554): unsure at all n locations
  Clone ID: PAT_TA_53465
gtctcccggaggcggggacggctgggtccggcggcgactgggctaggaggaggtggcgcggtgtggcggtgctggtggcagggtttcggtcgaggtcgtcttcaatctagatcgggttctccatcggggcgtcgcacggcggtgggatcggatcggcggcatcgtcaccggttcggcggagggctccgttccagccaaccgcgagattgggacgccgtggccttcggtgaaaatcgcgtctgactgcggtcatggcggacgatggcggcgtctaggacgtcgttcccttcttgaggcatcgtcgttgcaggtcacgtcaacctgatcgaaaggctccaggggaaacccttgatctggatctaccggatcggacgatgacgacgtttcgatgtcgttcttcctcctgggggcatcgttttggagtaagtgttggctggagggcgcaagaggaggagcggcgtggcatctggcatgtcgacaacggcgggtctcagcggnntggagcancgggggtctcncccgtgggcgtgtgatgatggaccgnngcaggatgg

SEQ ID NO: 53466 - DNA, 482 bp, Triticum aestivum
  Clone ID: PAT_TA_53466
cgaaaatctggtggccaggcgggtggcatcgcggcgatggcgtgccgccggtggatctcttgtgccgggaagcggaggagggagccgcggtgcgaggcgccgccggccgcgacagcttccccacctcctcgcaccgccgccgggatccgtggcgcccggttcttcgtcgccgcgtaccgtagtgcgccgtcaccgggatccttctcctcctcaacaccgccgccagggtcttgctcctcttcccggccgccggctccccgccagagcacgattagacctgatgactcactacctcgaccctctttttcatgattttgtcttgttcttgttgattgtgatcatcagcttcagcaattagtaatgcagcaggctaacgtgtgtgatgaatacattttgcggggtagcaggccactgcgtgtgatgtttctggtgcaatgtatgctgcaaatctgtgtgtgcaatgtacaagttgtgttatgtgc

SEQ ID NO: 53467 - DNA, 455 bp, Triticum aestivum
  Clone ID: PAT_TA_53467
gcggaacccgcacaccctcgctctctcgttctctcttcttcttctcccgagcaagaaggaggctctgctccgcgcaagcaagcgagctctgcctcatggcctgcgccttcttcttcgacgcggagccgctgggcgagccggggctgcgcctgcacgggccggagctggagctggacgcctgcgcgctctgcaccaagccgctgcagggcaacagcgacatcttcatgtacaagggggacacccccttctgcagcgaggactgccgctacgagcagatgcacttcgacgccgccatggccaggcagcaggccagcgcccggcggaagcagcagcagcagcaggcccaggcgcagctcagcgtgccgggagcaccggcgccggcaccggcaccggtgtccaacaaggccgatgtgtccgtggcgagttagttgcgccgcaccacaccgggttagcta

SEQ ID NO: 53468 - DNA, 543 bp, Triticum aestivum
  unsure (1)..(543): unsure at all n locations
  Clone ID: PAT_TA_53468
gcagcagcaccaaggggcttgaacccttccgtgtcggcaatcgggttcggtcccggcgtcagcttctccggattccgcgtccccgcgaggatgcagggcaacgaggagcacaacggcggcaatggcgacaagccgccgtccgtctcctcggcttcccaccactgacagcagcagtggatgacagatgacttcaccaccaacctccacagtgtaccaattgcattgcaactaggaggagcgaaattcggagctggttctacgtctggttggttggttggttggttttccatctcttctgctacgtgtgtcattgtcttttgcttcaagatcactcggagcttcttagaattaggcttgtgagagtgcagcgacacagcaagctggtgagccagcctctttgtggcattgcattaggtgtaagtgatgttgtagttagctgtaggtcaagctcgattgctttctttctttcacttgntgctgtatgctactactagatgttattctcaaacttataaatggatgtttgatggggagaagagtcta

SEQ ID NO: 53469 - DNA, 492 bp, Triticum aestivum
  unsure (1)..(492): unsure at all n locations
  Clone ID: PAT_TA_53469
aaagattttcgtttcgttttcgtccgcttccgcctctgctccgtcgtcctcacgcgacctgcagcttgactccctcccgcaccgcacgcacgagcagcaggggcgcgagaagatgcagatcttcgtcaagaccctcacggggaagaccatcaccctcgaggtcgagagcagcgacaccatcgacaacgtcaaggccaaaatccaggacaaggaagggaaggagtcgactcttcacttggtcctcaggctcaggggcggtactatgatcaaggttaagactctcactgggaaggagatcgaaatcgacattgagcccaccgacacgattgataggatcaaggagcgtgttgaggagaaagaaggcattcctcctgtgcagcaaaggctgatttatgctggtaagcagcttgcagatgacaagactgccaaggactacaacatngaaaggggctcggncctccatcttgtgcttggtctggggggggggttcta

SEQ ID NO: 53470 - DNA, 344 bp, Triticum aestivum
  unsure (1)..(344): unsure at all n locations
  Clone ID: PAT_TA_53470
gcatagctacgagnaaagaaagtcttgttgaagagtgagggagaggaagctcccacccacccagaggggtgcgaagaggcagcatggagcgtgcaggggaagatgatgatacagggagtggaagcaggaggaggagcaggagcatgagcatgggcggatcagatgcaacatcgaccatgagcggcggcggcaccacggcggtcaagcagcaccaggctctgaggctcgtggncntnaccaagatgaacgcagggctgctggattacatggcggatttcgggaagaaggaggtgacggctaggggcacggttatccacacctagtacaagaatataaatatgccc

SEQ ID NO: 53471 - DNA, 614 bp, Triticum aestivum
  unsure (1)..(614): unsure at all n locations
  Clone ID: PAT_TA_53471
gntggctctaatgtcaggagctacctgtactgtgaggatgttgctgaagcttttgaggtagttcttcacaaaggagaggttggacatgtgtataatattggtactgtgaaagagaggagggtaattgatgtggccagtgacatatgcaagctatttggcttggacaccgaaaaggtcatcaggtttgtcgagaataggcccttcaatgaccagaggtacttcctggagcaatcctgattactggggagatgttgccggtgcattgctccctcatccaaggatgttgatgacacctggagttgaaaggcataactggactgaagaaatcaaatctcttgcttcttcgccagctgaagccaaggaatgtagtacagtaccggctgcagccacatccaagagtaccagcagtgtccctcaaaaggccacctacaagttcttaatatatggcaagactggatggattggtggcctacttgagaagatatgtgagaagcaaggcataccttatgaatatggtaaagggcgcctggaagagcgctctcagctcttgcaggacattaagaacgtgaagccgactcatgttttcaatgctgctggtgtcacctgaaagccaa

SEQ ID NO: 53472 - DNA, 282 bp, Triticum aestivum
  unsure (1)..(282): unsure at all n locations
  Clone ID: PAT_TA_53472
gagaggggaagngagaacagcgcnaaggggggagcagcaaccangaagagcaccaagcgcgcggcgaaccnganccnccaggccgnccaggncaggggganccncncacacgggaacgccgacnannnccccaagggcngcaacaacggcagggggagggggggggncgacgncngcgacgacgcccacccccagggccccaagggcggcncggccngacgcggggngacgccnaacccggacaagacggggcggngcggcgccgnggagagcgcggggggg

SEQ ID NO: 53473 - DNA, 443 bp, Triticum aestivum
  Clone ID: PAT_TA_53473
cactacgcttcatgcatacctcagcgaagcgtgcgagtccgagcttccttggcgcgctaagagccaggcggcgtagccaccgggcagagtcagcttaatcggcgccggcccactggcgctcatttttttcatactaaacgagcgccaatcgcccggccctatgcaaaagctctacgaccagtggggggcaagcaaggaccgcgcctggaagctgaatcttgccgaccccggactgccctcgggtgcatggtcattgaggataaggcctttgacactgcacgtgcctgcgcacacatggtagacgatgcggatgtgccattagcatcgtgcactatgctcacagattaccgaccctttgaatacccccagtacatcgcagctgcgaagatagggacttatctccgctgcgccaagaacacgacaccgtgatctaccgcctgatg

SEQ ID NO: 53474 - DNA, 575 bp, Triticum aestivum
  Clone ID: PAT_TA_53474
gatcagagaacgaatagcagttgcaagcaacaggcctcagttacacaatgacagccaggcacgcctagaatacaagaagcaagctcacccagataactgggagcatttcatttccaaatggaaggagagaagccagcaagctggcatttttattcggtaatcgtttgtctcctccaagctcgtgagcaggctgtcgaagctccccttgaaggagctcaccccctcgtgctccagctgcttgccaacctcttcccagtcgatgcccagcttctccagggcactgtatatgccctcagcttctgacacgttagcgtcgattgtcctagcaactgtgccgtggtcgatgaacgcgtccagagcttggtcgggcatcgtagagacagtgtcaggtccgatgagaggatcgacgtaaagagtgtccaagtaagcccgggttcttcacgcctggtggatgcccacaacaacctctgcttcttggctcccttcttcaccaaagcctcccacctcgggccagagaatttcttcaggtaaaagctggttagctatctttgcttgtgctacggcagcctttcccc

SEQ ID NO: 53475 - DNA, 568 bp, Triticum aestivum
  unsure (1)..(568): unsure at all n locations
  Clone ID: PAT_TA_53475
gcagtcaacactattagtgaagagctttccagcattgttgagttagctgctactgatgagatagccatgacctcaaaggaagaaaagctagcagaactcatggagatgaaccaaggtttgctccagtgcatgggagtcagtcatgcttctatagaaaccgtgctgcgctcgacattgaagtataacttggtctcgaagctcaccggagctggtggtggagtccgctgcttcaaagtcgaggtcggtggacaaggtcttcagattcaccaaggataagataatgctcgctcctgtttcaatggagatgttgtacactatttttaggtttgcttgaccttccgagatgaaagcattcttcctattctgtgcctagcagaccactcactgtatcagtcaataagcgagtttgccagtcgcatgattgttgttgtatcaaatcaataaaccctgttccatagtcgggcgatgggccgtggttggaaggaatatttgaggtgccatgttgcatctgatctgatgtatcattgntatcaaagttgagttatttgggtagggtcattttttctgc

SEQ ID NO: 53476 - DNA, 492 bp, Triticum aestivum
  unsure (1)..(492): unsure at all n locations
  Clone ID: PAT_TA_53476
cgacctcggagcagcaacgaatccgccgccgcccggcaaaagggatccaaagctccaatggctggcaagtacatcgtcgccggcctcgtcggctcctgtgtcatctcgtatgcctgtgactacatcgtttctcagaagaagatcttcggtggcaccatcccagggactgtgtccgacaaggagtggttgaaggcgacggagcagaggttccaggcgaggctcaagatcttaaggtttgcggtcggttggaacctttaccctgatggcgatgcctgttgctaaatctacctatgtgtgctggctgtactctcgaggctattttgtctgtcgcaataattaaaacaacanctattgtgtagggcaatcgtggttataatttcttctgaagaacagaagagaacctaaagcatgctttttgtcatcttttgtttgtataaacatctgtttacttttcaatttgtgcttgtcagagcatcggagtacttgccttgc

SEQ ID NO: 53477 - DNA, 485 bp, Triticum aestivum
  unsure (1)..(485): unsure at all n locations
  Clone ID: PAT_TA_53477
gcgnnnnnnnnnnnnnnnnnnnnnnnnnnnnnnnnnnnnnnnnnnnnnnnccgtccggtggcctagagctcaaatctgagtgtcctagcaacacataagcgtctgtgaagcctgctgtgctgcctgctgagatcgctctcgtaatgtgagattcacctgctaaatccatgagagtggatgtgacagccagccgatgccatttccttagccaatgggtagagtgctttatgatcatggctctggcgcaccactgacgacagaggacatcttccttgagactccttgacacaacacctggagagagctgtgagcggtgtgcaaccttgggaagatacagcatgagcctgcatataccctcatagatattgtctacgcaacttcctactgcttggtccatcctgcgagtcaaccatagctggagatgtcatgacgccatgacaacaagctgatcacggtgtaacctgataccacagtccttgcatcat

SEQ ID NO: 53478 - DNA, 693 bp, Triticum aestivum
  Clone ID: PAT_TA_53478
acgcgtccgcagcttcataggccgcaaaaccaacagctgctactccagcatccacccatccatctctcatcttcttcttcttgcgaccaaacgagcgtctagctagctaaagattcgaacgatggccgttcttgtggcgaggcaggggcgcgagctgcagcggtacagcgcgagcaccggcgggcgcatcgtggtggggtgcatcccgtaccggatgcgcgacggcggcgacagcgacggcgagggcgagctggaggtgctggtcatcagctcgcagaaggggcacggcatgatgtttcccaagggcgggtgggagctggacgagtccatggacgacgcggcacggcgcgaggccctcgaggaggccggcgtccgcggggagatgggcaaggtgctcggctgctggcactaccagagccgccgctaccagaccacctacgagggcatcatgtacccgctccgcgtcaccgacgagctccagcagtggcccgagatggcgtcccgcaagcgcacctgggcaactgtgcagcaggtcatggagggatgccagcactgctggatgcgggaggcgctcgaggagctcgtcgcccggcacgccaagccgcagtccgccctgtgagcagccaagcgggctggcagggtgactggagctcgagcgcgcgcgactctcgcgagaagagggccgggagcgag

SEQ ID NO: 53479 - DNA, 465 bp, Triticum aestivum
  unsure (1)..(465): unsure at all n locations
  Clone ID: PAT_TA_53479
gaaaatttttcaaccaatctcgtcgccgaggaaccctaggctcgtcgaatcctcctcccccaccgcataagatgcagatctttgagaagacattgactggcaagaccatcacccttgaggaggagtcgtctgacacaatcgataatgtcaaggccaagatccaggacaaggagggcatccctccgggggaggagcgtctcatctttgctggcaagcagcttgaggatggcaggacccttgctgactacaacatccagaaggagtccacccttcaccttgtcctccgccttaggggaggcatgcagatcttcgtnaagacgttgactggcaagaccatnaccctggaggtggagtcgtctggnaccattgacaacgnggaggccaagatccaggacaaggagggcatncctgcggaccaggaggggcttatctttgctggggaggagctngaggatgggaggaccc

SEQ ID NO: 53480 - DNA, 641 bp, Triticum aestivum
  Clone ID: PAT_TA_53480
gtgatctacagtatccgtgaaagtataaagttcataaaagcttcttctgcccgtgagcagaagtttgctgagattgctctgcagctggagattcccagcactaagaccctgtgccttgatgttacaacacagtggaataccacttaccttatgctgcttgctgccttggattataggcaggcattcaccacattggagacatgtgatgacaactacaatgaatggctgcggcaaatccaacttccaacttatttttccatgaggcgtggaaacttcagctggaactgtcaaatgccataacccatgaagatccagttttcagtagcatcgccaaagaaatgcatgagaggtttgacaagtactggaaggattgcaaccttgttctagccattggtgttgtcatggaccctcgtttcaagatgaaacttgtagaattcagttattctaaaatctatggtgtggaggcagcaaagtatgttaaggtggtggatgatgctcttcatgacctttacaaggattatgtagcacagcccctgcccctgacgccagcctatgccgcaccaagggaagttaataaaaatgggcctgccaatgcgaaatacaacgcagtaacttcaccttctactggaggatggactcct

SEQ ID NO: 53481 - DNA, 664 bp, Triticum aestivum
  Clone ID: PAT_TA_53481
cggtttcgtgggctaacccaaaccctaccccgccgccgccgtcgccgccgcagcgcgcggaggcgacctcgcaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatctgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaggaaggagtgccccaacgccgactgcggcgccggcaccttcatggccaaccacttcgaccgccactactgcggcaagtgcggcctcacctacgtctacaaccagaaggcttagaggtggctcgcgtttgctctgctctttttacctacctatcgagaatcgaactcatttagatgtgtcccgtttgtcttttaaactgaaaccttgagtatcatgtttcctgaatatttcatcgcatactgctgtagtgcgatgcgtgcttaaattttgtgtccgtatgctatcagtccaaatgcttttaatctat

SEQ ID NO: 53482 - DNA, 672 bp, Triticum aestivum
  unsure (1)..(672): unsure at all n locations
  Clone ID: PAT_TA_53482
acctgcgcttcaaccgcgtcttcaatgaaggaatgaagaaccattccatcatcatcaccaagaagctccttgaattgtacaagggcttcaatggcctcgacaccctcgtggacgtgggcggcggcataggcgccaccgtcggcgccatcaccgcccactatcccaccgtaaaaggcatcaactttgaccttccccacgtcatctctgaggctcatcctgcacgactggagcgatgagcactgtgcaacactgcttaagaactgctatgacgcgctgccggcgcatggcaaggtggtgctcgtggagtgcatcctgccggtgaacccggaagccacgcctgaggcgcaaggggggttccatctcgacatgatcatgctagcgcacaacccaggtggcagggagaggtacgagagggagttcgaagccctggccaagggtgccgggttcggagccatcaagaccacttacatctacgccaacatatgggtcatcgagttcactaagtagatgcatgacaaagtccaccgatatcttgctcattgccgctcctaaatatgcactatcttctctttttccttgagtcttcgntaacttttttatgttctaaatcattccaaatactattgtttgtatccctggatttgttcaaaatgtactattatgaagcttctt

SEQ ID NO: 53483 - DNA, 516 bp, Triticum aestivum
  unsure (1)..(516): unsure at all n locations
  Clone ID: PAT_TA_53483
cccacgcgtccgaagaaagagagcagtcagagcagagcggagccttcgccttctcccgcacacacacagccgcaatggcgcgcgccggcgctctctgcctcgcgctgctctgcctcctcgcggcgcactccgccgtcgcccagaaggctgcggccccggccgccgcgcccaccaccaccacgcccacgccggcggctcccgccaagaagacgcccgcgcccgccgcggcgccgaccaccaccacgcccgtcgccgccaccccaccgaccgcagcggctcccaccacccccgcaacccccgcccccgccgcggcgccacccaccaaggccaccccagcaccagccaaggctcccgccgcggcaccgcccaccaaggccgtcgnctcgccccctgccccggctcccaaggccagcaccccgccggtcgaggcccccgtcgccgcccctcccgctcccgtcgccgaggcacccggcaccatgcccaccaagcccgacgcccccgcgcccggcccgggca

SEQ ID NO: 53484 - DNA, 583 bp, Triticum aestivum
  unsure (1)..(583): unsure at all n locations
  Clone ID: PAT_TA_53484
acgttaacactccccctaaaaaaacaattgttcacgatcgtccccatctcgctgcaatctccaccgggtccagacaccggcgatggccgccgccctccgctcctcttccgctgccgccgtgcaccgcttcctccgcatctcccggtccaccttgtcaacgctcccgtacgcctcacgtcctgctacggagccgcctttctctccctcgatcaccgccatctcaggtggctacaatgctttctcatggaacttcaggcgcttgctcagttcaaatgaaaaacatatgcctgcaatgtctgacccacaaatagaatctgctcttaaggatttgatggctgcgagctggagtgaacttccacattctcttgtagaggaagcaaagaaaacagtatccaaatccactgatgatgcagcaggtcaagaggctttgaaaaatgtatttcgtgcagctgaggcatgtgaagaatttggtggagttttagttaccctaagaatggccctggatgatctttgnggtctacaggcggagacggaggccccttaacctgntttgtgggggngctggggggggccggtggtgggg

SEQ ID NO: 53485 - DNA, 593 bp, Triticum aestivum
  Clone ID: PAT_TA_53485
ccgccgccgccgcagccgccgcctgcctcgagccgccgtcgccatggggagaagacctgcgaggtgctatcggcagatcaagaacaagccataccccaagtcaaggtactgccgtggtgtgcctgaccctaagatcaggatctatgatgtcggcatgaagaagaagggtgtcgatgagttctctcactgtgttcaccttgtctcatgggagaaggagacctcagggtcagggttcacccgttccatgtgctccgtatcaacaagatgctttcgtgtgccggggctgataggctccagactggtatgaggggtgctttcgggaagccgcagggagtctgtgcccgtgttgccattgggcaggtcctcctttctgtgcggtgcaagcccaacaatgccatccatgctactgaggcccttcgtcgtgccaagttcaagttccctggccgccaaaagatcattgagagcaggaagtggggcttcaccaagttcaaccgcaatgactacctcaagttcaagagtgagggcaggatcttgcctgatggaatcaacgctaagctgctcggatgccatgggccgcctgcaaaccgtgcccc

SEQ ID NO: 53486 - DNA, 698 bp, Triticum aestivum
  unsure (1)..(698): unsure at all n locations
  Clone ID: PAT_TA_53486
ctggtacagcctgcaggtacanacatcgttaatgtcgcatccgcagcgaatggtcgaagagcctgaccactgtccagggtctgaagaaaggagttcataccgggtgccggttaattncccagggtncgtaccccacgaccgtccgnataacaccaagnactcactaccagcgcctctccgcgatccaaatcctcccgggaaagttcttggttgatctcttcctcctcgaccgcctcccaggttcttggtgtagcttttgccactctcaccaggagatttcatgtctgatcttgacgttcagatcccaactgcctttgacccctttgccgaggcgaatgctggggacgctggtgcagctgccggatcaatacagcaagatcctcaaagacctcaagaaagagttttgctgcaatggtacagttgtccaggacacagaacttggacaggtcattcaactccagggtgatcagaggaagaacgtctcaaacttccttgtccaggccggcattgtgaagaaggaacacatcaagattcatggtttctgagcaactgccagctccatatcagagtctacatgcaaagcagctatatattaggtggtgcggtatatttaagttgtgtgctaacgctagcaagcgtcaccagcttgcgcgctccgagtatacagaatatctagcatagcccacctctctgcgtgt

SEQ ID NO: 53487 - DNA, 625 bp, Triticum aestivum
  unsure (1)..(625): unsure at all n locations
  Clone ID: PAT_TA_53487
accaaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggagtcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcaatggtggaaggctgctggcctgcatttcgtctcgccctggacagtgtggcagagctgatgggtacatcctggagggcaaggagctggagntctacatgagga

SEQ ID NO: 53488 - DNA, 583 bp, Triticum aestivum
  Clone ID: PAT_TA_53488
gtccgccaccacgcacgtaacccccagtgggtcacttggaaggctcaaccgtgcgtggcaatggagatcgaatccaacccaaagtattgcagagttattagaagagcatcatccgaggaggaccggctgagtggcctccccgacgacgtcctccactcgatcgtcggccgggtccccctcaaacaagccgtcccgcccggcacggcggggctcgccggcctgacatcgctctccctcaaccaagtcgacgtcaccgacgatgctctccgggacatggtgtccgggtgccgggtgctcgagtttctgagcctgaagagctgccacctccttgtgtatgtgagggtcgccagcgagagtctgcggggcctagagatcgtgcgctgcctggcaatgcgccacctgcaggtggacgcgcccgtgctggagtctgttgcctaccacggcgacgtcctcatctggagagaggacgagccgtccggcgtggagttcgttggcccaggcggcaggaccgatgccaggccggagctaaggacgcgtacctgaccacatcggttatgccgaatacgacgaagtaattcacgag

SEQ ID NO: 53489 - DNA, 525 bp, Triticum aestivum
  Clone ID: PAT_TA_53489
cgtaaacaagcagcttgctagagcgggacaagcttggccatccttaaccttatttcgacatggcgaggtcgcccatggcgatgctcccgttcctggtgctcggggtagcagcactagtcctgtctgccgcgggaatggtggccgcgcagaagtgcggctgccgggcgaacgagtgctgcagccagtacggctactgcggcactaccgacgcctactgtggacaagggtgtcgggatcaagtcccgggccggcaacgggtgcgccggcaaaagcttttacacgcgccggtcgttcctggccggcgcccgggcgaaccccaacttcgggaaaggccgcacgggcgacgacggtaagagggagatagccgccttcttcgcccacgtcacacacgagaccggacacatgtgctacatcgaggagatcggcggggcgagccagaactactgcgacaggaagtacacgcagtggccgtgcgcctcggggaaggagtactacgggcgcgggccggctcagctgacgtggaac

SEQ ID NO: 53490 - DNA, 385 bp, Triticum aestivum
  unsure (1)..(385): unsure at all n locations
  Clone ID: PAT_TA_53490
cgtccactccagtaagccccgaagtgctggctgtagcggcgaggggacgtcggcggcgccggggattaagccggccagggggagtcgctgtcgctggtggcgcggctgctccgggggttcaagaacctctcccaccagatcttcgcggtgtacgacgacgaggaggaggaggaggaggagccggagatggtgatcgggctccccacggacgtcatggcaccaccgctccggccaccgcgtcggcgtccacctcagtctcagcctcctcctccgccgctcctccaccgccacaggcgcagccgccggcgctgtccgcgcggcagttcgagctcgccatggccgcgcangcgttcgcggtcaccacggggaccccggtcagtaccag

SEQ ID NO: 53491 - DNA, 515 bp, Triticum aestivum
  unsure (1)..(515): unsure at all n locations
  Clone ID: PAT_TA_53491
gccgccgccagcagctgcgcaaaggctcgacaaaccctaaccctagtccatagctagcttagcttccttcctctcgatctagctagagccatggcgccgaccaagggcgaggggccggccatcggcatcgacctcggcaccacctactcgtgcgtcggcgtgtggcagcacgaccgcgtcgagatcatcgccaacgaccagggcaaccgcaccacgccctcgtacgtcgccttttattggcagaaggtttgctgatgcccctgtccagagtgatattaagatgtggccgtacaaggttattcctggccccgcagacaagcctatgattgtagtgcagtacaagggtgaggacaagcagttctcagctgaagaaatttcttccatggtcctcatcaagatgcgtgagatcgctgaggcttacctaggagtaactattaagaatgctgttgtcaccgngcctgcttacttcaatgattcccagagggcagcaaccaaagatgccggnggtattgctg

SEQ ID NO: 53492 - DNA, 302 bp, Triticum aestivum
  unsure (1)..(302): unsure at all n locations
  Clone ID: PAT_TA_53492
tgctgtttgacatccagaagttctacaacgtggtgattgaagagctcccagccaacgttgccgaccttctgtgatcgggcgggctgtcgagaacatatggtaagggggtcctgacagggctttgtttttgttgaagtatcaccaaactttcttgtctgtgggtgggggggttcaagtgataaatggtctggggttctactttaaagtcgtggtcgtggacaatttggttgctgttgctggagtcctcactttatttgttaagactatgtaatgaccgaatgatgttatttgtttgtgtcnna

SEQ ID NO: 53493 - DNA, 401 bp, Triticum aestivum
  unsure (1)..(401): unsure at all n locations
  Clone ID: PAT_TA_53493
attctactcctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagcggtggaccctgcaagaagtactgatcggttcatgccggcatatgatatgttccgcctaaaattaaataaaagctcggacgagatgagcagcgtcatcgtgcctatgcgtgtgtgtgtgaccaacaaatatgtataccagtatgtcgtgtcttcgtcgcaaaaaaaaaaaaaaaaaanaan

SEQ ID NO: 53494 - DNA, 650 bp, Triticum aestivum
  unsure (1)..(650): unsure at all n locations
  Clone ID: PAT_TA_53494
nnnnnnnnnnnnnnnnnnnnnnnnnnnnnnnnnnnnnnnnnnnnnnnnagcgtccgcccggctgccaccctccccgtcgccacacagagcacggcacacacgcacccctcagctcacgctgtcgcacctctcagctcgccacaacatgcagatcctccggctcctggcggcgcggcgcagtgccgcgtcggccgtggctacgtccgagccccgggacggcgagggggaggacgaggggccattcttcgacctcgacttcgcctcctgctccctccgcgactcctccttcagctccagctcgggcgcgctctcgggctccgactcagactccgacgaggagctcgacttcgtcatctcgctccagcggagccgctccgcctcctcgccgctcaagttctgcgcctcggagccgccgtccaaggcgaagaacgccggccgcaagcgcggcatcggcagcctgcgcacgctcagcttcggcgccaggaaggccgcgccgctctacggcgtcggccgccgcagcttcgcccggagcagctccgccagcgcgcggtcgctgcggctcttcatggcaacgccccaccccgaggaggacgagcacgagcgcgcgtcggagcccagcagcaggcgcgcgccgtcccgggacgtgatca

SEQ ID NO: 53495 - DNA, 572 bp, Triticum aestivum
  unsure (1)..(572): unsure at all n locations
  Clone ID: PAT_TA_53495
catccgccttccacttccaccgaggcggaggatggcctccgacgacagcagctcgagccacccgacggagaagaaggaggaggccgccgccgccgccgccggtggagctggcttcgacgatctggaggacccgcggttccagtgctgcgtatgcctggagcttctctataaaccagttgttattgcatgtggtcatatgtcatgtttctggtgcgtccataaagctatgcattaagcttgaacccgtggaatacaaaaagagggaaatggaagtactagagcaagagaggagcgtggataccttttctccacaaatcattgagttcttaaactccaagaacaacaatggcgaaaatggaaaagattggggcaacaagctggaagatggcaaaactggacctccaggagaagcctcagttgatgacagtactatgaacgagcattcaatgaaaataaagntagatgatgtgtctagtcctatctgcaaggagctgctgtatcaacctgctgntcttaactgtggtcatgtgtatagcatatcttggttgcctttcgtgggtgatgaaacattg

SEQ ID NO: 53496 - DNA, 323 bp, Triticum aestivum
  unsure (1)..(323): unsure at all n locations
  Clone ID: PAT_TA_53496
gtgacatcgttttttnagcgcggcgcacgcttggccgctgctggcatatatggcatcctgaagaagctaggccgggacatggtgccaaccgacggcagcccgttgccaaggaccgtggttgccttggacggtgggctctatgagcactacaagaagttcagcagctgcttagaggcaactctttcagatgtgtgggggacgaggcctcttcttcgctggttgccaagctggcgcccnatggatggattgaacccagagtgtagcagcctcttctcttccttcttttttgcttttctttttccttcgaaccttcctaatcgcct

SEQ ID NO: 53497 - DNA, 395 bp, Triticum aestivum
  Clone ID: PAT_TA_53497
ggaagcacgctgctgctacctggtcatgctctcagcagtgtgaatctccagaagcatgcttgccgtgccttcttccgggtgcaccggaagctggcatgtgagcaggggtgcttcagtgacgcagaagaaaaaaggcaagtcttatcggcaagggaaggctacgcctttcttccaggtctccctctctccatctaaatctgtgtttggaggagggggctacggttagtaattttagctacatataatggtcggttgtgtgagtgaatgggagtgtgttcatgtgtcggtctgtgtgtcgactgtcactgtgagtcaattagctaaaagaagtgtgatgtgtgggttcagcgagggagtaacagtcactgaataagaatgtaagtgtcctatcatat

SEQ ID NO: 53498 - DNA, 240 bp, Triticum aestivum
  unsure (1)..(240): unsure at all n locations
  Clone ID: PAT_TA_53498
ctcctcctccttctgcgccctaggagccccgccgccgccctgctgctactcctccaccggccagccctgctgcatcgcgagcccctccttcctcttcgtgttccggtggtcgatagtcggggtcaacgaggagatgcacgcggcggcggccatggacgactccatgagcgggaccatcgccgggggggcccctgcggccggcggaggnnntnnnnngnctgncgcggnancngagccacc

SEQ ID NO: 53499 - DNA, 567 bp, Triticum aestivum
  Clone ID: PAT_TA_53499
cccacgcgtccgatttcatttcatttttggtctcaagcaaggcacagaagaaagcagagcagaggtccttgacggccggcaacatccatggcgctcaaggcctccttccccggcgagctcgctgccctcctcgactccggcaacaccaggagcaggaggggagccgccttccgcccccgccagcaccagcgcaaagtggatttcacgtttcaaaggagggacaaaagagcagcctacctgaggacatgctgctcgatgcagcagggcccgccgcctgcctggcctggccgagccgtcgtagaacctgagaggaggtcatgggagggccccaagcccatctccatcgtcggctcaaccggttccataggaacacagacattggacatcgttgcggagaatcctgacaagttccgggttgtcgctcttgctgctggctccaatgtcactcttctagctgatcaggtgagaacgttcaagccaaagctggtggctgtaagaaacgagtcactactcaatgagctaaaggaaagcgtagctggttgtgaagagatgccggaaattattcct

SEQ ID NO: 53500 - DNA, 658 bp, Triticum aestivum
  Clone ID: PAT_TA_53500
cagcaggcgttccgtttcgttctcttcccttcccctctttcctttggccgtcgatacatctctctcccctcccctcggcggccattaattggacgggatatcgatttctccctccctccgcggacgatctagctctagcgagagataagtgttgtgtctgcgttgagagggagaggcagggagaaaggcggccatgaccaccggcgggaacggggaggagcagcaggggcggaggctgttcggcgtctcgctcacggacaggcccgtgtggcagcagttcctcatctgctcctccggcttcttcttcggctacctcgtcaatggcatctgcgaggaatacgtctacaaccggctccagttcagctatgggtggtacttcacgttcgtgcagggcttcgtgtacctggggctgatccggctgcaggggttcacggtgaagcacatggtgaacccgtggcggacctacgtgcgcctctccgccgtgctcatgggatccaacggcctcaccaagggctccctcgccttcctcaactaccccgcccagatcatgttcaagtccaccaaggtgttgccggtgatgataatgggagcatttatcccaggataagacgcaagtacccgttccatgagtacgtgtcagcggtgatgctcgtcatcg

SEQ ID NO: 53501 - DNA, 593 bp, Triticum aestivum
  Clone ID: PAT_TA_53501
tccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccatctgtgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcacggtgtacccatctccccaggtctccacctctgttgttgagccatacaacagtgtcctgtccacccactcactccttgagcacactgatgtctctatccttcttgacaatgaagccatctatgacatctgccgccgctcccttgacattgagcgcccacatacaccaacctcaacaggcttgtttctcaagtcatttcatcactgacag

SEQ ID NO: 53502 - DNA, 638 bp, Triticum aestivum
  unsure (1)..(638): unsure at all n locations
  Clone ID: PAT_TA_53502
cgcaaagcanatgtaggagaatcccaaaccccagcgacgaccatgactccccaagccctcctcctcctcctcctcgccgccgccgtcgccgtcgccgccgcctccgcggccccggcgaacggcgcggcgaacgacctcctgcccaagtacggcctccccaagggcctcatcccggactcggtctcctcctacaccttcgacgaggccacgggcggcctctccaaggggcggatcaccggcctcgccggcatccaggccaagaagctcttcctctgggtctccgtctccggcatcgtcgcgcaccccgcggagggcaccctcgagttccaggtcggcttcgtctccgaggagctctccgcctcgctcttcgaccgggtgcccgcctgcggcgccagcgccggcgcgcagctccgcggcgtcgccggggtcatccaggagctcggcctgctccccgtagcagaggcttgagcttggagctgggcgttcgttccacttgcagcaaacttctccttggatcctatggtggcgttacacgagtggtaataataagatgtgcggagccttatttagctcaaggagagaggctctgcggaggtgtgctgttgatccttgtactacgtgtatgtggtctgctgtct

SEQ ID NO: 53503 - DNA, 574 bp, Triticum aestivum
  Clone ID: PAT_TA_53503
gggttttgggactttagcctcctgcgccgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagagagtgcatcatcggctcctgctgcagctgctcctgccgcttccaaggatgaagatgacgatgatgacatggatctgtttggcgatgagaccgaggaggacaagaaagctgcagctgagcgtgaggctgccaagcctgcaaagaagaaagaaagtggcaaatcctccgtcctcatggacatcaagccatgggacgatgagactgacatgaagaagttggaggaggctgtccgcagtgttcaaatggagggtctcacctgaggtgcatctaagcttatgcctgtgggttatggcatcaagaagctccagatcatgctgacgatcatcgatgaccttgtgtccgtcgacactc

SEQ ID NO: 53504 - DNA, 570 bp, Triticum aestivum
  Clone ID: PAT_TA_53504
ggacgagctcgctaccagcggcatccgcgccttcgccatcggcccacttcacaagctctccaccatcggcggcgccggcagcctgctcgagcaggaccgaagctgcgtcgagtggctggacacgcaggcagcaggctccgtgctctacgtgagcttcgggagcgtcgctccggtgcaccgacacgacttcaacgaggttgcttggggcctcgcgaacagcggtgaggggcaggggcaaggtggtcaggtgggcgccgcagcaggaggtgctagcgcaccgtgcggtgggcgggttccggacgcacagtggctggaactcgacgctggagagtatctgcgaaggggtaccgatgttgtgcagccctttcttcggagaccagctggcgaacgggaggtccgtggaggacgtgtgggagatagggaccttgttggtgggtaagatggaacggggggagattgagcacgccattgcgaggttgatggaagggggagtatgcgcaacggcgagggaaagggcaaaggagcttaagaccaaatcggtggagtctctgaagaacgctgggtctactc

SEQ ID NO: 53505 - DNA, 666 bp, Triticum aestivum
  unsure (1)..(666): unsure at all n locations
  Clone ID: PAT_TA_53505
nnnnnnnnnnnnnnnnnnnnnnnnnnnnnnnnnnnnnnnnnnnnnnnnnnnnnnnnacgtccgaacctgttcgccggggagatcccagcgagcttcgcgtcgctcaagaacatgacgctgctgaacctctttcggaaccgcctcgccggcgagattcccgaatttatcggtgacctgccgaacctcgaggtgctgcagttgtgggagaacaacttcaccggcggagtgccggcgcagcttggtgttgcggcaaccaggctgaggattgtcgacgtgagcacaaataagctcaccggcgttctgccgaccgagctatgcgccggcggtcggctggagacgttcatcgcgcttggaaattcgttgtttggcggcattccggacgggctcgccgggtgcccgtcattgacgaggattcgactgggagagaattatctcaatgggacgatcccggccaagctgttcacgttgcagaacctgacacaggtagagctgcataacaatctgctgtccggcgaggtccggctggacgccgacgaggtgtcgccgtcgataggggagctgagcctgtataacaacggattatctggcccagtgccggcggagatcggtgggctcgtgggcctgcagaagcttctgttggccgacaacaagttgtccggcgagctc

SEQ ID NO: 53506 - DNA, 475 bp, Triticum aestivum
  unsure (1)..(475): unsure at all n locations
  Clone ID: PAT_TA_53506
ctcgccttcccatcgctcgcgtgcatgtcgccgccgtcggagaacaggattgtgcgggtcgcttcctccttttcctcccgccggatctaaggcgtgcggtcgtggagccgagcctctccggtggcggcggcaaagggtgaccacatggatcggtccttgcaggagagagagagagatgcgagagagggagagaatgaaggagaggagggaggcccggcagcgacggacttctccactgcctaatatggggcaccggtcagggagcacgggatcgatgttctgcggctcgaggtttgcttcctttctgagaagaagcaggagcaaagcatatgcttgctcttccatggtgagtttggactttaccctctgtccctggaagttgaaattggctatcatgcaagcgatggccttttctttaccatggaatacaaaggaagctacaaaattgncatatcgcatttttcttgagatatcc

SEQ ID NO: 53507 - DNA, 471 bp, Triticum aestivum
  unsure (1)..(471): unsure at all n locations
  Clone ID: PAT_TA_53507
nnnnnnnnnnnnnnnnnnnnnnnnnnnnnnnnnnnnnnnnnnnnnnnnnacgcgtccgcccgcccgtcccgaagcgtctcgccgccggaaaccctcgccgccctctcctcctcccgccggaccaccccatcgaaggcgagcaagtctcccggattgttgtctgccatgggtgactacacaatccggataagcaccagcttgatcgaccagctcacacgcgatgacgagaaggtgaaaaggaggaccaggaaacccaagccgaagaaggtcgtggagcgacaagaggagcctcaggacaatggccgggaacttccaagcgagcccaagagcagccctgcccccgctcctgggtgggcgctgccgccccccatgtacctaccagtgacccctgctcctccaccacccctgccggcaatccaggaagtttgaaccattcccgacgtggtggcggagagcgagaatgtgctggta

SEQ ID NO: 53508 - DNA, 262 bp, Triticum aestivum
  Clone ID: PAT_TA_53508
atctgtatgcaggcgatgatgttgatgtcaactcatttcctgctctctcgggttctagaggctccagttctgccagcagctcagctataggaaataataatatgccaaaggcaaagccttttgcatcagtgattcgcccccctgttgaatttgcagttgttggtaatgaaaacggaaataggcatttgactgatcacatggtgagaacaaattctggtgtaaactctggatgtggtgacaaaatgaagctgctgcaggatgc

SEQ ID NO: 53509 - DNA, 572 bp, Triticum aestivum
  Clone ID: PAT_TA_53509
cctcccctcttcctccctccctcctcgtcaccgctccactccacacgttcaccggcgccgacgaccgacgatgcttcgcgccgtcctcctccgctcagcctccggccttcgccggtcaccgatggccgccccgctatccaccgccgccgcctcctggctcgccgaggggacctcgtcgccgcctagggtgcgcctcctcatcggcggcgacttcgtcgagtcgaaggccaccgagcacgtcgacgtcaccaaccccgcgacgcaagaggtggtgtcccggatcccgctcaccacggccgacgagttcagggccgcggtggacgctgccaggaccgccttccctggctggcggagcacgcccgtcacggcgcggcagcgcatcatgttcaaataccaggagctcatccgggccaacatggataagctggcagagaacattacaaccgagcagggaaagacgctgaaagatgcttggggtgatgtattccgtggtctagaggtggtggagcatgcttgtgggatggggtcactgcaaatgggcgaatacctatctaatggttctcatgggattg

SEQ ID NO: 53510 - DNA, 313 bp, Triticum aestivum
  unsure (1)..(313): unsure at all n locations
  Clone ID: PAT_TA_53510
cccacgacgtccgnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccggttttaaaggatcaaattttacttccgggtgattgaaaagtaatattttttttttagggccacttaatttaatttaattgggggnataagcaaaaaggccccccccaatgccctttccaaaaatttgcgaaccttaaaggggaaatggaacccccc

SEQ ID NO: 53511 - DNA, 382 bp, Triticum aestivum
  Clone ID: PAT_TA_53511
gcggtcggggctcggcgaccaccggtggccgctggtgacgcacttcgtcgggtgcaagccgtgcggggagccgggcgcgacctatgatgccgtggcgtgccgtgagggcatggagcgcgcgctcaacttcgccgacgaccagatactcggcctctacgggttccagcacgagtcgctcggcaccacggccgtgcggcgcgtcaggaacgataccggacggccgctggacgccgacgacgaagaggtcggccggctcttgcacccagagttcagggccgccaacccattgtgatcagacatcagaacacaaagcacgtcatgttttacagacaagattttttttccgtttcactcgcttttcaccagaaccgtttgatttaca

SEQ ID NO: 53512 - DNA, 295 bp, Triticum aestivum
  unsure (1)..(295): unsure at all n locations
  Clone ID: PAT_TA_53512
acactttnctaatcagatcaaccacagagcgcagcaggagggactagctacaagctagcctgcaggcgtgctgccactccgggcattttgcttgcatcaaccacggcaatggccaccgctgatgtccagaacccgacggccgcgctgacggaggaggcgcccgcggtggagacgcccgtcgccggcggggggggggctaanacanangangtccccgcgccngtggaggccgaagagggggcgcctgcccccgncgagggtgaggcgaccaaggaggaggcgccgggcgccggcg

SEQ ID NO: 53513 - DNA, 461 bp, Triticum aestivum
  Clone ID: PAT_TA_53513
cccacgcgtccgctttttttttttttttttttttttttttttttttttttttttttttttttggtcttggtgaacaattgatgcaacagctcgagcaaaaagctaaattgaacaaaagaagggaacccccttttttcttgacatcaagaaaggaaaatcctcctctgatatctatgtcatccagccattgccctatcagccccgtcaacaacaacaaaaaaggggaaggaaacaaaactaaagccgactctgctagtaaagtttcaaaaagaaacaaaacgtcgactctaaaactattcctcccgcatcacgaaaaggtgacgcaaacgctgccattcttggggcttccgcacaccgggcacgcctgcgccaaggccgggcacggggcgcacacccagaggtgccggcacggcagcagcagcacaacggccgcgccctcgcggcaccccttgcacctttct

SEQ ID NO: 53514 - DNA, 608 bp, Triticum aestivum
  unsure (1)..(608): unsure at all n locations
  Clone ID: PAT_TA_53514
cttctcacaggattgcagcttatctggaggagggccttgctgcaagaatagtagcttcagggacgggcatctacaaggcattgacatgcaaggaccctccaaccctgtatcagctgtcagcaatgcaaatcctctttgagatctgcccatgctatcgatttggtttcatggctgctaattatgccatacttgaagcctgcaaaggcgaagaaagccacgccatttgagaataactggtgtggatgatcacgagacagtacagaggactgttggaggtctgaaggtcattgggcaacgcctggagaagcttgcggaggactgcggaatatcttttgagttcagggcagtgggtgccgacatcggggatgttacacctgcaatgctagattgccgtcccggggaagcactagttgtgaattttgcattccagctgcaccaccttcctgatgaaagtgtttcgatcatgaacgaacgggatcagctccttcgtatggtgaagggccttcaaccaaagcttgtgaccctggttgagcaggatgccaataccaatactgctccatttcagacaggnttccgtgaggtctatgactactactccgctcttttcg

SEQ ID NO: 53515 - DNA, 471 bp, Triticum aestivum
  Clone ID: PAT_TA_53515
cgctccgctgacctcaaccagccgccggcgaaatggcccctaagcgaggcggcaaggcgccggtcccggcgaagaagaaaacggataaggtgaccaacccgctgttcgagaagaggccgaagcaattcggtatcggcggcgccctcccgcccaagaaggacctacaccgcttcgttaagtgtcccaaggttgtgcgaatccagcgccagcgccgcatcctcaagcagcgcccggcctgaagacaaagctgccaagaaggagaggcttctaaagagggcccaggctgaagctgaagggaagactgttgaggccaagaagccaatagttgttaagtatggccttaaccatgttacctacctaatcgagcagagtaaagcccagctggttgtcatagctcatgatgttgatccgattgagctggttgtgtggctccctgctctttgcaggaaaatggaggtcccttactgcttt

SEQ ID NO: 53516 - DNA, 178 bp, Triticum aestivum
  Clone ID: PAT_TA_53516
ccccgcgtccgccattttgtgtctgggttatggcgaaaacaaatgcccaaaccgcttcgtggacctgatgaacagttgtgggtggtttgggagatgtcttaagatggccatgcttggcagtaggtgctaattgcgccttgctcattgctgacgttgtccttgcaggcgctgggcctga

SEQ ID NO: 53517 - DNA, 411 bp, Triticum aestivum
  unsure (1)..(411): unsure at all n locations
  Clone ID: PAT_TA_53517
cacccgtccccgcagccgccatcgaccaatagcggcggcgaccggtcggcggccgactcggctcccctgatcccctccggtatggacggccaggctccacaccccgtcgccgtggcacccgaatccctgccgcagccacctccgcgtctggagacggaggcggaggacgaccccgtcgtcgtccccgacgcctccgatgccgcttcttcggagccctccaaggtcgcctccgtggttagcgcaggtggtgtggtgccgccgtcgcggcctcttgaggcggaggaggatcccctcatcgtccccgacacttccgaggccaccaatgttggcacaggtagcgtggtgcccctgttgccatcgccacctcttgaggcggaggacgaccccctnatcgtccccgacattgatgcc

SEQ ID NO: 53518 - DNA, 409 bp, Triticum aestivum
  unsure (1)..(409): unsure at all n locations
  Clone ID: PAT_TA_53518
gaggggcggccgggcggcggcggcggcggcgtgatcgcaagaggttccgtccactgccacccctacgcaagagaagagggtgattcgtcgggatcccagttcgagaaagaagatgagctcggacttggagaaatccaagaacaaaaggggcatggcgggcgttccggaggaagtgctggcgaagaagaggaatctgtggagggagggagggcgcgaacaacaatagaaaaangactcncctgctctacttcccatgcccagagggagccctggctgcttcatccatcccaggtgggtcaccgccaagattgcgaaggagaaaatgggggccggaaaattagctgccattgccgcggggaagattgctacgctggagcacttgaaacccccggccagggttgacacacgg

SEQ ID NO: 53519 - DNA, 321 bp, Triticum aestivum
  Clone ID: PAT_TA_53519
gcatcatcatccctagaaccaaagctcatcttcttctccttgaaatctttttgggtccacagatttggaggatgtcttgcaactgcggatcaagctgcagctgcggctcagactgcaagtgcgggaagatgtaccctgatctgacggagcaaggcagcgccgccgccgaggtcgccgccgtggtcgtcctcggcgtggcgcctgagaacaaggcgggacagttcgaggtggcagtacgtgtgatggtgtgagagtatacgtgaataacgagcgtctgatctgatggagaccagcaagtgtgcgtgtgtatgtggataactt

SEQ ID NO: 53520 - DNA, 613 bp, Triticum aestivum
  Clone ID: PAT_TA_53520
cctccgtcttcgccgggatcgcgcagggcccggaagaccccatcctcggggtgacggtcgcgtacaacaaggatcccagccccgtcaaggtcaacctcggcgtcggcgcctaccggaccgaggaagggaagcccatggtgctgaatgtggtcaggcgcgccgagcagatgctgatccaaaacgagtcacgtgttaaggagtacttgccgatcactggattggcagattaagaactggttccctacgagtgggaggtgaatttcttgcaaggcactatcatgaacgcacaatctacattccccagccaacctgggggaatcacccaaaagtcttcactttagctggcctgactgctaggagttaccggtactatgatcctgcaacttgtggactggatttccaaggactcttggaagacctcagttcagctccctcaggcgcaattgtactgcttcatgcatgtgcccacaaccctactggtgtcgacccaaccttggaacagtgggaacagatcaggcagcttatgagatcaaaagcattgctgccattctttgacagtgcttatcaaggatttgcaagcggaagccttgacaaagatgcccaatcagtgcgc

SEQ ID NO: 53521 - DNA, 301 bp, Triticum aestivum
  Clone ID: PAT_TA_53521
ggaaggagcagcacgcaattagccagcgctcgcactctacgcttctcaattgacccgatcgaggaggagtcgccaagcaggccgagcgaaggggcaggcagccatggccaccgccaacctgtccagcgtggtggtggcggttgacggcagcgaggagagcatgaaggcgctgcgctgggcgctcgacagcctgcgcctccgccccgacggcgcgctcgtcggtgccggcgtttacgcaggccatcgagtcgtaccagcgggggatcacggaggcgatgctggagcacgcgctgaagatggg

SEQ ID NO: 53522 - DNA, 275 bp, Triticum aestivum
  unsure (1)..(275): unsure at all n locations
  Clone ID: PAT_TA_53522
acgacccacgacgtccgagtccaatgcagacgnncaacgtcccacctatctcgcctatccatccaaaaacatccgtccgtcttgcacccccatgcattcgtccgtctcgatcagcacagcatgccgacatcgccgccgtcgctcctggacctcctgagcccctcccctcctgctcctgaggcggcggcgtcgtctggacacggcggcgccacggtggtgcaggtggtgccgatggacgtctccgaggagctgctgggctngttcatggctgccac

SEQ ID NO: 53523 - DNA, 550 bp, Triticum aestivum
  Clone ID: PAT_TA_53523
gaaagtctttggtgcttttgaaaaatggcaagaatcggaaggaacctttcctccccttagccaagaatgcaacaagaatactcgtcacagggacacatgctgacaatgttggataccagtgcggtgggtggacaatatcttggcatggtgatagtggaaagattactccgggtacaagcatattagaggccatacaacaatctgtggaagtggaaactgaagttgtgtatgatgaatgcccaatagatgctaccattgaagcaggcaaattttcttatgcagttgtcgtaattggtgaggtaccctatgcagaaagcttgggggatagaaccgacctcagtattccattcaatggttccgatcttattactcgtgttgccaataaagtccctaccctagtgattgttatatctggaaggcccttggttattgagccgcaagtacttgagaaagtagatgctctagttgccgcttggctgcccggaagtgagggcatgggagttgctgattgcctctttggagaccatgattttgtgggcacgttggctgt

SEQ ID NO: 53524 - DNA, 318 bp, Triticum aestivum
  Clone ID: PAT_TA_53524
gcattatcaagaaggagaacaatttcaagcaggctggcgagagataccggtccttcgaccctgccaggcaagaccgtttcctccagcggtgggttgatgccctcacggatgctcgcgttacccatgaaatccagggcatctgggtctcatactggtcacagtgcgacgcatccctcgggcagaagctggcgtcgcggctcaagatgaagccgaacatgtagatgggctgtgtgggtgtagccatgaataaaaatgtgtaacagtgaaatgaatatcgtatgtaataccgatgaacgatgatggtgggtgttgtgaccc

SEQ ID NO: 53525 - DNA, 563 bp, Triticum aestivum
  Clone ID: PAT_TA_53525
cgacccactgacgtccggcgcgtgcatagcgcattggcgggaggatagcgagcatccttccttaccggagccgtcggcgtgtccagaccgaaaagataaaacaataacagagctttccagcccgcctaaccatggatctgcttgcgtcgcccttcaaaggagtcgtgcaagatgtctaaagaagggcgggttggcacaccgacgactggtttgcacggctgcgtaccggcttcaggattttggcgcctaccatgttcatattctttgcatctgccctgccggtcatagccttctgagagcagctaatccatgaaacaaatggaatgctcatcacagtcgaaacattaccatctaccgcgatttgtggcatcatacattccatactctgaggacagccaatgatgatagttggagttgcacaacctaccgggatcataggtacatatctctacaactttgccaagaaacaacaacgtattggtgaatcgctatatttatcgtcggctggatgggtctgcatatggactgaatttatccttcttcttctagcgactttgattgct

SEQ ID NO: 53526 - DNA, 453 bp, Triticum aestivum
  unsure (1)..(453): unsure at all n locations
  Clone ID: PAT_TA_53526
ctctgatttctttttacaagaatcttgcaaacagagaaaagccggactttcacaagggatcaggtgtggaccgatctcggacctcagtgacaatgtatactccttctggcatcctcttgcttgtttttcttttcacttctattctagtttatgcattattgattccacttcataataatcttatgtgcagtacattgactacgaggttgagagaacgcatatcagagtttcagacactaagagaagcaatccagacggagtacagggaagttgtagagcggcgtgttttcaccgtaacgggcgagcgtgctgatgaagagactattgacaagctgatagaaacaggcgacagtgagcaaatttttcanagagctattcaggaacaaaggcgtggaaaggtgcttgacacactccaagaaatccaagagcgggatgacacggggaaagagatcg

SEQ ID NO: 53527 - DNA, 549 bp, Triticum aestivum
  Clone ID: PAT_TA_53527
agcggctccatgaggaggggcaacatctcacatggcttgggtggcaattctgtgtcgctagtgtggcggggttgtcggctcggtcgacgcgtcccagaggaggcggtctgactttacgtcagggcagcggccctggaggagttggtggcggcggtcgtggtctgcgggtggttgccctgttcagcttgggttgtgggtgactaagtcgtgcggcattgcagcttgagggagagcggtggtatgtcgggacggcggtcccggaaggtggtatgttggtggactatgcagggcacaacggagcagcggaggtcgaggtggcagcctcgagagttcggcaacatcaattgcgttcacctcatgtcgcttgggcggcgaggttgctcccgatattgtcggcgacgtctcaagtgtcgcgtttggtggattgcaggcaccttcaccttgtgggagcgacccaggtctgctcctctcatagcagtcgtggcttcttctctctggcaacagtgggttcatctgtgtgtatggcgttagtgttctccaatgatgggt

SEQ ID NO: 53528 - DNA, 523 bp, Triticum aestivum
  Clone ID: PAT_TA_53528
cttccttattgaaagcttcttgcagccctccttgcgctggcctgatgggagcgccactgcctatgatcctagccctgttcaggactatctgcgttgacgacatgaatgcgcctgtgcgagctaatggatatcaattgcacggacccaatgggcgcaaccccgcaagacttctttaacgcatgcatgctcgatcagcctagggctactgaggcccagcaaggtcagtgttaacgtcaccaacatcactgtgataaatttgcctggtctcaacaccctatggatctcgctggctactatagactatggtccattcggcgtgaacacgccacacatacaccggcgagccactgtgctgctcacaacgctggatgcgacactgctccttggcttggtcacatccaacccaaacaggctctgattctagatagctcaaaaaggcaacgtgttcgacttcccaatagccctgaaccactcccacatgaacctaattcatgacaagccagcacccgcgatcacctcgctc

SEQ ID NO: 53529 - DNA, 381 bp, Triticum aestivum
  unsure (1)..(381): unsure at all n locations
  Clone ID: PAT_TA_53529
gacccagcgtccgcaagtcttttggtatagagaaacggagcggaagaagctagccagctcaaccatggggggaagacggcancanctcatggccgccgtcctcgtggcggtggcgctgatggccacngcggcggaggggacatcactcanaaacgtggggcgccatcccccnngcggaccccgccnggccgtgaggagggcggntcntncccaacacatacnanatnngccccntnctcnaggcacccaacttcntnnccancaaaagcatccctaacatnnacatccaagggcgaangtttcncttcggaaccatcgagagccaaancgtcgtcatgggcataactggactgagcatgctcaacgctnggctgaccaccc

SEQ ID NO: 53530 - DNA, 575 bp, Triticum aestivum
  Clone ID: PAT_TA_53530
ccgtcgccggcgcgccgccactgccaccgccagcgagattgcgacctgagaggtcccgcgtcctcgtgctgttcccggctctaccttcgccgcggccaccatgatctgtgcaatctccggcgaggtgccggatgagccggtggtatcaaagaggtcggggctcctctttgagcggcggctcatcgagcgctacattgaggaccatggaaagtgtccagttacgaaggaggaactctccatggacgacatcgtgctggtgaagaccaacaaggtcgtgaggcccaggcctctgcaggctgcaagcattcccggactccttggaatctttcaaaacgagtgggatgctcttatgctttctaattttgctttggagcagcagcttcacacagcaagacaagaacttagtcatgcgttataccagcatgatgctgcttgccgtgttatagccagattaaagaaggaaagagatgagtctagagcacttttggctctagctgagagacagattcctgcgtcgatggcgggagttgcacctgcagctgtcgtttccaatggaaaaagagcattggaggatg

SEQ ID NO: 53531 - DNA, 568 bp, Triticum aestivum
  Clone ID: PAT_TA_53531
ccgggctggtctttggcgcaatccttgcgaatcctcgcgagatcctgtttttgtttgcctttccgcgtaggggagggattccgccgggaatttgttgaccggcatggaggaggccgaggagatgcaggtggagcgggtgcacgaggacgcggagcacgggggcgccgacgccgacaagctcaactacgagattttctccatcctcgagagcaagttcctcttcggctacaccgacccgcaccagctctggctgcccaagccgccgccgccaccgccggcgcaggcgtcgcaagcggccatggcggccacggggaaggcggcgcagcgcgggaaggtgtgcgtgctctgcgttgatggcggcggcggcgggctcagggcgctgctcgccggccgcgcgctcgcgcacctcgaggccgcgctccagcgcgcctccgggagccccgacgcgcgcgtcgccgacttcttcgacctcgccgccggcacgggcgcgggcggcgtcttcgccgcgatgctcttctccacgcactcgcgcggggccccgctgtttcgagccgaggacacctggcgc

SEQ ID NO: 53532 - DNA, 483 bp, Triticum aestivum
  Clone ID: PAT_TA_53532
ccacgcgtccggaaggatccgcaagcaagcgttttaattttattggttcggatgatgatgaggctgatagatatggaaggaggagaatgtgtgaatattgggagcggagggtcccttccctaccccccttgagattgtttggttagtgattggattggatggagaagcattggtttggtttggttggatggacaagtaaaaaaagttgactggttgcaggagcgagcatatacagaaagagagagagagagagcatggtggtgctgttttgcatttcattagattagattagattagattattcctctgggctgggcttgactgactgtaacagcagtgagtcagtcagtctagagtggattaatcaatgagaatgagattaggaggcagatgttggttgactcttgactgtttaataggttgtttggttgtatgtacctttaccctgctgtgctgacctgagactgagactgagactgagac

SEQ ID NO: 53533 - DNA, 142 bp, Triticum aestivum
  Clone ID: PAT_TA_53533
tagggacataaacacggagtatgacactgttcttgcccaaaaatgaaccacaaatgctcaccctgtttccctgtaaacaccgtgtagcccttgggacgaaatgtaaattttttgagtgaagagggtgcaaggatcgttcatt

SEQ ID NO: 53534 - DNA, 428 bp, Triticum aestivum
  unsure (1)..(428): unsure at all n locations
  Clone ID: PAT_TA_53534
ccagcgtccgcgcgaattgctactcggagcaccagcccatcggcacggcggcgcaaggcggcggcgcggaggagaaggactacaaggagccgcccccggcccccttcttcgaggccggggagctcacctcctggtccttctaccgggcggggatcgccgagttcctggccaccttcctcttcctctacatctggggggtcaccgtgatgggcgtggtgggcaacccgtccgggtccaagtgcggcacgggcggcatccaaggcatcgcctggagcttcngcggcatgatcttcgtgctcntctactgcaccgccggcatctccggcgggcacatcaaccccgcggtcaccttcgggctgttcctggccaggaatctgtcgctcaccagggccgtgttctacatcntgatgcantgcctgggcgccata

SEQ ID NO: 53535 - DNA, 339 bp, Triticum aestivum
  Clone ID: PAT_TA_53535
cggacgcgtgggcggacgcgtgggcggacgcgtgggaaaaaaaaaaaaaaaaaaaaaaaaaaaaaaaaaaaaaaaggaaaaaaagatataaaagaatccaaacttacaaacacaatacatacaaaaaaataggcgtgttcattttgaaagctcaattctttcatccggccgcttgctaacaactacctgtctggtaaaaccctctaatttcccttcttagtccgctttctacaaacgccgcttttggcaaaacccttaatttcccaaattcactcacctttcgccacttccaccttttgcccactctgattgtcgaatagaaccccccctgtatcgccc

SEQ ID NO: 53536 - DNA, 504 bp, Triticum aestivum
  unsure (1)..(504): unsure at all n locations
  Clone ID: PAT_TA_53536
accttgacaccttgttccctaccactcagcactcctcctcctcgtttcctcatggccacggtacgccagagcaacggccacggtgaggccgccgccgccaacggcaagagcaacgggcacgccgccgcgaacggcaagagcaacggccatgccgcggcggcggcggattggaatttcgcggggggcgaggacggcatcctggcgaggacgggggccaagaacagcatccgggcgatacggtacaagatcagcgcgagcgtggaggagagcgggccaaggcccgtgctgccgctggcccacggggacccgtccgtgttcccggccttccgcacggccgtcgaggccgaggacgccgtcgccgccgcgctgcgcaccgggcagttcagctgctacgccgccggcgtcggcctgcccgccgcacgaagagctgnnncagagcacttgncacagggcgggccctacgagcnatcggcccgcggccgcgcggcccccccggggggggcc

SEQ ID NO: 53537 - DNA, 280 bp, Triticum aestivum
  Clone ID: PAT_TA_53537
cgctccgaaaaaaaaaaaaaaaaaaaaaaaaaaaaaaaaaaaaaaaaaaaaaaaaaaaaaaaaagggagaaacgatataaaagaaaaaaaaataagggacgcgggacatgaggggtcaaaaactatggtatacagtctctaagggtgcgcggccttggtatgggggccccccatttcagcccgggggcccccgggctctacccttttttttggggcgccccttttgccacctttgggcgggggcttacccagcgtggagggccgaaccgctggcgtttcc

SEQ ID NO: 53538 - DNA, 530 bp, Triticum aestivum
  Clone ID: PAT_TA_53538
agggttaggttttcgtcgccgtggcttcggagatggtagcgagtggaataagggatggccgggcttctccccgtccgtacggcgtcagatacggtgcccgcgaggagtcggagaccttttgtatcgcggatccggtcgaccggagcctgtggtggtgattctcttcactggaaactgcgccggcgatggtggcagctcccggcgaggcgacggttgttggggcttcagtccctgtttgtttgggggacgaggtttgcagcagttcttcatcctttgcgtctccggcgagctggagtcttggtggaggcatggagccatccaatctatggagattatccccggccgatgcgcccgaacccgacctttgttcctgttcgctggacaggatctacatgcggcctccaaagcctttgaaggcgatgcactatgcagatggatggtttctcgacggcggttcgagtagacagtgagcgggcgaccggcttgatggcagcggtgagcggcgtatttttctgtttcggagagatttc

SEQ ID NO: 53539 - DNA, 172 bp, Triticum aestivum
  unsure (1)..(172): unsure at all n locations
  Clone ID: PAT_TA_53539
tcgacccagcgtccggaccacttctgtgcgccgccacccccacacactccattgctgcttctcacaaagtgggagggagcgtgcctccttcttcctcggacgaggagatgtagacgacgccggcagggacgccattcatcatatcngaggcaangccggagtggctgctttc

SEQ ID NO: 53540 - DNA, 456 bp, Triticum aestivum
  Clone ID: PAT_TA_53540
ggcaagacgagatggcaaacgcgaagtcaccagcaagccgcgcacgcccatcggcagtctggaagactgatcaagccattcgccaatggctgcgcctcaggaatgctcgccacctgcatgattcaacccatggacatgatcatagcgtgaagatccaattgggtgagggatctgcagctcaagtcgcacagaccatgactgctaatgagggcctgggttactttaacaagggtacagcacatggtttactaaggcaagcgatctataccacaggtcgaatagcattcttgaaggctctaacaaacaaagcactcgtggcaaatgatgacaaaaccattgccacttgttcagaaagattctattgtcatgactgctagaacgataggaacatgatacgtcagcaatgctgatttcacactcattatgatacaatctgactcctccgtaacagcatat

SEQ ID NO: 53541 - DNA, 204 bp, Triticum aestivum
  unsure (1)..(204): unsure at all n locations
  Clone ID: PAT_TA_53541
accgccgagttctaccgggggcccggcgagcgctgacccaatcccgcccaaagaagagtaancaaancaaancanantgaattcncccatcacaattcatgcacaatcaattgnttgcccccattntaacccctacataatccatccattaattnntcatatannntctctcgggggagagaggaatcccancancattcaact

SEQ ID NO: 53542 - DNA, 323 bp, Triticum aestivum
  unsure (1)..(323): unsure at all n locations
  Clone ID: PAT_TA_53542
catatgttatatgacgacttcaacatcaccaaattgcccttggtagaagggaggtatntnntgtgcaanctcttcanaacttctccaancacttcctggcaccgtacagagcgtcgctgaaaaggggcagcgtggangagctataaaagagagtanccacactggggggggaggtgcaanaanccnantcnnanctanatananttannaaaaagaagcgggcancatnagccttcttcacctntcanaanttnttgcgcgtggggggacaccanttatanagattttnntgtngcctacattctccaggtgatttcctccat

SEQ ID NO: 53543 - DNA, 144 bp, Triticum aestivum
  unsure (1)..(144): unsure at all n locations
  Clone ID: PAT_TA_53543
gcgaanagagggcgagatgggggcgtccgaatctgtgctggagacctccgtacacgaattcaccgggaaagagtgcaacggcaaagaggggtgcctggacacctacaatgggaagggggggggcatcntcaacntcncccccaa

SEQ ID NO: 53544 - DNA, 615 bp, Triticum aestivum
  Clone ID: PAT_TA_53544
ctcgctcttcctcctcttcctcgccgtccatgtcttcgtcgcctgccatggctcccctcttccgccatctagtgcctacaatgattccgtgtgctcggagtcgttcaggtgtggcagcgttgacatcagatatccattctatctgtcaaactcgactggagctgcccccgattacacaccctactcatgcggctacaccgatttgaagatcttctgtcaaggcgagggggagaccgcgagcgcaatccttacactgggccaaggcgagttacacaactacaccgttctgaacatcatctacgaaaatcacgccattattctcagggacactgaagcctttattagcggcggcaagtgtcccacagtcagtcacaacgtgacattcgacagggggtggctaaactacaccgagtccttggaggagctcaccttcttcttcggctgccactccacggagagcgatctcccgcctcctgatcctccgctagacaagttccagatcgactgcaaagggttcaatccgcctccaggcagtggagacagagtttccttcgtcttcagctctgaggaaagcaacgtttctcgggagcacgaactgtgtgagtactgcaggca

SEQ ID NO: 53545 - DNA, 444 bp, Triticum aestivum
  Clone ID: PAT_TA_53545
gtgtacgtcgccgggatgggcagcaagggcgccgcgctcagcaacgccatctcctactgggtctacgtgatcgtgctggcggtgtacgtgagggtgtcgagctcctgcaaggagacgtggacggggttctccgcggaggccttccgcgacgtgctcagcttcttccggctcgccgtcccgtccgccctcatggtctgcttggagatgtggtcgttcgagctcatagtgctcctctcaggccttcttcccaatccaaagctggagacttcggtgctgtccatcagcctcaacaccgctgcctttgtatggatgatcccctttggcctcggctcggccataagcacccgtgtctcgaacgagctcggcgcggggcgccccgacgctgcccgcctcgcggtgcgtgtcgtcgtcttcttggccgtggcggaaggactgatcatgggg

SEQ ID NO: 53546 - DNA, 627 bp, Triticum aestivum
  unsure (1)..(627): unsure at all n locations
  Clone ID: PAT_TA_53546
cggacgcgtgggcttgacctggccgctccgctcctctgcctcttggccgtcctcctcctatccaccgcgtctgcggagtacccgcaggagctgcttcggcgcgccgagggggagcgcgagtggattatcggcgtgcggcggcgcatccacgcccacccggagctcgcgttccaggagcgccgcaccagcgcactcgtccgcgaggagctcgaggggctagggatcaccgcccgcgccgttgccggcaccggcgtcgtcgctgatgtcggcttgggcatgcccccgatcgtcgccctccgcgccgacatggacgccctgcccatccaggtccgttcccctcttctcttcccgtccgatgctacacttgtggtctggcgcagggtgcccttcccctccgatgctactctggtagtctggcgcggtgtgtgtgaccggtggttggtgctgaacggcagaactgtatcttctcggaactggtggagtgggagcataagagcagagttgatggcatgatgcacgcgtgtggccatgatgcgcacacagcgatgctcctcggagcggcaaagttgctgcntgagcgcaaggatcancttaagggaactgggagactcctttttcncctgctgg

SEQ ID NO: 53547 - DNA, 305 bp, Triticum aestivum
  unsure (1)..(305): unsure at all n locations
  Clone ID: PAT_TA_53547
gttctctgatctgaccggtcgcgccaaaccgacctctgatcatcagcctctgtctgagtcttcggcaccgggccgacgtgacaactttataccaatggtcgtcttccaggagcaagtctacaatcgcacgccgtgactcgtcgaggaggatctcctccgccgcccggcggacgctgtctcaaatgccaccccatctgcgaaggctacgaccccggactgcggagctcctcctgacactacgggctcatccagatccacttgctaaccagctgttaggccaatgaactgggnatcggtgcaggctg

SEQ ID NO: 53548 - DNA, 413 bp, Triticum aestivum
  unsure (1)..(413): unsure at all n locations
  Clone ID: PAT_TA_53548
gcgcatctcccggggcacccctctctcgggggcaccgcaagaccggaaggagcggagccggcagaccgggaagagccaccaccccatcttcctcgcctccgcttccgaaggggcagagatggcggaccgagctaaccacccgtctggcatgcagaagtttggaggacagggccaccttgcctccagggggggagagggagttcnagctcccaacatctgcccttctgtgccagccgatgagaggcgcttcaccacaagcggcgacatgactcagaaccggggcatcagtgtccccatgagggcatcttctccattgggtgccaatgcaccacctgagaagaaaggggtcaagaactttgcaattgacttcctcatgggaggagtggccgctgcagtttccaagactgcggcag

SEQ ID NO: 53549 - DNA, 305 bp, Triticum aestivum
  unsure (1)..(305): unsure at all n locations
  Clone ID: PAT_TA_53549
ggnacgagaagaaacctctcatctgagagaccctaaggaggtccccggcacgccgcgcaaggaggccctactcaccccaagcccagcctctcccgtgccgctctagctcagcgtgcggagacgggggcgccccctgacctgcctcccagccagccgccccgctcaccgatcgcgcctaccccgcgcggggcgcgagcaaccttctttggctgcgctgccggggccccgggggaggacaacctagcccggggggtgccctgccgtccgaagcccccctccgcttcagggtgcaccacctgcggcca

SEQ ID NO: 53550 - DNA, 237 bp, Triticum aestivum
  unsure (1)..(237): unsure at all n locations
  Clone ID: PAT_TA_53550
cgccgcgggcggctggtgtcgctggcgcggcttaacgacgcatcaatcatcatcgtcgatcctatactacggaggagatgcggcctggatgtttggctgtttcccattgtgtgtgtgtgcgcgtgcgtgcgtgcgtccgggcttggatgccctgctatagtgttcatgtgctcagatcagatgtgtttctcgtcgagcagggcttgtaccttttacttttacagctaagtattnatt

SEQ ID NO: 53551 - DNA, 320 bp, Triticum aestivum
  unsure (1)..(320): unsure at all n locations
  Clone ID: PAT_TA_53551
cccctccnatctcccgggagccggcgatggaagcaaaacgaagccaagacgcagtcctcctcctcctaagatgcagatcttcgagaagacccttaccggcaagaccatcacccttgagggcgagtcctctgacaccatcgacaacgtcaaggcaaagatccaggacaaggagggggggggccccgaccagcancgtctcatctttgctggcaagcagctcgaggatggccgcacccttgcggactacaacatccagaaggagggcacccggcacctggatctcaagctccgaggggggatgcagatattagtcaagaccc

SEQ ID NO: 53552 - DNA, 465 bp, Triticum aestivum
  Clone ID: PAT_TA_53552
tccatggagccgtgtgctaggggccgccgtacttcgagtgcaccaggaaagaggtcgacaaactcctcgacacgggtaatctggtgcctcatgtccgggcctgcgaagacatgtcttggggtctgaagctcactgagccgatctccgagaaggatgtgtagaattttcgatcgcagtttacaccgtacgtatatccttgctagttgtctaatgttttttcgcagggtgtggagagggaagggcctcaaataaacaatgcaaatcatgacactctcttcgatccgtattatatggatccgagggagtacactttatgtaagtttcacatacagtatgaattaagtgaccccagaagccagaactacctgagtgattcgtctatctgcgtggctagacatagaaaaattagagattttttgtggtacattgttctacacaatttaatatgtagcattaagttgattc

SEQ ID NO: 53553 - DNA, 626 bp, Triticum aestivum
  Clone ID: PAT_TA_53553
acctactcgacctacgcaagcggcatcatggagggcatggagctcctggcctcccaaggacgccgccgggctcgtctcgttagcccgccatggttgcaatatagaaacccttaatgacacacgtgtccctttttccctccgcgttgcttctgtggatcaaaaccctagcaaactcctctccaaacacgcgatcgattccgttcgtatacatctgatggtttaacaaagatgcaacaaatttcattttgtagttttgcctgtggaggtgattgtcattgaaaagcatacttttttgaatggatgttacttgccaactcggatgcctctttatatttttaaaattggttgtaaaccatgggtgcgacttcattgtttgcaaaacatggattcgatttatttcggcattggtagtgtggaaattgacatgggatgcactatactgttgcttgttctttggccaatcctaaacataattctctattttttatgtgtctctatgttgaactcgtacggggtttcttagtatgtagagatataatatgcaaattcagtgatacatacgcagaatgtttgtttgttctctttaagtaattatacagatcaacaatattaaatattagatgaca

SEQ ID NO: 53554 - DNA, 684 bp, Triticum aestivum
  Clone ID: PAT_TA_53554
gtcggagagatgctaaacctatgggcagattcttgaggaattaccgttgcagattgatgtgtgaattggagattagaaaggagggagggaccaccagcgaaaatcaggggctcaggtaagcttagaggtgaccgtagagaggaggaggaagaggcaccgggagagtgagggatgtctgtgcttctagaagtgttatccataaccctgagatatgcagatgaaggcaggaacggaggagctcccagcggcacaatcagcgccttcgacggcaagcgaggtctaaccatctacaaactcgaccagacagtagcacctcagcaggaggaacacccaaatcctggcgccaaacaggtatgttgtctgctcgtaacttcattcttcagaaaagttattggcaatcgttcatcttatgggtgcgtaactgccctatttctcaattggtgtagttgaaatggtatgaagaaatgggcttgaccagtctcgtactgtccggccattgtccggtcagcttggtttggtttggtcatgtcccagattgtctggctactctccggatccgctcggccacgtttgcaccaatggttgaatttagctagactgaccgctcaacttcaaactcttcatgatgcatgtattggcaaccatatgtaattgcacttactgagcgcccgtacaaattgcaaa

SEQ ID NO: 53555 - DNA, 606 bp, Triticum aestivum
  unsure (1)..(606): unsure at all n locations
  Clone ID: PAT_TA_53555
cggacgcgtgggcggacgcgtgggaaaaaantnatggagttttgcgcctcctttgttcttctgttggagtaggcatcgtctttgaaggagaggaagatgacgagcgtatggaagaccaaggttctccccgggctcaacaagatcttcgacaaggatggcaagaaggccgccgccgccgagttcttgaaatccttcaacaaggaggagattgacaaggagattgaggacaagaagacagaactagagcccaaggttgtggagaccattgaagcatctcctccagaaattaagggcttgatgaaggataagaaaacatccaagatcaagaagaactcagttgccgtcaccaagttccttgacgatttggccaagattgatttccccggagccaagctggtgagcgacgcggtggccaagtccggcaccacgcccctctccccggccatcgtcttcatcttggacaaggttgcgcccttcgtcccagcgcccaaagaggagcccaaggccgagcccgaggacgccgccccggcagaggagaccaccacccgcgaggtcgccgtggaggagaagaaggaggaagccgagccctccgccgcaccggcagaa

SEQ ID NO: 53556 - DNA, 682 bp, Triticum aestivum
  Clone ID: PAT_TA_53556
gaaacatggaaggggaagtagctgttgctgtaatggaagaaaataaatggcggacctggtttggccatacttgaggttggtttatcagccgcccgaggaatctgcgcggcgtcgtcgccgcgaacagtactcgatattcaccatcatggaggctctgaggcaaatgattcttgaaccaatcgtttacgacactgctgaacaggattctggcgaagttaaattctccatgatagccgcatcaaagggaggctttgacatcaagatcggctctcatacgatgcatgcgcccaagtatgccagtgcacgtcacccgctcgtctacatgatgctttttgcttgcaatctgctcgacggtaaattctcctgcccgaaagctatggtgccgagaagcatcctcaacatgattcagaaatcgcgctcggtatcacgcagcactggaattgctggagaatctatagtggaaagtatcggcgtgtatgctgagagtgaactaggttgcgctgctataccttcaacaatatcccctgcaatcgctgctaaagaagacgaagacgcagcttatcacgacaatgcaatggggtggcggctgacacccatactgatatggagagtatagcaacatgggatggctcaagcggcatctctgcatgagcaaaacaagattatgaattgttgggacaag

SEQ ID NO: 53557 - DNA, 683 bp, Triticum aestivum
  Clone ID: PAT_TA_53557
cagcgaactgccgccgccgccgccgccggcgccagcgaaacctccgtcgatcccctccgccgccaccaccaccaccaccaccctcgccaccgccgctgacggaaccacaaccatatcctcgctgggccaagaccagctcctcgagatcttcctccggctgcccaacctgccggccctcgtccgcgccgcgctcacctgccgttcctggctcggcgccgtccgctcctcccggcgcttccgccgcctcttccgcgccctccacccggcgcccctcctcgggatcttcctcgaggtcgacgtcagcacctccccctccttcgcccccctgcgccgctcagatccggacgtctccgccgccctccgccgcggcgacttcttcctcacctccctcccgccggacgacggcgcgcccccgtgctggaccgtcacggactgccgcgacggctacatcctcatgtggaactcgctctgggccgtggccgcggtgaaccccatgacctgggctgcggacatcatctcgctgcccgcgatgtcgcggtcgggagcctcaccggtttcgtcttccttggcttgcatctgctgtgtcccgaggagagctccaggtcgttcggcgtggtctgcatcggcgccgacgtgtctagggttcgcgcgcccacgacttctcgtcggagacgagggattgg

SEQ ID NO: 53558 - DNA, 275 bp, Triticum aestivum
  unsure (1)..(275): unsure at all n locations
  Clone ID: PAT_TA_53558
cgacccagcgnccgcggacttttgggtcgcccactcgtgcggccacgcgtccgctccgtttcctccatagccaagaggcaagcatactgccctcgccattgccgattgcttcgtcaatggcggctcctgctctcagcttggttttgtgtatgctcctgctctcgcacggttcggcgcaagccaggaagaccgttgggggggaggtggtgcctgccccggatcnggatggagcgtcnggcaggaagagggtcttgggtggtggtgtggaaagggcc

SEQ ID NO: 53559 - DNA, 491 bp, Triticum aestivum
  Clone ID: PAT_TA_53559
cccacgcgtccgcgccgccgccgcagcttgaggcggagatggaggagtacggcgcgggggacctcctcagcgaggccatgtgcgccggcgcgcgggtggtggtggtggaggactgcgtggaggcgcccgccgccttcgtcctccacctcctcctcaagcgcgcgctcgctgcgggcggtggcggtggcggtggcgcggcgctcctcgccctcgcgcagcccttttcgcactacgaccgcgtcctccgcaagatgggctgtaacttatccatgcataggaagagtgagagacttcatttctttgacttgcaggggttcccaggtggaacacggggaggtgccattgctgatagcttagctcaactgtatagtgctgctcagagagtggtggagacatgcaggggctggagaaaatgcaggtcggttcaccggtatgatagatgaagtttcactcttggaagttgctgcccatggttctgcagatgatgtctt

SEQ ID NO: 53560 - DNA, 616 bp, Triticum aestivum
  Clone ID: PAT_TA_53560
cctgcccgtaaacacactcttctccctcttcttcctcccaagaatccccgcggctcaagcaaaggagggaagcaggggcgggagccagcagcaccggccggccggcgcaccgaccccctcccgctgtatcgcggggctcctcctccgtgccggcgatggcgctcgaggaggccgcgccgggcggcggcggcggcggcgggatccgggtgctcctgcggcggaagcaggtggactccgaccgggcccgcgccgccggcggccagcagctcgccaaggagctctccatcacgcagctcatcgccatcggtgttggttcgacggttggagccggagtgtacgtcctcgtggggacggttgcccgggagcactctggcccggcactgacgctctcgtttctgatcgccggaatagcggctgcgctttcggctttctgttacgcggagcttgctagccgctgcccttctgcgggaagcgcctaccactactcatacatctgcgttggtgaaggagttgcatggttgatcggctgggctttgatactggagtatacgattggcggatcagccgttgcccgtggcatatctcccaatctagcgttatttttcggaggaccaaa

SEQ ID NO: 53561 - DNA, 373 bp, Triticum aestivum
  Clone ID: PAT_TA_53561
cgatagctgtcccgatcctcgatctgtgctcaaccctccctccgtccgtcgcagctccagatttccttccccatggctccgatcaagatcggcatcaatggtttcggccggatcggcaggcttgtggccagggttgcgctccagagccccgatgtcgagctcgtcgccgttaacgaccccttgatgaccaccgactacatgacctacatgttcaagtgtgacactgtccacggacagtggaagcaccatgaagttaaggtgaaggactccaagacccttctcttcggtgagaaggaggttgcggtgtttggctgcaggaacccacaggagatcccatgggctgctgctggtgctgaggacgtgggtgagtgca

SEQ ID NO: 53562 - DNA, 533 bp, Triticum aestivum
  Clone ID: PAT_TA_53562
cgttgctacaggtggccttcttctatgcctcgctctacctaatcgccatggcgcagggcgccgacaagccgtgcgctttggctttcgcagccgaccaatttgaccccgagcaccccaaagagcgtgcatcccgtagctccctctttaactggtggttcttctcgatggctgtcggcatctccatctgcgtcgccgtcgtcagctacatccaggagaacgtcgggtggggaatcggcttcggcatgctttgcgccatcatggtttgtaccttcatcgtattcctctctggcacccccacctatcgcttctgcgcttctaccaccgatgttgagagtcctttcgcccgcctcggtcgtagccttggcacactcatcaagagctcaagcgtccccttcagtacaaatggacaccaagatgaggatgttgtggcaaagtccgaggaagggcgcagcatgctccgtctgtgccaatttgggcgggatggcttgcgtatggtgttgcatatgcccaaatcatgaccctatttaacaagc

SEQ ID NO: 53563 - DNA, 650 bp, Triticum aestivum
  unsure (1)..(650): unsure at all n locations
  Clone ID: PAT_TA_53563
gctgccggatgcgtggtcgcaggtgcgggcgccggtgatcgtgccgctgctgaagctggcggtggcggtgtgcctgctgatgtcggtgctgctcttcctggagcggctctacatggcggtggtcatcgtcggggtgaagctcctcggccgccggccggagcgccggtacaaatgcgaccccatctgcgaggacgacgaccccgagctcggcagcgccgccttccccgtcgtgctcgtccagatccccatgttcaacgagcgggaggtgtatcagctgtcgatcggcgcggtgtgcgggctgtcgtggccgtcggatcggctggtggtgcaagtgctggacgactccacggaccccctcatcaaggaaatggttcggatggagtgcgagcggtgggcgcacaaggggatcaacatcacgtaccagatccgggaggaccgcaaggggtacaaggccggcgcgctcaaggccgggatgaagcacgggtacgtgcgcgagtgcgagtacatggtcatcttcgacgccgacttccagccggaccccgacttcctgcaccgnaccatcccctacctncaccacaacccggagatcgccctcgtccaggcgcgatggcgctttgtgaacgcggatgaatgcctgatgaccaggatgc

SEQ ID NO: 53564 - DNA, 631 bp, Triticum aestivum
  unsure (1)..(631): unsure at all n locations
  Clone ID: PAT_TA_53564
ctgtagatttgatatgtactcttgtcctgcttcatcttggactccgaccacccacctctccgccatcaagcacctcccatggtcttgacatcccagagcactttgtagtagtcaagaggaatcgtagctagtagctaggagcgtcatctcatggatccagcaaagtactggatgataaccaggagaaagcagggtgatcagaaggcgcctgccgtcttcagcacgccgcacatcgccgtcggcagcggcggcggcacctcctcggccacctactacgagtcgtgggaggagcgcgcgttcgcccaggactccgcggggagcctcgggggctgcatctggccgccgagatcctactcgtgcagcttctgcggccgagagttccggtcggcgcaagccctcggtgggcacatgaacgtgcaccggagggaccgggcccggctcaagctctccgggatggtggaggatgggggcggcgtcnacgtccatggcatgcctcttcatcaaagctacatgatccagccgctgccatgccctcctccaagacctagtgctccaagcacagaagctaaccctaatccagtacgcagctttctttcggatccagggaagtcgttggtggacgctgcaactg

SEQ ID NO: 53565 - DNA, 486 bp, Triticum aestivum
  unsure (1)..(486): unsure at all n locations
  Clone ID: PAT_TA_53565
accgaaccgccagctaagttctagatcggaggagcactgttatttcaccgtctatctatccctagtagtattgactggagcactatagtttgcagtatttgtattaatatctaccctagaatttccatctattttatctgcctgtcttgcactcatgttggagtaaatctctctatgctattaatatttgatatgtattcccctgtgccaagacatgctgattgcttcatgtgcaatataatatgtttgatttctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcgcgccntttaaaagaacaaaatttttcccccgcgggtggaagagaaaaatctttttttttggggcccca

SEQ ID NO: 53566 - DNA, 425 bp, Triticum aestivum
  unsure (1)..(425): unsure at all n locations
  Clone ID: PAT_TA_53566
cgtcctgccgttcaggccttctggcggtggatacagaacaccgtcgccggcggctgggatggcttttggccgctcatccagcgcttcgtcgccacggccgcgagcacggcccacgagcttgtcccggccgtggaggcgttgtggcggtggctcaaggacgccgccgccgtcgcgctccccgtcgtgctggccatcgccgcggtcgtttgcgtcgcggccctagtctggttctggtggcgggtcctcggcgtcgcggccttcgtggccggcgtgctggtcgcgcaagcgctcgtgctggccggagtgctggtcgcacaagcgctcgtcttggtcatctgcatctgcgggcgctggttgttcgtcgtcgccatgggggtcgngggtgcgctcgcctacctacttcccatctgtgggcagttctgcgc

SEQ ID NO: 53567 - DNA, 324 bp, Triticum aestivum
  Clone ID: PAT_TA_53567
aaaaaaaaaaaaaaaaaaaaaaaaaaaaaaaaaaaaaaaaaaaaaaaaaaaaaaaaaaaaaaaaaaaaaaaaaaacaaaaaaaaaaaaaagggcagcaccatataaaaaatccaaaattgggggggctcttttagagggtccaggttttttttcgggtgcctccaacttattacttttcgccttctggccacaaaattccattctgaggacccccttgtccccccctactttcttgggcatacccctacgggctccccctattttattccgttttgaatcacataccgttttggccggttggctgtttccaaaaggggcccccc

SEQ ID NO: 53568 - DNA, 480 bp, Triticum aestivum
  unsure (1)..(480): unsure at all n locations
  Clone ID: PAT_TA_53568
ccacaagccaagccacactgccttccacgccagagattcgcagccatgtccgacgagctcaagcgcgggatcgcgggcgccgccgccgtcgccgcctcccacccggcgccctacgcgccgcgggccccggccgacgccgaccgcaggctcgccgcctccgccaccgccgcgctcggctccgcgggggggccgccgcgtcccccacggcgcacaagatcacgctcaagagcgccgacatgaaggaggagatgcagaaggaggcgttcgacatctcccgcgtcgcgttcgagaagcacaccatggagaaggacatcgcggagtacatcaagaaggagttcgacaagaaccacggccccacctggcactgcatcgncggccgcaacttcggntcctacgtgacgcacgagacgaactactttgngnatttctacattgattctaaagctgacttgcttttgaagtctgggtgatgggggaatc

SEQ ID NO: 53569 - DNA, 456 bp, Triticum aestivum
  Clone ID: PAT_TA_53569
gtcaaatgttagcatcttggggacaacagaatagaacactgtattagtgcttgttttgtgtcaaatgtcagcactttcaatactaggtactgcatacacagtaatgcacttagagcttgtttcctgaaactagatatatacatggcgtatattgatgcccttgctagtaatgtgcttgttcgcaatgttctctttaatataaatatgatccgaacatgatgaggaactgaatgagaatgaacatgcattcattacagcataagtatgatgtaagatcatcacctgctgaagcaagagacgaatacggcttacatagtagtattatagaccatgaagttgaccaacaaacatgtggcgaaggagccacatctataagctgctcaagatggcactcctttcgaacctgaatcatgaatcttcttactgtgtgccatatgaacctagagacttgctctt

SEQ ID NO: 53570 - DNA, 425 bp, Triticum aestivum
  Clone ID: PAT_TA_53570
agaacttcttatttatgtccagattacaatgatgctgatccaagaacacatcaaggattggaccttacaaggatgacaactagagaattgattgcgaaacacggattgagtgacgatactatagatttcattggccatgcgcttgctcttcacagggatgatcgctacctaagcgagccagcaattgacactgttaaaagaatgaaactctattctgagtctcttgcacggttccaaggaggctcaccttatatttacccattgtatgggttgggtgagctgccacaggcttttgcacgtctaagtgctgtttatggtggcacttatatgttaaataagccagagtgcaaggttgaatttgatatggaggggaaagggtggggggttacattagaaggtgaaactgctaagggcaagaaggtggg

SEQ ID NO: 53571 - DNA, 555 bp, Triticum aestivum
  Clone ID: PAT_TA_53571
tgagcacattccatctccacccatcaccatccttttggaaaaccaagagagacagaactcatggagggcgcggcacagaccattttggtcaatgttgggcagctggttggccaggagttccggcagctccgcgccgtcggtggcgaggtcgctgagctgaaagacgagctggccaccatgaacaccctgctacgcatgcagtcagaagccgatgaaagtgggttgagccacttcgtccgggagtggatgaagcaactccgggagctggcctacgacgccgaggactgcgtcgacctctatttgttccgcatcaagtgccggcagggcgacggcttcctcgtctggtccaagcgcctgcttgcaacgctgttccctcgccgtcgcctcgccggcgagatcacgggcctccgcctgcgtgctgtttccatcagcgagcgccatgctcgttacggggtcagccttgagttgctaggccgcaccgcttcttctttggaggcttcgcaggcagtggtggggttaagacgcgcgccacgccctcacgacgaccccaaacag

SEQ ID NO: 53572 - DNA, 662 bp, Triticum aestivum
  Clone ID: PAT_TA_53572
ccggcggcggcgcgtagaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacaccaaggggtcgcttccgccttcactctgtcagggatgaggatgctaagttcaagctctgcaaggtcaggtctgtccagttcggccagaagggcatcccctacctgaacacctatgatgggcgcaccatccgctacccagacccactcatcaagggcaatgacaccatcaagctcgacctggagaccaacaagattggtgacttcatcaagtttgacgtcggcaatgggggtcatgggtactggggggcgcaacactgggc

SEQ ID NO: 53573 - DNA, 538 bp, Triticum aestivum
  unsure (1)..(538): unsure at all n locations
  Clone ID: PAT_TA_53573
gtgcgggctatcgtgtttgtgctgcggcgaaacgtgcagctgatacaaccagagatacttcaacatgtggttcttgacatgcctgggcttgcgttcttcactacatacgcgcttttggtgctattctgggccgagatttactatcaggcacgtgcgatgtcgactgatgggctgaggccaactttctattggatcaatggggtggtgtatgcaattcagataattctgtggttggttttgtggtggaaaccagttcgagttatggtcatattgtccaagatgttctttgcaggtaaaatacttgcttcatttgctctctgtgtgtgtgaatgcgggggcgggtgagcatgtgtttcaattcaatgtaaattgcagtgtccatggatgcatctgtcttgacattttntgcagtgctagttttcagctactacagtattatctaagtcgagaaactgtgaagcacattattggataatctactgtggggtgttgacaccttgatcttttcagctaattatgctatgacttttcaggcgta

SEQ ID NO: 53574 - DNA, 726 bp, Triticum aestivum
  Clone ID: PAT_TA_53574
ctcgccaatcttcgagaacggtacaatatatacaatcttatcaggcttttagctacggctgtcatggctttcgctaatggtctcaagttagctgccctgtgtgtgttggtcctgactgtgggccaactgatggcagttgctgatgcgtcggctccactcatgcagtctgtagagcaggagcgctcaaccttcgaggattgcccctgcagcccagataaattgtggtgttgcctccgagcaagcggagtcgcaaaacccttcaaggattgcccctgcagccctgataaattgtggtgttgccttaaagcaagcagagtcgcaaaaccctccgaggattgcctctgcagtcctcgtaccaggttttgttgccttcaagcaagcgaaatcccaaaagcctccgagaattgaactaaaatcttcaggagggggccagacggtaagagatgaacattaagacgtacgtatggcttgaacttgaagcatcattttctttgagttccatccatgtctacatcttttatgtgtattgtatgtggtcgcatgtcatgcggtgtgtctaactaaagaataaatatgtaagctccaaggaagataatcgtcttggagatgcatatgcgatgtgcatatgccagtttattgttgggttggtgttgtagcaattatatgttgttttcaagtgtttatctatcttgctctcaataataaataagttgaatctgctgcccc

SEQ ID NO: 53575 - DNA, 723 bp, Triticum aestivum
  Clone ID: PAT_TA_53575
agaacccggatgtagggcccggcatcagctctgaactgcgattttatgacaatggcacaattcaacttgtggaccgtctatcagaatctcctctgtggcagttctccacaggaccacctctgtccaagcacattaccaccacaaactctgatttgagctatctcatatatcctttggacgagtctgatctcgtggaagttcataatggcaccggtgtgaaacttccctgggaattggaagagtttatcgctagaactccatacatacgggattctgtggttactattggatcaaaagcctcgacaacttttgccgttgatgctgatagtggtgagatcatttacaagcatagtctgccagccgccctgaatgagttagcagtcccggctggggaagcaccatccaagttagatgttggtagaagttctaatatcatcgtggttgtgagaaccgattattctctcagtgcatcagatcttggtgtacatttgtttaactggacacggtcttctttctctgcaaactactatgttaaacaaagccatccaaatatgcttgaacaatcatcctgtttgcaagaaaatattccgtgcattaggactgatggtgtaccgatcaaacttactttacctgattccagtacagccaatgcacttgtcttgcaagatgtgaacaaagttaccacttagggatggtgctgatgctttgagacaacttcaaact

SEQ ID NO: 53576 - DNA, 192 bp, Triticum aestivum
  unsure (1)..(192): unsure at all n locations
  Clone ID: PAT_TA_53576
ctttcctctgccactcgccgcagccgatggccgcctcggcaatcagaaaccctagcccagccgccgccgtcgccgcgcctctgccctcccgcgcggtgctgcggatggtcacgccgncggnccggagaggcgcgtncgncgnggcgnnncggnaatgcggncggncaaggcggncgnggcggaggcgccctc

SEQ ID NO: 53577 - DNA, 542 bp, Triticum aestivum
  Clone ID: PAT_TA_53577
aaaaaaaaaaaaaaaaaaaaaaaaaaaaaaaaaaaaaaaaaaaaaaaaaaaaaaaaaaaaaaaaaaaaaaaaggggcgaagctttatagggaatcccagttttgcgcgcgcgagcagtgcggcgttatactctcttctatggggccccctattttcttttctgtggggcggtgtttcaccactgttgagtcgggggaaccccctggcttcccccctttggagccctttggcgcttctccctttttcgcgtgggggtgtaatccctatgggccccgcccttttcccttttcacaacaggggcacaccctgtgtggccaggggcacgccctctgtaggggccctttaaccgcccggggtggggggtttacgcgcgggggccccgttacttttccccgccccctagccccctctttttgcggttttttccctccctttttcgccgtttttcccggtttttccttgtaggggtttatcgcggggtctcccttggggtttccgttagggggcttctcggcccctagccctaaaaatttttgttgggg

SEQ ID NO: 53578 - DNA, 521 bp, Triticum aestivum
  Clone ID: PAT_TA_53578
cccacgcgtccgaaagacctcatcaaatagctggagggagaacctcaaaaaaaaaaaagctagagggacagtgatcaaggtagcgacaatggcggccgaggctcagcaattgaccgttcccaccgaggcagagcttctgcaggggcaggccgacctttggcgccacagcctctactacatgacctccatggcattccagtgcgccgtcaagctcggcgtcccaaccaccatccacagcctgggtggcgcggcatcgctgcccgatctggtcgtcgcgctgtcccttccacctgccaagctgccttacctctgtcgcatcatgcggctgctggctacctccggcgtcttcgccgctgataacgccaccgacgtggtcacctaccgcctgaccccgctgtcctggctcctgcttgacggcgtcgccgtagaaggccacccaagccaaagctcccttgtgctcgccgcaacctcgagaaactgccttgaggctgcaatggggctctacgactgggtcaagaagg

SEQ ID NO: 53579 - DNA, 536 bp, Triticum aestivum
  Clone ID: PAT_TA_53579
attattggggctcattttttcagccctgctcatattatgcccttgcttgaaattgtccggacggaaaagacatcaccacaagctatcctcgatctcattacaggtgggaaaataataaggaaagtccccgttgttgttggcaactgcacaggctttgcagtaaatcgtacattttgcccttacacacgaggggctcaacttctagttagtgttggtgttgatcttttcagaattgatcgagtaataagcaactttggcatgccaatgggaccttttcaactccaagagttaactggatatggagtacccttagcagtaaaggatatctatgcagctgcctttggaacacggaattttaactctgttctagtggattcgatggtacagactgggcggcaggcaaagagcaatggaaaaggttactacctttatgagaagggtgcgaagccaaagcctgaccctaatgcacaacttgtgattgatgagtacagaaagtaggccaagacaatgccggttggaaagctctgttctttatc

SEQ ID NO: 53580 - DNA, 752 bp, Triticum aestivum
  Clone ID: PAT_TA_53580
cctcaagcgggaagggaaaccttgatccattctctatggaatctttgaacaaagcaatggatggagcaaaaaagcaacagtccatacaaggcttcctgatggagcaaatggctaagattacaggacaggggtctggtggaaatggaggaaataataaccgttatggaggcagcggtggtggttctgatggcccggatgacgaatctttcacggattcattgtatgaagtggtccaagttgtgttagcaactgttgcttttgtactcacgccctttctccttgtggacttgccagctcagaagggataatatgtatacttgaagtacataatagtgatattaccattctccattagtgagaaaacatcctatatccacatcatcagaggagaggagttgtaccgccttgctagggactacaccagatacctcgtcactggcaagagaacgtcccggctgaagcgtgccatgcttaactggcgtgatttctcagatagcatcacaaagaatttcagcacacaagacgatgtgtatcaaagcccggtcgcttctgaagccatgtggtggcaacagccccagaagctggttcatcatctcggtgaccttttcagaggcaacctgcgtccacatgcccaggaatcttaaaccctagcattccacggttgccttcgaatttccacctcagaaacttctgtttctgaccatctagtttatgctagtgctaagtaaatcgacgcaactagacgatcagct

SEQ ID NO: 53581 - DNA, 507 bp, Triticum aestivum
  Clone ID: PAT_TA_53581
gctagccagccaagccagtcctgctcgcggaagcagattcaagctggatccatggatggccgtaatcaaagggactgatgggcgatgcgcgggggtcgaggcgctgttggtggccatgggcgacgggccagggctggccgttcgctgaaggcctatcctgtgataaacagcaatagctttacgaactctggcatgacaccagcgttcagggcgcccatgttctacaagatcacatgaggctactgctagcggacattgctagaccgcactgaggggagccaacctccggagctggagccataagaaggtacttgtcccatgcttgcacaacaagcacgcccggcgttccatgaatattcggttcaggtgcgctatatttagacaggctctgacggtattattaacaaaataaccgcctagtgaaacatatacaaacgtacgcatgaacaaccaacattagtcataataaataaaaagcattcttgaggacatctacttaatatctac

SEQ ID NO: 53582 - DNA, 802 bp, Triticum aestivum
  Clone ID: PAT_TA_53582
gcgtcgaccgagaccgcgtccctccctaaacggcggcgacgatggagggcgccgcccacctcctgaccgacggattcgccggcttcccgctcctcagggccagcccctcccccgtgccaggtctagcatcggcttggaggccccaaggggctgccgccggtgcgggagtcccgcgcggccgtggggctggggcggtggaggctccgctgagcctccggcaggcagggagacaggctcctgttgaggcggcgggcttggtgcgggctggtcttccggatcgagcccttcctcatcttcctctcgttcgcttggcaccttccctcacaattggtgcccaggcgtcgccatcgccatggatgtgctgcagaacgcggatgcctgcttctcccccaggagggccatgttgcctcaggtgcacccgaggggagggggaggcgggtggagcgcctgcatcagcgtgtcgtgaaacccctgcatgattttgaacatctcaggcaaaagaagatgattgggtttccgtggttagggctgctgtcgtcgtgcttcatcagcgtcatcattgcaggattcattttctacaagtactgtcttgggagtaaggaagcagagatacctcttcaatcccaaaacttatattgttccgggaattaccatgggaagcaagcactgaatctttcttggctatcaataaaatctgttgcggcagtacatggcttctgaagtggcgagtaacagtaatcatgccaggttaatccaagctcagtccattggtatgccccatggctggatttgtttgctttgc

SEQ ID NO: 53583 - DNA, 758 bp, Triticum aestivum
  Clone ID: PAT_TA_53583
ccggtacgcccgcttgccgccctcgcgccgcctcctcctcccccggtgtgatccgacccttctagaagcgccgcgcgcgcgtcccgtgcatcggcggcgccggccatggcgctggcgttcgacgatttcggacggcccttcatcatcctgagggagcaggagagcaagtcccgcctgcgggggctcgacgcgcacaaggccaacgtcgccgccggcaaggccgtcgcgcgcagcctccgcacctccctcggccccaagggcatggacaagattctccaatcccccgacggcgacgtcaccatcacaaatgacggagcgacgatcctggagcaaatggatgttgacaaccagattgcaaagctgatggtggagctttcccgtagtcaagactatgaaattggggatggtactaccggggtggtggtcctggccgggtcgctcctggagcaagctgagaaactgctagagcgtggtattcacccgattagaattgccgaaggatatgagatggcctccaagatagcttttgatcaccttgaacatatctccactagatttgagttcactgctgcaaatatagagcccttggtgcagacctgcatgacaactctgtcctcaaagattgttaaccgttgtaagcggatgcttgctgagattgctgtcagggcagtccttgctgttgctgatttgaaaggaggatgtaaacttgacttgttaaagtagaaggtaagttggtgggaagctagagacactgagct

SEQ ID NO: 53584 - DNA, 763 bp, Triticum aestivum
  Clone ID: PAT_TA_53584
cccacgcgtccgggtatacagagcgaaagatccaatctcacttcctccaccatgactggcaccaaccctgctgcttccctctccggcaccgccggcaccctcaccaccctcaacgccggcaccctgtccgccggttcctccacttccgctccgatctcggtcacctcgctcggtagcctgatcactctgcgccttacgcgcgataacttcctgctatggaagacccaagccgtccccgccctcgctgcaaacggcctgttcggctatgttgccggcaccgccgcagccccgccgcacaccatcaaggaaggaaccggtgatgcggctgttgatgtggccaatccggagtttcttcgctggtaccagcaggaccagctcgtcatgatcgccctcctcggctccatgaccgaggacatcctcgggcagatgacccagctgacgacctccgccgctgtttggactgcactgcacgacatgttcgcctcgcagaatcgtgcccgcatcatgcagctcaggtatcaactttccaacctgaagaagaaggacctctctgcctctgactactaccgcaagatgaaggggttcgctgatgcgatggcgtccattggcaagcccctcactgacgatgaagtgctcggctacatgctcgctgggttgggctccgagttcgagccactcatcgcgtcgatcacggcgcgagatgatccagtaagtctcagcagcttctatgcgtatctccttagtgctgaacttcgcttggagc

SEQ ID NO: 53585 - DNA, 577 bp, Triticum aestivum
  Clone ID: PAT_TA_53585
cccacgcgtccggtctgcctgcgccggacggagccgccccacccaccgaagcgatccaccggaccggcgagcggcggaggaaggcgggagatggcgtcgacggcggccggggaggagacggtgcgggcgtcgcacatcctgatcaagcacgaggggtcccggcgcaaggcgtcctggaaggacccggagggccgggtcatctccgccaccacgcgcgccgacgccgccgcgcgcctcggcgacctccgcgcccagatcctcgccggccgcgcctccttcgccgacctcgccgcgcagcactccgactgctcctccgcccgccgcggcggcgacctaggcacctttgggaggaggcagatgcagaagcccttcgaggacgccacgtacgctctcaaggtgggggagatcagcgacatcatcgacaccgagagcggggttcacatcatcctgcgtaccgcatgaggagaaggaaggcccacgccgtcaccatcacaacaacctgatgttatttagccctcttccttcttccagggcctgcggctcttctcattctgtcagcccgaaactttaatgagtg

SEQ ID NO: 53586 - DNA, 565 bp, Triticum aestivum
  Clone ID: PAT_TA_53586
gacgagggggatggcaccaccgcggcgcgtgtgcgtgaccggcggcggcgggtacatcgcctcgtggctcgtcaagctgctcctctcccggggctatgccgtccacgccaccgtccgcaacccacgtgattccaagaacgcgcatctgatgcagctggacggggcggcggagagcctgcggctgttcaaggcagacgtgctggacagcgccgcgctcgccgccgccgtcgaggggtgcgagggcgtcttccacgtcgcctcccccgtccccgcggataagatcgtcgatcctgagtcagaagtgatggtgcctgctgtgaagggcaccgtaaatattcttgaagtttgttcatctatgaaggttcagaaagttgaggtggtgtaatacacttcttgtgttgattgtaaccccaactgggctgaggctaaacccaaagatgagagttgctggtccgacaaaaaaatgtgcggggatgatgagctctgagactgaatggctaaaactaggggtgaagaaacagtctgtgaatgtggagaaaagaatgggctagatgggcggacaggg

SEQ ID NO: 53587 - DNA, 803 bp, Triticum aestivum
  unsure (1)..(803): unsure at all n locations
  Clone ID: PAT_TA_53587
atttggagagtgtttttaagcacgagtctggactgtaatgtaggcacatgggaagtaccaaaatactaacagctgaagcggcagattagttatgatgcacacttttttaattgtttgtttggtaatcaaacaagaaacactaatttggatcggaggcagtagctgtttctgcagaaattgtcctttggttaagtttcctcaaaacccgacggcaaggaaaggaggaattagtggcagcaggaagctccagttcttatttgcctgcacagattaataataggaactgagctagctcgcatgggtgaagtggatgtacaatcccactactcaggtttaagtcctcatgaacgtgatttttgttcctgttttgtctctgttcttcctccgacatgttcatttagtgtctaagaaaacatggattaattgatcactgtgacatgttcacagtagagaaggaaatagatgtttcccttttgcaacatatgcaagtgtgtcctttgaggataaggccgcaaaatggtccataacatgtcgatgaccatgcttcagaaggagagtttaccttgtgatgagatattttgagtttgcacttccagggctttgcccttttcttttcaggggaatggtatacagcttttgcaagtgcttcaaattctctgaatactgctgttgatcatttcagtcttgtagaagctttatggaatatatcattantctgtgttaagaagtgcctttttgacaatgtttttgacagacaaagacattattccaaaactctcaatgacgtgaagctcatcaatgct

SEQ ID NO: 53588 - DNA, 547 bp, Triticum aestivum; identical to SEQ ID NO: 50394
  Clone ID: PAT_TA_53588

SEQ ID NO: 53589 - DNA, 781 bp, Triticum aestivum
  Clone ID: PAT_TA_53589
cggacgcgtgggtgcgaggagagaaaattggtacacttttccataatgaagcaaatgtctgggattgttcgaaggaggtgacaacccgtgagatggcagttgctgcaaaagattgttcacggcatctccagaatttgtcatcggaggagcgtaagaagattttgctagatatcgccggtgctctggatgcaaatgtggatttaattatatccgagaatgaagctgatctagctgcggcacaagattcaggttatgagaaatccttggtggctaggatgaccctgaaggcaggaaagataacaagccttgctgaatcgatccgtgcaattgcggacatggaggaccctatctcacatacactgaaaaaaacagaggttgctaaggatttagttttcgagaagatgtactgcccattgggtgttctcctaattatttttgagtctcgtcctgatgccctggtccagattgcagctctagcaatccgaagtggaaatggccttcttctgaaaggaggaaaagaagctatgagatcaaacacaatattacataaggtcataaccagcgtgattccagatgctgttggtaaaaagcttattggccttgtgaaaagcaaagatgaaattgctgatcttctaaagcttgacgatgtgattgatcttgttattccaagaggcagtaacaggcttgtttctcaaatcaaagcacaaaccaagattcccgttcttggtcatgctgatggtatctgccatgtttacattgataaatcagctgacatggacat

SEQ ID NO: 53590 - DNA, 620 bp, Triticum aestivum
  Clone ID: PAT_TA_53590
gactaggtttaacccatcgccctcgtggctaaagactacatggactgtacatactatcaaaattgggtcggtcagctcattaagcagcttcagcatccatgtggggaatgtagaggcatccacatcagcattagctgtcattgatacactcaacgactgtggcaagacagccacgaccgtcgcacttgatcaacgagctagggaggcttaacactggcgcacctaacgagaagagactaaaggaagccactgaaatgaaccagaaggattttaaggatgccagtgtgctggacaagacaacagctacacgaaaagaggtgtatcactatagatacagaatatgcagagaggcgataccaccaataacactagcactctattggatactcacatgcaccctgaccataccaaaaacataaccactgtgacctgcctacataatcgagctgcgctatatgattgactccatcaatgatggtatgcgaggctgagctacatcaacgctggcctggaaccgtgaacattgctgctccttgctaacactctagcatagaaacaaaacagccgatcatgtatcaggaggctatcctacactcaccagaaccagaaggcccgaatgc

SEQ ID NO: 53591 - DNA, 754 bp, Triticum aestivum
  Clone ID: PAT_TA_53591
tacccctcaaagcttcactcctattttctgtgtttgctgtggcattcgaaagttaaaacttgatgccactcttttggacaggatcgttcaaaattcttcttattttagtttgcaagctcagatagacaaaccttatatttgtgttcaacataatagtggagataatgtaaaaaactggcaatacggccctaactatgttattgttgactcctatgaaatgtatggatatggtgacatgctttaagaatttttgttaatcatttgcggtagactcgatcttagcatctgaactttgtgcaattgtgcagcaaacttctggaaattcaaagaaaagatggtgtaaaaaaacctatattggatgataatcaagttgctcacgttctggactactttgttcccttcatcagcctgattactcaatttcttgtctcttttaccagtcagataatcaaatggaggaattgtgccaacatcaaggtcaattaatttgctttacacatgtgcattatgaatggaacattgctaactatactgtagctggtaatagcatcttcaaatttgtaaagtttgccagcatattggttacagtaatttcctcctgtaaaaataaccctgagtaatatgtatgaacccgtgactagatgagcttgacaaactgctaccattggctggagcagctattcggagtattgcagtgtatatttccttctatagctcgctggtttgactagaattttgataaaacagtagcaat

SEQ ID NO: 53592 - DNA, 698 bp, Triticum aestivum
  Clone ID: PAT_TA_53592
cccccgccctctgaagcacaagtccgagctagctagaagaagcctccgtctccaaccacataccatggcggcatcggtggcctgcgccttcttcttcgacgccgagctgctcgccgagcccggcatgccggcgatggacgcgtgcgcgctctgcgccaagcagctggcgcgcgacagcgacgtcttcatgtacagaggggacacgcccttctgcagcgaggagtgccgccaagagcagatgcacctcgacgccgtgggcgccaggcaggctgcccggcggctgcagcggttcacggcggaggcggagtgccaccgcgggcagcggcagtccaggaaagtgtccatcgccagctagccgcggaaagttttgtttggatcggcaagatctcaattctgaagaaaacaaccactgtctcttgggaggcgtctgacgtttccgtccctccgggtaccagatgcagcttggcgccgcctatgagatgcaaggcagccaggcagggcagcatcaggcggcacgaagcataggtgccctgtagcttcccggatgtgtccatggcaaacaaattaagctgcccggatgggagcaaattgtacttgttcttggtcgatctgtgctgtgccgatgaattatttcattagaaatgaaaacagaaaagtaaacgccatggatctgaagagagtaatcagacatgattcac

SEQ ID NO: 53593 - DNA, 519 bp, Triticum aestivum
  Clone ID: PAT_TA_53593
gcgatccgtcgtcctccattagctcctcctcttccccttgcccctccagatcaggtgcatgaccgcgcgcgcgctcaggtggccggcgagacctagctagggaggtagggggcgatggagcagggggaggaggacggggactggatggtggagccggcggcggggaagaagggcggggcgatgatcgaccggaagaagcgcttcagcgaggagcagatcaagtcgctcgagtccatgttcgccacgcagaccaagctggagccccggcagaagctgcagctggcccgggagctcggcctgcagccgcgccaggtcgccatctggttccagaacaagcgcgcgcgctggaagtccaagcagctcgagcgccagtacgccgcgctccgcgacgactacgacgcgctcctctccagctacgaccagctcaagaaggacaagcaagcgctcctcaaccagctggagaagctggcggagatgctgcgggagccgggcggggccaagtgcggagataatgccggc

SEQ ID NO: 53594 - DNA, 772 bp, Triticum aestivum
  unsure (1)..(772): unsure at all n locations
  Clone ID: PAT_TA_53594
cggacgcgtgggcggacgcgtgggcggacgcgtggggccgtcgtgatgcctagagcgtagagcgagaccgcgtctgtctcccacctttgcaaattcctcacaatcgcgtcgcctaaaagcttctcttgatcagaccaaccggccaccaagaatccaagcacttccgagctcggacttcttgtccccggactgggccgcgcagcatgccgccgccgtcgtccctgccgcgtcaccgccacgcacttctctagcgcgcgcggccggaccaccagtgcatacgtgccgatcgacccacgagagctgtgcctgtgctgccgccgtcggcatggacgaagacgacgtcgccagcagccacggcggccggggcagaggctgcccgtgcctgccgttctgcttctggggctcccgtgtaccggccgcgccggagcggcggaggcgtcgccggcgcaggttcaggctcaggctgaggctcagcctgtcgtggttctcgtggtcgtggcggtggctccggaagagccgcggaggcaagagctcggaggcgggcggcaagaacaaggggaagcggaggaggaagctgctgctgctcctgctcaggtcgctgcaggtcaagaaggcgctcgcgtccgtctcgtcgggaagcagcttcctaccaaagctgcangttggcggctccggcggcgccaagaagcanaaacggagcaagccatggcgaacggtcgatgacgacgccgcaccaccacgagctgcgctaaagagacgcgcctgtgcggcc

SEQ ID NO: 53595 - DNA, 370 bp, Triticum aestivum
  unsure (1)..(370): unsure at all n locations
  Clone ID: PAT_TA_53595
gtggtggtgcgcaaaagtttcgggttaagctgctgccagagggtgccggaagccctaccgatgtgctttgccagattggtctggatggaatccgcatgcttgatcccagcacaagcaggaccctaaggatttatccccttgatacactgacgaaatgggaggntttggatncaactgtattagcgatntgggcaaagactcgagnagatagtgaaggagaaggaataagggccaagctaaacaggcatcggctggatactggtggggacctgaagcctaagctgcacggatgctccgtctaggggctgcagttcgccatcggccatgcgctcggtggccacatgcggggtcaccgtgccatggccgctgg

SEQ ID NO: 53596 - DNA, 418 bp, Triticum aestivum
  unsure (1)..(418): unsure at all n locations
  Clone ID: PAT_TA_53596
ctggatcccctcccatcccatcccacttctcccccgcgctcctcctccccgtccggcgcatgtaagctcctcctccccgtccgccccgcccgtccgagcggccatggcgtccacgctgctgcgcaaggtgtggggcaccgtgctggcccgcgcggtgccgcgcgacccggacgcctccgcctcctcctcctccccgcgccgccgcggcgccccggcggcggcggcggcggagtacggctccctgggcgcgctcgacgcggtgccgatcgacgtgctggcgcagatcctgcgcctgctgggccccgccgacgccgcgcgctccgccgncgtgtgccgcacctggcgtctcctcgcctccgacaacgcgctctgggccttcttcctcagcctcgggcccgacccctgggacctcgtcgtc

SEQ ID NO: 53597 - DNA, 215 bp, Triticum aestivum
  Clone ID: PAT_TA_53597
acgggctctcgaagctagctcggcacggtggctaatctagagatcggcttctacagtaagacatgccccgacgctgagaagatcgtccgtgaggagatggccaagatcatcgtcggcgcgctcaggctagacggttcgctacttcgtctgcattggcactactggcgctccaggagctcggaatgccgacgcccagccacaatcctgggtggcgc

SEQ ID NO: 53598 - DNA, 564 bp, Triticum aestivum
  Clone ID: PAT_TA_53598
aacctccggcgccgccgtcgccgcgtcgctgctcgacgaccacctcaagccgctcggcatcggcggcacgggcccctcgtccagctcccgcgccgccgtcgccgcgccggcctgggcgacctcgcccagccacgggattgcgttcgattcctcctgggcgctcctcgacgacctggagatactcgtcaagcgcctccgctccaagcagctgcggaagacctcctccatcgacaccagcgggggcggcagcaatctcgactccttctctgaggccggctggtccagggagatctccgcctccgccgattcgggtttggcgtccgcgccgtgggacgagacgagccgggactacctcaccttcgtcaaggagctcgctgttctccgcacgcgcgcggacgcctcccgctctcgcgaggaggccttcgacaaccacatggtcatcggccgggcgctctccgagcaccgcctcttccgagacgcccttgccagcttccgccgtggctgcgagcttcagcccaccgacgttcgtccgcacttgcgcgctggaaactggctgtacaccct

SEQ ID NO: 53599 - DNA, 697 bp, Triticum aestivum
  Clone ID: PAT_TA_53599
cccacgcgtccggtgtgcgtgatgacggacaagagattgctgtcaagctgctcaatgctaacttgcaaacaattgataatgaacaattcacacgtgagtttcgtaaccttatgatgctaaagcatcaaaacactgtacggttagttggctactgctatgaaacacaacatcaacctatggacttcgaaggaagatttgtttttagtgaaagaatacataaagccctttgctttgagtatatgcctcaggggagccttcacgaccgtctttctgataaatgtaatgtacttgattggcaaacacgttacaaaattatcaaagggacgtgtgaaggtgtaaaataccttcatgaaggattggaaaaaccattttaccatctggacctaaaactgggcaatatacttctagatgaaaacatggccccaaaacttgccgatttcggtctgtccaagctcttcaacgaagaacaaacctgcagggtgacgcaaaatttacgcgcaggaactattggatacatgccaccggaatacataaatggaggcacggtctcaaagaagtttgacatattcagcttgggtgttgtcatgaccaagataattgcagggcctagcggccacaccaaatgtgctgaaatgcagcatcaagggtttcttgatcaagtagaaggaaatttggagaaaaagtttgaaagatacat

SEQ ID NO: 53600 - DNA, 546 bp, Triticum aestivum
  unsure (1)..(546): unsure at all n locations
  Clone ID: PAT_TA_53600
acaaaaaggtgaggcgggaagcaccaaataacaaagtgggcagattagcaatggcttctgcttcttgccttagcttactggtgctagtggcaatggcctccgcggcgtcggcgcagctgtcgccgacgttctaccaggcgtcgtgcccaagcgcgctgttcatcatccagactgcggtccaggccgcagtcaacaatgagccccgcatgggggcgtcgctcgtccggctgcacttccacgactgctttgtcgatggatgtgacgggtccgttctgttggcggacacggggagcttcgtcggcgagcagggggctgctccgaacgccggttccattcgtggcatgaacgtcatcgacaacatcaaaacccaggtcgaggccgcgtgcacgcagaccgtctcctgcgccgacatcctcgccgtcgccgcccgtgactccgtcgttgcgttgggagggccgacatggcctgttcttctggggaggagggactccaccaccgcaagcaagaccaatgcagagaatgaccttccacctnctaccttcgacc

SEQ ID NO: 53601 - DNA, 124 bp, Triticum aestivum
  Clone ID: PAT_TA_53601
cccgggatcgaacccacagcgtccggagcgactcccagcatccacatgcgaaaccacctaccagacgcagcttcgacaagaagaaaggtagagatgtgacgagaagaagagaagatagcataga

SEQ ID NO: 53602 - DNA, 409 bp, Triticum aestivum
  unsure (1)..(409): unsure at all n locations
  Clone ID: PAT_TA_53602
ggaaccaacaaatcccaagctaatctcgtctccgatcgactcgaggcttgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattccccctgaccagcagcgtctcatctttgctggcaagcagctggaggatggccgaaccctcgctgactacaacatccagaaggagtccaccctccaccttgtnctgcgtctgcgtggnggnatgcagatctnncngaagaccctnaccggnaagaccatnactctggaggnngagagctnngacacnatnnacaatgnnaaggnnaagatnnaggacaaggagg

SEQ ID NO: 53603 - DNA, 725 bp, Triticum aestivum
  unsure (1)..(725): unsure at all n locations
  Clone ID: PAT_TA_53603
cttgtatggcagcctattctgtaatctgttcaattacagagcttatgattatgtgaatgaagcaagggatctgagaaaaaaaagttattcctgcccatgtttatgtcaaggagcatcaccgtcggtgttcaaggaatgccattgattgtattatcattattatccgtcacaaatttggattctgaattctttcagaattcgattatcttggattgagacctaccgcactgagccttcatcatgtgcttccgaaatagccctgccatctacaatttggcagtcagatggtgatctgaaacttaaaatggagcaaatggccatgagctctaacaaatatgaggttttctatcacaagatacctcagctgcacgacaacagagccatgggtgccgagggcgggcactggtggtcggcagaaggcgctgtggaggtgctcgctgctgcccggctctacttgcacgccaccaggttcagaattggcatggacctgggcgccgccgcctttgcagctgctccctgctgctcagtacgtagccggctagccgccgtcgaggaagagtgattcttgtggcggtgccgctgagtatcatgtgttgccgcttgccagccaggatcatgtgttgccacccatgatagggcgcccacgtctctacaacaccgtcatctctgttgtgaggctccttgnagatcaattagggcaggaactaaccatcttctcatctgga

SEQ ID NO: 53604 - DNA, 577 bp, Triticum aestivum
  Clone ID: PAT_TA_53604
cagtaacagtaatcacagtccaagacaatggttgctcaagcctttaccgtcgatttggacaagcctcttgtatttcaggttggtcatctggaggaacagtatcaggactgggttcaccagccaattgttagcaaagaggggccacggttttttgccaatgatgtattggagttcttaacacgtacgaaatggtgggcagttcctctcatttggttgcctgttgtttgctggtgcttgaatacatcaatccaaatgggccacacagttccagaagtagcgctgatggttgtggcaggaatattcatctggacactggttgaatacgtgctgcatcggtaccttttccacatagatactaaaagttactggacaaacacagctcactaccttctgcatggatgccatcacaagcatccaatggatggacttcgacttgtgtttccaccaactgctgcagccatcttgtgctatccggtaaatagtctctctcatcgattgatagcagaacaacactgttagtggcacccatcaactgaagcatggcaacacttttccacatttgttctatatactgctt

SEQ ID NO: 53605 - DNA, 233 bp, Triticum aestivum
  Clone ID: PAT_TA_53605
ggcgggtgcactgcttctcggagatgatcgtcggcctgcgcatccacggcgagctcgtcgtcgaccccaagctgatgcccaacggcaagagcatcaaggacttccaggcgctcctacagcacccctacagtggacagccgttgtcccctggcatgggacatctacgtgttttggttcgcacaggtctgggcggcgcagcgcgccctgtattgccgggtcgggctctccggggg

SEQ ID NO: 53606 - DNA, 729 bp, Triticum aestivum
  Clone ID: PAT_TA_53606
cggacgcgtgggtccgccatcaagcagacctcccccggctcaccgccaccccccgtgccgatgtgctaatggttgcgctgcctctgcccgatgacgccgtctacgtcgatctgaagcccacggaggacggggacgaggtgggggaggagatgcaggtcgtaaggagatgggaggcgctgcagtcggtccgggtcgcgcggacgtcggggtggatgcagtgcgccggcgacggccccgttgtcctcgactcatcagatccaacctcttgcccgcgccagctgctgacggagtagtcggtgaagggaggcccgttcttgccgaccactggcgttgcgtcgtgctaccgagcctctgcaactgtgtcgtgatggtgagtccatcgtccattcattcctctgtaactcgcacacattctaattcgttgtcgttttccatgtgtgttttctgcatcagcgtgcatgtgtattcttaataggagtatcaaattttggttgtgtgaacagaaggcctttttgtgtgtgctctagcctcagactgttgcatcatgttcctgatatagagttgtatacttgtattaggggtgctcaattatcctgtgtgtttccgctctgtttaattgatgtttcatgaagggatctcaatttgattatgtgtctaattgtcgtatccgtttggtttgatcatccaagcagggtacttgagaaggttgtccttccactcgatgttgca

SEQ ID NO: 53607 - DNA, 545 bp, Triticum aestivum
  unsure (1)..(545): unsure at all n locations
  Clone ID: PAT_TA_53607
gccatgcgtgcgggagtgaggcgacggtggaggccacggcccgtaccagaactcggggcaaaaatagggggcaggtcagggcacggatcagaacgccacacataaagccatgcctgtatccatgaagatgcctaacaagatccgtgcctgagccggggcctgaaactcctcctagaactcctactgggctagaaactgggctgcagcctaggccatagcataagtcattaatggagtgaccaaaggcgccttcaaaggagcctggacggcaacgggcacggtcactggcgctgtgcctgctgctgcctgatctgcaggggaatggtcagcataatcatgaccacgaccacaaccacgacgaccacgaccaccacctgggccgtaggctggatcaaatggatgattaactccagttttatatcgattcttatatcgatggatgaatcatacgatgacacagacaagggcatacacgatgatgcgtacgatcatacctgccatcttaccttgtctctgctcctggtcgctctntggattccttgtcg

SEQ ID NO: 53608 - DNA, 472 bp, Triticum aestivum
  Clone ID: PAT_TA_53608
aaaaaaaaaaaaaaaaaaaaaaaaaaaaaaaaaaaaaaaaaaaaaaaaaaaaaaaaaaaaaaaaaaaaaaaaaaaaagaacaaacttattaaagggtgacaagctaaattaaaaaatcttggccgaggaaaaacatcttttgtttctggggcaacctttgtttatcgggccttcttggcacagccctgtagtttccctttttcctggcgttgcaatacttattcgtttggcagcttttgctctttccgacgggggccgttcctgcggggcgtcccgaacggtccctgttttgaatcattattggagcccgctttgttgatgcccctcaccctgggcggttgtgttgctaacggcctgtgtgacggttcctctcctcagggcccttccccttgcccccgtcctttggtcccctcctttaggctccttttttgccgctttttcccggggggccgtatttcggggccacccttta

SEQ ID NO: 53609 - DNA, 781 bp, Triticum aestivum
  Clone ID: PAT_TA_53609
caaaactgatccgtgacagtgccctccagatgctggagacactctctctccgtgaatgggctgaagatgatgctgatggcattggacattatcgggcatctgttgttggcaaccttccagactcctaccaacaattccagtacaagctgtcctcaaagctcgccaaggaccatcctgaactcagtgagcatctatgcggggaaattatgcagcgccagcttgacgcagtggacatcatagcacagcatcaggtcctcacatgcatggctccttggatagaaaatctcaactttgtgagattaaaggagtctgggtggagtgagagattgctgaaaagtctttattacgtgacatggaagcatggtgatcagtttcctgatgagattgagaaactatggagcaccgttgcaagcaatactcgcaatattatccccgtgcttaacttcttgattaccagagggatagaggactgcgatgccaatccatcagcagagatcactggtgcatttgctacgtacttctcagttgccaagcgtgtcagtctatacctagctcgaatttgcccacagcagaccattgatcatttggtctgtgagttatctcagagaatgcttgaagagaacgaggaaccaatcaggcctgggaagtttgatgcttctgcaaatgttgtgttggagtactctcaaggacctactacctctcagatatcatcagtaattgatagccaggctgacatgtaccctctgcttgaacgtggttctcttgatggcgcaatcaggaa

SEQ ID NO: 53610 - DNA, 626 bp, Triticum aestivum
  unsure (1)..(626): unsure at all n locations
  Clone ID: PAT_TA_53610
gactagtaatacctgccatacccgaaatgcagaagacctggactacagtttttgggtttaagcctgttggccctatgaagaagcaaaaaatgaagtcttttaatctcttgattatccatggtactggtcttctggagaagcgcttgttgctaacagctcaagtgaatcgacaaactgcttctgtgacagttaatgccgttgaatgtgacaagacagcttctcaaacgtttggggaagcaagtggatcccttacacctgtttatgtttctcaagaatttgctgtgggtggtcatcctgaaactaaggatcatgacacttgtgctttgattgagggctcttcaggcttggcatctaaccttcctcctgtttctgaagaaaaaactgaagaaactatttcaacagtttccatagctgatgttaatttgcatataagtgaagatgacatgccttgcaaggctttagctgacattacggaaaaagtgaaatatgcagaaacagatttgacattggttgctgataagattgttgtanaagagaagcctgaagataaatctagctccagttctgcagattcaaaggctattccagggacaggggatccatgcccatgtttcatttgatgagct

SEQ ID NO: 53611 - DNA, 543 bp, Triticum aestivum
  Clone ID: PAT_TA_53611
cccacgcgtccgcccacgcgtccgccaaaaccaaaacaaataccaacacacacacagccagccagccagccagccagcgaaaaaatccccccaccccgtccctccctgcaatagcaaacacgcggacaaaaaatggaggcatgaacacgccctcctcctccgtccgcccctcctcccccgatcccgcccgtcggcagcccagcggccccgcccccccgccccctcctcgccggcggcgccctagctcgtaggcgcgcgtgagggagggaagcggcgcgcagcgacgatgccgtcgcactcggatctggaccggcagatctcgcagctgcgggactgcaagttcctgccggacgccgaggtcaaggcgctctgcgagcaggccaaggcgatcctcatggaggagtggaacgtgcagcccgtgcgctgccccgtcaccgtctgcggcgacatccacggccagttctacgacctcattgagctcttccgcatcgggggcgacacccccgacaccaactaccttttcatgggcgactacgttgaccg

SEQ ID NO: 53612 - DNA, 387 bp, Triticum aestivum
  Clone ID: PAT_TA_53612
cccacgcgtccgatgagacccatgcctggcatggttggtctgatatcttctagttccaaggagaagaggaagccaacgccaaccaaaccatccgatgtcaaaaggacacgtagggatcgccgggaactggaaaacattatattcaagcttttcgaaaagcagcctaactgggcactgaaggctctagtgcaagagactgaccagccagagcaattcctcaaggagatattgaacgacctctgtatgtacaacaagcgagggccgaaccagggcacgcacgagctcaagcccgagtacaagaagtcgtcagaggacgccgccggtgctgctccgtgaagatgattcgagtatacgactgctgttgtataaccgagtacctgttgggtt

SEQ ID NO: 53613 - DNA, 328 bp, Triticum aestivum
  Clone ID: PAT_TA_53613
ccggccagcaaacacaaacgagcttctctttctcctcctcgggttcagggtaattggccggagttgaagacgaagccggcggtgaagacacgagggggatcatcagttcatcacagagatcgaacggccatgtgtaacaacagcggtggccgcggcggggcgagggcggcgaggaaggggccgtgggcggagaacgaggacgcccaactggtatggttcgtgcgcttgctcggcgaacgccgttgggatttcttagctcaggtctcaggtttgcgcggtggcggttgatcgatccaacctgactctacgggcaggggcgatgggatgg

SEQ ID NO: 53614 - DNA, 623 bp, Triticum aestivum
  Clone ID: PAT_TA_53614
cggtcgtgtgcgtgcagacggacaaggcgtcgctgcttgccgaggtgctggagcatgtgaaggagctgaagcggcagacgtcggcgatgacgatgatggcggctgccgtcgggggcggcgaggatgacgacgcggcgccggtgcagatgctgccgacggaggccgacgagctgggcgtcgacgcggcggaggacggggatgggcggctcgtggtgcgggcgtcgctgtgctgcgaggaccgcccggacctcatccccgacatcatccgggcgctcgcggcactccggctacgcgcgcaccgggcggagatcaccacgctgggcgggcgcgtccggagcgtgctcctcatcacggcggaggagggtgagtgcgctgacgagggcggtgacggtatcgacgaggagtgcgccgcatctcaccggaggcacgagtgcatcgcgtcggtccaggaggcgctgcgcggcgtcatggaccgcagggcggcgtgcagcaacgacacgtcgtcgtccggcggtggcggcgttagcatcaagaggcagcgcatgaactacggagcgcatgagcagtgctcagtttatccactcgccgttattatccaagatcgcaagagctgaatgcactgc

SEQ ID NO: 53615 - DNA, 722 bp, Triticum aestivum
  unsure (1)..(722): unsure at all n locations
  Clone ID: PAT_TA_53615
ggcaccaaaggggcgccgcctcctcctccgccgccaacaaggtcgaccggcggcctccgaggattacatctaacgtcaagcagaacctgaggatcgtcaaattctggaaggattacgaaaggaggcaaacaaccgggcctcagcctgccaccaggttccgcaaaaagaaaataatgaaggaggtgcttcctgatgacacagacttctatgaggacccttctgccactcttacctggtcaggcctgtctttcctttcatatctagtaggctggtgattcgacgagtccactgaatttgtgccgttgtttcctctagcacaaatgacggcagcgtggagattgcctcccctgttattcttgtggacggctacaatgtatgtggctactggggaaagcttaagagtgatttcttgaacgggaatcaaggaattgcgaggcagatgctcattgatgagctggtatcgttcagtgcagtacgagagataaaagttgtagtggtatttgatgctgcattgtctgggcaatctacacacactgaaacttataaaggggttgatgtggtatattctgctgacttatctgctgattgttggattgagaaggaggttgaagcttttgtggcagatggatgtncaaaggtctgggttgtaacgtcggatgtactggagcaacagttatcacatggtgaaggtgctcttatttggagctttaaaagactggtta

SEQ ID NO: 53616 - DNA, 534 bp, Triticum aestivum
  Clone ID: PAT_TA_53616
ccgaaatccatccatcacgcccttggccttggcagccgcagcagacgactcgcctactctgcgcctgcctgagccggggacggggaagaaggagaggagggagccgctgacggagtgggaacaagaaccacggcaggtatcgactgccggatcactgtagcaagatgagcgacaatctcatggacaaagttaacgccctgggcgagcgcctcaagatcagcggcgcggaagtcagccgcaagatgtccaccggcgtcactagcatgagtttcaagatgaaggagtttttccaaggccagaacatggccgacaagattgttgacgaggccaccttggagaccatggacggccccgattgggctaccaatcttgagatatgcgatatggccaacaccgagagggtcaacagcgtcgagctcatccgcgccatcaagaggcgaatcatgctcaagagcccgagggtgcagtatctggctcttgtcctcctcgagaccattttcaagaactgggagaaagctttttcccagattgctg

SEQ ID NO: 53617 - DNA, 525 bp, Triticum aestivum
  Clone ID: PAT_TA_53617
agggaagccagcgcatcatacctcatcagccgctaccggaatcttcaccgggaccggcaccgggcagggggacagagccattgattcattccccttaccctcgaccgaaattggaagtggatcaaaggagaacaagcaagatccaagtgctctgctctgctgccggccggtcaagatccaaccttgtaccaggagagcgtcctgagaagggaagggaagggaggatgctgccgcggcacaagggaagggaatcggcggcgtcgtcgacagattccaccttataccagtgtgagccctgagtgcgcccacatcgtacccgacaccaagctcaagaacaagattggaaagaccctgaacgaacacaaatggaacgccggcttcacacaccagggatccctccacatcgcctctgttctaaaccggtattcagagcggtggtgtgcacccttcaatcaggggagaggtctgggagttcctgctcggttgcttttatcccgagagcacattggatgaccgcggccacat

SEQ ID NO: 53618 - DNA, 417 bp, Triticum aestivum
  Clone ID: PAT_TA_53618
gtaggatctgttttttgtctccctttgtcgcattactttgtttaggggctactcttgaaacacgttgggcattgtatgccattattctgtcaagctcatttgttgggcttaataacgaattttgaactagttccgcaaaaaaaaaaaaaaaaaaaaaaaaaaaaaaaaaaacaaaaaaaaaaaaaaaaaaaaaaagggcaaaaaaaaaaaaagaaacaaaaataaaaaaacacaaaaaaacaaaaaaaaaaaatattaaataaaacaccactaaattaaatcaacgtgccagaagtttaaaaacggaaaaaactgcaaaaaccctgaagtaacccaaattaaaaaaacttagaaaaaatccccaatttccccaaataaaaaaaaaagcgagggggccgcgcacagaaaaaaaattac

SEQ ID NO: 53619 - DNA, 568 bp, Triticum aestivum
  Clone ID: PAT_TA_53619
ctaaatcttgatgctatttaggtgccaacaagttagttttgttttttacaggtttcagaagtaaattgagcgaattcactttgcaattcttggggaaaaagttgacgtttatcatgatgggattctgttatataattttgatttggttaggcgatttcctttcaatttcatttggggcgaaataaaccgttcttgttttatttatttttgtgcaagctgattgggtattagtcaacgcaggagtatgaaggttcagttgggtggctagtctggctcttatcctgcatcgaatcatcttttgttttccacaaatattgcgcttgaaataaatttatttggaatgcgttggcatctttcatcggtcctagcttttcaagatgccaatttaggggcaattcagctagattccgtgtgttgtttcggtgtcattgagcggatcagtgtcctcatttctgtaacttgctgtgcttatggcaccaagttttgtcagttcattctgcaagtgaattaaaatttcatgtagtagtgaatcagaacgtacaagataccattgagcgtttgggatgcc

SEQ ID NO: 53620 - DNA, 648 bp, Triticum aestivum
  Clone ID: PAT_TA_53620
cacgacaccgacaaggtagctacccttcgcgcctatcggcgggcgacggggttgtgcttcacttgcggggagcggtggggacgcgaccatcgctgccctgcctgagttcccctccatgtcattgaagaactgatgcagatgttggaaactgaggacaatgtgatgccgactgaaaacgagcagcagagcgatgaggtggcaaactgcgtagctatatctttccacgcgctcgacggcactgcatccccaaaagcgctccagctgcaggggtgggtgggggacactaaggttttgatgctcattgattcaggcagcccatcgtcgttcatcaaccaggagttgatcagaacggagatctgagcaactcctctgctcgccgacttcgtgtacgtgtagtagatgctggcgaattagcatgcacacatgaggtggtggattgccaatggtggagctagggccaacagttttcttgcagtttgaaggttcttcctttgcacggttacgatatcatattgggcatggactggctggagagccacagccccacgcaagtggaatgggagaagaagtgcatcgagtttcaacaccatggtagctgtatcagattgcagggactattgaaccgggggccatagtgttccttggcat

SEQ ID NO: 53621 - DNA, 573 bp, Triticum aestivum
  Clone ID: PAT_TA_53621
gcgagtccatgatcatcgtgcaatacatcgacgaagtgttcgccggcaccggcccgtcccttctcccagcggacccctacgagcgcgccgttgctcgcttttgggtgccctacgttgacgacaaggtttaaattttcctcaattggttgaactagtagtatatgttcttttccatttagatattagtaaggcatcgaacaaaggatctgtgaccattattttctatgcacatattggtagaaaattataaaagtaagtcctatccatcctagaatgatatagttataacaataatacaaactacaaaaaaaaatcgtgtagaagctagcggccaataataatactagaagtttgactgtgctttactgatcactgaagactgaactagatttcttttcctggagatcgaagactgatccctagctaatatgatgtgatatgcagctggtagccccatggaggcagtggttgaggggcaagacagaggaggagaaatccgagggaaagaagcaggcgttcgccgcggtggaggtcctcgaaggggccctgtaggagtgctccaagggagggggc

SEQ ID NO: 53622 - DNA, 627 bp, Triticum aestivum
  unsure (1)..(627): unsure at all n locations
  Clone ID: PAT_TA_53622
gggtagcaatgngaacccaaatgggacatccaagttagcttgtgcgacggtcaacttggagttttccgtggggggtgtttgcacctgctcatacatcttgatgggctggcaattgttgatgcacaagggctaaaatggaggaccatccccgtgccaaatttcatcgatccgagtttctcgggtttcatcggaaaatctgcaggacaactgttttatatcaactctgacgacagtgaagaaggatatggctcgacctcattctcaactatatctgtctacgttctcggtagcgggatctataactgggatgcgtcttatttggacgacggatgcacgcattggatattgctgcacaagctttcagaagtgattccaaaggagaatttttgtctcggctgggacctcaaagtcgtcggagtacacccacatgccaatatcatctttatggctgatttcaacaataatgaactgttggcatatgatttggatcatcgtgaaagtacatctgtacaccacattgagcggacctacctcgcgcatgagcaatatttcccatatgtgccgctgctgtccaacctaccggtgccaactcccagttgatgaatattccacctgttgaaaaatggg

SEQ ID NO: 53623 - DNA, 302 bp, Triticum aestivum
  Clone ID: PAT_TA_53623
aaaaaaaaaaaaaaaaaaaaaaaaaaaaaaaaaaaaaaaaaaaaaaaagggaggaacgctttaaaggaatccagatttacgtacacaaagcatgcaaagtgggagggtcttttttagggaccccttttttcattgccttgcccggggtttttcagcgttttgttggggaaacccttgtcgattcccatgttcgtcgtcttactgcgcgtggcttgttcaaccgctggcgtaccagagatgaggcccgtcccgatcgcccttctttacggttggggagctggaacggggaggggcacgccccc

SEQ ID NO: 53624 - DNA, 598 bp, Triticum aestivum
  unsure (1)..(598): unsure at all n locations
  Clone ID: PAT_TA_53624
ggagaggcccgtccgtcatggacggtcctcgccggctcctcgcgctcgcggtccttctcgcctcggcggtcggagcggacgccgccggcctcttccgcgcgccgcccaccgggtacaagtacaacgcgacctttaccttcaccgggcaattcctcgtcctgctttcctgcatgggcccggccaacgacacggcggcgtacgggcacggcgggatcatccacagctgcacgctcgaccagctcaaggaaggcagctccgcgccggagacgacgcccttaaagttcaatcatgggcacggccacccggccccgtcgccgcgcgcagcaccgccggaggacggcctcctgcaagctgcagcagggggagagcaggagcagcacgcaggcgcagctccagcgatggctcttcctcttggtcgacgtcgacgtcgcctccgacactgcctacagcggtggctcttcgccaacggcaggaccatgctgccgcgcagcttggacgcggtcaatcacgggcacaggcagggccacccgcccccctcgccgtcagggcacgcagcagctccggagaacggnctcctgcaagctgcagcagggggagc

SEQ ID NO: 53625 - DNA, 646 bp, Triticum aestivum
  unsure (1)..(646): unsure at all n locations
  Clone ID: PAT_TA_53625
cttcagaaagagtcgagaccgagcgagctagggtttggcgcggcgctcgcgagaaggaagatgagccgcagccttgggatcccggtgaagctgctgcacgaggcggcggggcacgtggtgacggtggagctcaagaccggcgaggtctaccggggctccatgatcgagtgcgaggacaactggaactgccagatcgagaacatcaccttcacagctaaggacggcaaggtgtcgcagctggagcacgtcttcatcaggggcagcagggtccgcttcatgatcatccccgacatgctcaagaacgcccccatgttcaagcgcctcgaggccaggataaggggcaaggggtcggccatcggcgtcgggcgcggccgtgctgtcgcaatgcgtgcccgggctgctggtggacgtggtggtggccccccagttggaggaggacgaggtggtgcgcctcctgtgaggaggtagatgatgtgagctgagccgctgtctgagtcgaggaaggaactcgctgctgtctttgctggcgaaacaaactgctgcggcagccatgcttgtgagcttatgatgtgcctctagtttagtttgtcggtttttgtgaaccgatttctttatgtatgatgatgatgtattngctgttgttagc

SEQ ID NO: 53626 - DNA, 643 bp, Triticum aestivum
  Clone ID: PAT_TA_53626
cgcatcccccgaacaccagcgcaaaccccgctattccgccccgtccccgtccccgtccccgtccgtctcgccccccacctccgacgattcgaggcccggggctcccgtgcggcggcggcatgaggacggcggcgacggcggcggaggcgcaccagtcgcggctcctgtacgaactgggcgcgctgctgctgacgatcatccggtcgccgctcgggccgggggaggagccgcggcaggtgacggcggccggggtggcgtccatgatgctgggcgcctccatggcgctcatgctctgcggctccgtcaccttcatgctcggcttcttcctcatgccctgggtcgtcggcctcgcctgcgtcttcctcttcgtcggcttcctcaccaacctctccgggatctggagggccatcctctgctggcccgccgcatgctcctcctcctcgccccataaggacgcctccacatggcatatatttccaaagcctccattcatgtagacgtgaagtcgaataccgagcagcgatgtacagaagaagcacatgagtttgggcagcagtattttccttcctgggcaacatttaccatgtaacaaatgcaacagggctaaatggggtgatacttataactaggaagatacatcttg

SEQ ID NO: 53627 - DNA, 443 bp, Triticum aestivum
  Clone ID: PAT_TA_53627
caccaacgggctcattcagcaaacaggcaagctacccactcatgccacactctatactactccctccattccaatatatagtgcgtgtagttctcagcgcacataccaatgaatgagctggaggctgtcctttggacgatcataccccactcgtcccatccctctccaagagtactagtacatcttttttctctccgcatctcatttcgctccttctctacactaagccatggcacagatcgatttaagcatcttggatttaactcacacagctagtgcgttgattgatttgataagcagaggacgaactgagcatacgcatgctgagcctcggggcgtatcggacttgaaaaagtagccactgcgtgcgtgtgctaatcggtcgaagtggcagcgcgccattgcagcttggtctcgccggtggtatgaccttacgacttggt

SEQ ID NO: 53628 - DNA, 328 bp, Triticum aestivum
  Clone ID: PAT_TA_53628
aaccagcccgtccacgtcccccagctcgagggccggaggtgcggcgagtgcagccaggtcctcccggagagctacgagccgcccgccgacgagccgtggtccaacgggatcttcggctgcaccgacgaccccgagagctgggcacaatgctggagctggtaggcaagctagcacccatggattcgtgaactggcttggatgtgtacttggtcgccggggttggatgaggacgacggtaacgagggtgactagtgatgcgggacgccaagcagcatcaggggaagggggtctcctgctcgaggaggcggatgagtacgggcgcacccag

SEQ ID NO: 53629 - DNA, 718 bp, Triticum aestivum
  unsure (1)..(718): unsure at all n locations
  Clone ID: PAT_TA_53629
ctcctctcctcgtttctctcctccgcctcttccccgtggggggccttgcggctgcagcgggctgagagtcaagggggcgagcaggattgggggccaactgattcttcgccggatctggagcccagaggcgccgccggtgagaccggcctggtgttgacggggcgatgaagtggtcggaggcgctggatcggcagccaatatgtctgcaacgacggcaagacggcggagatcgggcacgaccggtgctaaaggaattggcatcgtcagttgataattaagtttgcctcgttatttaatctgctgggcatattgactctgtggctaaggtctgaatagataatattgaggagtatacacctattgtttacacaccgactgttggcgctatttgccaaaattacaggggncgtgtttagacggcctcggggaatgtatttttgtgcagaggatcatggtgaaatgatgttcatggtgtacaactggccagctgattagctatgcattggttcttgtccattcattgatttggtattctgtagttcaactcttcaagtgtgtcttaaagggcgtcgttcttgccttcgagctgtctgtcacgccgtcgccatcacctattccctcgccacgcgggacacagagatgggtgaggacgccaataggaagcttcgttgccgtcgttctcgccatcgagccgcattgccattacctagccccttgg

SEQ ID NO: 53630 - DNA, 680 bp, Triticum aestivum
  Clone ID: PAT_TA_53630
gcggaaccgaataatcagcccctcgcctcaagcctccaaccaccgccggcagatccccaatcccgccctcccgaccccccgaacccgagcgagttcgagcgatggaggcagcagccgcagccgccgtggcgctcaggtcgccggccgccgccggagccgcgccctcgcgccgggtcgccgccgccgccagctcgctccccttcgagcggaggcgcagcttcgccctcggctccatcaagggcctcgggcggcggcagcgcacttccagaaggctgcgcggcgtgatcagggcatcctcctcgtccccgtcggagtctctgccatcttcttcgccgatcgcgccgctgcaaatggagtcgccgatagggcagttcctctcgcagattttggtcacgcaccctcacctgctccccgctgccgccgagcagcagctcgagcagctccagaccgtccaagactctgcagacaagaaagacgcgcaggcaccgccggcagccggcgacatcgtgctgtacaggcgaattgccgaggttaaggagaaggaaaggaaaaggaccatggaggagatactgtacgcgctggttgttcagaagtttgttgaagctggcgtcttcttggtcccagctctgtctcactccatcgatgcttcttctggtagagttgatcagtgggcagagcat

SEQ ID NO: 53631 - DNA, 175 bp, Triticum aestivum
  Clone ID: PAT_TA_53631
gggcactagcaatccccaatctctccccttttaagcaggagtggtacatcttagcaaggaattacatcacaactcaggggttcatgggcggcctggaaaagaggcagccgggcagtggaagaactatacaactggccctgcgcgaaggacatactgcggcgggccaaaacactgg

SEQ ID NO: 53632 - DNA, 320 bp, Triticum aestivum
  Clone ID: PAT_TA_53632
ttttaaaaccgttagtattattggggggtatttttcctcacattggctgtagtacacttacacgtgcattaagttaacgatgaatcgatgatgagtatgtatgtcattgcagacaggaaaggttttttcgtggagataaggttgtaatggaggggtcctactttggtgcttacacctgtacaactgcttccaaaccttagcattttgcctccagcatactctcatcccaaaatatacagcaggaggggtcatgggaacaatcatggggatctcgccggctgaaaagaataatgtgaccgagaacaagctctgatgatgcc

SEQ ID NO: 53633 - DNA, 248 bp, Triticum aestivum
  Clone ID: PAT_TA_53633
gggggaaaggttcttggtgaaccaaatgagcaaaaatttgggccatgggagggctgggtggggggggatttggatttttaatccccatccggaaccccgggggtgctcgttcatcaaagttgcaagaaaacaaaaggggcataaagcggacccttttgcttgtttgggcaaaaccaactggtactactactacgggattcactgacctgacctgacctttttggggggctctccatttttgggtgaac

SEQ ID NO: 53634 - DNA, 481 bp, Triticum aestivum
  Clone ID: PAT_TA_53634
gctgcttgctaagtgctttctattaagattatttgtagcatcacatacatgcatagctacatggctaaacactgcgtgagaaagtacaagtagaatggattgttagacagtcacggaacgcaaccacggcaaaaagaaaagaaaaaaagtcaggcgcgcgtctagctactacgagggctacccggtcacgtaggtgggctgactttttttttttttttttttgcgggaaaggtgggctgactttgcatgcggctaaaaagaggctttggcgccacagcgatcgaacggccccggaggcggctgatcaaaccaacaaatcatccgcctgtttttaaacatttcccgggtatgaaatatgtgtctccgctattacagcatatataaatcactagaccgagctgctcggggacgtggcgtcggccgcgacctgcgaggtctgacccgacttgagcatgaacccttcgactctgccgccggggcc

SEQ ID NO: 53635 - DNA, 182 bp, Triticum aestivum
  Clone ID: PAT_TA_53635
caattcttgggattcactgcttgatattacgggctagccggtgtgaggtttaaaactggtgcaggggtaggagtgcagctgggggaaacgaaaacacaagggaactgttctttacaatgaagttctaaatgaattgttggaaggttcgaggtttataaaaccagtgggggtgggggtgagtg

SEQ ID NO: 53636 - DNA, 613 bp, Triticum aestivum
  Clone ID: PAT_TA_53636
agcagcagcgcctgctcgacctcgccgcggagctggaggaggagcgccgcctgcgccgcgcggcggaggagtccctcgcgagctccgagacccgcctcggccgcctcaaggcgttcgcgcaggacgcgctgcggaagcgcgacgacctcaaggccgagtccgccgcgtcgtcccgggcgctgcaggcgctccaggccgaggcggccaccgcctcctccatgctctcctccggcctcgagcggatctccgccaaggcgtccccgtccaccccgcccgccccgctccccacctccggcaagtactccgccggcctccccgccctcgcctacggggtcctcaagcgcgccaacgacatcgtcgacgacctgctcgcgcagatcgacgccgcgggccgcgaccgcgaccgcgcgcgccaggacatggaccagcgcaactaccagatcgccatcgaggtgtccgagctcgaggcggccgtggcctcccgcgccgccgagtccgagtccctctccaggtccctatcggatcgggaggcggagatctccgcgctgcaggataaggtccgatccctcgaggcgaagatggacgcgcagaggcccctcctcgccgagcagat

SEQ ID NO: 53637 - DNA, 336 bp, Triticum aestivum
  Clone ID: PAT_TA_53637
aagaaactcttgcttagccactcaggtaaaacattaaaaaaaatagaacacactagtgtctcactgtctcatatatggctctacttgttgcacatcaaaaggcacacaacattctacagctcataccaagtgtcttgtacacgtgggtagtagaagataaataattctggcttagccaatagagttacacacggaaatgtctgatacaatacatcatctgcgtttgaatctttgtgaacagttcacttgaaaacgcaacgggcaactgagcacctggagcatggcttgccattctgaatcggggggatgtggatgaactgggagttgtcagtcgtt

SEQ ID NO: 53638 - DNA, 406 bp, Triticum aestivum
  Clone ID: PAT_TA_53638
attgaagcctatctctgacatttatttgagtatgtcggtccaccagctttatatttcagtttaaaaaagacaactttcacaatctaaaacaagctcatacactatctttttagtttttactcggttcttagttacccacctcctcgccaacttcgttcttattatgggcttcctctccaaaaagcttgtccaggaaggacagtatctcaaagttcaccctttcggcctgctcttgctggaggaaatggtgtccttcaatgatggaaacctcaagatcaggaacattggacttgaaacccccgctctcgatgtagcgcttgactccaaaggactcgacaccgatgtccttctcacccccgatgaacttcgcaggcaccatgatctttgcaccatgccagggcgcact

SEQ ID NO: 53639 - DNA, 359 bp, Triticum aestivum
  Clone ID: PAT_TA_53639
ctgcaacagcggcgagacacaatgtcgagtaagtttaagtccctaatcgtattattcgatcaatacattttgcttattgtttatgctcttgcatatgcaaacacaaataatgtaacttgtacatttgtgctaaaacaacaataattaatcacaggagaatttataaaatggtttcttaataatattgtaactcgttcattgtttggcgttcttaggcttgttcaaatttgcataagcaactagtatttcaaatggaagtgaacaatttattttggtaacaaatctggttgccatataattcgtattcttgggcgtgtcattgtatattattggtgggtgtgcatccttatatatgtgat

SEQ ID NO: 53640 - DNA, 670 bp, Triticum aestivum
  unsure (1)..(670): unsure at all n locations
  Clone ID: PAT_TA_53640
aacaaatctcaaaacatacaatantcttgaataggttcagctaggactccccaaattcaatatcgtgaggaggaacactccaaccagagcaaatgctaacaaagcttagtagctagatacaatgctaatgacacttcctctttacaatgacctgatgccagaatcatacgttcctgagcatcagcacggggtaattgtacaatagtcttcagtgcagcccatgaacttcagaccaaatatcatacatgccatgaatctaccctatctggatccaattagttggtgacaaaatggtacctggagtccacatagctctcgacgtcccagaggaaggatccgaaagtgacagcctctaagatcagccttctcaaaccggagaagcttatcctgacatactcatccttggaagagtcgactgttccttccggggtgatcacgatctccggcttcccgaatagcgcctccgtgtgcttctcgatgatgccaaatgccaccttcgaccggattgtcgcgtaagtttgtaacgtgtctgaatcaaatgacatgacatacgatcgaagacgggaaggcttgacggactggccgagacctcctgcgctgaggtcaggggaagtccatgactccacctctggatgagaactgtacgtctgatctgagggccgtgagtcgg

SEQ ID NO: 53641 - DNA, 304 bp, Triticum aestivum
  unsure (1)..(304): unsure at all n locations
  Clone ID: PAT_TA_53641
ccggcggtggcacgtcgcggtgggcctgcgggttcgatggcggggggttgcgggcacgggcgtgctggcgcggggcgtcctcgtcctgggtgcgcgtggccctgggcgtgtggcgcggtcgtggtggcgcctggtgctggtgcgggcggccacggacgcgcgtcgagtcaggggagctggggncgaggtggatccagagcggccggcgcgccggctccagaactggcagtggtcggagcttgcgcaaaaacaccttcccaatcagacaatcttcaaagcggacaaaaatgaaaaggtactcgag

SEQ ID NO: 53642 - DNA, 502 bp, Triticum aestivum
  Clone ID: PAT_TA_53642
gtactctatatctatcttctgcaattcgtataaagatttctccagacaaacgattaatattggtactccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcggtttaaagggaccaaattttacgacgggggggggggaaggaaaaatttttttttagggggccccaaaataaaatcagggggggggggtttaaaaaggggggggggggaaaaaccggggggtacccaaattaaaggggttggggaaaaacccctttttgggaggggggggaaaaaaaaaaggggcccaaccagtgggcctttcaaaaaatttgggaacccgaagggggaagggggcccccccttttagggggaaattaaggggggggggggggggg

SEQ ID NO: 53643 - DNA, 315 bp, Triticum aestivum
  unsure (1)..(315): unsure at all n locations
  Clone ID: PAT_TA_53643
gatccccgtctccgccgctcctcttccccaaatccgtcgaaccccaacgccaatccacgatctcctcgcgcgcccccgcggagtgctgcggcccccggccgatcctcacaaggcaggcaggctctttttttttttttgaagctaggcaggcaggccctcgttacatggattggcgctgctgggatcgtgccgcggcgtaaaccctcgtgcctgagctggcccggttcggcctggttggttggtttggtcaggtcttggtggactgagtggttcctggaggaggagctgtttgggnaattctggaagctggtggaa

SEQ ID NO: 53644 - DNA, 359 bp, Triticum aestivum
  Clone ID: PAT_TA_53644
agttaagtcgcctttcgattcgaacctccccgaaatccgcagcagtcgacaggaggccaaaggcgccgccatggcccgtacgaagcagaccgcccgcaagtccaccggcggcaaggcgccccgcaagcagctcgccaccaaggcggcgaggaagtctgcgccgacgaccggcggagtgaagaagccccaccgctacaggcccgggaccgtggcgctccgggagatccgcaagtaccagaagagcacggagctgctgatccacaagctgcctttccagcgcctggtccgcgagatcgcgcaggacttcaagacggacctgaggttccagagccacgccgtgctgggccttcaggaggcgg

SEQ ID NO: 53645 - DNA, 312 bp, Triticum aestivum
  unsure (1)..(312): unsure at all n locations
  Clone ID: PAT_TA_53645
cgtctagccgtctcggctctatgctgctgacgcagaaatacacgataacgtagaggtttgtccgatccgaggcagatgccctggtaaactacatggagggctaatggggattgatctcgatacgacgcactcgtgcgtagaactgtgcacttacgacaggttctgatttattgagaatgccaatgaactccgaaccantctagctgacgctgagcctaaacaggctatcaacgctttacctgagacagtaactataaccaagggcctgggagccccatatgcaccaaactaaatggccgaacagctcatggg

SEQ ID NO: 53646 - DNA, 453 bp, Triticum aestivum
  Clone ID: PAT_TA_53646
cccacgcgatgcgggtggaaatggcggcctcctcccccttcgccatcgcgctctcccccttcacgcgggtggtacgcttgggccggccctgctgcttgctgcgaagaggacaccggccacccgagtggccgccgatccctccggccagtttcccggctgtttttggggccctctccggccggagcttggcccgggccctggcccctgcgccgcccgttggatggcgcctctggtacggacttgcgcatggatgatcacgtgccacattgtcagattcggcttcacactgggcaccgtcgtcgacctcctcttgtacacgctcatgatcgccggccccaacgacagcatcactaagagcaccgtggagagcaccgccccctacgtggcgctcggcctcctgtactactacctgttgtacctctactggacccgcgacaccatccgcgccatgtt

SEQ ID NO: 53647 - DNA, 560 bp, Triticum aestivum
  Clone ID: PAT_TA_53647
gttcaacggcgtcattgtgaactcgaaggctggcaacaatgcgatctccaacggcggcccggatggcgtcgcaccacactctcctctgttcgagtcgtcgccactcaccttccagaccggcaccaacgtcatcgtcatcggcgtcagctgcaacggccgaggacagccggagccctgctactatgagtacgtcatcacttgcgacaagccgggctcgggcggttcggtcgtcggtgacccccagttcgtcggcctgcgcggtcagtcgtaccaggtgcatggcgtgtcgggtgagatctacaacatcgtgtcggatgtggatcttcaatacaactccaagttcgtcttcctcaactccggcgactgcccggtcgtgaacggcaggaagcagaagggatgcttctcgcacccgggatcctacctcggcgagctcggactgaagacgcgcgcaggcgacaagatccacgtggtgactggcaacgccaagaacggcttcgcattggtcgaagtgaacggtcaggcagttgccgagggcgagactctgctcctgggtggggacc

SEQ ID NO: 53648 - DNA, 680 bp, Triticum aestivum
  unsure (1)..(680): unsure at all n locations
  Clone ID: PAT_TA_53648
cctcgcaccaccattccttttccgtttccattgaccaagattgggcataaatgccccatggggcctcctcaaggtcgctgcttcggcgccccctgggcatggcgaattggagagcagagcatgccttacatacggcgctcgcttgacgccatggacgaccaggagggaggctggaatggaggtgctggcctcttattctccctccgatttgatcccatgagggcgggcttcgatcctactctggccagcttccctgtttccgcgctgattagccgccttcttggatggggcaagaacagtggccaagggaggccgcagggggccgtgatggtcgccgccgccgttgccctttacgtggctgcgctctgtgcttcagatcagcagcctcgccggcgacgcctggctgcttctgctgcagctaggccaacttctgcaaccagacctcgtgctctgcctgcgccggacgatggcctcagaattctgtcatcgaatgatgaatatctggagaacgtgatccacagcgtgtcgatcggtgccggggacgatgagccgattctggtggcaagagttcagaccatgccacccgacatggctggagcaacctctgcatgggaaacggagcgcgatangctggagaaagaggaggtcgagcgattcaagcagctgtggctgtcgctcgt

SEQ ID NO: 53649 - DNA, 469 bp, Triticum aestivum
  unsure (1)..(469): unsure at all n locations
  Clone ID: PAT_TA_53649
caactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtntttgcttcatctttctccactattggtggggggatgaatatgtaagaatgaatgatttacctt

SEQ ID NO: 53650 - DNA, 572 bp, Triticum aestivum
  Clone ID: PAT_TA_53650
cacttagctacctcccactctcgcatcatgtcttccggtggtggcgggggaggggatcagggccgtcatggcctctaccaccagcatggccacggccaactcacccgctacgatggcgccggcggctacgagctcagcaacgacgacatggagagcttcttcttcagccagcctgagggcgtcggcggtggcgtgcgcgccgacgagatcgcgccgtactcgagcatcacgagctacctgcaggggttcttggaccccaccgggctagctcggcatctcgacgtgccggccaagcacgagctgtcggtcgacgttaggagccatgaccaagacagccagggcaccggcagcgctgctggagaaagcgcggcgctgctaacacccaactcatcggtatctttctcgtccggaggcggggacggtgagggaaagtctcgccggagcaagaagggccgggcgcaggagccggatgaccaggaggatgggaaggaccatgaagatggggaaagttccaagacagcgaataacaaacccaaaaagaaagccgagaagaggccgcgggctgccccgcg

SEQ ID NO: 53651 - DNA, 164 bp, Triticum aestivum
  Clone ID: PAT_TA_53651
gtttgttttgccaaaaaaaactcttgtacgagtttaacaaagaattcaagatacaatatattaaagggtccagaaccataaacatatttgtattttgaattctttgttaaactcggacaagagtttgttttcgcaaaaacaaaaaaaaaccgtggcggttccta

SEQ ID NO: 53652 - DNA, 126 bp, Triticum aestivum
  Clone ID: PAT_TA_53652
ctgaagatggcgcagcagagcaccggccgcaaccacacttatgaaagggtgccagggtaagatcatctcgatttgtgtcacctgaaagcaaaggacggaccgtcagactctacatcagatcaggcg

SEQ ID NO: 53653 - DNA, 520 bp, Triticum aestivum
  unsure (1)..(520): unsure at all n locations
  Clone ID: PAT_TA_53653
gcagctcgctcgccctcaaatctccttaaaaaatcgctcattgaccctgctcctgcacagatttgcaggggaggggggcgagaaatggggatgaaatggcacgtcgtcgcggtgctaggcgtggcctgcactgtagccgccgccgtcgccgccgacagggggctcttgttcgccggcgccgtggcgccgccggaggaagcgagctacgacctgcgcaagctggccagctccctgtggcagagtgacggaaccgcctaccaccacgtgtggccgcccatgaaactgggatggaaaattgtgttggggtcgttcattggattcttcggagcagcgttcggcagcatcggcggtgtaggtggcggcgngatcttcgtgccgatgctgaccctgatcattggctttgatcccaagtcgtctgcggcgatgtcaaaatgtatgaatcatgggggctgctgtgtcaacccgtgtactgtaacctcaagctgaagcaccccactttggacatgccagtgatagacta

SEQ ID NO: 53654 - DNA, 144 bp, Triticum aestivum
  Clone ID: PAT_TA_53654
cggttggcggtagccatgctccaaggcgacttaaattctcggtgtgatattcataagcagtcagcatagggaagtgtatcggggtggagctccctggaattatggacaaaaagactaatatcctggaacatgctttgttattgt

SEQ ID NO: 53655 - DNA, 352 bp, Triticum aestivum
  Clone ID: PAT_TA_53655
gaataaacagaacgagcggggttaatgcatcgataatacaaacagcgtacaccacgcacagagagcctgcttgcgaggggcatcacaggacggacgaaaagcaaaacctgacaacgggaacaggagacgatgtctggggggggagggaatagagggggtaagaacaatactgatacattaacagaggaaagtaagcgcggtcgagagaagagcaaggttcaatgggcgctcaagaaggcgccaaccaaaggctatgactgggcgagcgacactaaagagcacataaatcaccaacgagcggtggcgatagaagcactagtaaagggtctagaagggggtgggcccggtcacc

SEQ ID NO: 53656 - DNA, 168 bp, Triticum aestivum
  unsure (1)..(168): unsure at all n locations
  Clone ID: PAT_TA_53656
ctttttctttttttttttttaaaatgcccatgggggtactgccacntcaaacatctaccactgtacaacaatccccggnatacaagaaaaaatatacccccaancacaaacctttctnaccccttttttttccccggaattccngacctttttctgggggctttcttt

SEQ ID NO: 53657 - DNA, 350 bp, Triticum aestivum
  Clone ID: PAT_TA_53657
ggtggaatagtgccacagtagtcaaattcagggcgtgttcgtgctacatatatatactagtatagcacaagagtgcgaaaagagattacagtccctacagtctacccacacaaaacggggccacaagctcatgaaacctgtcatggaccaactctaacaatcaacccatctttgcctgcctagcacaaatcaataaataaacattggtagccaggaaccagcttgtcatcagggagtaacaagaaaccggtaccatctggacgaccaaacctcgtgggacaccagctcagttcgacccgccattgccgctccttcatgaaccccaacttcagcttcaagcgtttttttca

SEQ ID NO: 53658 - DNA, 385 bp, Triticum aestivum
  Clone ID: PAT_TA_53658
tccttgacctcgccctcgccgtcgccgtccgtcatcccgccgccgctgatctcggagaagcgcgcgctgttgaagtccatggactggtccatgatggacctggagaaggtggcgctgctgcggaacgactgggagaaggacgtgatgctgcggaacgagtcccccagggctcgaggcacgatctgctccggctggccggggacgacgccgccgggctcgaccgaggaggccggtatggagtgcatgatgcagcgcatccgcctaggccctctcgtgccaagaacattcagctcgtatgtcacctgggctatgttgtaactgacggtaggcaccttgggtgagacccttgttgagttgaaccttgtgctgctgcttcgagcggggg

SEQ ID NO: 53659 - DNA, 659 bp, Triticum aestivum
  unsure (1)..(659): unsure at all n locations
  Clone ID: PAT_TA_53659
tatgacgatcgcatggcacgnnccgtacgtaagnncttggtatncctnnctagaaaancggccgcncnncttttttnnttttttnntttttttnnttttttttnnttttttttgttttnntttttttttnntttttttttttttttttntttttttttttttttttttntttttttttntttttttttttntttttttttttttttttttggggaaaaggggggcccccccccttccaaattaggggggccaaaatactgggggggggggggggtaaattaaaagggatttaagttttaaaaacaatttttttggggacggggaatttaaaaggggggggggggaaaaattggctaaggggggggcccaacccaaaaaaggtggccccccaaaaaaaaggccccaataacaaaaaaaaaggggatttttggaacacccgcaaaaggcccccaaaaaagggaagccccgggaaaaaagggtaaaaaatttggttaccaaaaacaaccccgggggggcaaaggtgggggaaagttataaaagggggcaaaaaagggtggaaacccccgcccccaacggggaaatttaaaggccaaacttttttggggactttgggatttgattaaaaaaaagccccgtttttatgaaagggggggggaacc

SEQ ID NO: 53660 - DNA, 184 bp, Triticum aestivum
  unsure (1)..(184): unsure at all n locations
  Clone ID: PAT_TA_53660
catcaaccaaancaaatgtcgaacatgattganccnnagattaaccttcatatattgntgcnctcntctccatcctatcctaactacccccactcaatccnctcctgtncattttcacaacctcacannttacagggggggggagaactntnctatantgnncncattncccanncatcatcca

SEQ ID NO: 53661 - DNA, 256 bp, Triticum aestivum
  Clone ID: PAT_TA_53661
acatggcgcaacagaactcttattacactgcttcaaaggcacagtgcgtaccccattcacagaatacaagtcatacaggaaaaactacatgcacttacattacggtgacagttataccaccaaccttgggggcattatttacgtacttactatcgtctctcgtattttgcatagatccacgctactatatatagtaccggagattttttctagatgcacgagggggcggcttttggtttatacaatctgtactact

SEQ ID NO: 53662 - DNA, 432 bp, Triticum aestivum
  Clone ID: PAT_TA_53662
gaatggttgcttcgttctgctgtccgctttgcgaagaaactgaacgcagtgcggacaagcagcgcgcatgccaccatccttgaagatgtttttgctgaaaatcagccaagtcgggcggatggtgcggtcgagttccgtgttcctcacgacgacgaagtcgcgaggtgtgtggtaggttgagccacacgcggagctcgaccgtcgccatcgcggcctggatgcgcagagggcgatgacgatggagggcgaagagagaaagaggctcgccgagaggagtcggatggagcggcgcagagtcgaacagcaggggagcgacggacgcgaggatcggacgctggaaaagatggcgatggagactgagcaagagcgacgagtgaagagggacgagtgggtgaagagggcgagcgatagtgggggaggagagaagcgact

SEQ ID NO: 53663 - DNA, 576 bp, Triticum aestivum
  Clone ID: PAT_TA_53663
aaatgcataaacaacactatccgcatctttgctgatgttacaatgtgacaagttacaaaggcaaccactgccaatcagcacagcatttcctccataaagtttttgctgagcatttgctctatggacaatacaacaaaattttgccaactgtttcacatacattgttttctcatcagcacaaattttagtgctgatgcaaatttcaggggacagtgtccctgtaatgacagatgcaaagatgattcggacatcacccctgtaacgaagacaagcaggcatgtttgcttctttggtagacaccatgtgattaccaactgagtcagattacgcctttttcctggtgattctgaagcaatgaatcccaagtgcgttggtgatttcatggataacggacgtagcaaaatgcatgtacagcgccactgtaaataagcagtatatcaggagaacgagctgctcatcaaaaagggggtttccatcatcaagtcgggcagtcagtgcatttgcaattgcaaacggaaatatgccaggccatgcacattcctgtcttcagaccttttggttcatcacataagtgag

SEQ ID NO: 53664 - DNA, 167 bp, Triticum aestivum
  Clone ID: PAT_TA_53664
ggcaaaacaaactcttgtacgagtttaacaaagaattcaagatacacgtatgctgtgggtctggaccctttactttttgggagccggatttctgcgtggcgctcgcacgggagttgctgtttcctgtgtgaaaccgttcgccgggggggggggcggcatcgtgcgcc

SEQ ID NO: 53665 - DNA, 317 bp, Triticum aestivum
  unsure (1)..(317): unsure at all n locations
  Clone ID: PAT_TA_53665
atgctaaactggaatcgtatggggctcattgatatatccacgatggtacaaaggttaattgaaacaacgactcatgcgagtcttgatcaaatgatcaagccgtatcaatagagttttccatgtgaaatatactatttcccctggggggggggggctaagtacttcctccataaattaatataaaagcgtttagatcgttaaaatagtgatctaaacgttcttatattagtttacagagggagtagctaacactggcnttaatgaatagcaaggcaaatcaccgggcagaagcccacgtgtgaaaagcttgtggttga

SEQ ID NO: 53666 - DNA, 403 bp, Triticum aestivum
  unsure (1)..(403): unsure at all n locations
  Clone ID: PAT_TA_53666
caaaccttctcctccttctgaacctcccggcgcatctccgacttccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgcctcgtccggnagatcgcccaggacttnaagaccgacctacgcttncagagcttcgtcgtcttcgcccttgcctacggacgcactcggctacctgagggcgactgggatggnactcagcncttggtcaaatttattgattcacctggc

SEQ ID NO: 53667 - DNA, 268 bp, Triticum aestivum
  unsure (1)..(268): unsure at all n locations
  Clone ID: PAT_TA_53667
tccgctttctgaaaaccctnaccgccgcagcccganagaagccatccttaggtttccgcgccaggggcgtcggggaaattttcgggctcgaattggattgggagatgaccggagaagggagggtggggaaccggggattctttcggtggggcgggnacctggtccctgggggaaccaccccacgggnagccggccacgccctgggagaccgaggccttttccgggcggaaggtttcccggggccaaaagggggttccaatttcccggg

SEQ ID NO: 53668 - DNA, 214 bp, Triticum aestivum
  Clone ID: PAT_TA_53668
aaagaagggcatatcaagggctgagattcaccgacccgtcacaaacagcacccctttttcagtttgtgtaaagtattattgaccggtaaaaaaaatctattattgaccagaaaagtcgatcttctttagatcattcgccggaggggggggcgaccacccggtccatgagggccgacgactcgttgtgcttcgtctggtggaggtagaacttatg

SEQ ID NO: 53669 - DNA, 471 bp, Triticum aestivum
  Clone ID: PAT_TA_53669
agagttaactatttttcatgtagatgagaatcatcaaaactgtttctgatttatttggggcaaacaattaaccaattaaaccgttaaatccatcctgctacaacgacggcgattgtctgctcgcaaggccggtggccatggcagctcgaatgggtaccccgcaccggcgtaccggttcctctcatgcgcctggtccacctcgagcgtctcgaggtcgatggaaaaaatccaggtctcctcctgcggcgtcacgaggacgtgcctcgtagtcgtcgcaacaatctttgctggtccgtggaaatacgtctcctcgcgctccggtagcccactagtcgcctccggcagcctcacgagcttctccaccacccactcgccactggtgtcgagctgccgaaacaccgtgaggtcattgttggccatcacgcgtacaacacgcaccgcgtcgtcgtcgccgccgatgacccggaaggc

SEQ ID NO: 53670 - DNA, 639 bp, Triticum aestivum
  Clone ID: PAT_TA_53670
gaacaacaaaacaaaagtaaagatgtttgcatggacgtagaacatatatgattacatttacacgctgcacagagccgcatggatacatgtagccggaatgtgtgcttatttacgtacgtacgtaacatttgtagacgtataaatattcaaaccacacaaacataaacacatgcacgtacgtatgcatgtatgatcacactcacacgcacgtactacttggcttcggcgtcaagggtgaggaacgcgaacgggcgctcgccgttgaagttgcccggggggttgtagttgcaggtgatgaagacgccccggttcccggcgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctggagccggcaatcgccggcgcgctgcgccgcccagtcctgcgcaaacctggccacgttgttgtcccacgccaccgggccgacaccgtccacggcgcgggcgcggttgtgcaggttg

SEQ ID NO: 53671 - DNA, 563 bp, Triticum aestivum
  Clone ID: PAT_TA_53671
aggaagaggatgctcttatttttattccgaaaatggcaaacgtcacaactaccgacgctcctcctgaacgctgatactgacaaccaagtttgcaaatgatctgtactactgaactgagcatcagccaatggcgaacgtacggactactgttataatactacaagatgaacaacacctcgaaggaggatgctcttattcactccgaaaaccgaaacactacagctactgacgctgctcctcctgaactctgataccggcaatcaaggttacaaatgatctacaccactgaaccgaaggtctcatcagtacaataatacaaacacatggtacacaacactgtacatgcacagtacagtaagagaagaaccgcggctacaagcgtcggctccagcctcaggagaagaggtacaccaactcgaaggatttcgaggttttcccggaaaatgtagggatgtagttgtagatcaggttgaccaacaccttgtcggcaggcggactgtttgacgacttgcgggcttggctgataaagtagttggcaaaattttgtgtgacttgaactgcat

SEQ ID NO: 53672 - DNA, 441 bp, Triticum aestivum
  unsure (1)..(441): unsure at all n locations
  Clone ID: PAT_TA_53672
tttcttnntttttttgatacatataggacagactggagagaacattaatactattgtatacaagataagaaacgagctgcctggtaggaacaaacagtagtgttacacactcgaccaacagaaatggttacgcaaggggaactaatctggcctttctaccacaggtctaggcatgagatggacctaggatgaagcctcaaacaggaaaggaacagatcaccgggaacctgctcctccggactgcaagaaccaaccaattcacacaaacagtcggtgtctgtgcactcggatcaataacgaatgaaacgagccagtttctgaagactgacattaggatttgcgctcatcttccttagaggaatgctcataaaccaagctgtcggtcttttcgtccgactagggaaccttatcttgctgctcattggaccagaacggctgaaa

SEQ ID NO: 53673 - DNA, 536 bp, Triticum aestivum
  Clone ID: PAT_TA_53673
attcatcaacaaccacaaactagcaggctgtagcaaaactcacatcataattaaatggacgaccttaccaatcgttccagcttaggcctgaccttacagaaatagtgctacattattggtttctgaggcacccagagcctggcagctactacaagaaagcacacaccacactcagctccacagcccagtctccctgctgcagtaggattaacctcctagtccaccaccaagggagcggcacttggcggtgatcaaccacagctgagcctgggcacagggctgcagcctgcagccaccccttcgtgcagccatagcaaccagaaatgcccttgtcccggcgtgcagaaatgtgaatagacaacagcccagttgttgtaatccacgcattgcataatgtggcatcacctgctcagaagtatcgacgagctgtgctgaaagatggctccgagttttgcaatgttgcttttagacagtcgagacagcatagaatggcctgcacctttcaactcttgctgggtgggatccaagtcatgagt

SEQ ID NO: 53674 - DNA, 598 bp, Triticum aestivum
  Clone ID: PAT_TA_53674
gaacccgttgcgccaaatggcgcagaaacctgctgattccatgttagcgatgaaaagtaatccatggtttagttgcttagttacaggcaagcacatatgacaacaaatttaatctcctggaaaaacaggggcttgctgtctacaatgaaaagtatatgcacattaaaatttggtagcatagggttctatttgtaacaaatctaatccctgtcgacaaagcacaaaaacataaatgattcttctactactcggactcatagtcatagctcaagtcttcatcatcatcgctgccgttggagtccaaagttggccaatcctcccatcttcatctatgttggcaatggcttcaatatcctctcttccggttttcgcggaaaagaaatcccctctgccacgcatcccgctcggcatgaatggcggaagcgaacatgatagttttacgcttgtcttcctctgctctcaaatgcagtaatcctcacatcagcgcctgaagcatcactgcttgctgcagttgcttcttcctcttgtatattccatgtttatcaagtaaagatgttgtaatccacctgtagtcacaccatcatgggttgaatgccgt

SEQ ID NO: 53675 - DNA, 642 bp, Triticum aestivum
  unsure (1)..(642): unsure at all n locations
  Clone ID: PAT_TA_53675
gaccggaagcaaaggcnnaancccccancggacaagcaaacaaccggacggggcagcgcgcccacgcccacacacggggcagancagancagancagancagaaggacagggggggggaaaaaagnaagnaaaaggcgggaagcccaaanncagaagnccgacgagcnaggcgagcggcgccggcgaggggangcacaccagcccagcnagagggggggggcgncccaggggggggcccagnngggggcgccgccgacgcggggcagggaggngancnnggggaaagcgncgacccngaaggnggcgcccgacaagacgcccncgcgggccacgcgcgggaacgccnngagccgggggagggggggcccgaagcncnngagcccggcccggcgggggaacaggcacccgggcgggaaccgggggggcgaccgggcgggcccggaccggaccccccggggggggggggggcggcccccggccccgggcgggcgcccgcgcgggggcgggggggccgcgggggggggggggggggggcgggggcgcgggggggggnggggggngcccgggggggggggcgggggggggggggggggggggnggggggggggggggggggcggnnggggcggggggggcgggggg

SEQ ID NO: 53676 - DNA, 516 bp, Triticum aestivum
  Clone ID: PAT_TA_53676
aggcagttgtacattccacaagatgatctaccacaacaacacacagaaacttgtccgagagtgagcgtacaacgcaacgtggaatcttgaaaacagctacaggttcctcttatctccgccaacaacaacgacacgcaagggttttgctcttaaaccgagttcatagcacaaactaatacaatggacacaaagaaccaggagagaccacagcgcaggtgcgtgcacgccctgcacctgccactcgcacccgtcaatcgcatcgaggcatcgggatggagatcgagagctgggtcgtcgagaaggaggtgccgttggagcgctcgtcgtccatctccgaccacgagtcccgcctccccggccactcgtcgaagaagggcctcagcggctggttctcctgcttaacatttcccatgagccctgcccctgcacctgcaccaccaccaccgtcaccgaaggagcggcggttctgcttctgggagtgggacagcgaggcgatggttacctgcccaagcttct

SEQ ID NO: 53677 - DNA, 703 bp, Triticum aestivum
  Clone ID: PAT_TA_53677
cataataagccatccattggcatacgttgcacccaaccccgacaagttctgttcatgttacaatacactcgtcccaacgatcaggatatcaagccacacactttttaaaaaaatgaaaagccacacacttcactctacgcctaccatctttcatctccctcccacatattcttctccttgggcccggtgggcccttcctccttggagagctcgttcggcatcttgttgagcatgttctccgccggacaactgagccgctggggcatactcttgaccatccgttccgtccccgtcctcgacctgtagatcaccgtcggcccccactcccgcatgaactgcagccactggggctcggccacgacgccgtccccgaggtactccgccgccaccacgcggtacttgacgctggagtcgacggacagcttgctccgggcggcctcgttcaggatcccgaccccgagcgccgccgagccctgcaggtacacgccggcgcgcgggtagctcgcgtgcccgttccgggacgagtacaccgccggcctgttccccgcggcgtactccagcttggccgcgtccacccacctgcccccgctgtgctgcgagtagtagacggccatgagctcgccggtgaagttgctgacccggagcgtgaagtgctcccagtcgccgacgtgctgcccggtcgtgcccagcggcaggttgatcg

SEQ ID NO: 53678 - DNA, 716 bp, Triticum aestivum
  Clone ID: PAT_TA_53678
gaacaacaaaacaaaagtaaagatgtttgcatggacgtagaacatatatgattacatttacacgctgcacagagccgcatggatacatgtagccggaatgtgtgcttatttacgtacgtacgtaacatttgtagacgtataaatattcaaaccacacaaacataaacacatgcacgtacgtatgcatgtatgatcacactcacacgcacgtactacttggcttcggcgtcaagggtgaggaacgcgaacgggcgctcgccgttgaagttgcccggggggttgtagttgcaggtgatgaagacgccccggttcccggcgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctggagccggcaatcgccggcgcgctgcgccgcccagtcctgcgcaaacctggccacgttgttgtcccacgccaccgggccgacaccgtccacggcgcgggcgcggttgtgcaggttgacgaagtcctgcggggtgttctgcgccgagacgtcagccaccacggccatgactatggccagtgcgaacattgcaag

SEQ ID NO: 53679 - DNA, 615 bp, Triticum aestivum
  unsure (1)..(615): unsure at all n locations
  Clone ID: PAT_TA_53679
ggaggaggaggattggagcgcaggggagtttggaggttattatggcgctcaattacccgtcgtgctcattcttggtgagcgacgagtgctctgccctgatgcgggggtgtggatgctggtcggaggaggcctcgcccctctcgtccccaggggtcaactccaggcgctgggatgatttcgagccggaccctgcggatctattgcccgcggatcccttcgggatgaacttggggaacaccatcactgcagccatcgccagttgccttgaccgcacggtcatgtctggtgcagggcgttttgttggaagcagtgacggcggcgcggctgttcgtgccgacttgagttattacctggacctgaatcatgctattgcgctctcctgggagccacctttcctcccgggtggctgcaggcgtgcttttgaggggccttttgggtttggaggcctttatgctgccggaggcgccaactgctctcaaggattgcctncccttgcgtcctgctcacggcaaattgtacctggagaggatccatctacttctggcagtgctgcattggtgtgccgtgatggagttgatgcccggggagcgtcatgctcatgggcattgtacccgg

SEQ ID NO: 53680 - DNA, 402 bp, Triticum aestivum
  unsure (1)..(402): unsure at all n locations
  Clone ID: PAT_TA_53680
gccacccaccccgacctccaccttggcggcgcccgccgccggcgtcgccgttcccccgaggaggccgccgaaatggccggccgccgccgcagccgctccggaatccacgccagcgaggacgacgacggggcgacccgtcccagccgccgccgccgtcgccgcgcggaggtgcctgtccctctgccggacggcggcgataccctgttggagtcgctgcaggacgacagcagtcggcctcctgccccatcggagtcgctgccgttgccgttggatatgctttggaagatcctcctccttctgccgccgaagccgtcctcccgcctccgcgcatccgccgtctccaggcgctggcgaggcatcgccgccgaccccaactntaaaagccagttccgtgtccacagc

SEQ ID NO: 53681 - DNA, 356 bp, Triticum aestivum
  unsure (1)..(356): unsure at all n locations
  Clone ID: PAT_TA_53681
aacccttggttttaccctttaaaatcctaaccgttacctaaaaacaaaccatttttttttttaaaaaanccaaaaaaagggggggggaaacattttcataccttttccctggggaaaattttaatccgaaaaaaatttcaaaaaacatacgacccgaaaacaaaaagggaaaagccgggggtcccaaaaaagtaacccaaccaaaataaattgccaaaccctaactgccctttttccaggcgaaaaacacttggtgccagttgcattaaaaaaaccctcaacccccggaaaaaggcgggtttcctttttgttgacacaagggtgtttttttttttcaccaagggaaacgggaaaaa

SEQ ID NO: 53682 - DNA, 431 bp, Triticum aestivum
  Clone ID: PAT_TA_53682
gaaacatgagaaaaccatgcattcacagcaatggattgtacaaacaaaaaagagcttcacattcttgctaaccaccgttgttgtacaacacggtggcagaaagttcaccaggtgcaaatttagattgcaaacttagtaacttggggggggaacgcacacagtgaaattcccttaactacacaagtcaaaaatcttgaaaacagacactcccaaggtctatcaaatctagggtcaatatgtatgtagggtgaaactagtccactgcctggtcctcagaaagatgaatggcagaacagaacgacggggacacaaagaaaacatccagctcacctgctgaagcaacacagaatagatctcaggcaaaaaagaaaactttgatgaacagtgccagagcaaactgcagcactgatgcacttgcgcggacgcgtggg

SEQ ID NO: 53683 - DNA, 514 bp, Triticum aestivum
  unsure (1)..(514): unsure at all n locations
  Clone ID: PAT_TA_53683
atgtaaaccatgcattccagacacacacaccatcatcacatacaccaccatagcacaacctccaggaggagacctggatatattcctgactgactgcacagcaaaataaaattatgaagcaatttgagcgctaagcatgagcagattttggagcacaatgtgccatccaaattgctaggctgcaaggactattatcactatgagcagcaccaccccaaaaataaccatcaacaggcatatcagagaagagttcgacttctgggttttagcagcttttgaaagctggccttttgcttgtgcagtcgcagcaacagaattgtcgatatgagtgtcaatgtcatctgcagaacaaggagaaataatacaatcagataatggtgggaaagtaaacagtattgcccttcaacatatgaattgggtatcgtctcatctgtcagctgaaaaaaggtnttacagaccaatcattgctccttgatcatgaacctagccagncagatctttggagatcttcttt

SEQ ID NO: 53684 - DNA, 470 bp, Triticum aestivum
  Clone ID: PAT_TA_53684
ataataagaataaaagaatatatttttggtagtgttacagatgtgcaacatgattggactttatttcagacatatgtaagtatgaaagcttattacatggcgctccactaaacactatgtaataaaatgatatcatgcacacttctataatgctcatcatcatattgtcctgagcttaatttgtgcaccatgcatggggcgcaacattttctggttatgcggcacatgagaatacgtcggggcaaggtcgaattcgaagtgttgaaggatcatgcacaaagccatcttagcctcaagcagcgcaaaattctgaccgatgcaaatccgtggaccccaaccaaatgggaggaaggcaccaggatccttggatgccttcgcaatcccatcagcaaacctttctggcttgaactcatgcacatcgcttccccatatgtcggggtcatggtggataagtagcacgggcagctcta

SEQ ID NO: 53685 - DNA, 227 bp, Triticum aestivum
  Clone ID: PAT_TA_53685
aaaaaactgaagcttacacatccaacgcaggagaagagagctacacaggtgtttatgatcaagccacgtgggaaatttgtaagaaaaaatagacaaaatatatattggacctcttacactttcgctcggtcgtatcacgaagctttgttctgctttgtcttggcgatgctgagaaggtcgccgaagagcttgtcctcgggttttgccggcctggtgcgttgcgccgt

SEQ ID NO: 53686 - DNA, 224 bp, Triticum aestivum
  Clone ID: PAT_TA_53686
gtagaagaaacttctcgaattctctccacggatgtcaagtcaattttttcgtgagccaaatacataaacaatcgaagaagaaaaaggcatacttttgtataaaaaagacatgttgtatctctcattcctcaccacactctgggggggggaaggtacaagaacacattttttggatggttggtgctcccttgagcttggggaaatagctgcggagaaccagggtg

SEQ ID NO: 53687 - DNA, 415 bp, Triticum aestivum
  Clone ID: PAT_TA_53687
ccaaagaatcagaagttttgaaggaaatttcccccatctcgctggaagggggcgaatcctaaacaaccatttggggcacccgatacaagatagcagctttcaaactaaatttttttttcaaacccgggaagggggggccccaccaagccaatccaaacggggggggatccttattttttaacattcacagcctgacgaggggtgttgccttccagccccccccatgtggattggatcagggagatatatatcttcttcagggtcatttttgatagcattccttggtatacactcgaaaggtggttccacattgaagccttttttagcaaacgtctaaaaataagggatgtttcccttggaagcacaccaagctttaacctttttctcaaaaacctgaaagaaagtgggctcaaaa

SEQ ID NO: 53688 - DNA, 503 bp, Triticum aestivum
  Clone ID: PAT_TA_53688
aagagatgataatatttactagttaaacccaccataaaatcttctcttttacataaatcatcattactattacactgaggatatactacatttggagaaccttgtgttctgcggctacatgatatctgaaactgtggattgaagagctgtacatacctcaagactgggctgacatgcccacgacaacctgacgagtgtttcagttacaagctggaagaaggcggcaaatataaatttcaaatacctcacctggcagtagaggcttgtcacatgattacatctctcggttggcatgattgactcccacctgcgctagtatcgaacggatgaacaggtccaagaggtaggacaatatcggcactgtattcataacaacgtggggtattgagacgccggactctccaattgatcggggatttccctttcttggacctgttcgggggcctgagggaaaacttgtgccacggtggcctgcagccgagaattagattcctgttcctctt

SEQ ID NO: 53689 - DNA, 453 bp, Triticum aestivum
  unsure (1)..(453): unsure at all n locations
  Clone ID: PAT_TA_53689
tttttttttttttttttttttttttttttttttttttttttttttttttttttttnttttttttttntttttttttttttttttttttttttttttttccccctttccccgggccccaaaaaaaaaaaaccaacccgcccaaaaggaaaaaaaggggggggccaaaggggcccagtcggggtaaaaaagggaaaaaaacgggggtcccaaagcgggggggtaaaacttgcccagggaaaagggccaaaaaaatggccaaaaaaaacggggataaggggaaaaaatcgaacaaccctacaaggaaccaaaaatgtattggccccccccccacccaaaaaaagctggggaaacccggccgtggggtaaggcccccccagccgaaaggggccccttttgaaaaggacctgcaaggagctaattatttggacaaaggaccccaaaaccaccggggcg

SEQ ID NO: 53690 - DNA, 118 bp, Triticum aestivum
  Clone ID: PAT_TA_53690
aaaaggaaaaacttgctttaaggctgatattgtcattaccatagtcggtggttaatcattaagaagaacattactacaccacacacacatgacattatacacgtgttgcgtacacaca

SEQ ID NO: 53691 - DNA, 202 bp, Triticum aestivum
  Clone ID: PAT_TA_53691
cgtatagtgtcaaaaaatatcttacattttgaaatagaaggagtactatagaagaagaaagggggaaatcagctgcaacaaacaaccacctgccatggattacaaatatccaacacagtgccatttcatgataacatcatagggggggtggaagaaaccttctgggacaaaatgaattggggtgtgcgaaactggtgggcgt

SEQ ID NO: 53692 - DNA, 244 bp, Triticum aestivum
  Clone ID: PAT_TA_53692
aacaagaaaaatcaagcctttattttcaaaaggggccacccccccccttggggacaggccaaaacaaacaaaggggaggaaaattgaagcaaaaataaaccccctgggccccaaaaaaaaaaaaagaagaaccggtttaaaaaagggtttaaaacatttgaaaggggggaaaaaccaaacgggccccttgggaaaacctggggggggggccctccttaaaagggggaattcccggggcccggga

SEQ ID NO: 53693 - DNA, 444 bp, Triticum aestivum
  Clone ID: PAT_TA_53693
ggggggccgggaaacatttttttaagccagggggggggggggcccaaacggggcccttttttttgggaaaggtaaaaagcccaggttaaaagggcccaccattttttggaagaaagggggggggggttaaaaaaaaaggggaaaagaaaggggggtctcaaatttaaaaaaaaggaaaaaaggggggggcccccggggaaaaagttgggggggggccaaaaaaaccgaaaaggggcctgggggggtaaacggggtatttaaagctttgggggttttgggttaacgaggggcattttaggggaaaaaaaatttgggtttggttttccccggaaaaaaaaaggaaccccctccgaaaacattgaaaaaaaagtggtttccctcccggaagagttacgaaaaaaaacgggtttgtttttcttttttcaaaaaaaaaaaggaaaaggg

SEQ ID NO: 53694 - DNA, 508 bp, Triticum aestivum
  unsure (1)..(508): unsure at all n locations
  Clone ID: PAT_TA_53694
ctccgttctggtcgcctggacagaaagattgagttccctcatccgacggaagaagcaagagctcggattttgcaaattcactcaagaaagatgaacgtacatcctgatgtcaactttgaggagctggctcgttcaactgatgatttcaacggtgcacaactgaaggctgtttgtgtggaagctggcatgcttgctctacgcagggacgctacagaggtgatccatgaagatttcaacgaaggcattatccaagtgcaagcaaagaagaagtccagcttgaattattacgcttagtttcccttgagtaatcagaacgcttggtcctgtgatggccgctgtttgtaacactcggctaccatttttatttggagtatagtttaaaaaaaaaaaagaaaaaaaaaaaaaaaaanaaaaaagaaaaaaaaaaaanaagaaaaaaaaaaaaaaaaaaagaaaaagaaaanaaaaaaaaaaaaagggggcgggcgttttaagggatccaagttta

SEQ ID NO: 53695 - DNA, 393 bp, Triticum aestivum
  Clone ID: PAT_TA_53695
cgatttttaggtgctcccgcagaagcgcacagacgtggacaccgacgccgccacagacggcttaccgttgcaccacccacggaccttcgcgctgcagcagggcaagaatgcatgggcgctgtgcggatgccgaagagaaaccagcaggaccatccgaaaagcccgtggaggcggaggtggatgcggacgaggactaggactacgatgaggacgatgacgaggagtattggccctaccatgacgtgggtgaagccctatactggctcgacgccactgagggcccggcatggcatcgacgcttctttactcaacattctcggccgccggaagcgcctcatgcggctcggttgtcctaacgcacactgtcggaactgctaggaacgcacactgcag

SEQ ID NO: 53696 - DNA, 332 bp, Triticum aestivum
  Clone ID: PAT_TA_53696
ctagtctagatcgcgagcgacgcccctcctcgtgccatcttcttcctctcccttccctccaccacactcgtgactgactcactgagctgagctgagcctgagcgcacgcgacgtcgcagggaacagttacgcgcccgagttaatgccctgctgaatgcggagcagtttctttccactgcctcgctcgcttgcttcagctgccccggcattcaatgccctcgtatccctcctactacgctagctagccaagtgtgtctgcgtgcgctccgccggacgccggattgggtggatagattggtagaggtgggagaggggggatgaactacctacgg

SEQ ID NO: 53697 - DNA, 549 bp, Triticum aestivum
  Clone ID: PAT_TA_53697
tcatcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactcct

SEQ ID NO: 53698 - DNA, 744 bp, Triticum aestivum
  unsure (1)..(744): unsure at all n locations
  Clone ID: PAT_TA_53698
gtgcggcctgcacgaggcctccgggcgcctcgtgctgctcaaggaccacctgtccaccttgagcctgaacgtgatctcgcgcatggtgctgggcaggaagtacctggagaagcaggcggcgggcgaggacggctcggcgaccatggcgccggaggagttcaagtgcatgatagacgagctgttcttcctcaacggcgtgctcaacatcggtgactccatcccatggctcgactggatggaccttcaggggtacgtcaggaggatgaagaagctgagcaagaagttcgatcgattcctagaacatgtcttggacgaccacaatgagcggcggcgcctccagggcgacaacttcgtgtcacgggacatggttgacgtgctgttggagatagccggcgacccaaatcttgaggtcaagctccaccggaacggcgtcaaagctttcattcaggacctcatcgccggcggcacggaaaccacagcgatcacggtggagtgggccatgtcggagatgctcaagaaacccgaggtgttctccaaggccacagaggagctggaccgcgtggtgggacgagaacgatgggtgacggaggacgacatccncaaccttccctatgtggaagccattgtcaaagagaccatgcggctgcacccggtggcacccatgttggcaccccgtctgtcccgtgaggatgcctccgtaggtggctacaacatccccgttggtccgcgtgtactcatcaacgt

SEQ ID NO: 53699 - DNA, 575 bp, Triticum aestivum
  unsure (1)..(575): unsure at all n locations
  Clone ID: PAT_TA_53699
nncgtccgccacagctcgctcaccacaatctcaacagccatcggaatcaacagcagcagcggagcgatttcatcgactaacaaatcagcggacatggggatgccggcggtgaggaggagggagagggacgcggaggcggagctcaacctgccccccggcttccgcttccaccccaccgacgacgagctggtggagcactacctgtgccgcaaggcggccgggcagcgcctcccggtccccatcatcgccgaggtcgacctctaccgcttcgacccgtgggcgctccccgaccgcgccctcttcggcacccgcgagtggtacttcttcaccccgcgcgaccgcaagtaccccaacgggtcgcgccccaaccgcgccgccggcaacggctactggaaggccaccggcgccgacaagcccgtcgcgccccgcggagggcgcaccatggggatcaagaaggcgctggtgttttatgccggaaaggcgcctaagggggttaagaccgactggatcatgcatgagtaccgtctcgtcgactccggtcgcgccgccagcagcaagaagggctcagtcaggct

SEQ ID NO: 53700 - DNA, 568 bp, Triticum aestivum
  Clone ID: PAT_TA_53700
cggacgcgtggggcagtcgcagcggcgacgaagcaaagatgtcgtattcgaggtacaggagtcgttcaaggagtgtggactcgagtgatgttgagaaccctgggaacaatctcttcgtgactggtttatcatctcgtctaactgatcaagatctggagaagcatttctctacagagggagaggtgattgatgcaagtatagtacttgatccatggacaagggaatcacgtggatttgggtttgtcaccatggctactcttaaggaggcagaacgctgcatcaaatatctcgaccgttcagtgctggaaggtcgtgtcattactgttgagaaggcaaagcgaagacgaggtcgaaccccaacaccgggaaggtatctgggcgccaaatcatcgcgtggaaggaggtatctccgaagcaggtcacctgttaggagagaccgttacagctcacgctactcgcctgagcgagaacgctcttattctccttatcgcagaggacgatcatactctcgttgtgacaggcgtagatcatactcgcgaaggagatcatacactccttccaacaggtc

SEQ ID NO: 53701 - DNA, 516 bp, Triticum aestivum
  Clone ID: PAT_TA_53701
gtcgtaccgctggggtatatgcttgctgcaggattgggagaggaagatacccccttactgtttactgttttcaacagcagcgagagaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgtttaaaagaaccaaagtttacttcccggggattgcaaggtaaaattttttttatggggcccccaaaataaaattaaggggccgggttttaaaaacgtgggaatggaaaaaacctgggggtacccaaattaaatcccttggaaaaaaatccccttttcccaagtggggaaaaaacaaaaaagcccccaacaaatcccctttcaaaaaattggccaaccctaaagggaaaagggaacccccccttaagggggcaataaaacggggggggggggggggttcccc

SEQ ID NO: 53702 - DNA, 297 bp, Triticum aestivum
  Clone ID: PAT_TA_53702
agggaggaaaaactttattcatcatgcggatcgtccaaaacgaatacaagccataggccatgaaagaactcgccaagaaagaaagaaagagattgacaatgaaaagaacattaaaagggggtaaacagtctacatacgtgctctgcggggcatgcgtgcatatgcagacttggggcttgcccgtgtaggttcaaaaccaaaccgggcgcgtgggtcggcccggggtttccgggccggggcctggaggggagccaggttggcctgtggggggtggcgttaaagctgggcggtgcgatg

SEQ ID NO: 53703 - DNA, 412 bp, Triticum aestivum
  Clone ID: PAT_TA_53703
aacccctcccccaaaaaaaaaggggggccggggggtacaaacgggggccctcacagggccagggggtctgattccccagggggaactaagcggtataattcaggggggcctttttttttggtggccctggggtaaggcctccggggaaatcttcaggggccccccctggagcgcccctgggtagagcaggcatgccagcttccacccaaacagcctttaggggggccccggggaaatcttcggtgggaccagcccgccccccaaagggggcctcgggggggccgtccatctttctgggggggatttgcaaaacccgagctcttgctttttccggggggggggggaacccaatctttttgtcccggcccccaaaacggggcgggcccgggggttcccccgggaattcccggcc

SEQ ID NO: 53704 - DNA, 623 bp, Triticum aestivum
  unsure (1)..(623): unsure at all n locations
  Clone ID: PAT_TA_53704
agaccaaaataaatctcagctagctgagttttagcaatccctacaaagtaatgctacagaggaagacaaaaaacagatcctacctttgattcaagatatacatatggtccaagaccaaaactaaactatgctgaagatttgctgcagttcagtagattatgccaaatcacggactgtcaccgcgggttgaagtgaacccttattctctgtggttttatgtaccgtcttctgcaactgcaatattcaaaatatatgcttcccgtgtttgctctcttgtccagattcactacgtcctgtattttgcatgtcctaacctaaaccagatcatatagccttagatctcaatttggaaacgttccaaaagcgtgacgttcatcaacatcccttgtggccttgtactttatacaggagaaactgttgtactcggttgcgacgagttctcattattaagtgcatcatgttcagatgactcaacccaaaggggtgacaaggccaccaccttgccgatnattatcagagttggagaaaccagatccgcagagtggacctcattcacaagatccttcaacattgcgaataccattcggtgttgggggggtaggctacgctctactgcaacagca

SEQ ID NO: 53705 - DNA, 357 bp, Triticum aestivum
  Clone ID: PAT_TA_53705
gataaccgggatcctacttagactcggttcattttattaagcaacttgcattgtataagatggccaggtgagaaaagaaaataggtactaattgccaccggatagacggccgcaggagagcatttccgaataaaactgttcaccctcccaccagcggaacaaaggaaataatcgatttctttcgctgaaataaaatccctcctcttacttttcttgtctcctctctcccgtcctagcccgtgagttgacttagttttgctcaccgcaggaaattagacgacctgtgcaatccgatcagaatttcgcttggacctgtgttcgccctgcgaggctggaactgcgtcctcggcgtggcat

SEQ ID NO: 53706 - DNA, 494 bp, Triticum aestivum
  Clone ID: PAT_TA_53706
ggaaacaaaaagggttgcatttacgagttcatatatgcccacacctctaaacatttaccaacaaaaagatgggacgatgtaaaacacctctaaatgtgatctcgagcccctacatcctctgatctgaatacaaaacatcacaacatgcatggcaccactaagtagaaatgcttcagccggccggtcatctcctttggctcaggaggcaacaaagaaccgtacgtgaagcaaaaaatgggtgcattgagcaacgaatgaagcaaccacaaattgcttccgagctaccctctctttttctgttatctgtttcattcaggaatcctcgggaactctgtacacggcagcagccttggcacagcagcctgcaagcatgcatgcatggtttatgcctggaatgggtccaggcttcaggacgcgttcatctgatcgaggagaatgaccacggtcatggtcagcgccgggtccaagtgtggttgcaccaccaggctgaacac

SEQ ID NO: 53707 - DNA, 558 bp, Triticum aestivum
  Clone ID: PAT_TA_53707
cccacgcgtccgcggacgcgtggaggccatctagctcgctcggattacggccgtcggcgatggtgcttccagaggtgagcggcatggcaggggcgggggcggaggaggcggtggtgggcgagagcttcgagttcgcctttgacaaggaggccttctccgacaagaagctgcgggtcgaggtcgtcggcagcgacgacgccgccagccgcaagcgccgccgcgaggacgacaaaagtgatgaaggagaatgtgttgattcttcttctatagtgatggctgcaccaattttacgagtcactaccatgcatatcaattcggccattcttgctgcaaaaagccctttctttttcaagcttttctcaaacggcatgaaagagtctgacaagggacaggcaacacttcgaatagctgattcagaatctgcagtgctgtgcctagatctaccatattccatttcaatggcacctgccctggcagtggcagccaagaaattctttgctgaaagatacaaggatttcctgtcaacaaagttacaagacgaactggtgaggatccctg

SEQ ID NO: 53708 - DNA, 501 bp, Triticum aestivum
  Clone ID: PAT_TA_53708
gcccaagaagaggttgcctcctgggccatggactctgcccatcatcggcagcctccaccacttggttggcgtcctcccacaccgcaccataatggagttgtctcgtcggcatgggccgctgatgctcctacggctgggcgaggtgcccactgtggtggtctccgacgccgaggcggcggcgctggtgataaagaccaacgacctcgcgttcgcaagccggccatgcagccccacgcaggagatatttggttgcggcggaaagggcatcctcttcgccccctacggcgaccacttgcgcaagatgcgtaaggtctgcaacgtggcgctcctcagctcccagtcccaagtcccaacaggtgaagcgaatggaggctatccgggcggaggaggtcggcaaccttctccactgcatcacccccgcagcctcgaccggcaccaccatcaatcttagcgacaaggtagccaagctcacaaaccatgtggtgtgccggtcagtgtatg

SEQ ID NO: 53709 - DNA, 545 bp, Triticum aestivum
  Clone ID: PAT_TA_53709
tgtacaaagcacttatacaactggagcatggcctatcatgtttgtcccaaacttgtccttcaaatggatgtatctagcactaacttggtgctagatacatccatttgagagacaagtttttcggacggagggacctccgtcccgaattacatgtcgtggaaatggaaaaaaatgaatgtatatagaactaaatacgtctagatacatccatttatacggcacgtaatttcggacggagggactatatatgcaagcaagcaggtggatgaggaggccaaaccatccatgagggcgtcgacatcatctcgccccttgccttgtggggcggaggacgaggaggcggagcagtccagagcgccgtcctactcctcctcaccttcgagtgaaagcggaggacgaggaggccatgctagcgttatacgtagatctttttgcaattagcgtagtatgtgcttgcttgactgaatatcagtatgcgtttattcttgtcaatgtcatgctagtgatttactcatggattaattgagtcgacatattgcctattt

SEQ ID NO: 53710 - DNA, 591 bp, Triticum aestivum
  unsure (1)..(591): unsure at all n locations
  Clone ID: PAT_TA_53710
cttgctctcgtcctcagcgcggcttcgtcaggaagcaggccgagagccccgccgccacgcccagaggccgcggcggtgcgccggtgggcggttctggcgccaagcgttccagatcggcgtcggtggtggggagcggcggccgtagctcctcaatccgaagataagagaagaaggggatcgagcgagcaggccaagcggcggtcatggcccatggcgctcctcgtccgagatccatctaccacggtcatcaggggagcacaatcgcccgctcgcgcggctgtgcgcgaggagacggctgcgcgctcacctccgtgccagccccatcttccccacccaccttaggcggcagattggattcgcgtcgtcgtcaagggccttgacggagatgctcctccgtatgcttctgctcggccattgcccacgccatggagctggagcttctgctcgcccggctcgtcgctcttcccctagtgcagtgcagatgcaccagcggctctgcctgctcctggtccgcttcccctgcccgcgactctgggtggcatttgctgcanttttcctatgttcatttggaggaggcgggtgattaatagc

SEQ ID NO: 53711 - DNA, 373 bp, Triticum aestivum
  Clone ID: PAT_TA_53711
gcgccttataatatactcttagctgatgcatggttctgcgtaggcgagattgcaggcagaggattcaccttaaccggctataaggtctgaattagatgtcgaggcgcgccttataatatactcttagctgatgcttgtcgaaattacctgtcttggttcacaattttgtttctgaaaagtttccagtgctgaatgccagcaagacgagcacacaattgcaacagtgcctcaataatttgctcgctcaattgcccattatttttttgtggtctgtaacttgttccacttgacgcctgctgcaccactcttgtgttgtctggtatgaaatgaacccatttcttgttgcagatgaaagtaaacttattggttgtgc

SEQ ID NO: 53712 - DNA, 273 bp, Triticum aestivum
  Clone ID: PAT_TA_53712
cggtacgcgtgggtaaaaaaaaaaaaaaaaaaaaaaaaaaaaaaaaaaaaaaaaaaaaaaaaaaaaaaaaaaaaaaaaagggcggaccaaatataaagaatacaaaaattaagggggcgggcgatttaaagaatcggggttttctttatgggggcttcaatttttttaccgggttctttggggcgccttaatttttttttgctggcccttgttttacttcatttggtcgggtttttccacgggtgacttggataaatcgtgtggaagccaatt

SEQ ID NO: 53713 - DNA, 380 bp, Triticum aestivum
  Clone ID: PAT_TA_53713
gccagtagagagacggactagactagaccagatctcgtagcggggtctccggccgcctccccctcccggggccagcacgccctgccgtccgccggcggcctgctcggtcgtcggtgagtccgtgcagcggcccgaagaggcgcgtgctcgctccaagggcgaagggggacgcgccggatctcgcggggcaagtgcgccagcgacctgaggtaccttggtatggaatgaagtgaagagcgcagagtatcttggtcttactaatcaatgcatcatattatgtgcgcaataagattttgctatgctttcaccgtcgatgcccactggttggatcatgcttctgtttatgagctgattgaagtaactgtgtggtgactgaaatg

SEQ ID NO: 53714 - DNA, 400 bp, Triticum aestivum
  Clone ID: PAT_TA_53714
gaaatccccgggtgcgcacccacgcgtcgcgggcccttttcccacctcgcggacctgcagccaggggcccgctgggggcttacaacaacgacatccctccccccctctaccggggagaaagagcgcagacttcctcaccaagcagctcacctggctcgccaacggccgcaaccaccacatagggcgggacagccaatggcagaccaacaactgctccctccccagggccgacgccaggaggttcatggacaggaggaaggggaagcggctcatgagcgggggggactcgctcaacaggagccagctctacccgctggcgggcgtggggcactccatcctgagcaacaggaggaagaaggggcgcaagcggggagcaaacaccatggggcacgccagggag

SEQ ID NO: 53715 - DNA, 489 bp, Triticum aestivum
  Clone ID: PAT_TA_53715
aatccagccccctccgatcgaagcgaagtaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccagaaggaatccacactccacctggtgctcagactccgtggtggcatgcaaatcttcgtgaagaccctgaccggcaagaccatcaccctggaggttgagtgctctgacaccatcgacaacgtgaaggccaagatccaggacaaggagggcattcccccggaccaggagcgagtcatttttgctggcaaacagctcgaggatggacgaacgctcgctaactacaacatgcaggaggaatgcacactccacct

SEQ ID NO: 53716 - DNA, 545 bp, Triticum aestivum
  Clone ID: PAT_TA_53716
cttgcaacaaccttgtcaccttcttccacctcccaatcaagtactagtacgtaccagtagtaacgttacatggtgcagtaaaaatactatagcatgcatgcagctggccaatgttacatcagcgtggcatgcatgcatgcaaagactagtaaatatagcagtagagagagaattaagcagcagagaattaactagagaagacgagacgcacggccgggcatgcacattccatgcacggacgtcaggtcatcagccggccggggaagaagacgttggcaccacgtacgttggtaggatcacgaggaaagcatggacgagacgacgacgatcggtgacggcaacaaaaaaacctcgtccaccgatcgcacctcatatgccgctggcccggaagagccgcatgaggccgaaggtgagccccatggcggccagcccgccgacgacgacccgggcggaggacctcaccacgggcgccctccccagcacggccccgacgaccccgaacgccgccagcgccagcgtcgccacggccaccaccacggccaccc

SEQ ID NO: 53717 - DNA, 565 bp, Triticum aestivum
  Clone ID: PAT_TA_53717
gacaaaccctcataatttcctcgaaaaaaaaaccctcataatgctttacagagaggaaagggttgatgtatcttttccatggaaaggaaaaataaccttgattcctacagataaaaaataacctcgataacaaatcatttaaacactccacaaacagtagagcagcagatttattacagatttcagtctgctgacaacacaatacctgaatgtgaagtaaaaatgtcatcaaataaggcatatattatacaacaaccacagcacaaaacaccaaagaaaacaaagacggattaacacgttcatgcgctgcttcaatccttcttctggaccctgagtgtgaaggcctggagggacaaaagcacttgcttgatccgctctctgatctcagcatcaatcaaatttccatcactgtcaaacttgggtggctgctgaaatgcttggacgaacagctctggcttgttgatgaaatgaagatctaagaacaccccgacctgccggagatggtactgtgatctacctcctccaaagccacctcccgcgctgacaatcgaaggaggtttgtctg

SEQ ID NO: 53718 - DNA, 578 bp, Triticum aestivum
  unsure (1)..(578): unsure at all n locations
  Clone ID: PAT_TA_53718
cacgaagttcaacttcagacaattttatataagcagactaaaaacagataaagtactttgaactatgaagcgtaacaggttgtgcaagtccaactgcaacggtgaagaacgaacatgtccagttggtccaaggaagaacacttcatcgcatcaagacccgtcaatgtcacggcgccggcattttcggcgccttgccgaccgtgaacccgccgtcgacgacgaggttatgcccgttcacgtacccggcctcgtcggaggccaggtacaccgccgcgcgggcgatgtcctccgccgcgagcgccggcccgcccatctcgttcatgtccctctccacgatccgcctgcgctcctcggcgctcgccccgggataggactcggccatgtaccccatcaccatcggcgtcgggatgtagtttggcgagatggcgttcacgcgcaccccggggcgcgccatttcccccgccacggngcgcacgaggcccaccaccggcgccttggacacgctgtacgccggaaacccacgcctcccagcaccgncgccgtgctggccgggcagatgatgctgccgcgccggttgg

SEQ ID NO: 53719 - DNA, 608 bp, Triticum aestivum
  Clone ID: PAT_TA_53719
gcaaaaatattaacaagtacgctgttgcctttaatcacgtcatagcccataattgtacaatcctctctggcggcgctgtggacaagaggagagggtggatgcaacctaagagactccttaatgaccatccgcatgtattggagttcaccaagatcgctgttagtaatgatagctcggtcttgacctagcacatctcggatctctagctgtgctttggccatggcttcaggatggcgaacgagctccgacatagcccactccaaaactgttcccgaggtctcggtgccacctccaaatatgtcaaacaagacgccacggatgatctctgtggttagagggaattccatcgtgtcctccttctgcagcctgagcagtacgtccagcaggtcctcatcgctgcctccatggccagcagcttgcaccgcctggcgctcctcgatgatgtcggtgatgattttctggattcggccacagctcctactaatcccgctctcgccgctgctgagccaccgcactagccgccacgacgggaacaagtcaacaagatagaagccgcccagcaacctcaaagccttgcccaattcatggaaggactccacctgctgctg

SEQ ID NO: 53720 - DNA, 145 bp, Triticum aestivum
  Clone ID: PAT_TA_53720
ggccacaaaaagtttcgtgaggacttgcataataaagtgaaattacaaatacagggcgccggttgaattgaaacacacaccgtcgcacgacacacaccgtcgcatgaggtgtgggagccactgtatgaacaggagtccctcttat

SEQ ID NO: 53721 - DNA, 452 bp, Triticum aestivum
  Clone ID: PAT_TA_53721
gggcacgcgacccaaaaactggattaaccataaatcgggggcactagcccaccggtgtttacaacagggcacacaaagggaagaaaattaccgacccgcccctgttttttggatgggggacccccaacaggaaacaaaaaatgcaatcgggtccaaaatattttccaaccggatccaatcccgttgtcgccggggaccttagcacttggtacctcgggacctccccaggtgttttttccataacacaacaccgcaaaaaaaaaaaccttaaactcccatttggaaaagaactgccttccatttaagcaccaagcccggaggaaaaaaaagggccccccttcggccaacatattcaatggggaaacggggaggaccggtttcccacaaccaaaacggaccccctaaccttaggtcaaacccattgaggatgagctccttcccaaaatgaaaaa

SEQ ID NO: 53722 - DNA, 438 bp, Triticum aestivum
  Clone ID: PAT_TA_53722
cggtcagacaagcatttttattttggaaaaacaattaaaacatacaccgccgatacagaagcagtacacaacacgccaacgccatcgccgctttgccgcccgggggcgcgtccgtccgtcacttcaccttgccgagcgtcgccttcttccacgtggcggcgacttcctccagcgcccggcgggacgacccttccggcgaccacgcgcgcgccgccgcctgctgcaggtccccggcctgccgccgcacggcgcgccccttctccgcactctccatcagctccttcaccgcgcccgcgatctcgtcgcgcgccaccacgccgtcggcctcccgcggacgcagcggcagcgccaccccgacgctccctaccagggccacggcgttcatccgctgctccgggtacaggggccacgccaccatcgggacgccaagcgatacgc

SEQ ID NO: 53723 - DNA, 585 bp, Triticum aestivum
  unsure (1)..(585): unsure at all n locations
  Clone ID: PAT_TA_53723
agtgtaacttcgatttctctgttattcgcatttgtgcatgtttcttagactactgtactatcttggtttattcaagaggatacaaccattgttccagtaatcgatcacacgagtgctcttacaaagtgctattacaacagcgcaacacgccaatcaaactctacaaagaatagttgtgctacgcccccctggccgtccgccccctgcgctccccgcaagttggtgcccgccactcgatcagacgttgtcgggcaggtcgaagtgctggacgccgagcacctgcagcgccgagttctgcacgaagaggacgatgccgcacttggtggcgcggaagtcgtcccacagcgggaactggacggacccggacacggccttcctggcggacgtgccgtcgcgcacggcggccaccttctccagccggcgcaccacgtggtcgttgagcagcgacttgctcttgttctcgccccggccgcagtcggtgaccacgccgcttctcgtacagcgccaccagcacgcttccgccgncgtccacgcggggagtggagcgcgcccgtgaaagacgcctgcagcgtgctcgggttcggc

SEQ ID NO: 53724 - DNA, 402 bp, Triticum aestivum
  Clone ID: PAT_TA_53724
ggagcagggtccagtagaggtattcaatatccgtgcgatgggctcgcaaaaaatcagcataaaacaacttacactgcagttggaccatgcgagacccaattatttttaactgaaaaagaactccagcaagggccagtggagcaccgtttccatagtcctgaaacaaagactcctagcccattgtaaacagcttagcagtgcatccggaattcactcctggcgagaatatatgtcgggaggtactgggtctaggctcttaggctatgagcatcctcctattcctccagagactgtgcgtgcgcacctcaaggcggacggtgcatggcccttgccgagactgccatagacgtcataacgtgagccatggtacggtcagaaccaatcaccaaaggctccatagtt

SEQ ID NO: 53725 - DNA, 606 bp, Triticum aestivum
  Clone ID: PAT_TA_53725
aagacaatccagacaaatactggttcgcataaaaattcagtacaaagtatcaagattaacataggaagggcaacttgtcgcatgtgacctataaaaattcagtacaaagccttcttagtctgcacaaaacagagatcaccatacatcaaaacagttgaaactgcaatgctgatccatgcactcatgtaccgtgctcaatatcataggtaaacagttcaattaaaaatatatactacagacatctaattcatggcattggcacatcgcaagacacaagatttcattcgagtggctttcaggctacttctattctgcaaaacatgagggaaagcgaaaggatgtaggtcatcggcggtcaatatgacgacgtccttgatggcaccatcagtatatagcggtggtggattgtgctcttcctgggcagtaactcaccaggtaaagtaaccatgacctcatccgactcaagcggcgaccaggccgataactttcatgtctgacatttttaaatccccaatctatgttgcgaatcatagcccaaacaattatagcttgtttatatcaaccttccatgtgcatatcatccatatgttgaaacaaactaacaat

SEQ ID NO: 53726 - DNA, 561 bp, Triticum aestivum
  Clone ID: PAT_TA_53726
gagttgaaacactatcaatcaagcttcataagatctgttcaacaactcatgaaaaaaagagaagacaatgaaacatgtgttctgtacacacatgcctttcaaaagagttccctaaaaaaccgtgggggatatggtccttgtagaagccatgggggatatggccgcacataggacaggggtcgtgttctccggctcctccggttgcaatcctatagaaccaaaaaggaaaaacaataaaattggggacattgcatatatgacgaaatagaagttattgttcatttttacaattgctgatttggattctaattcatactctaacataggacatctatattcctgtatttatatgctataaataaagtgtataagataagaatgaaactatgcgcagaaagctgcaagatcgtcatccttgctagcaaaaaatatggccttttcttctcactgaaagtacatctgtgtgagaatcgctagttaagcacaagtctaactaacaatttatcacaggagcaacaacagaatgccgactacactaaaaaagaacgcaccttaaccaaa

SEQ ID NO: 53727 - DNA, 349 bp, Triticum aestivum
  unsure (1)..(349): unsure at all n locations
  Clone ID: PAT_TA_53727
agcgaaagtacattcatccttgtctgctcaaacttcgtaaaaattacatataatctccagacgacaactcgacataacatattggattttgttgtttaggggggggggggggggggggatctaaatctgaaatgaactacaaggggggggtccaacactaaaccagtatggccggcctagaacatgttatgtaagtggcactgaaatattgcgggcttctatttgctttttggagcttccgtggtgctggtggagcctgcttcagccaacgaaaatttcttcactttcttttgggcgatgcactcccggagcgcgttaaggagggagaggcacttgttacggncgtagg

SEQ ID NO: 53728 - DNA, 642 bp, Triticum aestivum
  unsure (1)..(642): unsure at all n locations
  Clone ID: PAT_TA_53728
attttctcctctgttcggtccaagatcttggagctggcggacatggcggcggcggtggcttcgagcggcggtaggaagcgcaagtgcgaggagctgtctgcgcctgagcttgggcagctccacgaggacatgctcgagcgcgtcctcgcgcgcctcccgcccgccagcttcttccgcctccgcggcgtgtgccggcgctggcgcgaggccgcggggtcgcctgccttcctcnccgcctgcgcgcgcgtccccgcccgggacccctggttcctcatgctgtccgaccaacaggaggaggaggagccgcgccctccctgccccgccgtcgcgttcgacgccgccgagaagacctgggcgcagtgccgtgccgcccctggccccgtgccggtggccgcggcgggcgggctcgtgctctaccgcgcgcctgaaaccggcgcgctcaccgtggccaacccgctcagcggcgtctcccgggcgctcccgccgccgcctccggccgcaacagacgcgctctacgccgtggccatgtacggatcaccctaccgcgtggtcctcatcctgggcgagcttccgaacctgtccatggcggtgttcaactcctccaagaacgcgtgggaggacgccctgcctctggcgcgcaag

SEQ ID NO: 53729 - DNA, 572 bp, Triticum aestivum
  unsure (1)..(572): unsure at all n locations
  Clone ID: PAT_TA_53729
cccggngtgcgaccccacgncccgtcccgcccacnngcgtccggnaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcagttctttgttggcgagagcatgcatgatgatggcggcgtggtgttcgcctactacaaggagggagctgctgatccaacttttctgtactttgtacatggactgaaagaggtgaagtgctaa

SEQ ID NO: 53730 - DNA, 301 bp, Triticum aestivum
  Clone ID: PAT_TA_53730
cgggcgactctagggcgacaaaccctagctctcacaggcctcccccctcgcttcccctccccgccgccacccgagatggtcgccaacgttcccgcgcggctgccggtgaaggtggcggcgaggttcctgctgccccgcatctcgttgggagctttggtacgacggggcggcggccctggatgggaaggcggcgtcgacctcgtccaacgggtggcgctgcaagtgttggctggccctcccggtcgcgtgggcggcggtggcttctagcgggatggtctgactgggcggctggaccagatct

SEQ ID NO: 53731 - DNA, 326 bp, Triticum aestivum
  Clone ID: PAT_TA_53731
aaaaaaaacaaaatagatattaaaacaaaaaacaaaaaattaagataaaaagaaaaaaatagggggggcgatttaaagggtccaaggttacgagccctgtgcttgctacagtatagcgtattctatcctgcgagcctattggatttaattgcccggccctaacaacaagttcgactggtaaaaccctgaggttccccaacttaatgagcgtgggactacatcccgctttcggccattgggcgtatggcaaataggcccggcccgatgcgtccttcctaacagtcgcatcaacctaattctcctatgggacggcccctatatcggcc

SEQ ID NO: 53732 - DNA, 704 bp, Triticum aestivum
  unsure (1)..(704): unsure at all n locations
  Clone ID: PAT_TA_53732
ctacaacacagtagtccatatacatagagcagtgtctaagattacaaacttacaatcaaggaaaaaaaaagattacaacttacacaagcttcttcataaccgaattccgcttctacaacacagcagtccatatatactaccaagtactgacccacagctagagaaatccatacgccgtttattgtgcacatatttacataaacaggtcactcgacggcattgcgataattgcattaaagctttataccaagaacgaacatgtgaagaccctggtgtggcacactgctctcacatgttcattcctgcttgtcacatattcaccatcctggcggcctcggggtggtactggagcatctcctgccacaacatttctcggatcatatctgtgccaatgttttcatctatgtcgagatcgatgggcacctgcgcaggagggtttgcgctgggatcatacagcggggacatgtaggggtgctccagagcctgngtgacactgatccttttggaagggtcaaagacaagcatcttctgcaacaggtcaatggcaagagggtgcgcttgcgggtacatgctactgaggggaatccctgnggtgtatggaagggatttaatgtagttgcgcgctttcgggttgtcaatgaacgcgaggtcagcctcgctcatggtgccaagaacattgactatgagcttaagctgattaaggc

SEQ ID NO: 53733 - DNA, 426 bp, Triticum aestivum
  Clone ID: PAT_TA_53733
ccggggcacgtcccccccgccgcacgaacggggaaatttccccgggctcaaactcgactccataggccacggttacagcgggcgactcggggcttttaaaaccgggcctgggctgggcacaacccacgccctcccacccttggtggccccccgatgggcccgctccgttcggggccacctcgcgcacaaatgcccacggcttggggggagcccgcagcgatcacccccgcctcgcaatcccttaaccacctggacctagccctaccccaccccgagggatgcgcacacccacgcacacccccgagttacgcgcgcacacacggacgcaacatggacactagtcaaacaccccccaaaccatggccagactacacacaagtcggcccatgaccatacagtgggcaaactatgcctaagttataactc

SEQ ID NO: 53734 - DNA, 516 bp, Triticum aestivum
  Clone ID: PAT_TA_53734
acaaaaaccccctttggttttttgaaatcaacccgcactacagggtttaaggcaaaaaggggggggcaatttacaaaaagcccctggggtttttttccaagacagggggggggggttcgcgacttcgcgggctggatcgaggggggggaagctggaaaaacacgccctggggtttttcttgggagtttgggcgcgggagcttgggggccacaagcgcggggtggggggggttacgggcggggcggggcccttttgggcttaagggtttcgcgggcagagggtggacatggcccttgtaggccagggggggccgaagaagggggggccaaaaaagtccctgggttttgtttaatttaacccgcaattcttgatgggtgaagagcgccgttatggaagtacgggtcttgggggcaaaggatggccccaatttttggggaggggaagaaaaacccgatcccgtcgggacatgaatgaagacgacgggggcagggctcccgggggggggggaaacggcgg

SEQ ID NO: 53735 - DNA, 552 bp, Triticum aestivum
  Clone ID: PAT_TA_53735
ggaataaatggtggcaattgtattaatcatgtccacctagctacatacgtactactgaaaacagcttcaatctccttgctgatcagcatactccacctagctacatactgaaaacagcttcaatcttgctgatcaatgagcatcggagcgactaatctagctaaaactttagcgaccttgtgcttatagaggaaggtgggcatgggcagctcactcgggtccggcgacacaatgaaggtcggcatgggcagctcgctcgggtccggcgacaccatgaatgtcgggccagcaaagaatgatgcctccgagtcctcctccatcttagtcagaggctccgacttcttcttggaccggtcgatcgacgaagcgaggccggcgaagggcgatgcctccatcacggtcggaggcgtcaccttcttctccgaccagtcgaccgacaccacagggccagccaagagtgtcgccgcctccaagtctgccaccatctcaagtcgaggctctgccttcttctccgacccggtcgatcgacggagcaaggccagcgaacgatgt

SEQ ID NO: 53736 - DNA, 423 bp, Triticum aestivum
  unsure (1)..(423): unsure at all n locations
  Clone ID: PAT_TA_53736
cagtgaccaacgtcagaactgacatacgtcagaggatactagtctttttttagatgaaaggcatgatgcccggcttgaaattaatgaagccatcaactggctaggggatacaatggtgttgcggacatcggggcagacttgttgcagggggggagagtcggccgctagatcaagaagctgacttgagaaggtcacacacaactgccgcttgagaagntggcgtggtcagggcggagatgaactgcaagcccgaggagaccagcgcgtgcataggccggcgagttgcgctgggtggtgggtggcggggtcgccgccgtggggtgtgcgccggggccgtgggtggcgatggaggggccgggggcggggggcgtgccgccgtggtgggctggggcggtggccggggagggggccgtggggggcgct

SEQ ID NO: 53737 - DNA, 606 bp, Triticum aestivum
  unsure (1)..(606): unsure at all n locations
  Clone ID: PAT_TA_53737
actaagaaaggccattatattataggtagaaaacccactcacagaaaagaaaccatctctttaattattgtccatatataggtaatcactactacaagccaactagttaatatgttgaacttgtattttcagggtctcgatgaatgtcttcccttgacgaaaacattcagtcgaaagaaaaaccgaaatcattggccttgaatttcccatatcttggtggtcgctcgtcatccagcaaaccaggcgcaggctccagcaccatctcgccatccacaacataaaacacacccagtgaaagtctctccttcttggcattcgtcaccaccctatgaactgggctcatgaagattccgttgcacattatctccatgcagtcagctaagttaatcaccaaagtataaggcttggctggaacattataccatttcccatctctctgaacttgcaagccaccgacgtcgtggtcgacagaaaggatggtaaggagaccaacatcagagtgaggcctcatgcccaaaactaggtcaggtctcggacatggggggtaggtagttgaacctagcaaacccacgagccttgtttgatatttggntgacgaagtaatcc

SEQ ID NO: 53738 - DNA, 303 bp, Triticum aestivum
  Clone ID: PAT_TA_53738
cttcttgcatctctttcactcgctgtattttcacctacaggctaaaccaatatccaagtcacaggagagaggagggagggggtgctctgctctgctctgctcatttcatctcgatgcttctgaagtcgagcatggcggtccggagccccatgaagctgctgcacttgcactccacgctcctggggagccccatgctgcggctgaagcacaggcccacgacgccgacgccgacgccggcctgcctcttgaccacgggcttggggtccaccatggggcgctggtgggacgggtggctggtgcaca

SEQ ID NO: 53739 - DNA, 233 bp, Triticum aestivum
  unsure (1)..(233): unsure at all n locations
  Clone ID: PAT_TA_53739
attggcgattgctgagaaatgggttattcgcaagagcaacgganccagtgcaacaatgagtaacacactctggtgttggcgacgtagcgttgcagactccgagctggtgatgtctaaacacgtggttgtgggcagcttagttgggtgggggggtggccggtgccgcagcctgcgcctgtgtgatcttggcgagctcgaccactgttgtggcgggcgggcgggcgggcttgggg

SEQ ID NO: 53740 - DNA, 644 bp, Triticum aestivum
  Clone ID: PAT_TA_53740
caagcccttcaatggtatttacagaactgatatataataaatatgtacaccaggtagtagaacaaatgaactcacctatgcacacaggatgagaattaacaggaaatagttgaattacgaccaaaggtacaaagctcatgtacaatagaaaatatgcagagtaaccaaaacttctcggaaaagcctgtgctgcaaaaagttaacaacggcttttttctaaaagaagacattgtaacattgaacaagaatgctgatgatctctcgtgggcatttcagtattgttggggtgcaagagtacaatatttacatgcatgatagatctcgtatcaagccaatatatggttgttcattgacgaagggtaaaccaccatgtacgctttgagtgtggatgacgtgcatatgcaaatttaaattgatatagcgaagtgctttgctcgatagaagcagtgagatgtaccttcgtttgtagttatcattgctcttcagtaagtagttatcgcccgcaccaagcctgtttatgtaggattgtggtgcaatttaggatgatcttgtggaagtcacaccacatgtgtaggacaaagactccatgtcagggtgggagaacccgggcagaatagaacaaatggatagatgcccgggcgatc

SEQ ID NO: 53741 - DNA, 290 bp, Triticum aestivum
  Clone ID: PAT_TA_53741
cgcagctatcacttgcattttcttcatccatttaaactgagttcaaacataggattccaacatcacatcccaatccatgacagaagggattgctgcatcaccgacgaacacgaccgaccgaccgactgaaagataacacatgttgtttcttcctcgcgtaaccagctctaattaaccccggacagagcgacactcgagctcgcgatcaaaaacaccacagggccggacgacacacacgactaaagactgactggcgcaggaacacgtctgcgactacgctgaggggtggg

SEQ ID NO: 53742 - DNA, 415 bp, Triticum aestivum
  unsure (1)..(415): unsure at all n locations
  Clone ID: PAT_TA_53742
tttttntttttttttttttttgtttttttttttttttttttttttttttttttttttcatctaaggcaaacaatccatcactgcagtaaatacaaaggatccactggcgggccagggatcaaatggagggggcatgaacattatcccacaacatgagaggggagcagggctcaccatgcccgcataaggctccaagaaaggcagataaccccagggccttacggggccaacatatcacctggggaggacccgccggtagtaaacccccaggaacgcttaggatcgaggggcgtttataactcactcataaatgggggcgctggcccctgggaacctcatccaggatcacaacagggctcgcgatgaacacgtagtggacgggcgggaacacgggcacactgaacgggtccctccc

SEQ ID NO: 53743 - DNA, 500 bp, Triticum aestivum
  Clone ID: PAT_TA_53743
gcgagccccagaaagtttccgatcgaatcgaagccaggctttctcgtcctccgagatgcagatctttgtgaagaccctcaccggcaagaccatcacccttgaggtcgagtcctctgacacgatcgacaacgtcaaggcgaagatccaggacaaggagggcatccctccggaccagcagcgcctcatctttgctggcaagcagcttgaggacggtcgcaccctcgctgactacaacatccagaaggagtccaccctccacctggtgctccgcctgcgtggtggaatgcagatcttcgtcaagaccctcaccggcaagaccatcacgctcgaggttgagtcttcggacaccatagacaacgtcaaggcgaagatccaggacaaggagggcatcccgccggaccagcagcgcctcatctttgctgggaagcagcttgaggacggccgcacccttggtgactacaacattcagaaggaggccaccctccacttggtgctccggc

SEQ ID NO: 53744 - DNA, 535 bp, Triticum aestivum
  unsure (1)..(535): unsure at all n locations
  Clone ID: PAT_TA_53744
aagaactaggaaagcgttacccccaagggcttccaaagctacatccaattacggacatgggtattgaagaacctgaattagttgacctggttcataaacttgaggatcttgagcagaaactatgttctcacccacttcataagtctgatcaaagtgagcagcaactgtcatggtaccaaagaaaagctgaactgaatcatgaaattcagcaactaaagtcaaagatgcgggattcacagctacaaaaatttagggatgaactgaaaaaccggtctcgtgttctgaagatgctgggtcatattgatgcggatggtgttctccagttaaaggggcgtgctgcctgtttgatagacactggggatgagctgcttatcactgagcttatgtntaatggtgcatttaatgatcttagtcatcatcaagttgctgccgatggtagctggtttgttccgggtgagaagtctagtgagcaaatacgcctgagaaatgagctttgtaaaccaatgatgcagcttcaggagggtggaagaaaaat

SEQ ID NO: 53745 - DNA, 219 bp, Triticum aestivum
  Clone ID: PAT_TA_53745
taccccgggcttgcaaggtaatattttttttatggggcccccaaaattaaattcacgggccgggttttaaaaacgtgggaattggaaaaaccctggggttcccaaatttaatcgctttggagaaaatccccttttcgcaagttggggtaaaagcaaaaaggccccccccgttcgcctttccaaaaatttgcccaccttaaatgggaaagggaacccccc

SEQ ID NO: 53746 - DNA, 124 bp, Triticum aestivum
  Clone ID: PAT_TA_53746
cccacgcgtccgtccgacggcgatgtcggagggtccggccgggcgggatgtatcgtgcagcgcatggaccggtgaggagggtccccaccgtacaggctcaggagtgtgccacggtgcccaccct

SEQ ID NO: 53747 - DNA, 250 bp, Triticum aestivum
  unsure (1)..(250): unsure at all n locations
  Clone ID: PAT_TA_53747
gtttctcatctcgttcccgatcccctttgcctgcctgtttcttttctcctcgtcgccggagacttggagcctcggagccgccccacccctgccccctcatccccaggagagccagccagccagccaggaataatccccttctccgcgcggcgacccgacgcggcggccaggccaggccacgtcgctgtccatctactccgacgccggcaccgctccggcctgattgcgnccgacttggattcgggtccat

SEQ ID NO: 53748 - DNA, 613 bp, Triticum aestivum
  Clone ID: PAT_TA_53748
cagactcgcgtctcctctcccccggcacaggcacggcaccgcatcacaccacaccgcacagagcgcgcggtcgagagggatggcgtacgcggcgagcacgccggcggtgccggactggctgaacaagggtgacaacgcgtggcagctgacggcggcgacgttcgtgggcatccagtccatgccgggcctggtggtcctctacggcagcatcgtgaagaagaagtgggcccgtcaactccgccttcatggcgctctacgcctacgcctcctcgctcctggtgtgggtgctggtggggttccgcatggcgttcggcgagcggctgctgcccttctggggcaaggcgggcgtggcgctgacgcaggactacctcgtcggccgcgccaagctgtcggcgacggagcgggggagcacgccgctcgtggagcccttctacccggaggcgacgctggtgatgttccagttcgagttcgccgccatcacgctcatcctgctggcgggctccgtgctggggcgcatgaacatcaaggcctggatggccttcacgccgctctggctcatgctcttctacaccgtggcgcctttagcctttggggcgggggcttcctttacact

SEQ ID NO: 53749 - DNA, 178 bp, Triticum aestivum
  Clone ID: PAT_TA_53749
ctcctctcttgcgtttcttccctctcgggttctcctccctctctcttgacggcgagcgggtatggcgacggtgcaggcggtggccaaagggaccctggtctcgacgtgcggtaaccagggccgaaagatttggtacccagcggcgcgatgccgtggcgaaccagcatgtcgacctgcg

SEQ ID NO: 53750 - DNA, 657 bp, Triticum aestivum
  Clone ID: PAT_TA_53750
gcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgcgggttcggcttcgtcacgttcggcagcgaggagtcgatgcgccaggccatcgaggagatgaacggcaaggagctcgacgggcgcaacatcaccgtcaacgaggcccagtcccgccgctcgggcggagggggcggcggcggcggcggcggctacggcggccagcgcggcggtggcggaggttacggcggcggcggcggctacggaggcggcggcggcggctacggcggccagggcggtggcggctacggcggccagcgcggtggcggcggcggctacggcggcggcggcggctacggcggtggtggcggctacggcggccagcgcggcggtggcggcggcgactccggcggccagtggaggaactgagcctcgaatctcccagttatcgatctatctaccgtgtcgttgtcgtcgtcgtcttcgtcagcaagttatcttcggtgtcgacgtgttcctgtgtcagtctgagtcgacgtgtgtgtggtgtttttgatcgcaagctcaagtgagactctgagc

SEQ ID NO: 53751 - DNA, 704 bp, Triticum aestivum
  Clone ID: PAT_TA_53751
gccaagtcaagaaaagtggggcagaagcaccacttaacactctggtatagtattacactagtctctagatcagcgatggcctctgcctctcgccttggcttagtggtgctcgtggcaatggcctcggcggcgtcggcgcagctgtcgtcgacgttctacgacacgtcttgccccaacgcgctggccaccatcaaggccggcgtgacgaccgccgtgcaaaacgaggcccgcatgggggcgtcgctcgtccggctgcacttccacgactgctttgtcgatggatgtgacgggtccgttctattggcggacacggggagcttcatcggcgagcagggggcagccccgaacaacaattccattcgaggcatgaacgtcatcgacaacatcaaaactcaggtggaggccgtgtgcaagcagaccgtttcctgcgccgacatcctcgccgtcgccgcgcgtgactccgtcgtcgcgctgggtgggccgacatggactgttcttcttgggaggagggactccaccactgcaagcaagacccaacgcggaaatgacctgccacctcctaccttcgacctccaaacctcaccaccttgttcggcaacaagcagctcagcatgacagacatggttgcgctctcaggtgcccacacgatcgggcaatcgcagtgccggtttttccagaacaggatctacaacgagacccacatc

SEQ ID NO: 53752 - DNA, 357 bp, Triticum aestivum
  Clone ID: PAT_TA_53752
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggccttttttaaaggaccctggtttccgtccgggggcgtccttttttatggttttttttttgggccccctaattttatttttttggccttttttttacaacggcttggctgggaaccccctggggttacctaactaaattgctttgggaaccccctttttttccccggttggattccttgggggcccgccccctcttttttcctttccaaaaatttgaaaagcctgtcgggacattggttcccccc

SEQ ID NO: 53753 - DNA, 187 bp, Triticum aestivum
  Clone ID: PAT_TA_53753
gtggcagctcttccatggcatacacggacgaccaccgtgcttcgcagtcatgacaacgggctgctctgcttctaccggaagtacacgctgaagatcggcaaccccgcgaccggacagcgtctgcacctctggaagcccgactggagatcgctccgggacctgtactacactgtatagtttagggttc

SEQ ID NO: 53754 - DNA, 225 bp, Triticum aestivum
  Clone ID: PAT_TA_53754
ccacgcgtccggcatgtcgacgctggcgcccacgacggccggttgaaccgatgaactggaccgactacatcatcctcggcgtcctcggcctgtcggttctggtcggcctgtggcgtgggctcgtctccaaggtgctggcgctggtgatctgggtcgccgagttctgggcatgctgactggtcggaccgggcggggggacgcattgggggggccgggtccgtgggg

SEQ ID NO: 53755 - DNA, 201 bp, Triticum aestivum
  Clone ID: PAT_TA_53755
gaaatatctccttcgcttttgcacttttcttttgggggggtccccgacacgtcacagcacagcaccgctgctcccccggtgatggcctgcggcggcggcggcgagtccgaggccgagcggcggacggcgctgctgcgcgagataacggaggagggcgggttaggcttaggcggctgagcagataaggcgggagggggggac

SEQ ID NO: 53756 - DNA, 273 bp, Triticum aestivum
  Clone ID: PAT_TA_53756
gcagagcaaggccggcgtggaggagtacgtcggctgcgccaccgtgcacggcatcggcccgtcgatcggcgtgttcgactctgtcagggacgggcagctggactgcgcgtgcatgtacccttctcctctgcattccaggaagcagatacaggagatattcgacaaggtgaagcggattttgggcgaagggtgcaacacgggtgatgagaaaccatgaagattgtacgtaggggctttgagggtgctaaattcgaagaatgttgtttcgaacaa

SEQ ID NO: 53757 - DNA, 376 bp, Triticum aestivum
  Clone ID: PAT_TA_53757
actcattgaagcagagattacggatcttgaaagaatgattgaagagtctgaagattctgagctggttaccttgttaaaagagaagatcgatcgactcaaagatcagaaagagaaccttgagactcttatagaggatattcttcaaatcgaggaacagctgcgcaagattcgtgaggaagcaacctccgacaaagaagaagcaaagcgtaagttagcaatcattggaagaaaaatgatggaaaaagagagtggtctcccaagaaacaagccatggcgtaaactcttaggatgggggttgctcttgctgttggcgcctaaagcaactatgggctttcctaaagccattgaagaagctttcacgggctggggggctgga

SEQ ID NO: 53758 - DNA, 307 bp, Triticum aestivum
  Clone ID: PAT_TA_53758
aaaggaaacacccacgagtatttcatattcatatctgatagtacatcaaggaatacaacgattcaggaaagacccaaaatacagagcaataacaggaaagaaacagcagggtcttgaactccatgggggggaaactgcaagccaagaaccaagtaccttgccttttggtccgatgccggaggaggagaaaagcactgtagacagcttccccagctgcgggaacaccaactggccaaacatggctacagatgcccgagtaaaagcccgcctctggaggcggggcaaagccctcagggaaagggcaccg

SEQ ID NO: 53759 - DNA, 159 bp, Triticum aestivum
  Clone ID: PAT_TA_53759
aaaagcacccggggcaattctcaaactcagccaaaacaaagccaaaccgacagacaaaataacagggctagacaaatagcctcaaatcatattctgatcaagggggctgctggggaacttgactgcaatttttacttgggggagggctgggcccaaact

SEQ ID NO: 53760 - DNA, 458 bp, Triticum aestivum
  Clone ID: PAT_TA_53760
ataacaaacaccaactattaattaataatagttcactaatagttcattgatcagataagcaacttgagatacatcatcatgcaaatttcctaataactaatggccaacatggagcaccaaccgacctcggccggtacgcccatgtggtatgcaattatatttctaaaatgcaaagccagctattcaggttttactagtttgcaaatcaagatgtaaaactggaaggccattgcattttgattcaaacagcacatatcattccacacttgtaacagcagatgaattatctgagcacttttctggcacatcttcgttggacctatttgcctcacgagatgcatctcccagagtttggcccttgttttcagaaacaaattcaccgttctcgactctgggttccttgaggtgcagcagtgaagcactgctgggtggctcctgggttacgggccgtacttgtt

SEQ ID NO: 53761 - DNA, 264 bp, Triticum aestivum
  unsure (1)..(264): unsure at all n locations
  Clone ID: PAT_TA_53761
tttttnntttttttttnntttttttttcttttgtgtcttgagattcgacaaaaacaggtgtataggagcccggtgttaaggtttcaacactatgagtggatggataaatacaggtctggtacaaaaatacaaaaccactttcagacaaagggaaaatgaagggtccctgaggtgcgcggaggggcaaaaccgaggcatggggcactaccaagatgacccagtgggtctaggataacaggggggggattcttgcgatggggcatg

SEQ ID NO: 53762 - DNA, 480 bp, Triticum aestivum
  Clone ID: PAT_TA_53762
atgctcatcatcatggagctgtttatatataacccaattacacagtctgccggtgatgtactcctacatccaaactctgccttgtggtttcattagatgtgcaccagatgatttcggtatatatattcacatggaaatggaagcgctcgatacaaattaggtagtagatactgaaaagaatatgaccccataccgttcatgaggcaatgacactgactatacactgtacaacaacctcaataacctcctactaaacactactcgtcgtattaacctacctgcagtctagcgattgagatgttcaaaaattccaactgaatttccagcacgttcctataccttctggtccatgccaaagaccgcaacaccaagcgttggcaacaggaccgtgagagccgcgacgccgacgattttgatgggcatgccggggaccaccatgtccttgatggtgacgtagccggtgctgaacccgacggagtt

SEQ ID NO: 53763 - DNA, 292 bp, Triticum aestivum
  Clone ID: PAT_TA_53763
gagtattaattagatcatttattggttcaccgaggatgaattaataacacgtcagtgaaataacattggccagtcgaactggctttgcgtgagttaataacacgtctgtgaaataacattggccggtcgaactggctttgcgtgagcgggaggctgtagattgctgatgaatgcgtcggcgaaagggcaacagcagtactgtcacgcagatacaccatcgccgccaaatgcgtcctgaaggaattgaccttgatcgagatggccgacgaggccggccttctggtgggtccat

SEQ ID NO: 53764 - DNA, 280 bp, Triticum aestivum
  Clone ID: PAT_TA_53764
ggtgaacataaagtattgcgcgatcacttttttatcaacaaagattatgcaacatttaaatacaagaaaggaggacactataggcttctaaagatgccatgttatatcagcgaagtcgcttaatataaagggggtgggtaactaccaaggacatcgaggcaggatatactaaggatggaagaaaagagagggctcagcttagacatacatgtaaagatggtttggatgaggggcagagcaacagcagctggggccatgtgggatggggctgggggctggg

SEQ ID NO: 53765 - DNA, 482 bp, Triticum aestivum
  Clone ID: PAT_TA_53765
gagagattcacgaccggccgcccgcgaggtcgtatggaaaaataatattgtttgtcgcaacagccaagatcacatcagcgactcacaacctgcagttaaaaacctcgctattcctacagggctacgagaaacatcaacagtacagaccctcgatggataccctcctacaactggatggtgacgcccctggctcccatgccggcgagccgctgctccgcggtgcccatttccctctcgccgccggcgcccctggacacgtcgtgccgcgtggcgtcgaacttttcgccgtcgccccacagggcgtaggcctcctccccgtgcgcggggtcgtcgccgatcatgagctggtcgtcgggcatccggagcggcacgaacagcccgatgccgagcatgatgagcgtggtgaccacgaggttccacactatcacgaacgccgcgccggccagttgtttgcccacttgtttgatgccccccccgtaaaa

SEQ ID NO: 53766 - DNA, 659 bp, Triticum aestivum
  Clone ID: PAT_TA_53766
gagtggaaagtggcagatgttatcatctcgcagcatgacatacaattagcatgttacacatgtggacgtagatgcacagctacagtttccaaccaacacacatacgtaaccacacaccaccctactccgtagattctggtactggtacccgagaccttattcagttctttcatgcgcagcagcagagtgtcggcgcggagattacgagttgaccttggagcagacgagcctgatctgcccctgcgtccccgtctttggcgcgatgttccccatgtttaccatggccgttgtgaaggcgctgttgaacgtcgccgcgctggacgcgaagctcctgaccgtgttgtcggcgccgccgccgttgaacagcacctggtccgagtgcaggagccccttctgggacatgaggttggtgtagtaggcgttgtcgaagccgttgggcgtctgcgtgtccagcggcgccaggctgctgtcaccgccggactgggggcagttggccctgagagatgtggcgaaggtggtgttgatgttggtctcgttgtagatcctgttcctgaaaaaccggcactgcgattgcccgatcgtgtgggcacctgagagcgcaccatgtctgtcatgctgagctgcttgttgccgaacaaggtggtgaggtttttggaggt

SEQ ID NO: 53767 - DNA, 150 bp, Triticum aestivum
  Clone ID: PAT_TA_53767
gaagttgaaaagcttagtgcacaaaatacttattacttgtgaatatgttacaatagccagttgcttaaatgtggctcgcgaattgcacggtagttcattcttggtcgggacggaattcattggtctggtggctccccgtatggggggggg

SEQ ID NO: 53768 - DNA, 247 bp, Triticum aestivum
  Clone ID: PAT_TA_53768
ctacaaaattatttccctagaatcgatcaaatggaagatggaacaagcggtactactgtctcgaatcgactagcgcgcgggcctcctagaggcgtgcgcggcggatcctgtcgccgtcggtgacgacgggggggggggtgatgtcccgcagcgacgggcacccgctgagcgccatggccagctccagctcgtcccgcagcatttgcagtaccttccgcacccccgcctcgccgtccaccggcaggga

SEQ ID NO: 53769 - DNA, 132 bp, Triticum aestivum
  Clone ID: PAT_TA_53769
gaatctatgaactctgagcagactccattgaactactagtgattaatagagtagtgaaaatttggctcctctatctgtactacacatggtgaaatttcaccattccttgtgtgttagttgtgtcatctatat

SEQ ID NO: 53770 - DNA, 231 bp, Triticum aestivum
  Clone ID: PAT_TA_53770
ggtcgtcgccgcagcgggcgccgctcccgatatggggggcagcagcgacgtcggcaagcgcggcaggtgatcgagcacggcagccggatgcagatgttcgccgatactggccggcgcccgttgctccagccatgcgggggggggctggaattgtggcagcaataccgattgctgccaccacggatcgcgcgtgaaggcggagaatccttccaggaacaccggaggggtcgc

SEQ ID NO: 53771 - DNA, 183 bp, Triticum aestivum
  Clone ID: PAT_TA_53771
aaaggaccaaaataattatagtataagtaacaagggtcatctgcgataacagcaatcaaatggccaaaataattatagtaaaagtaaccatgtacatttgcgatggtgggtgggtcgcagggcatccacccaacagtgggcggccggttgtgggagcatggggggcggtcgggctgaccgagg

SEQ ID NO: 53772 - DNA, 564 bp, Triticum aestivum
  Clone ID: PAT_TA_53772
aaaaaaaaaaaaaaaaaaaaaaaaaaaaacgatataaaaaaaaaaaaaaaaaaaaaaaaaaaacaaacaaaaaaaaaaaaaaaaaaaataaaagaaaaaaaaaaaaaataaaaatggacgaaaaaaatacaacaaaaaagactgggaaaaaccctgaagggggggggcttttttggggtgccaaactttcctcccgtggccgtgggcgtttttgctttttttttggggcccgctaagtcctttccccgggcccgcgttttcccacggggggtggggggaaccccctgggggtccccatatttgagggcttgggggcggttccccttttcccgaccggtgcattgccagagggcccccccccgttccctttcccaaattgggtccctttcttgggggggttgggggcccccccctttaggctctttttaggggggtgggttggggggttccccccaggggttcccgtttctttggccggccccttctggccggtttttttggtttttttcctttcttttcgccccgtttggcgggttttcccccgttggcctttaaagggggggc

SEQ ID NO: 53773 - DNA, 711 bp, Triticum aestivum
  Clone ID: PAT_TA_53773
gtgaccacctcaacttcaggtggaagattaagtccacaagaacaggcgactatacaagcaattgttgatgctagcttctatcctctttcaattgtgatggtgggggtgggcgatgggccatgggatgcaatgcagcattttgatgactgtattcctgacagagcctttgataatttccagttcgtgaactttactggtctcatgtcagcaagcaaggatatgtcaaagaaggaggccgcatttgcgcttgcagcgctgatggaaatacccactcaatacaaagcgactcaaggccacctccagagtacttgctcttcttcattccttgaggccctgcattagttattcttggcatccttatgaaagtgtgcactttacaatcttgtactcatcatcttaacctaactaatctatcaggaggcatgcacaaaacgccaaccctccgaggatccttccccctcccagcaaggttcttgaatatgacaatattgtcgcagcttctcatactccagccgcaacctcgcagtcaaccgacgttggctacaccgtttcggatgaaaaggtatgtcccatctgcttaacgaatccaaaggacatggctttccaatgcggccatctgacatgcaaggaatgcgggccgacgctatcgacatgccccttgtgccgtgcgccgattactgtccgtgtaaggctcttttcgtaagatgatgc

SEQ ID NO: 53774 - DNA, 717 bp, Triticum aestivum
  unsure (1)..(717): unsure at all n locations
  Clone ID: PAT_TA_53774
gtggacctcggccgcggcttcggctttgcggaggtcgagctctacggcgacgtcgtgctccgcttcgtcagccatccggacggcacggacgtgcccttcttgccggggttcgagggcgtgagcaacccgggtgccgtggactacggcctgacacggtttgaccacgtcgtcggcaacgtcccggagcttgcttccgccgccgcctacgtagccggcttcacgggtttccatgagttcgccgagttcacgacggaggacgtgggcacggccgagagcgggctcaactcgatggtgctcgccaacaactcggagggcgtgctgctgccgctcaacgagccggtgcacggcaccaagcgccggagccagatacagacgttcctggaacaccacggcggcccgggtgtgcagcacatcgcggtggccagcagcgacgtgctcaggacgctcagggagatgcgtgcgcgctccgccatgggcggcttcgacttcctgccacccccgctgccgaagtactacgaaggcgtgcggcgcatcgccggggatgtgctctcggaggcgcagatcaaggaatgccaggagctgggggtgctcgtcgacagggacgaccaangggtgttgctacaaatcttcacaaagccagtgggggacaggccaacgctgttcctggagatgatccaaaggatcgggtgcatggagaaggacgagagaggggaagag

SEQ ID NO: 53775 - DNA, 800 bp, Triticum aestivum
  Clone ID: PAT_TA_53775
ggaaattaaggaaacagtcacgttcattgtcgcctggtttatggtaactggtgttgccccctcccttggaatctctcagatttatggcatagccagttctccatcccgcagttttcgcatgttgcaacgcactggctcttttgtaggaccatcgtcgacatagacaagttctgcttcaaggacgagacatagaagaaggctcaacaagaggaaggaagcaggtgtggtttagcaacgtacctcatacatggttggttgctgacaaaggagggcagaattggattacaaaggctaaagatggtaccatctggctctcgcactagagtttttctggatgttggctttggagtaacaagttttgggccatacttaatttcacgtgaatttgagcatggtgttcctgcaatggtggcaactaatttatcaccggctattatccaatgttcccactgtagaataaattcgacatgtgatggtgagctgaggtatagtcatgcttcgtctaatacacctgaatccttttcttgatgatccacttaattatcataatttacccaaagatggacttagctggataaattatgataaaagtaattaaagtggaattctgctctggaggttaatagagtgtcagaactggcgagtactttccttggccagcacagcctgtttataagcatgaagaggcccaacatgaggcagggaaagatatgctccttaatactatcatgtaaatttgttcccttagggctatataatatactcaatgtgttaaatttacttattttccgcatgatgaa

SEQ ID NO: 53776 - DNA, 408 bp, Triticum aestivum
  Clone ID: PAT_TA_53776
gttcatcatgtattaagtacattttattgtgtcacttttttttaggggtagctttattcatcaaacaccacaaagtgtgcaacggagttcatcaaaccaggctttactgtgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaggaaaaaaaattaaaaaaaataaaaaatgggaaaaacccggggggttcccaaataaaaccgcttgaaacacatcccccttttggaaaagggcgtaatttttaaaagggcccccccaat

SEQ ID NO: 53777 - DNA, 713 bp, Triticum aestivum
  unsure (1)..(713): unsure at all n locations
  Clone ID: PAT_TA_53777
ccattgtgttgtcgacatgccttgttcgagcagatcagggttggagcaagcgcgctgggctgggttgatacccgctatggcattctccttctggacgacctgtttggcaggcatcctgtcgtcaagataatcccattaccagtgacaaccgttggcttgcccgagccaaccaagccgtatgactattactgtgcccctgagtacttttacaatgttgcctgctgcgatgatctcatcaaattcgtccacatcaaatacgatgaccctgatgccatgaccagaggttcaggttggaaagccacaatgtggaatatgaaggtctctgagcaaaattggtgcgagcgctacacagttgatgttgccaaaatctcggttgacaaaagctttcctgctaaattgcctgagctgtgggatgatgagactcaacaactgcagttgaagaacctgatgttccaaggcccgattctgagcatgctcaatgacgatttgctttacatgatggccaaggtgaatgatgaagacgacacagcctgngccatcactattgacatgaaacatgcagctctcaaggcactggcaaagttntctgtcaaaccgaagcaacaactcctcactacactctgcttctcatgcgtcttccccaagtacctcaacattcccccagggacagaaatgtatgatcccatggaaatgcactttaagaggatgagttt

SEQ ID NO: 53778 - DNA, 733 bp, Triticum aestivum
  unsure (1)..(733): unsure at all n locations
  Clone ID: PAT_TA_53778
ggtctttcccacgatcccaaccggcggcggtggcgcgcttttcaggccggcggcggcggcggcggcgcttttttcaggccggcggcggcgcttttttcaggccggcggcgggacggcggcggcggcgcgatgaggtcttgcaaccgtgttgcttttggtccccgtctctatctctgattcaactgcacggccggctcggattctgccgagattacgtcaaagaaggccccgtcagatcgattgcagtctgcccctattcaagatctgtcttgttgggttgccctatacacctcgattgcgaccaaaattgagtctttagacgaactcggctgagcagatcttgggaggagggatgtccaagcgtcggcaggagcaggtaagctacagggaccgcgccgacaaaaagttgcggtctgcgcagaggcagaagcacctctatctggcgctagatgactggaccaagggctttgctatctacaagattgacatcgacaccttggacagcagctccgacctggacttggagcccccggttcttcggctagtgtcagcttcacctccttatcccatgtacttcgctgccctgggcagcaatatcttcatggcgagcagcanacaccctggcaccatggtctacaacacagagacagctggattgngccatcgccctnctctncctgatgggactactcggagcattaaaatctttgtggctactgccaacatgcagctg

SEQ ID NO: 53779 - DNA, 541 bp, Triticum aestivum
  Clone ID: PAT_TA_53779
atcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactcct

SEQ ID NO: 53780 - DNA, 747 bp, Triticum aestivum
  Clone ID: PAT_TA_53780
caaaacctcacttccccagtacactttgccactgccaccgtcggccaagcccccgacatcgtgtatgcgcttgcgctctgccgtggtgatgtcctcaatgacacaacctgtgccgagtgcatcaccaacgtattcggcaaagtgcagaacgctatgccgccagaggtagagtgcttcagggctgcctcctactttgctgattgtatcctcatctacaactccaaagacatcctcgccccgtcattcaccaatagcacagaaggagaaaatggtggcgaccctccttttgagaggtggaatgtcagaaatgtcaccggcaacgtgcctctcatcaccggtctcatgcacgagctgctggtggagactgtggagaaggcagccagcgcgtcgccgaggcggttcgccaccggtgtcgtggacagtggcacaaacttcccgaaggtgtactccttggcgcagtgcacgcctgacctgtcttccggggactgtctagagtgcttgcaacatctccttggcatgatcaactccaccatgtccctccgcatgtggggacagatgggtgtgatacggtgttatttcaggtatgatgcgtgtcagttctatcaaggccaaccaatgataagtctggtgccggtagctacaactacagaccaacacagagagtgagtggacaagctggggggaatagccatgagagggatacctgtgactgggggggcatggggggggggggtgtggggcttgggg

SEQ ID NO: 53781 - DNA, 538 bp, Triticum aestivum
  Clone ID: PAT_TA_53781
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcctttttaaaggttcaaagtttacttccccgtgtttgcgaggttttattttttttttggggcccccaaatttaatttcattggccgtttttttaaaacttggggattggaaaacccttgggtttcccaaatttattcgttttgaaaaaattcccctttttcccagttgggttattaccaaaaaggcccgaccgtttcccctttccaaaattttgtccaccctaattggcaattggacccccccttttacgggccctttaagcccggggggtttggggtttccccccagggtaccctttacttttgccagccccttagccccggttcttttggtttttttccttttttttttcccaactttgccggtttttccccttaaatttttaattgggg

SEQ ID NO: 53782 - DNA, 604 bp, Triticum aestivum
  Clone ID: PAT_TA_53782
aataaccaacctaatgacaaatttcatcaatcggtaaatggtggcacagtgctgaggaaaactgttaaaatcatcaacctactacagattatgcgatgtcgacaataaaaacatatttttctcttgaagttcccgaaaggctttcactgctcacgcttcctcccttggggcagcagcaggagtttcaccggttgttggcctgcaaaatcacccattgttccagaattctcccaaagagatacgaccaatgaaaatcacaaaccataaagatgtaggtaaaatactcacagtccaaccatgactttgaaggaatcatagatcacccactgggtgccggtcagtgtgccgatcatgatgatgcggagcggaaggccccgcgtgaagagtccccataggcccaggttcttgacagcgtctccgacggtggcgcccttggcattgttgaggaaggagaccaggttgtcggcggggtgcgagatggcggcgcaaaagactccagcgatgtagccgctcccgaagctcaccccgagctgcagaggcttgctgcactggtccttgggggtggggatgaggtgcttgtacgccatcttcacgatgttctcgt

SEQ ID NO: 53783 - DNA, 587 bp, Triticum aestivum
  unsure (1)..(587): unsure at all n locations
  Clone ID: PAT_TA_53783
cgtccgccgtcgtcggcgccggcggggctggaggcgagggcggcggcctgctcgtgcttgccgcggtaggtgcggaagccctccttggcgcacacgaactggcgcgacatgatggagccgtcgcggcgggagcggtgcatcacgctgatccgggtgctgaagccgacgcggtgcgcgtagaggttgtagaaggtccacgcgtcctcctcgtcgtcgaactccatgccctcgaacgggtccaccccgtcgtgcacgctggggcgcgccgggtaggcgggagcggagccgggggttgaggcggcgtcgagctccatctccgtgccgtagccgacgctgtcgttgtccccgtcgcccatttcgctgtcgggcgtcccctgctcgctgctccccgccaccaccctctccatggccggcccgcccgggggtgcccggaggccgcggcggcgagatcaagctgcccccttttcgcgcgcggggaggggcgggcggnggcgatcgagccgcatacggcgcggggggccgaggggggaggtggaaggggaggggggcggcggcggcggcggaggtccggcgaggtgcgagtgggg

SEQ ID NO: 53784 - DNA, 575 bp, Triticum aestivum
  Clone ID: PAT_TA_53784
aatgaagcagctaaccttacgtaaatttactggtcgaaatgttcaatgcagatgtggtaggaatacatatggggtacagggcgtacgtgcagaaaacaaaagagtatgacactgctcgactggtctatgatcctagtcattcattcttcaaccctacaaaattcacttgtgtccaacatgaacatatctgttcgcactaaaacttatcttttgtttaatttcagattggtacttggtgttaccgatgatctctacagcgcgactgtttcaacttcatctactggtcttccatcatccttcttttggttggtataaatatgtcttcgtcttgaggaagccatggagcccgtgggagctctttgccctactgattacgaatctcgataagaaaccatcaggccatgtctcctgattaaagatgatccgcacaatggatgtcaggccttggctttataggatccgcgctagaggatatgaatgatatgattgatcccttgctaatggtctgctagaaatctgaatgatatatacaaattaaacttgaatgtgtaataggagttctgcatagggggcat

SEQ ID NO: 53785 - DNA, 470 bp, Triticum aestivum
  Clone ID: PAT_TA_53785
cccggtgttccgccgccgctctccccctgcccttccggtgcgccgctggctgatccgccgctgctctcccccttccgttccgctgcgccaccgctgctcccgctctgcattcccggtgctccgccgccgctctccccctgcccttccggtgcgccgctggccgatccgccgccgccgccgctgccgctgccgctgaagctaaacgaagcgagcccttgctgctggacatcgctggcgaaggatccgtcttcggccgccgaagagcggtggcccgccgccgccgccgagttgctgcagccactgcagcaagtgctcctgcggcggcggcggcggatcttgctggtgggggggggtgggctgctggtcttgctgctgctgctgcggaggcaatggcttacgaatgcagcgccgccagatgcacgccgtcacggcggccgtgactgccgacgcaaaaaccccagtgacaaacg

SEQ ID NO: 53786 - DNA, 757 bp, Triticum aestivum
  unsure (1)..(757): unsure at all n locations
  Clone ID: PAT_TA_53786
ggaggtcaccattcccatctttggccaagaagttttttatggtgtagataccgcaacttgcagtgaacaattaaacttcatcgttgatgcgctaaagccttccaagctgcggagcctcgttgatcccatgtctcaagaagtagaggcctactttgcaaagtggggacaagatggcatagttgaccttaaacatgaactcgagcaggtactcatgtttatctcaagtcggtgcctactcggatatgaggttcgagacatgatgctggaagaagtatactcattattccatgaccttgcaaatggcttgaactttctcagtttcttgttcccatatactacaaccccgagaaaccgccgacgagacaaggcacacatcaggctgaaagaaattttcactgcaaccaccatgtcacgtagaagctccggccgagtcgaggacgatgcactgcagaggttgatgaattccaagtacaaagatggtcgctttacaaccgaagcagaaatttctggcatgatcatgggcctcgtcgttgccggacacatctcaagcactagcactagtacatggactggagcttgcatgttgagcaacaccaagttcttaatagctgccatggangagcanaaacatatcattagcaagtacaagaaccaaataggctacgaagccttgtcggagatggataccctgcatagatgcatcaagggaggcaatagaatgcatacatcagcaccagttttagttcgcaaggcacat

SEQ ID NO: 53787 - DNA, 252 bp, Triticum aestivum
  Clone ID: PAT_TA_53787
cccacgcgtgcggatggcagtactacaagcgagtgacacaagttcttgcaccgatcagatccaacttctgcgcaagatgctggacaagctgtgggacgacgtggtggccggtcctcgcccgtagacggtccttaacaagctccgacgtgccgtcgacacccaacccctgtgcatgaacacagttggagttgaggcgatgaagcaggctgcgtttatgccgactacccctaccacgccggttacgccgttttt

SEQ ID NO: 53788 - DNA, 765 bp, Triticum aestivum
  Clone ID: PAT_TA_53788
gccccgccctgccgtccgaggagaggagaggagaggagaccaaggagatttgccgttttttctcttcacgacgcagccgctgccgctgcgaggaaacaaaacaatcccgtgaggcaaggacggttgtgaagcaaagtgatcaaatggcagccgagtcctctgttccacaaacttcctctgaatcggctgctcacaagatgggcttcttcagagtctctgatcttcttgtcaaactgagcaccaaatgtttgattgagttggatgccgtccgcagcccaacgtctcccttagacctgaaattgttcacaggccttgctaccaaatcacccagatcgtctttccttgatgccggcgcagccagccagaaccaaaagatcttgctcggggacagggttggccttggactggtggattctctcagtcatgaaaacaaccccacacccttgggcagcaggaaggttctcggatctgagatgaggattactgacaacttaactctcaagaacagctccactgctcctaatcaagctggactgcttgaacagaaagatgagaatatgagtgatggactcaacggtagtatcatgtccctggatgacattgtcaattcagaggattaccacctgtgttgttacccgtggtccgaaccctagaactacccacatttttggagaccgtgtttttgagtttcaagctgagcaactgatgcctgatgaaggtgggtgtgaggaagagtttgcccctcatctgaatggggataccatg

SEQ ID NO: 53789 - DNA, 788 bp, Triticum aestivum
  unsure (1)..(788): unsure at all n locations
  Clone ID: PAT_TA_53789
tgatgaagctgctgctctcccagcatcttcccaaccaccagatggacctatgagagccagcacaagcaactgttggctgttgctggctaccaccaccaccgaattctcaagccaacctccatcaccatttggctttgcccagtaattccgagagcgccaaaccaagatcagctgccaacaccaccaaagctagctgatccatggacctgtcggcgaacccggacagccctctctctggagggggcaacggcggcggttcctcgagcagcatcacctcctcgctttccgtggtctcagggggcactccgcagtcgccgagcaggtacgaagcgcagaagcggcgcgactggaacacgttcgggcagtacctgcggaaccaccggccgccgctgagcctggctcagtgcagcggcgcgcacgtcctggagttcctgcgctaccttgaccagttcggcaagaccaaggtgcacgcctcggcctgccccttcttcggccacccgagcccgccggcaccctgcccgtgcccactccgccaggcctggggcagcctggacgccctcgtcggccgcctccgcgccgnctacgaggagaacggcggcagccccgagtccaacccgttcgcggcgcgcgccgtccgcctctacctccgngaggtccgcgagcaccaggcccgcgcacgcggcgtcagctacgagaagaagaaacgcaagaagccgcagcagctgacccgcgacagcagcggcagcagctttcacagcaaccagcaccaggcccctcccggggcgcct

SEQ ID NO: 53790 - DNA, 507 bp, Triticum aestivum
  Clone ID: PAT_TA_53790
cccttcctcttcgttttcgtttgtaatgttctattctatgatctggatgtatcttgctgtagaatgatgttccttgaaacttttgcttccctttcctttccatggcaaaaatatcatgcatgcatgcatggtcgcttccagagtttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccctttaaaagaacccaatttacctaccccttcattggaaagaaaaattttttttttggggcccccaaattaaaaaaccggggcgggggtttacacggggggaccggaaaaaacccgggggtacccaaattaattgccttggaaaaaaatccctttttccaaagttgggaaaaaacaaaaagggcccgaccggtccccctttcc

SEQ ID NO: 53791 - DNA, 779 bp, Triticum aestivum
  Clone ID: PAT_TA_53791
cgaagcgtgcccaactccatctgctttccttttcctcttccccccatcccctcctcccaccgaaaccctagctagctcgagagccagccgcgatgttcggctaccggaaggcgccggacctcgacctcgaggcgggcggctccgcgccgctctacccggggatgacggaggacgtggagctgcgctgggccttcatccgcaagatctacgtcatcctctccgtgcagctcgccatgaccgccgccgtcgccggattcgtcgtcaaggtccccgccgtctccgacttcttcgtctcctccaacgccggcctcggcctctacatcttcttcctcgtcctgcccctcatcggtacagtaattattatgtcgagcctccccgaccccgccccctctctaaaattcgggttcctgcgttgactgatggaattgcttgcttcgttcgcgccgcagtgctctgcccgctgcgttactaccaccagaagcaccccgtcaacctcatcctgctcggcgtcttcaccgtctccatcagcttcgccgtcggcatgacttgcgccttcaccagcggaaaaatcatcttggaagctgcaattctcacagcagtggtggtgatcagcttgactgcctacactttctgggctgcaaagagaggccatgacttcaacttcctgggcccgttcctgtttggagctcttatggtgctgatggtgttctcacttatccagatctttttcccactgggcaagatctccaccatgatatatggggcccgggcgtcgatca

SEQ ID NO: 53792 - DNA, 579 bp, Triticum aestivum
  unsure (1)..(579): unsure at all n locations
  Clone ID: PAT_TA_53792
cggacgcgtggngaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcggtttttaggggtccaagttttcttccccgggtttgggaagttttttttttttttttggggcccctaaatttaatttcctgggccggtttttaccaccgggggggggggaaaaccctggggtttcccaatttttttcgttttggaaaatttccctttttcccgggtggggttattagaaaaggggcccccccatttcccttttccaaaatttggccccctttaatgggaaatgggccccccccttttaggggctttttaaccgggggggtgggggggtttccccccaggtggccctttatttttccagggcctttagcccccgtttttttgtttttttccctttttttttggcccagtttgggggtttttccccgaaaattttaaatggggggctcc

SEQ ID NO: 53793 - DNA, 192 bp, Triticum aestivum
  Clone ID: PAT_TA_53793
gccacgcgtccgctcttccccttggccccctcgtcttgcgccggaactagggttttagcggacctcgcccgtccggacgacgacctcgggagccatcagacatggacgcctggggcgagctgcagggcggcatgtagcaacagaaggagaagatgagggggagccacatgatgcgcggggggacgagccagg

SEQ ID NO: 53794 - DNA, 493 bp, Triticum aestivum
  Clone ID: PAT_TA_53794
caggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcggtccttcatgccacaactgtgacgtcccccatgttgaccgccaagattatcagctgattgacataactgatgatggatgtgtgagccttgtaactgagagtggcagcacgaaggatgacctgaagctgaccactgatgatgaggctgggtagagcagatgcaagactggatgggggtggtggggagggacctggatcctggggtgggagtgggcgggcgtgggggagggaacagggtcgtgggctggggg

SEQ ID NO: 53795 - DNA, 627 bp, Triticum aestivum
  Clone ID: PAT_TA_53795
catccctgctcgcgccgcctgggcccccctccgcagctgcccactccgccctcccggcgcgccactgaccggcgactcgcgcccggaaccctaagcaagcaacggcgatcgccggccaggatgcacatggacggaggcgcggcggagctgcgcgagacccaccggctgacgggccacgccgaccgcgcctggtcactcgactggaaccccaacccgggccccggtgcgggccccgttctcgcctcctggggtggcaacaagaccgtgcgcatctgggaccacacgcccgacggtgtctggaactgctaggacgtgctagacggcgtgcacaatcgcacagggaggacctgctcctggatcccaggcaggaagctgatggcgaccacaagtgtagatggcaccaccgcaataacatagtactcgcccggagacttagaatgcgtggcacattgaacgggcatgacaatgaagtaaatagcgtggcggggacccagtccgggtcgctgttctcgaccggctaacgagacatggtacaggaacatgggaggtgcaacctgcgaacgagcacgagtgtgtagccgtgctacatgggcacactcaggacgtgaagatgggccagtgtgaccc

SEQ ID NO: 53796 - DNA, 262 bp, Triticum aestivum
  Clone ID: PAT_TA_53796
cagtcaagttctgtcctcctcccccttctgttttgctcgccagcggccggcagctaggcggttgctctcccatcctccgcaatcctcccctcgatctcgtcggagcgggcggagaccgggccgcggcgatgacggtgatcgacatcctcacgcgggtggacgtcatctgccagaagtacgacaagtacgacgccgagaagctcaacggcgccaacgtcgccggcgaggaccccttcgcccgcctctatggctccgtcgacgc

SEQ ID NO: 53797 - DNA, 653 bp, Triticum aestivum
  unsure (1)..(653): unsure at all n locations
  Clone ID: PAT_TA_53797
agcataactgttcaaattgcgacttaatgaatgattttccagattagtaggtacatctgacttaataaatgattttccagattagtaggtacatctgacttaataaatgattttccagattagtaggtacttctgacgatcctgccggtggaaattcacggtcacagatttgtccagaatcaaatagctcttcacgtctcttcagccatcgaagctccaacgagagaaacatccattcgacggtgcagcgataattgtactgtaagcttcatttgggtaatacacggaccacttacagctgttcaagctttggtctttcgagggtagctccatgaacgatttgcgacggtagaacgttgtgccatgtagtcggatcggacgaggggtgcggacaaaggagcacaccagcacacaggggggagaacccggggctaaaacaagataacccccgtgcgatctccccccgagacaaaaaaacatctttattatggtggcggcctgccatgcgagcgcacccaacatggcaaaggcctctagatgttcacatctcttttttttcactctcctccgacctctccacaagcacctngcttgctacatctttctaccttacgtcacctncgatctcttagatctaataattatcgacatag

SEQ ID NO: 53798 - DNA, 776 bp, Triticum aestivum
  Clone ID: PAT_TA_53798
gtctgttttgatcttgcaatttagcaatgtgacagtgtaggttatgtgtaaattacataatctagcattacatttggtgcaaacggaaagcagctttgcaaggggatagaaaaaaaatgcttaagctaacttggtgcagacagtgcaagctacgtaaactagccgagaatactctctaataacattaggtgcggttatattgcaccgaaacaattaatctgttattagatcttgatgcttgatacataagtaattggctgagacatgtgaaaaaatgcagttatattgcgccgaaacaattaatctgttattagatcttgatgaagtattacaagtgtcaattacagagaggcgaggttacaaaacagcgtagaagattgtccacaaagtgtattctacaacagtggctaaattagatgaccatgatagtctaattacagacaggtaaggatagacaacaaaggacatgatttatcatttcctctgaaagaggagtagggatcagatgacttgtccgtattccttgaaaccatcacgcggatgtggttccatagcttcggcaagtataccattttttgcaactcgacaaataatatggcaacaagcataaagctgatcctcagatcacaagaacaacccaataggtcaggctgagggcgtggatctgggcatacagtagatagtatgtggattgctgcactgctaacttagtttagatgccaccacatatatcgttctctctgtaccacaccagtcttggatcactagctagctac

SEQ ID NO: 53799 - DNA, 740 bp, Triticum aestivum
  unsure (1)..(740): unsure at all n locations
  Clone ID: PAT_TA_53799
caaggcctcagccagcggctcgacgacgacgacgacgagggacgacggttcagcgacgagttgctgagcgagctggcctgcgtcgacgcgctggcgccgcagctgcagcagcagatcgtgcgctggctgcgggcgcgggtcgagcggcagatcgtcgagcagatcgcgccgatgttctggtcggcggtgggcggcgaccggccgcacgccttcgtcgacggcgtggtgcaggtgcggcgctaccacacgcggctgcagctgctgctgcgacgcggcttcggcgacgccgactggctgtggcagccgctgtcgcagctgctcgacgccgctgtcttctccgaccgctggtcgtcgctgtcgccgctgctgtcgcgcttctttcaccggcgattcgcggcctttgcgcgacaacactcgtcgtcagaggacttcttcccgccagcatctgacgacgaagaaaaagacgacgacgacgacgacgacgaagacgacgacgacgacgaagacgacgaagcgtgcggctgtgggatgcaggtgagcgagtgtcagtgcgcagagcgagtggtgcgctcgctgggacggctggccgaggaggtgtgcgtcgagctgtgctgcgcgcggattcagtcgacggtggagaagcagtgccggggccgctttccaccgcgggtgctnggggcgctggtggcgtggtgcccgcaggtgcccgtgcgctggctgggcgagctgntcgcgggcag

SEQ ID NO: 53800 - DNA, 694 bp, Triticum aestivum
  Clone ID: PAT_TA_53800
gtcccattcgacaaaacacgccaagcacgcgcaccgaatccatcgcccgagcgagcaagcagacaccacctgccccgccccggcgccccgccctgcccagactgccgcccaccgtctcccaggagctcaaaggcgccaccaagaaccgcacggaagcggccggagcaagcggcgcctgagccaccggatcgatggcgatggccggcggagccccgccggcgccgctgccggtggtggggcaccagttctgcgcgccctacgtggtgccgctgacggtcaccaagaaggccctcagcctctccgacggcgacttcgccatcaccgacgccaacggcgccgtcgtgctcaaggtcaagggcgccatcttcagcatccggagccgccgcaccatcctcgacggcgccgggatgcccctcctcaccatgcaagaaaaggtgttcagtatgcaccacagatgggaggtgttcagaggggacagcaccagctcaggcgacctgctcttcagcgtgaagacaacttcgctgatccaactcaagacggagatggatgtcttcttggccgggaacaccgcgcagcaggtctgcgacttcaagatcaagggcagctacttcgacaggtcctgcgtcttctaccttggcgactccaacaacatggtagctcaaatgagccgtaagctgactgtttccaatgtgct

SEQ ID NO: 53801 - DNA, 343 bp, Triticum aestivum
  Clone ID: PAT_TA_53801
cgagcgagcgagcggaggaggaggtttcagatcagctcatcgctccctccctttcttccccggatccagccgctcccgatcgagatctgccccggcggaccatgagagcatgacccccgtgcaggatcccttctacatcgccaaggaccagatccactattccattgacaaaatacaagatacttttactcaatggaagctagcacctcaaaatacaggagagtatgcgcactctaaccagagaacttgctaaccacctgtgagagcgtccaatggcatgggagatgagttaagcagaaggcaatctcctggtgctgatatagatccaccttactatggacta

SEQ ID NO: 53802 - DNA, 679 bp, Triticum aestivum
  Clone ID: PAT_TA_53802
tacaaacccaaacactcgaacacgtatagaaaacatgtcgagtcctctgcttgttgcaatggccgcggcggcgatcatcgtcgcctgctgtttcgcagcatgtccggtcggcgcgggcgcgagcgctggtggcttctacgacaacttcgtggtgaagtggggcacggacccagaccctgaccagcgggtcgagatcgtcgacggcggccggctcgtgacgctcaccctcaacaacgtctccggcgccgggttccagtcccgagacgccttcctcttcggcgagttcaccatggagatgaagctcgtgccgggcgactccgccggcacggtcaccaccttctatctgacctccaaggatccgacggcggtgggggacgggcacgacgagatcgacttcgagttcctgggcaacgtcagcggggagccgtacctgatgcagaccaacgtgttcgcgcagggggtcgggggcagggagcagcggtcctacctgtggttcgacccgacagaggacttccacaactacaccatcctctggaaccctctaaacatcatcttctcggtggacggcgtgccggtgcgcgtgttccggaaccacgacgcgaacggcgtgccgtacctgagcaggcaggcgatgaatgtgcacgcgaccatctgggacggcgacacctgggccacccgc

SEQ ID NO: 53803 - DNA, 520 bp, Triticum aestivum
  Clone ID: PAT_TA_53803
aaaaaaaaaaaaaaaaaaaaaaaaaaaaaaaaaaaaaagaaagaaaaaaaaaaaaaaaaaaaaacaggcttacaaaaaacaagcaaacaaaaaaaaaaaacaataagaggggcaaaccttaatttaattgacagggccgtcgtcaaccaacgtgcctggctggaaaccgggcggggccgccccaaggaacccggctggcggcccctccttcttccgccggctggctttttacccgggcggcccccgtccgttcttccgccccgtcgctcaccctgcttgattggtgaaacgcccgcgtcctgctgccgttccgcacggccggtgtgtcggttgctcacgcgctggggggttggttcgctggccccccccctaccgctccttcggcttggtgccttcccttccttccttgggccccccgcctttcccccccagcatatactaagggggtggcttttttaagcctagggtgcgctttcctttcccgggctccccccaaaggtgcttggggggtgggcccctt

SEQ ID NO: 53804 - DNA, 715 bp, Triticum aestivum
  unsure (1)..(715): unsure at all n locations
  Clone ID: PAT_TA_53804
tgttgattgattcacgggaagagcgagacgccaagaactcgggcaagtcgcgaggccgcctgcctccgcccgcccaggactcgatctcgatccccgccgacaagggaacccgcgggagcgccaagatcccgccatgaatcccgagtatgattacctcttcaagcttttgcttattggagactcgggtgttggcaagtcatgtcttctgttaagatttgcagacgactcgtacctggatagttacatcagtactattggagttgatttcaaaataaggactgtggagcaggacggaaagactatcaagctgcaaatttgggacactgctgggcaagaacgttttagaactattaccagcagctactaccgaggggcccatgggattattatcgtctatgatgtgacagaccaagatagcttcaacaatgtgaagcagtggttgaacgagattgaccgctatgccagtgagaatgtgaacaagcttctcgtggggaacaaatgtgatctggctgacaaaagagctgtgtcatatgaaacagcaaaggcatttgctgatgagattggcatcccattcatggagaccagcgcanagaacgccctgaatgttgaacaggctttcatggccatggctgcttcatcaaggataggatggcgagccagccagccgcaaacaacgctcgcccagctactgtacagatccgcgggcaacctgtcg

SEQ ID NO: 53805 - DNA, 681 bp, Triticum aestivum
  Clone ID: PAT_TA_53805
gccaagtcgtggggcctcgagaccgtcaagcagatgcaaaagagcgtcgtcatggaagacattgggtcatcgctctttggcgtgctctcgagcaagctcaaggcgccggacgagcgctttgtcgccgtgcacgagtacgtcgtccaactagagagcaacctgacggccctcgagcggctctatctacggctctccaagcggcagtctgatttggcggccgattattcggaactggctgcgtcgctcaccctggcgagcgcgaccgaggacgcgctaggcagcatgctgcgcgcgattgcgcaagcgcacgaccgcgtcggtacggcgtacaagacgctgcaggaacgcatcgagaccgagttcctcgacccgctgcacgactatatcttgtactgccatgcgatcgtcaacacactgaaggagcgcgaccagcggcagctgctgcacgaggacctggccgccgagctcgaggccaaggaggcgaacttggcgcacctgtcggacgccaacgccgcgggcgtcgcggcgtcgacgtcgagcgtctggaaccgcttccgcagcaacgaccccgaggccctccgcgccgcgattgaggagaccaagcgcgacctcgaggacgccgaccaggtgcagcaggcgttcagcaagctcgtcatgcaggagctcgacctctttaatcgc

SEQ ID NO: 53806 - DNA, 710 bp, Triticum aestivum
  unsure (1)..(710): unsure at all n locations
  Clone ID: PAT_TA_53806
cggacgcgtggggcggccggcgaccgaggcgcggcttcctttcctggcgcacggccatcccccctcccgctctccactccgggaacggcacaggtagtggtccctatcgctccttgtttcctcctatgcatggcggaacttgttcttctgtcgggagaagtggaaaatgacggccagatggtggaggtgagccgtgagcggcgatgagggggcggagatgcggtgagccgcgcggcgtgggatttgggacggtgaggacctagtttcttttttcttcctctcgagaccataagacctagcttgcgtggatcgctttgctctgatgatcttttgttctggagacgacaatggaaccccgactagattatccttctcttgccatatcgatctcagttgaccccaatctttctggctcatcatgcgatggcaggaatgcactccgatttccatgtatctcggtgcaattctcatggactggtaccaccgtgttgtagtttatatttaaagaaaattggggcctcagccgaaccctcatccacttgccctcaagccattcctccattgttcatatgagctggcactacgggattnttttttttgttcccaagactatgtcagatgtggatgcatctatttcctaattgcaggcatttcagatgttangatactgtgctaggctgctaaggtaccagctgtcttgatcatgttaa

SEQ ID NO: 53807 - DNA, 754 bp, Triticum aestivum
  Clone ID: PAT_TA_53807
caccgaaccgtatgggcatggcaatggggatcatgagcttgccatggtcactagtgctcgccctgacgatcgccgtggtgagcgccggcgacgaggccgcgctgcttgctttcagagagcagatcagcgacggcggcgcgctggcttcctggaacagcagcgccggcttctgcagctgggagggcgtgacgtgcagccactgggcgccaaagcgggcggtggcgctgcgcttggacggcagggcgctcgtcggagcactctccccagcccttgggaacctcacgttcctgcggacgctcaacctgagcttcaactggttccacggggagattccagcaagcctcggacgcctacgccgcctgcagaggctcgacttgagcgacaactccttctccggcacgttccctgtgaacctgagctcctgcgtcagcatgaccgagatgagactgcgcaacaacaagcttggcgggcgcatcccgaccgagctcggggacaagctcgcgtccctgaaagtggtctcgctgagaaacaacagcttcacagggcccatcccggcatcgctggccaatctgtcctatctgcaaaaccttgatctcggccttaaccaactcgtgggctcaatcccgccagggctcggcaccctccacaacatgcggcagttcactgtcgtcagaaacaacctctctggtatgcttccagattctctctacaacttggcatctctggaattacttaatgtacggggtaaatatgc

SEQ ID NO: 53808 - DNA, 766 bp, Triticum aestivum
  Clone ID: PAT_TA_53808
caatctgatccaatccagtccccctccgatctcaccgggaaacctccgatcgaagcaaagccaaggctctctcgtcctcctcctcaagatgcagatctttgtgaagaccctcactggcaaaaccatcacccttgaggtcgagtcttctgacaccatcgacaatgttaaggccaagatccaggataaggagggtatccctccggaccagcagcgactcatcttcgccggcaagcagctcgaggatggccgcaccttggctgactacaacatccagaaggagtccaccctccacctggtgctcaggctccgtggtggcatgcagattttcgtcaagaccctcactggcaagaccattaccctcgaggtcgagtcttctgacacgatcgacaacgtcaaggcgaagatacaggacaaggagggcattcccccggaccagcagcgcctcatcttcgccggcaagcagctagaagatggccgcacccttgctgactacaacatccagaaggagtccaccctccacttggtgctcaggcttcgtggtggaatgcagattttcatcaagactctgaccggcaagaccatcaccctggaggtcgagtcctcggacaccattgacaatgtgaaggcaaagatccaggacaaggagggcatccccccggaccagcagcgcctgatctttgctggtaagcagcttgaggatggccgcaccctggcggactacaacattcaggaagagtccacccttcacttggtgctccgggctccg

SEQ ID NO: 53809 - DNA, 496 bp, Triticum aestivum
  Clone ID: PAT_TA_53809
cttgcaggcaaaccaggcccccagagagagagccaaaaaaaaggcggaaaaaaagaaagagaaagcgactgaatgaaaaaaggggtgggccgcaggcagaggcaaaaaacgaacaaggggcaaaaaaaaaaaagaaagggggggggaaaaaaagaggaaacgaaaaaaaaaaaaaaggaaagaactaaaaaacatgtagggggaaaaaaaaacggcccagcgaaaaaaacaaaaaaaccaacaaccggggaaaaaaaggcaacaccccgggggggggagaaggggggcctttgtaccagggaggggggcgggcacaaatggaacgagaaaaacggaccctggctgagagggggcaagcagaaggcccagagaggccggcgaaaggggaaaaaatttttgttggaggggaaagaaaggaggaaaaaaacaggagccagcggaaaaaaaaaaaccacgaccgacccaggggcgcgaacaaggagccagagcagaacca

SEQ ID NO: 53810 - DNA, 614 bp, Triticum aestivum
  unsure (1)..(614): unsure at all n locations
  Clone ID: PAT_TA_53810
cggggaaagcgtgtaaaaacaccttataattgtcgtatttcacttgtgtacagttgctgggggaaagggtaaattaaacggcaggaagtaccgaacaggggctgcatagctttttattttgcccaaattctcagtacaccaattgccgttcccattgggtacctccagcatgccatctatatgatacaaagacttggatatatggtgcttttcctcctctgaatgaactaatcccagcagaatcgtatcgtcgaaaaaatcggacctgtgtgatctgaatgtagaaatgtactcttactgtcttacatacggtgggctgttgttactgtaccatcccatcagtcaccagctcttgcaatccccgccttagcctctcgccggcgagcctcgtgtcttcctccttcagccctccgaaggaaacacggatgtatccggggcctccgctggcgctcccggggatcactgcgacgccgtgcttggtcgcgagccacctgacaacctcaaagtcgtctgaacagttatctggtaacttagcccagaggtagatggcaccctccccacccttgacagcatcctcaccaaggggagacattgcctncacaagcagctcgcgg

SEQ ID NO: 53811 - DNA, 621 bp, Triticum aestivum
  Clone ID: PAT_TA_53811
cgtcatttataaatggaaccactctcatatagtgactctacaaggctcttttgtaaaagaatattttcaagtgagaataaatgtcctagtgaacttaaggaagtatctagagatattttgaagaaatgtggcggtgtaccattagctatccttactatagctagtcttctcaccgctggtcatcagataaagccaaaagttgaatggcaagttctgctagactcaattgggcgtggacttacagaagatgcaagtatggaggaaatgcagaggatactatcatttagctactatgatctgccttctaatctgaagacttgcatattatatttatgcatgtatcctgaagatcatgagattgacaaagaagatctgatatggaagtggatttgtgaaaattttgtgcagcatggaaagcatcagactagtatttttgaagttggggaaacttattttaacgagctcataaacagatacatgattataccaatattcaatggtttccgtgaagtacaaagttgtcgtgtgcatgacatggggcttgatctgattcgttccttggcagctgaagcaaaggttttgacaatattgggaagtaataaggatattactagttctcaa

SEQ ID NO: 53812 - DNA, 471 bp, Triticum aestivum
  unsure (1)..(471): unsure at all n locations
  Clone ID: PAT_TA_53812
cccgggtancgacccanncgcgtccgagtccagtagagacccagcaaacagagcaagtcttccacgcccgccagttcttgcaagagaggaaagaaatcgaagaggcagagaagcagagagagacagagatgggaagaaggagaagcccggcgctgccgctgctggtgatctttggcgtcctcgccgtcgtcctcgcagctcttcctccgctcgccgaatccagcagcagccaccaccaccaccacggccatggccatcactcccgcgtccaaagcagagggcacggaggagaggaagagcagtcggcggctgcggcggcggcgaaggcgagggggagcgcgtggccgtgctgcgacagctgcggcgggtgcaccaagtcggacacgccgcagtgccggtgcatggacgcggcgcccgtcgggtgccacccggcgtgccgggactgcgtcaggtcccccctcatcgtgcacc

SEQ ID NO: 53813 - DNA, 576 bp, Triticum aestivum
  Clone ID: PAT_TA_53813
ggcttctttggttgggctctggctggcggctcccttcgaacagacagcggagatgagtgctctcctcatccccgccacctatgcatggaacctgctgatcgcggtcatcatgggcgttcaatgcgtcatcaccggtttcactgcggtgggcccggctcgccgtaaggtcttcaacgaggattttttcaagaaaaattttgccgacgatgctgaattcaagcttcagttccccggttcggagggcaagttcggctggccgcgcggcggctacccggacatgggcaacggtcgcttcgctagcaaactgtcgctcgaccactggctcgtcatcaacaacgcacagcgcgcacactacaactacgtcgagggcatcgccaccgtcatcattctcgagctggtgtctggtctgttcttctctcgtcttgcgttcctcgccggcatcgcctacatcgtcggccgtgagctctatgccatcggctaccgcaccggcggcgcgagccgtcgcctgatgggcatcatcccgatggatctgggtctgctggtgctgctggtcgctgccatctacggaccgttcca

SEQ ID NO: 53814 - DNA, 272 bp, Triticum aestivum
  Clone ID: PAT_TA_53814
cctctcctcccccccgccgccgctccccagatccgctgccatgtcgacggagaagaagcagctgaaccccatgcgggacatcaaggtgcagaagctcgtcctcaacatctccgtcggcgagagcggagatcgcctcacccgcgcctacaaggtgctggagcagctgagcggacagtcacctgtgttctacaaggggaggtacactgacaggttgttcggtatcaggcggaatgagaagattgcgtgctgcgtgactatcagcggggagaagg

SEQ ID NO: 53815 - DNA, 513 bp, Triticum aestivum
  Clone ID: PAT_TA_53815
atcggccatccccactggacggcggactgtatatctaagatgaggaagccggagaacccaccaggtcctggcgacatgtacctcgtaaaggcattacacgcaaatattacaagaatgtcatctatggactaagacgctgatacctctgtggggaaaaaggaaaactccttaatacactttgataatgggtgtattaaacactaacattgatttaataaagataaacccggtctctaaggatactgaacatgatacttaaaatagtgcttttgttgaaaacaatgctattacacgctatggtgatcgatcatataatgataacctgttaccggctaatggtgctcataaaatattcacgtgactagcacagcaaaaactttgttatcacagaacaccattccactatccattagagggtatacctaatgcttagttatagacattataatgcctagaaaataaccatttctgcatataacagagcccttgattcattaaacacacacatgacat

SEQ ID NO: 53816 - DNA, 563 bp, Triticum aestivum
  Clone ID: PAT_TA_53816
gggcgaccagggcgaccagggcgaccagggcgacgagggcgaccagggcgacgccggtgcccggacggcgagcgcccggaatatgctctcgggggtaggggctcgggtcggcggccggttttgggcgctagccggagccgatgaggacgatgcggacggcgacggcgaggatccaccaacgccgacaccctccgaccttttctgtgagttctttcacgcgggttatgatgaggacgaggtggcctcgacggtggatcgtgtgttgccagttgaagacccggcaagggtggggctccatgcgggagagaagaaggagatggtccggcgggtggttcaccgtcgaacggcggcgacggcggtacgtccatggaagggtccccttcctaaggttatcttccgagctacggcgttgatccgttcatggtcattactcactccgatggaggccagggagcatttggttactgggtctatccggtgggagatggttgctcgggatatcttcaaccggtttggatgacggacatgtaataggataggcaattagtattcctatctcttta

SEQ ID NO: 53817 - DNA, 207 bp, Triticum aestivum
  Clone ID: PAT_TA_53817
gccgaccaatggcagctcgtatgcaatcggccagcctccctcctactcatgcgcggttcttctgtccggcgcaaccttccttgccgtcccggccgcgggcactgtgaagaccggccaggtggccgcgttctgtggtatgaacaagaacgaggggtccctgcagtaggcctgttacaccggggcctacaccatcggcatgatagaact

SEQ ID NO: 53818 - DNA, 724 bp, Triticum aestivum
  unsure (1)..(724): unsure at all n locations
  Clone ID: PAT_TA_53818
caggacccatctcctctcaactccaaacccacgaactcaccgccgtccctcccatccccggcggcgaccacgccattgaagccggcgagagtggtcttaggcgcttgtccatctggaccggttgattggagcacaaacacgggagcgaagagcggagggacgcggtcccgctcggtcccgtgcagcggcggcggccgacatgtctgtcgaactcgtcctctggctcttctccttcgcctctgtgatggccctcgtcggcctcactgcctaccagcttatctgcttatctgatttggagtttgactatatcaatccatatgattcatcatctcgcatcaacgcagtggtcataatagaatacgtactccaaggggtcctctgcgcttctttcctcttgacgctgaattggtttccgtttctagttatggctcctgtaacatattaccatgtgaagctgtatatgaatcggaaacatcttatagatgttactgagatattccgacagttacatggagagaagaagtacaggatgatcaagcttgccttctacttcgcattatttattatatccatttacaggcttgtcatgacggctgtgctactatttattgatgaggatgtgaatctggtagaaactaggactatttagagcttgtcatcaacatctcacatgtgngccaggaatcccaatgatgcagttggttaacttgtcgcacacatgttt

SEQ ID NO: 53819 - DNA, 243 bp, Triticum aestivum
  Clone ID: PAT_TA_53819
agattgtgtaataattttttaaatagcaccgatatggcataagcacactttgacatcatttctagccggtggggtctactgtcacctgtcaggctgaggtggcatcaaagtcccacggcgttcatcaagccgtacagctgtattgctggcaaaggaagttgagttccaaggaaccattctggagtcggactgcaagacggtggagagcaagctcaactgaaaagagtaaggaccgttcgatcc

SEQ ID NO: 53820 - DNA, 256 bp, Triticum aestivum
  Clone ID: PAT_TA_53820
aaaaaaaaaaaaaaaaaaaaaaaaaaaaaaaaaaaaaaaaaaaaaaaaaaaaaaaaaaaagggaaaaaagggataaaaggttccagagttgggcaccctgagcttccggctgccagccctgttctatcgtgtcacctagagtcacctttactggaccggagtgttccatcgtttgtcactggtgaaaaccgtggagaaccctgggcttaatcgaacttgttgcccattgccccttttcccggcttgtgcgccagtt

SEQ ID NO: 53821 - DNA, 542 bp, Triticum aestivum
  Clone ID: PAT_TA_53821
agccgagcatggcgtccttttctgccgctctcgtcgcgctgctggtcgcgagctgcgccgcggcggcggcggctacgacgttcgacgtcggcgacgggcacggctggcagaccggcgtcgactacacggcctggacgtccgacaagaccttcgcggtcggcgacgcgctagtgttcaactacacgagcaaggcgcacacggtgacggaggtgaacaagagcggctacgacgcctgctcgggcggcaactcgctgagcaacgacgacagcggcgccaccaccatcacgctcacgacccctggcgtgcactacttcatctgcgacgtccccggccactgcgccagcggcatgaagctcgccgtcaccgtcacggtcgcggggggctccacgacgggaggcacaatccccgccggcgccgccgggggatccctcctgccggcgatgagcggcctcgacaccggcgccgcgggggctctaatcgtgctcgcaccattctgatgaaagcccgtgatcgggggtgagtatggacagggcgaagacact

SEQ ID NO: 53822 - DNA, 682 bp, Triticum aestivum
  unsure (1)..(682): unsure at all n locations
  Clone ID: PAT_TA_53822
gctcttaaaacaaaaatgaaataagattacaatataggagtaatttcttagttcaacaagaatctatctgcaggctactccaagttgagaaatctgaaaatgcaggctacttggtctgccacccgtgccgtaccggccgtctgctttagcgacaacagaagatgacaccactgattactgatacacaaaacacaatcgggttacagggcaagcctatcgattttacacgagtagtctccattattgaagaagaaaggatttcgctatgctccttgcatggtagtactactatgttcagtttcttggttggttcagtagctgctgacgatgaggaggccgatggcggtgacgatgatggtggacggcaccccgaaccggaggtggctccagaaggagaggttgtagccgaagaactgtgcccgcctcgcctgctcgcacacgatcaggttcgccgccgaccccagcagtgtcaggttcccggccaccgtgctcacgtacgccagtatcagccacgccttcctctccgacgccggcgagatcgccgccgcagaagcggccaccctcgtccccagcagcagaactgttggaacatttgatgcgacgttggagaggataaggatgacgaggccgangagcgcgacgcctctggcgctgtcgatccgcgagtagggctcaccagctc

SEQ ID NO: 53823 - DNA, 547 bp, Triticum aestivum
  unsure (1)..(547): unsure at all n locations
  Clone ID: PAT_TA_53823
cccacgcgtccgagctaataagcgcgaagggtacgcaggaagttagagagtgaaagaagtgaattgaagccagaatccgtctcaggggtggatatgcttccttactcgacggctgccgaggcggaggccgcgctggggcgggccatgtcctacgcggagggcgcgtggtttcggtactcggcagggatgccggactactacctgtactgccacatcgtccccatgctcctcctcgtctacacgctgtcgtcggtccccctcgcacttttcgagctcggcgcgccgtccatcgctctgcgatacaagctgcagccccgggtgaaactctcgccgtccgccttcctccggtgctacatggacaccatgggcctcttgctcgtcaccattgctccgctccatctcgtctcctatcctgccatggcgggcatcaggacggngcttccgttgccgtccgtgggggagacagtggcgcagctggtggtgtacttgcttgtggatgactatctcggctactggatccaccgtctactgcacgccaagtggggat

SEQ ID NO: 53824 - DNA, 586 bp, Triticum aestivum
  Clone ID: PAT_TA_53824
gcctcccctccccgccgcctctgaccccgccccgccggagcgccgccgggatctctaccggagatgccgataccaccgcccccgccccctccgatggctaccgcggggagggaggccaggcgatcgaggcgggcggtctcgcggcgggcgggggcgatggtcctcgtgctgggcgcgctcgcgctcgcggcctactacagcttctactcggacgtggccgtgcagttcctcgggatggaggaggaggaggcgcagaaggagcggaacgagaccaagtcgttcctgttccagctctaccccaaggcgcaccagggccgcgcgctgcgggaattcggcgacatcaagctcgccgccaagagggtcgatgacggcggcggcaggaaggtcacgaagaagctggatgtcaagggggcgacatcggctgggacgaactccacagttctgctcccgatcaagggcaatgtgttccccgatgggcagtattacacatctatctttgttggcaatccaccaagaccttatttccttgatgttgatactggaagcgatttaacatggattcagtgtgacgcaccatgcacaaact

SEQ ID NO: 53825 - DNA, 498 bp, Triticum aestivum
  Clone ID: PAT_TA_53825
gcatcgcctcgcgcccgcaccccaggaagttcaagaggcttttctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctggaaggaacaaattagaccagtaccagatcctcaagtacccgcttaccactgagtctgcgatgaagaagattgaagacaacaacacccttgtcttcattgtcgacctcaaggccgacaagaagaaaataaaggctgctgtcaagaaaatgtatgacattcaggccaagaagggtaacaccctcatcaggcctgatggcgagaagaaggcggtcttgaagtttacacccagactacgatggctctcgacgcggccaa

SEQ ID NO: 53826 - DNA, 149 bp, Triticum aestivum
  Clone ID: PAT_TA_53826
cagcacaaacacacacatacacacacacacacacacacagatgggacttcctgctaatgccgctgcctcgttgagcttcccggtgatccacatggagaagcttgagacccgggaaaggggcgcgaccatggggggtcatccgcgatgcc

SEQ ID NO: 53827 - DNA, 326 bp, Triticum aestivum
  unsure (1)..(326): unsure at all n locations
  Clone ID: PAT_TA_53827
cccgggtncgacccccacgcgnntccggcagcaggggagtcgtgagcgagcagtagacgatgagcagagaatgggtggtcaaagccgatctgctggtggccctcctggccgtgagcctggccctcgaggcccaggccttcagcgggtacggcggcgggcacgcccccaccccgacgccggtcgccccaccccccaagcacgagaagccacccaaggggcacaagccccctcaccaccaccaccacgccaaaccaccggccgcctcccacgggccgccgacgcacgctccggcgccacccacctacttgcccccgtctcctgatcct

SEQ ID NO: 53828 - DNA, 268 bp, Triticum aestivum
  Clone ID: PAT_TA_53828
agcactcatgaagcctcctgcagctggctgttccaggctgacgcatctcaactagcagacccgctcactagatcactgcctggcgggaccggcaccggccgctgctggtgcgcgtgctagcgcgactggcgctgcccgagatgctgttcggcccggtgacctgcctctacgagacgcccgccatgcagcacgacatgtgctacgccaacgcccaagccacggcaccctccgaacagacctggaacgctgttaggaccctcaacaccta

SEQ ID NO: 53829 - DNA, 723 bp, Triticum aestivum
  unsure (1)..(723): unsure at all n locations
  Clone ID: PAT_TA_53829
gcgcaagaaaccacacccacaccaactttccccgtctgtctttcttctcggcggaggcgaacgacgaaccctagccgcccgaggaacgccaagatccccaaggccggcgacgatggccgcggttcggtgcgcggcgaggaggctcggcggctctctgctccagcgaacgcaggcggcggtcgcggaggagggacgcctgctcgcgccaagcaggctcatgcgctcccgccagctctccaccaaggtctccggcgagcgatcgcaggtggcggagcgacacctcctcgagccaggcagcctcatgcgctcccgccagctctccggcgagcatgctcgcaacatccagaagaaagaggatgactgctgggcggggttcaatgagacgctaaagaggcgcatgatatccatcgaccgtgcgttgaagagtttggtctatggatctttcaaggtgacagttgtgtatgtggctgctgctactgctttctctggcagtgggctagaagcgtagcccaggccgtggccaaggaaaacgtgtgaagacgaggtggaaaaatgaggaccaaagatgggcgaccagcttggtggatgggaattgtgacccctgggggggggctaggtaggactatgctgtggggcgctggggtntgggggggcatggggtggtggggttgtttggggggcctgtgggtgggtgggggggggtgggggggggaggctgggggg

SEQ ID NO: 53830 - DNA, 616 bp, Triticum aestivum
  Clone ID: PAT_TA_53830
gattatttgcaccccagaaagacaacttccaccatgaatggacgctttctagatgctacaacggatgagcttaatgtgagtgatgttacatgtattatctgctgtgaagagacgacaacagcaaagaagctgctttgtgggcacttgtttcatgtgcattgtgaggtcatggcgagagcgccaaaatacttgcccgacatgtagatctcccattgccccccggacaatggacgtgctccatcagcgcgatagcatgaagcccaactgggagttagcttggtgagcttcgttttgttgttcaattttttgttttgattttttctacttaaccatttctatcagtgagggctacaattggcaaatagtttttatgtgattcctaatttagtgtgaggaaaaatagctgcaggcgtcggtgctccaggtccagaaggagtaacaagcaagaacgtgaacaggcgcccaacaaaataggcaatcttcattgaaagttgtaacatatttacaactggattcagttttaaatcagaaatagaagtcgttcaagttttagacagttatatgatgtggcatgtgcatgctttacagttaccttgcaagtgtcgtgatgatgcat

SEQ ID NO: 53831 - DNA, 382 bp, Triticum aestivum
  Clone ID: PAT_TA_53831
gatacaggtacccttatagttgaaggtccttggagctgatcctggggagtatggtatcacatacatacttaagtgccgcagcgcctggcatgagtcctcgtgcgataactcaatcgctagcacacgggggtgatacttgagcgctgcactgcttgcggctcgggacctctgcattgaggcattttactgtgaccccttcttaccacaaaaaaagcatggctaccttgtgtccttaaacctataaccatgtttaagataactctatcctactccgtccctgcgaccagcaaggggcataccaggaatattgacctgttgtccatctactacacctttcaggctgaccttaagccctgactcaccatcagtggacaaaccgtgc

SEQ ID NO: 53832 - DNA, 613 bp, Triticum aestivum
  Clone ID: PAT_TA_53832
ggtcaatccaggatcttttattgacgataaaacgacatggtatcattgcaaaatgcaagaaagatattacaaagtttgattattcttgtcacaaggcatacattttaaaatgtctaatgacttttattacattcataaaagcagcataaagtaacaatgcacaacaactccatctcaagcatagatagtcgatgtggttcatttggcctcactccttggggtcgccatagtagtcgtagccgcccccttcatcttcatagtactcttcactaagtttgccatatggtacctgtatcctttatccgttccatgcaaataatcacagaaggtgaaaagggatgagaagttgctctgactgtgctccccaacaaagtgatggtagtcgtggtattctgctcctccatagaacgggatatagtttgtcggattgaacgggaacttaaacccactgtgggtgtcgatggcctctatctggcgtattaccaaccagagccagagggttgttatgtgacatggcacaatggacgggccgacaagggagggtgctccaaggatgagcacatcggaccagtgcccgtagggcgcggcgaaggcgattggcgccgtgtactca

SEQ ID NO: 53833 - DNA, 158 bp, Triticum aestivum
  Clone ID: PAT_TA_53833
aattagggaaatcattcattcttacatattcatcactccatccataggggagatagatgaagcaattacagggacacatgcccacacatacccacaagggccccaagggcagagcataggcggagagcgagcgaagtaaaccacacgcacatgcccac

SEQ ID NO: 53834 - DNA, 624 bp, Triticum aestivum
  Clone ID: PAT_TA_53834
gatgaacttgtccattcattaaagactctgataaagtttgggtgaaggctacaacaatcagtagcctccttacacaaagaccgcaaccaaaatcaccacacatgcttgctttttattaagcgcccacgaggtcacacacacttgactcacgaactaaactcaattcatccctaataataataataaaagtgcagctaaaactcctaagattcaaccccgatggcgcgacacaatgagtctctagttactgcccttgctgatgagctccagggcggtggcggtggtgggcagcgccgggatggctcccttcttggtggtgcaaatggcgccgcaagcgttcgaaaactgcagcacctccctcagcttggcctcattgtaaaagatggagtcgtccttggagaccctgacgaggagggagccgacgaaggcgtcgccggcgccggtggtgtccacggtgttgacagagtagccgggcaccgagcccttgaagtccttggtgaagtacctgcaccccttctcaccatcggtgacgatgagcagcttgaggccctcgaaccagagggagagcacgttcttctcgtcagtggcgtcgccctgggtgaggaaggctacctcctcgtcgct

SEQ ID NO: 53835 - DNA, 433 bp, Triticum aestivum
  Clone ID: PAT_TA_53835
aaaaaaaaggggggagttattttttttttttgggaattcacccaaacaaaggggggcgcgaacacataatttaaaaaaggggggggaggccccaatttttttaaaccaccaccaatagcagaagcagttttaaaacacgggggcatggggggaaaagctagggcaaacccggcccaaactagaaaaaaaaatttttttaggccgcccgtttttttaggaggggaggggggcaaaagcacctttaaacccaagccgaatttctgcactcacgggggggcaccaggagggccgggggggcgcttccaaaaaaaggggacaaaaaaagggggggttaaaaccagacccggcccccggggcaggagaacggaattcacccgcttgggaaaattggggggaaaaaaaaaaacgggccgggggaaaagcgattttaaaa

SEQ ID NO: 53836 - DNA, 567 bp, Triticum aestivum
  Clone ID: PAT_TA_53836
gaaagggaaaaaaaaaaaggggggccccccttttttttttttttggaaaaaaaaaaaaaggggtttttttttttttccgggggggggaaattataaaaaaaggccaaaaaaaaattttggtttggggggggccggcccccctttccctttttttaaccccaaaaaaaaaaaaaaaaattgggtttcccctcccccaattaaaaaaagggaaaaaaaggggccccggttttaaaaaaaaaaaaattttttttttgcccccgggaccccgaaaaaaaagcggggaaaagcccccccagccccggttttttttctaaaacccccgaacgggaaaaaaatggtgggtttaaaggggccttcccgttttttcaaggggcctaaacagcgggaaaaaatgtgttttggccaaccccgcggaaaccccttttgggggctttccccctttttgggttttttccgggccccgattttttgggaatttttcaaaaaaaaaggggggggggcccctctggggggggggaaaatttgaaacaccaccccttggggggccctggagaaaagcccccccca

SEQ ID NO: 53837 - DNA, 389 bp, Triticum aestivum
  unsure (1)..(389): unsure at all n locations
  Clone ID: PAT_TA_53837
aacatgcaacaggaaacagcaccttatactgccatatgcagtggcgaacaatggttattacagcgacacgggcacattgccacactaacaacccaaacgctaacactggacgaacacaaatgagataacctggtaagaaaaactaatgggagccatcggcattatcccatctcctgagagaacggccctagtgcggcagcaacacacaccgggggaggatcaacgacgccgtacgtggctcttgttggcctgactccacaactctgctcgaccggtttctgagctcccagattgacagagtggtggatctttttanaggaagaaccgccgaggccgngggctgggggtgaagggcttgtacgccggaggaaaaggcgtngggggcttgt

SEQ ID NO: 53838 - DNA, 635 bp, Triticum aestivum
  Clone ID: PAT_TA_53838
gaaagtgagcacttctgagtagattgcaatcacttcgatccagaagcactaaacaggagcccaacaatgcacgtcagtgaccttgcaagcatgttcacttcaagctacagtttcatgcagaatctactcgaatagatagataggtagagatataataacatgataccatgtcacacaatatcacagcgtacgatagcatagtgctagctagccaaactgcaggggtcataattaaacataaaacaagctgggcggccatctttggttctcatttttccacctcgtcttcacacgttttccttggtaacggcctgggctacgcttctagcccactgccagagaaagcagtagcagcagccacatacacaactgtcaccttgaaagatccatagaccaaactcttcaacgcacggtcgatggatatcatgcgcctctttagcgtctcattgaaccccgcccagcagtcatcctctttcttctggatgttgcgagcatgctcgccggagagctggcgggagcgcatgaggctgcctggctcgaggaggtgtcgctccgccacctgcgatcgctcgccggagaccttggtggagagctggcgggagcgcatgagcctgcttggcgcgagcaggcgtccc

SEQ ID NO: 53839 - DNA, 555 bp, Triticum aestivum
  unsure (1)..(555): unsure at all n locations
  Clone ID: PAT_TA_53839
gcttgcaatccgacatccatgtgattttcccattcttccaaaagaccgccggtgcatcattttcacataaaacttgcacgcccaggcatttttttgtacaactacgaaatgagcagtaaattaggaatgtggcaccaatcataatgaagtccacttcccataatgttcgtaaagaaatcaacatcataaagctcttggactaccttccattcaagcttgaagttttgctgctggaatcctctttggggatgtaacaacctgtagaaaatagataacttatatgactggcatagcaaaaacatattatcatgcaaaatatagtaatgtacattcagcaagatatagatgacaacattctatgagaagaaatcacactgtcctatagagcgcaatccaaccattcccactttagtctagtataaaagtactgcnttactaaaggagagctagttctcacntnggaataaaataagatcaatcacgcaggggctgacattcctctagatccataaatttttatgcctcatcacgacccttgcaaggtaacctgtaagc

SEQ ID NO: 53840 - DNA, 215 bp, Triticum aestivum
  Clone ID: PAT_TA_53840
gcgctaggaggctccctccaacataagttatttaacatatgatacactctgataccctcacaaagcattgttgtttagagcaagtgctcagtgcgtgcggagacttgatggaaactaatctcccaaatacatgtatacgtccatggggggggggcttgatttcgctttgcttgggttgtcggttctcggtcgcgttggttctgtgcgtttttctt

SEQ ID NO: 53841 - DNA, 751 bp, Triticum aestivum
  Clone ID: PAT_TA_53841
gtgagtaatcttccatgccgtgtaaaagtgtgcccttgtaacaaactctatcctcttcttatttaatagatgaggcaaatcttttgcctccgtttcaaaaaaaaaatgatttgctgctgcagcgactctaagccgccttgttgggtgggtaacaaatactataatcgcgaattcagtgattttggtgaagctataacgtggtcagacaggacaatcttcttgttcttctttattttgtaggaaattgtagcgatcagatgctctgcagcctgccgttcccgccgaagatccggttgaggatcgccgccagcctgacgcccccctgggcgagcctcttctgaaccaccggcagcgccttgaagtagtactcatctcctagggtgtcgtcctgctcgacgccctcgtacgcgtcgcaggccagcaccgcgctctcctgggcgtacttttcagcgcaggtggtggttttgctgcggcacgtctcccactgcttctcctcgctggaccagtcatcggtgatgttgcgctggatggactcgatcatggcgtcctggtctttgttgaagaagtccttcatggcctctgtgatcacgtccgaatcccacaccttgtgcaggttgctcttcctcttgtaccagcggagtttgatggtgttgccgccgaggtcgtcgacgtggccgcagtgcagcggctggtgcacgtcgcccacgaagtgcgccaggaacatcaggctcttcggtcggtcaaatgggct

SEQ ID NO: 53842 - DNA, 233 bp, Triticum aestivum
  Clone ID: PAT_TA_53842
actcttccatatatgcaacttaataaggagcataaaagcttagttatttcaaattacgaagtatacatagtcgtacccatgtcttaatttatagcataactagctacaaacccagtcatgccaaaccttcactctttactagtgcatcgtataagtgtttatacactcgtatcaagctaaatttggatcttagcaggttattagtgcgtgtaaacatctctgccgtacgtctt

SEQ ID NO: 53843 - DNA, 276 bp, Triticum aestivum
  unsure (1)..(276): unsure at all n locations
  Clone ID: PAT_TA_53843
catcaggcgagacgnacgnggnncagnncaacagnacgagaangagctcctcggacgacaccngcggcaagaaggcgncgnggccggagctggnngggaagnccancgaggaggccaagaagancancangaaggacaggccggangngaagancagcgagggcgncccggncggcaccgccgngaccggggaccccaggcccgaccgngnccgcancnncgncgacaccgnngcggagancccccgcangggcnagcnnnngnngangccccacc

SEQ ID NO: 53844 - DNA, 525 bp, Triticum aestivum
  Clone ID: PAT_TA_53844
cgcggctgccgcctcgccacgccacctccatgaggagcagcagcagcagcggcagcgccggctcggcgcccaggaggaggccgatgagcgacctcatcggcggcagcgacgacctctcccgctactccgtcgccaccaccaccgcctcgtccgagcgctcgtccggcagcgtccgcggggcagccgccttcctcgacgccttccgctcctgcttcgcccccggggacgcgcgctcgccggagacctccctctccgacgtcgacttcgacgcctcacaccaacactcgcagtcgctgagctctcaaggttctaccagcgggagcactttcgagagcaggagatcagctaggggactatatggctccaccctcaggaactcttcagagagggaggtacccggcgataggaagttcaccttgccagagatccagaaagcaacgaagaacttgtgacccaacctgaagattgggcagggtggatctgggacagtgtacaagggtcagctgagagatggcgccctggggg

SEQ ID NO: 53845 - DNA, 261 bp, Triticum aestivum
  Clone ID: PAT_TA_53845
cccacgcgtccgcccacgcgtccgggagaaagaagcctctccttttccagcagagcctttccccatctctgcccacaaccgccgccgcccatcgcgcacagaaaccacgctgcaagacaccaaaacccaccgatcccgcatggagaacggggacgaaaccctggagtggcacaccgctgaggccgagaaggctgggaccaacggaggcgtcatggactaggaggtcaccctctccgacggccgccacccgggcaagtgcta

SEQ ID NO: 53846 - DNA, 473 bp, Triticum aestivum
  Clone ID: PAT_TA_53846
cccacgcgtccgcggacgcgtgggaaaatcccaaaatgtcaagagggtcaatatcaaagggtcatatttatccagcggtccttcctgtcgaaagcaagaaaatgtcttgaaagtagctagggagggattgctggagtggaaacagagcaagaaccagaagcagctcaagattttgctactaccttgctaatagctttgtgagtcatcttctcatgagggagctgacaagatgtcggaaaggcgcagcctgctactcaagcccctctccttcgctccttgcagaggagaggcacgggtgccaccacactcgagagacagatgaggacatgaagctttcgtggagacgacgaggtggccaccgctgcacccccacgccgtggatgcgaagattcccatctgctctgccctcgataaccacttcggcggcgccgtgaacagcagcaatggcctcttgacggaaggcgcagaccgga

SEQ ID NO: 53847 - DNA, 483 bp, Triticum aestivum
  Clone ID: PAT_TA_53847
cacacagagttgcgcacatgctgatgataggtacacggggtcctgttgtgcgtactactggtggaggtgggacgctggctgcaggtattggaaatttataagtgattctgcgcatagaagcatgggtgcgggccatacatcttgtaacttatttgtgaatgaagcgtgcgaactatatctggacctgtcaactgccataaccaatgacttatccagctttaagaagcgtcggcaatgaaaagcatgagaggtttgacaagtgctggaaggattgcaaacttggactagccatggatgctgccattgaccctcgtttaaagatgaaacttgctcaatctatgttattctaaaatatatggggcggtggcactaaagaatgataaggatggagatgatgctcttcatgaccttgacatggattatgacgcacagtccctgcctctgactccagcctatggcgtaccatgagaagctaataaaaat

SEQ ID NO: 53848 - DNA, 694 bp, Triticum aestivum
  unsure (1)..(694): unsure at all n locations
  Clone ID: PAT_TA_53848
agggtttcctttccctttcccttgggccgggatggcaaaatgttgacaaaaggagataatgcagggaaggctgaggagagcagagtggacaaggcaaaaaggaaggctgaagagaagaggttggcgaggttagagaaggaaatgctggaggaggaggaaaagaagcagcgggaagagatggcaaaactagtagaggagcgtagaaggctgagggatgagaaagcagaggctgaggaacgatccaaaggcgctacccctgtcggggagaaggatgctaggaaggaagcagaacgaaagcgtcaggagagaaggaggaaggaagacaagggatcaagcaagagtaattcagattgtgaggatattgagagaagagtgagcagagagggtgaatggaagcggtacttcgatagaaggaatgagccagacaggcgggatacaggtagagttggagcagatggatataagcctcataactttgaagctaatgttcagggtagtaaggtagtacagagcaagacaaaatattttggccgtatgactggaggtttgttatcttcttccagaggtttcagcggtggttccatttttggtaggagtactcangcccctgctcctcaagctaacaaggtgactaaaccacttgntaactgcactgaccagagtaatactgttaaagagatgcccagtctgcagc

SEQ ID NO: 53849 - DNA, 349 bp, Triticum aestivum
  unsure (1)..(349): unsure at all n locations
  Clone ID: PAT_TA_53849
gaccccgcgnccggcgcagacagacagagcnngagagagcgcgcgcgaggaggcagccnccangaccaccgcgccgangggggcgccgacgagcgnccccncccncncccgccggggnnccnccnncgccgncgncggcagcggnggcaagaagancaagggcgacaagccccnnggacccggaggcggcngggcaggggacancgacgccaacggcaggaaggggggcaagaagggcgngnaccagnncgnngacaagnacggcgccaacgncgacggcnacagcccaancnacacgccagaggaaggggcagaancnggggaccggagcgccggcgggacgaccggg

SEQ ID NO: 53850 - DNA, 353 bp, Triticum aestivum
  unsure (1)..(353): unsure at all n locations
  Clone ID: PAT_TA_53850
gacccacgcgnccggcaaggggcgngncaacanagagcagcaggcggcggacagngcccagggggngcacggacagnncaccaagcgcccngagganannggngcnggngaccagggnancangnnnggcnangccaccgangagaccccngagcncangccccncagccaggggcnngccaccaagcngggggccggcggcacngaagnccgcaagaanggcacnngngccnggcnaaggccgganggcaaaacccaggncacggnngaanaccncaacgagggaggggccanggnnccngnacgngngcacacngnacngancaccacccagcaggangagacngncacca

SEQ ID NO: 53851 - DNA, 590 bp, Triticum aestivum
  unsure (1)..(590): unsure at all n locations
  Clone ID: PAT_TA_53851
atgattntaattgtagggagggtnatttanagtgntnngaaagatgaanagttaagnagtgattnttntagaaaattgattattatttgtgggattattttttgtnnattaaatntggggtgggggggggtnntgggntggnatatnnanntnatattanagaataaagggggggttgagtannatgaaggagttagaggaatgtggttggnagaaaagggtggnganntttgtgatgatggatatgaagttggtgtgtatgagaatgttatttggggggttgggggntggatattgtggtgggtgtggggggggtgggggaatggagggggtggggtgggggggggggggtggggtggtgtgggggggtgggggggggggtggggtggggggggggtggggtgggggtggggggtggggggggggtggggggggtggtgtgggggngggggggtgggtgggggggtgggggggggggggnggggtgggttgggggggggggtgggggggggggggggggggggggggggngtgggggtggtgggggggggggggggtgggggggggggggggggggggggggggggggg

SEQ ID NO: 53852 - DNA, 405 bp, Triticum aestivum
  Clone ID: PAT_TA_53852
cacgcgtcggtgttgttacaaaccagtgtatggggtagggttgcttcgtgccgtacgatcaaaatctgattggacgatcgcccagttatcagccaggctgattacataaacacatctcatccaagtttcatcggtggcagcaaggctatagtgcaagcacatctgcaagttagaaccgccagattgcctgcaatggtggttaggagggatggagatgccgatgggccacaggattctgaaagaacccgaaaatcacacgcattattgggtagaactactggtgtgaatggaattatgaccgaacagatccagggggtacgccctgctgctggcgcacagagaccaggatcttgaggtaggggaagcacttattttggcggctgaatattgacctgaagcgaggac

SEQ ID NO: 53853 - DNA, 206 bp, Triticum aestivum
  Clone ID: PAT_TA_53853
agacgatttgatccggtaggcttgtggcgatagaggtggcaggggaagccgtcggagggaatgtaagcagagataccaatcatgaaaattcagagagcaacagcatgaacgaagacctggaccaaactttgcatggcggtgttgctgaagttcagtcctgtaacattggttgaacaaaaacagaggcgggagatggcctgttgctt

SEQ ID NO: 53854 - DNA, 431 bp, Triticum aestivum
  unsure (1)..(431): unsure at all n locations
  Clone ID: PAT_TA_53854
cccgnnnnngaacannngaaacaccnnaagncgancactangaagnnccnncnncccanncggcnngcggcacccgcngncaggggncgggcnggcaaggccccaancccaagcgccganncgggggncccagaccacgccgcacccgnnnanaccacccnngcgacccangnagcngcnncnagcaagccnacngaagcagcaancgagccacaggcngnaaccagggcccaggccggggccaagcccaagcccaaggcggaaaccaagggcaagacnaagcccaaggccaaancngagaccaaagccaagcccaagggcaaggaacggggaaagggcaccagcaggacgggggcaagagcgcggggggggggggcgcggggggggggacggggggggggggggggcggcgggggggggggggggggggg

SEQ ID NO: 53855 - DNA, 389 bp, Triticum aestivum
  Clone ID: PAT_TA_53855
cgcaggcccgcaaggccgcaaccagaaagcaacaatatccctcgcccgccgccgccgcccgtcgcggtcgcccggccggacgtagcggcgacgaccccccgccctcccgccgatcgaccggcgagcggagccgtgatggcggcgcgcgggctgcggggcgtccgcgacgacctgtcggagctgggccgccacctgctcgacatcgcctgcttcctccacccgctgctcaacccggcgcacaccgactcgccgccctccaccccgacccactcccacgcccacgcccgccgccgctccccgtccccccgccccgcgacgccgccctccccgcccgcctccatcctcgccggcatgctcgccgacctcgccgagatcggcggatacttacg

SEQ ID NO: 53856 - DNA, 603 bp, Triticum aestivum
  Clone ID: PAT_TA_53856
cccacttgtccgcgcggagcacgaatccagggtcggttacagattcccattcctatcccgcctcccgctcccgctccggggatgaccggggaaatcaagaacctcgacggcgacaaggcgctggcggcgccggccgatgacggcggcggagcggccggccatggcaggaagggcggcaagaacaagctgtcgctggtcccgctcatcttcctcatcttcttcgaggtcgccggcgggccctacggcgccgagccggcggtgcagtcggcggggcccctcttcgctctgctcggcttcctcatcttccccttcatctgggccatcccggagtcgctcgtcacggccgagctctccaccgcgatgcccgggaacggcggcttcgtggtctgggccgaccgcgccttcggccccgtctcgggctccctcatgggcacctggaagtacgtctcgggggccatcaacggcgccgccttcccggcgctctgcgccgactacctcgcccgcgtcgtgcccgccgtggccgacggcggcgcgcgggtggccaccatcgtcaccttcaacgtcgcgctcttcgtgctcaactacaccggcctcagcgtcgtg

SEQ ID NO: 53857 - DNA, 727 bp, Triticum aestivum
  Clone ID: PAT_TA_53857
acatcaacaaaaaatgggtcggcaattttcagtcatgacaagcaccaacaaagcatgaaagtaaataatgctagcaagtagcaacagaaacaaacttcagtacagactatccttcattgacatgaataatttgcactgtttttggcagaaataagccacatattacagggaacaacaatcaagtctgcattcccaaacagttccagaaggacaaatttaaagataaaacttttattgagcagctccagataggaactagctaagattgtaacggatatctttgctgcttccagtatagttccagaagggaaacatcattggaacaactcaagagtcacaacttgtttcatactgactcgtctgcctgcactaggacaaaagctggcatgtcccccaacttgtcccggcccttcagctctggcagttcaataacacaggcacactcaaccacctttgctccaacacgctcaataagtttggcagcggcacaaagggttccccctgtggcaattagatcatccacaataaggactcggtcattgggctgcacagctcctacgtgcatttcaattttgtcagtgccatattccagagaatattcttccgatatcacctcaccaggtaattttttcggcttccttattggaacaaactttgcacctatggctaatgcaatgggaggaccaaaaatgaattcctttggctttcacaccagcaactacagtta

SEQ ID NO: 53858 - DNA, 497 bp, Triticum aestivum
  Clone ID: PAT_TA_53858
aaaccaagccccaaaccctttttctttctaaaaggaccatcccagggggggtgggggtcctcatggcacagatccttggggctaaaacattttaggggggggaaattcgccctaaaggcccataagataggtaatccttagcataaaagattccacgggaaaacgggaatggaacggtttagtcgaacaagcggaagcccagggaataatggttcttttccttagcccccccctttttcttttttttcttctttggaggggggggggccccaccagcagccggggcagcagcagcagcagggggagcaccacctccaccaaatccgacggaagggaggaggtcatcgacgctccttttttccaggagctgggcaaaaagcgggggccagtaggcctaaaccttgattccggcggccttcaccaccggcgggatcttttaagaagggggggggatcccgtcatcggggaggatgagggcggcaagggggcaggccacc

SEQ ID NO: 53859 - DNA, 692 bp, Triticum aestivum
  Clone ID: PAT_TA_53859
atactatcactcatacactgatgaggctgattatcatgcatacacagaagcaacagttcaaaagaaaacagagataaacattagggcagtgaccgatagtatcatcagaaacacaaaagtgggacttcaactgccaagtttagaattgaacttctatgtctagttacaactcaaaaaaaaaaaaaagaaccgagacacatggcttctatacaattgcctctttcgagtatatcatagcaggacagaagaacctagcagcgacttgcgtggaccttcgttccccaatgctgggaagagtcttatggcaagcaccatactggaggagagtgtctggcataatactggtctaagaacacatattcaatgcacttgtcgaataacactttcactttccagtgaccgtctacaatttcaatatccctgcgagttgactttcttattctccagcaaccagtaatgaggccccggtatggtccattcatgacaacactcctcggcacatcattgagatattcatcatccagaaagaatagaaatccgccctcaccaaaaccagggaactcggacttctcataggacctgccagagcctttgccgacaaacagaaccctctcatcaaggtcctctagttctgtccactcatgcgtggtcaaacctcgaggtgtgtcaagttctttcaactggaatacccg

SEQ ID NO: 53860 - DNA, 650 bp, Triticum aestivum
  unsure (1)..(650): unsure at all n locations
  Clone ID: PAT_TA_53860
gggggggggggggggggaaaaacgangagngccggggggggcaacnananacacgaancgaaaggnanacgnngnncgncaacagggggcagggnaaccggcgaggggccgagaaaagcagccagcggcnccncgngcaccagagccaaccaccgggggagggcggggcgnnnnaccaacaccncaccagacanncccaaggccggncgaaaaggggggccgggcccggggccgggcggggggggnggggcgngcgggggggacagggggggngggggcagggggggngggggggggggggnggggggggggggggggggaggcggggggnggggggggnngaaggggggggggcggggnggggggggnggggggggggggggnnggggggggggggggggggnggggggggggggggggggggggggggggngggggggggggggggngggnggggggngggggggggggggggggggggggggggggcggggggcgggggggggggggggggggggggggggggggggcggcgggcgggggcgggggggggggggggggggggggggggggnggggggggggggggggggggcgggcggggggggggnnggggggcgggcggggcggggggggcgcggcggggggggg

SEQ ID NO: 53861 - DNA, 670 bp, Triticum aestivum
  unsure (1)..(670): unsure at all n locations
  Clone ID: PAT_TA_53861
gacaattggcaattggatcagctgcccccgaaagattattcccacatcttacagtattacaccttgggggacttggtgccaaaactatatacagcaacatatcaatacaagaagaaaaaatgcatgtgcatggggggggggcgcccggctatgcaaaacctatttactgcattcttgccaggatgtatgtcttctaactggacatagagtagtttgttactggccctagggggtaggcctaaatgccatgcagaatggggggctgatcttggccagggcaagcaaggccgaggggaagatccaaagcccatctgcacatgtgaaaccagatgcaactggcggggccatgggggcgggctggcttgtgggcatggtggggcggacgaggactgctgggggtgggcgcgcgcgtggngggtggggggagggggngccccccggggaaaggggccgggggtggggggggggggggggggacgcgcgngcgggtgcggggnggggccgggggggnngnnngnnngggggggggggngggggggggngggcgggggggggggggggggggggggggcggggggggcggncggcggggggggggcgggggggggggggggggcggcggggggcgggggggcgcggggcgggggggggggggggcgggggggggggg

SEQ ID NO: 53862 - DNA, 393 bp, Triticum aestivum
  Clone ID: PAT_TA_53862
gttttatttgtttgttttttttttttttttttttttttttaggccaaacattaagcattaagctgaattcaacattgagccaaaacatgcctcattgccttggtgacgggacacacaaggctgggggtgcttcagaccaaaagttcaacaaatcttccagcccaggtgatttgattggcacccatgattgaaacaaatggggtataggggattttctcactatatgaaatagaataacttagtcgacctcctggatcttggggccagcaccgccgttggcagtcggagcggcctcgtccatgccttcgggcatgggaggaccgggaccctggtacatcttggcgatgatggggttgcataggccctccatctccttcattttgtgctcaaact

SEQ ID NO: 53863 - DNA, 519 bp, Triticum aestivum
  Clone ID: PAT_TA_53863
caacccaggggtcccaggttctttattgaacaaaaaaggaaccaaattcccctttgccaccccccgccagcccaaaaataaacggaaaaaaatagggccggcttatcaccacaaactctaaatagcagagtttatgcaacaatgcctacgtttgtttcctcctttccagatatccccccaaactatggatggggccccctgcttccctaacgtttcgggaagtccaaccccttgggggggtaggcaaaccccaaaaaaaacccgatgacgtccccgaaatgcccgacccccacatccccaaggaaatcgggcttaatgcccataccgccccccaaaaattgcttcccccccccgaggctcccaccggggacccaccctgggctggtgttatcgccaaactgccacccgatgaccccttatatggcccaggacacggggtttgcccatttgtcccccctcccccaaattggttttaacggccccataccggggaacccaaaaaaaaggtcccacaggggg

SEQ ID NO: 53864 - DNA, 675 bp, Triticum aestivum
  Clone ID: PAT_TA_53864
caccccattgcacgatgcggtgctgcagcgaaagtcggatgttgcacttaagctgctggaggccaacccaagctgtgcgcacatgttgaatgcagcaatgcagtcaccgttctacattgctgttcgggacagccttacatatgttgtcaagaagattgccgaccaggggctgtacgtggctttaatgtccactcacggcactgttctgcaccaatccgtgttggggaataacatccgggcgctggagatcttgctggacaggtatgaggagcttgtggagttgacagatttatcagggaacaatgctctgcactacgccgcacagcacaacaacgcacgcatagtatccattttgctcaacaaatactccaatctagcctacaagcagaatgacgagaagcatactcctctacacacagctgcttactatggctcggcagaggctgctaaagagctgttaaagcagtttcctgatgccattgagatggtggataatacaaggcaaaatgccctccatatagccgccagaaatgacaaggtggacgtgcttgaattgcttctcaagtatgtgctgccggaggagattgtgaaccaacaggatagggacggtaacacaccgctgcatcatgccgccaagctcctgaatagacaatcaacaatgttgctactcaatga

SEQ ID NO: 53865 - DNA, 390 bp, Triticum aestivum
  unsure (1)..(390): unsure at all n locations
  Clone ID: PAT_TA_53865
gacccacgcggccgcccacgcgtccgcccacgcgnnccgaggctctggggaggggngnaggagggacngaagaggggaccannggctgaccggaagagnggaggaggngancaaggccagngggcaccggagggggacagcagagggggaancngcgcnngggncacaaccaaaaggggcggaggccgcngnngncggaggggagcangaggnnaaagggcagggaancnacgcannnggcaccgggggggagggggggccnnacagngaggagccacgaaaaagccagancanggcgggccggagccaggagggggcgcgggcggggcccgacaaggagcacgggccacggggggcgcggggggcgcgggggggggggggggggggggg

SEQ ID NO: 53866 - DNA, 471 bp, Triticum aestivum
  unsure (1)..(471): unsure at all n locations
  Clone ID: PAT_TA_53866
gggatcccctacaggcaccccttcgctgtcaccggcgtcgtcgccaccgtcggcacaggcggcccgcccttcgtcgcgcttcgggctgacatggacgcgctccctatgcaggaaagcgtggaatgggaacataagagcaaagtgcctgggaagatgcatggatgtggccatgatgcacatgttgctatgctattgggttctgctaggattcttcaggagcaccgtgacgagttgaagggtactgtagcccttcttttccaaccagctgaggaaggtggtggtggagccaanaaaatggtagaagccggagctggggaaaacatagaggtcatgtttggacttcatgtagctgacagtgtgccaattggtgtgctggcatacagacctggtcctataatggcagggagtggattctttgaggccagaataagtggaaagggagggcatgctgcacttactgatgacactatg

SEQ ID NO: 53867 - DNA, 340 bp, Triticum aestivum
  Clone ID: PAT_TA_53867
aagctgtaaagcaccaccgtggtacacctacgcgcggccagaagaggtgtgtgtcgtctctgttaggtccggccagatgaagctcccgctgtcggcggggtcgcccgacgcggcgcccgagctggccaagccgtcgctgccggcgacgtggctcatcctgcacgcgctcttctgcgccacctccatggccgtcggcttccgcttctctcgcctcgtcgtcttcctcctcttcctgcccacgccgcccatgaacccctccgcgcacctggtctccctcgtcaccccgcccgtgatgctcgccagctgcaacaccaccggcaccatggccaccaccgccacc

SEQ ID NO: 53868 - DNA, 179 bp, Triticum aestivum
  Clone ID: PAT_TA_53868
ggcttttacttctacttctggaccgatacccccagcgctgtgacctacaccaacggtaacggtggtcagcttactatgaactggaacggaaaccgtggcaaccacgtccttggccaagggatggaaccccggcgctggtcccaccatggccccctctgccgactaccgcctttatctgt

SEQ ID NO: 53869 - DNA, 269 bp, Triticum aestivum
  unsure (1)..(269): unsure at all n locations
  Clone ID: PAT_TA_53869
gacccacgcgnccgcccacgcgnccgggcccananaaaaggaggggggggcgggcanngggangagcacaaccaaaccaanaaaacaaaagcananaacagncnccgancgagaggganccagagggcagcaacagcgagcanggagaggggnggnggcaagaggagggcagcggangnggnggccanggccaggggggggcggcngcnacngcagcggagggcagcaccgcggacggacagggccgaccaaacccngcacggggggga

SEQ ID NO: 53870 - DNA, 393 bp, Triticum aestivum
  Clone ID: PAT_TA_53870
cccacgcgtccgcccacgcgtccgcccacgcgtccgggaggcaaataaagttgtccttgttgagttggaggagaagggggatgcgaccactcttgtatccccatttttaagcggtatatgctcgtctcggggatgagatacttgtgaattttacggtccagttcgctgtgtcgatgtctcctctggctcttctgctcttccttctctgctcgtctctggctttggcttccgggtccgagccaaccctttcatggacctgtggagatgaacaagtttccatcttggagacctctgatggccgtcaaaatctgtccatcaatggggttttggtgaaggaccgtgctcaaggctgagacaggctacgggactactttgagagtggaaggctgagct

SEQ ID NO: 53871 - DNA, 293 bp, Triticum aestivum
  Clone ID: PAT_TA_53871
ggcgaagtcaggaacttccttcggcgcccccaaatcgcctccctccaatggtggcagcctcgcctccctccctccacctcgccctcctcctctttgcagcccacgcggccgtcggcggcgccgcgggggcggtcggggtgagcgaaggcgggcagctgtggtgcgtggcgaacaacaacgccgaggacggcgcgctgcagtcggacatcgactgggcctgcggacccaacgggggggccgactgccaggccatacagaagggcggagcctgctacgagccgggggacctggtg

SEQ ID NO: 53872 - DNA, 150 bp, Triticum aestivum
  Clone ID: PAT_TA_53872
gccacctactaccactacttccacggctacggcgagctcatcgcgtcccacgccgacgaccccgcgtacgaggtgactctgcccgggctgaagcgggctgtgaggatccgggactggcgcgggttggtgcccaacaccaacgaaggtgag

SEQ ID NO: 53873 - DNA, 335 bp, Triticum aestivum
  unsure (1)..(335): unsure at all n locations
  Clone ID: PAT_TA_53873
gacggccgngcgcatggcctcgncagacgcgccgcagctcggcgccgccaccgnggaggggcccggcgcggcggggcccgngcgggncgnggcggcggcgggcccccccgaggcggaccccaggaaggcgcnggacncggcgcngnnccggcgcnggnnggagagccngcagggggagagggggcggcgcgcccacgggaagcncagccgccggcagagccgcacccaggggggggacangnncggggagcgcgnggggnnccncaagnncaaagccgacancgncgacgaggcgaccaaggccaagagnccagggacggacnncgcaagagggc

SEQ ID NO: 53874 - DNA, 679 bp, Triticum aestivum
  Clone ID: PAT_TA_53874
cacccaaatcacaccctcttgttccacagcaaatttagaagtgtgtactgtatccagtattccaacgtccatcaatcaaacaagaactaagaagtaccccgggagcatctttgtttcacctgtgacctgtctccccttgaggtaccagtttcatgccgatccaccgtgtaaacagggactttctagtcaggctcttccgcagtatcaggcacgccaagaaaggagcgctggcaccaatggcaatcaccgcgtaggcaagaaaccgcgacactggcgcgatggtgaggtatacggcagtcaacattgagatgatcgctgttagaacggagaggacaatcagcatgttggcccaaatcaatctagtgagtacctggccatgatactgccacgtcaagtagcagaggacaagaacagtggaggtggagccacacattgagatggtgttgccgaccgcgaatatcttaaaggccagatggtgtccaacaatggcggtgcctgactgttggctgtaccctccaggcacggcgagtgtgactgcaaaggtggccatgctcatcatggcagccacgaaaagattaatgaccacactgctaaccatgtacgtccttcttccccagtaccacagtggtcgaaactgttgctctgtcaatacctgctggctgcgccttctggaccatgc

SEQ ID NO: 53875 - DNA, 707 bp, Triticum aestivum
  Clone ID: PAT_TA_53875
agaataacagggcagaatctcttgattcaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtacgcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtagcgcttcatgtgagagataaactgcttcttgtcaaaagcaggttgctcctgaagacggaaggtgtcaacaatgtcaaccaccttcacggcctggtcatcaacaccctcatcatcaccaccaccctcagcagagggattggctccaatgtccacatcaactgctccttgaacgacccaatggccatcgacttcccagagcacgccgttctccagctccctgtaagggaacgaatccgacagaagctcgtcgccggaaagcttgtcctggt

SEQ ID NO: 53876 - DNA, 690 bp, Triticum aestivum
  unsure (1)..(690): unsure at all n locations
  Clone ID: PAT_TA_53876
attcaactcccaatcaaatgaataatacatgatacatatttacatacaacaaacaatcttattagtacacaatacatatcattgttgtgaaatactagtttagtagtccaacatttaattaattgtggttgtcagcccagaattgagcctggagccagtccacagtcttcttctccacctgaaaggccttggccaaaacatcgtccgagattggtggcttcgaaccaaacacagcgtttgcaatggttatggccccagggttttggctgctaagtccggcaattgcaactgcaggcttgtaggggttggggttgaactggaagtggatgagtccttgtgggaaaacatacacatcacccttgttgaggaccttccaaatgagcttgttctctgggttagatgtgacaaagccaacatagagtgtcccttcaagcatggtgaggatctcactggcacgaggatgagtgtgtggtgggttctcccccaaaggtgcatagtcaatgcgtgctaaggagatacctagtgtgttgagaccggngatcctcatgacattgagcagtgtgacaatggatcccaccttgctcatctttgtgtccctaggcatgtcaagtttggccgctaagaagaaagtctncgcagtcacctnctttgggtctttgcagacaaacccattaaacagcacatgtgagc

SEQ ID NO: 53877 - DNA, 605 bp, Triticum aestivum
  unsure (1)..(605): unsure at all n locations
  Clone ID: PAT_TA_53877
aaagagggccaactcttcttcaacttccaaggggggactaaacttagcaccaccacttgtcattttatacatgggctttgagatttcagaaattactatgagcctagcccattaattctaacaggacggacgactcgtgctcgtgcatggctagcttgctgcagaacatggagacggtttcggggtggatggcgggcggggagcgcgcgcggaggagggcgcggtcgtggcacgggagctctatcacggcgccctggccgtccctgcagtaccttgcccacgtcccaatgaaatggaacgcgctggagccgtccacggcggcgtggtgcaccgctgtccctaagaccacaccgccacacttcaagaaggtgacctgcgcggccaacatgatggacgacggctgaacgcgaggacagaacagcttcgtcagctccgacgacggtgaagggccgctgaagtcctcgacggtgcgatcagagcgggctaccacgaagagcgcgccctcgccgttgcagtcaatctccatgcggccgtcaccatccgcaccgaggcggcctgcnagagggtagaagggcaccaccgccttggccatggacttcttgagc

SEQ ID NO: 53878 - DNA, 558 bp, Triticum aestivum
  Clone ID: PAT_TA_53878
gctgcagctcaatggttgatcatatacatgacacgcagacaggagtttaagcaaacccatcagaaatgcgaggcaacaaaaaatgttacagacagagacatgcacaaaataaatgaccgggtgtcgagtcgccatgaaaaactttggcttaaatctgcaccggggcgaccataggttgttattcccgtgaagctgccatttctgggggatgaacaaaacagagtaattttcacaacttttttcccgcagcagctggaaggaaacacgcagttcccatgactagggttgaggccgatgagcgcggcggcgccggaaaagtcgcaggcggcggggctggcggcgccgccggatcggaggaagtagtcgttgaaggcgtaagaggcgtgccccaagaggtcgggcggctcgtaacaggcgccgccctgctggatggcacggcagtcggcgccgccgttggggccgcaggcccagtcgatggccgactgcagcgcgccgtcctcggcgttgttcttcgccacgcaccacaggtgcccgcctttgctcaccccgaccgccccc

SEQ ID NO: 53879 - DNA, 448 bp, Triticum aestivum
  Clone ID: PAT_TA_53879
tatttttttattttcttttttattttttttattttttatttttatttttttctttttttttttttttttttttttttttttttttttttttttttttttttttttttttttttttttttttttttaacaaaagggcggggggggggaacccaaaaaagagggggggaaggggcccaggatttaattaaaggaagtacataaaccccccaaaaggggcccaaccatcggggtacccccaaaaaaggggttttgggtgaaaaaattccaaaaaaaaattttttccaaaaaaaagggggttggaacacccctggggggaaaaccactcccccggggtttttaaggcctttaattaactgggggcggggcatgggacggataaagaacacccccggggggggggacccccctctgagaacgtccagaaaaaaaatctttataaagggttggt

SEQ ID NO: 53880 - DNA, 544 bp, Triticum aestivum
  Clone ID: PAT_TA_53880
ggcaaccagggcccactttaaaaagggttcaacaggtaaatcacaaaaacaggggcgcaggacacgaaaaattcatagaggagccaaattctgaaaacatcccctaaaacaaaacttaggggggggaagaaaccaagtatcaaagggtcgtttggacaaaaggaaacaacgggggaaggggggcaaaaactaaagccttgagcttgccgaaaaacccttgtttttcgcccgggggcgggaaaccaccggccccaaacttggaaaagggggcaaaaaacttgagcttgaacccccccagggccaaaaaaaagggctgcttcaacagggacggggggaggggcaccaccccctttttggggccgacacaacatcccttgaacataagggagccagccctcaccaccccatagggggggaacccccccaggggagggagggccttttcaggcccgggaaacccgggaaaggcatcaagagtttcctggccaaccctgccaaattggaaaaccctttgggtcatttaaaggggggggggggaaccatt

SEQ ID NO: 53881 - DNA, 479 bp, Triticum aestivum
  unsure (1)..(479): unsure at all n locations
  Clone ID: PAT_TA_53881
cctaaacccaccgagctcatctccccagcgccgccgccgagggaaccccaccaagctcatctccccggcgacctcccgccccacccctcctcaaatcgtactccctccaccaccaggacctccccgaccccacgcaccgccgccggcgagggtggccacgcgaagcagccggcgctgattagccggtgtccgactgtacagcccaacaagaccgccaaagatacccaggaggccgggagaggcataaaccctaggaagcccgcggctcttccctctctcacccgacagagcacgccgcgacccgccgaccacgagaatgagcgcggagaccgacgagacggcggccggcgggctcgcgggggagatggaggtcgaggcgtaccgncgcctcttccccctcgcgttcctcgagcgtcacctccgcgagtccgtccggcctgatgcccgncgcctcgncgaagccccgcccaccaccgtcg

SEQ ID NO: 53882 - DNA, 600 bp, Triticum aestivum
  Clone ID: PAT_TA_53882
ccatcttgaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaacatccggaagctggtgaaggatggtttcatcatcaggaagcctcagaagatccactccaggtctcgtgcaaggagggcacatgaggccaagcagaagggccgtcactctggatatggtaagcgtaggggtaccagggaggctaggctccccaccaagatcctgtggatgcggaggatgcgcgtcctcaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagttcgaggccaagcgcgccaagagcaaggcaagcagggagaggaagattgccaggagggaggagagattggctcagggcccgagagatcatgcaccag

SEQ ID NO: 53883 - DNA, 658 bp, Triticum aestivum
  unsure (1)..(658): unsure at all n locations
  Clone ID: PAT_TA_53883
ggacggacggcgncgccacnngcacccgcacgcggcaacanacnagcngccnccacnccnccgcacacnagcgccgcngnccagcngannngcnnncgagaggacangngcangggcanggccaagcngcngcngcngcngcnccncgnggncaccggcggccacggccacgcggcggcggcggcggggaaggagaggaacacnagcacgcacgncaaggggnncgacggcccgcngcccnncgccccggagaccgggnacgnggagggggacgaggcgcacggcgccgagcncnacaaccacnncanccagacggagcgcagcccgcgggaggacccgaggcaacacgggaacaccgggggacccggggggagcgcgcagaacgggcaccagggggagaacgggccccggcaaggcggccggggggggggcaccgagggcaagccgggccggggggccngggggggccgggggggcccgggggggggccgggggggnggcgggggggggcgcgggggggcccgcgggggggccgccgggcccnggggngnnggggcgggggcgggngccgggcgggggggccggcgcgggcgcggggggggcgcggcgcgcgcggcggccaccgnggaggccgggggggggggggggggggggaggg

SEQ ID NO: 53884 - DNA, 570 bp, Triticum aestivum
  unsure (1)..(570): unsure at all n locations
  Clone ID: PAT_TA_53884
cgacccacgcgnccggccgncgcgnccaaacgcagaacgcaggggccgagcgaaccaanggcganggngacggcgaagcncagcnccccggccgccgcccggcncgcccccgnccggaccgcgcagcccgcccgccgcgccacgcacgaccgcgaccgcgccaccggcggcaccaacgccgacgagcacgacaccaccgcgaggacggaagcaaccccnggccgagggaaccaggcgancgacgagacgagggcagcanggggaaagagangggggggcangggggggggcaacgcgggagggaaccggcaggcacacaggcagaaagggcnggccaccggggggggggggggagagggggggggggggccgnggngggggggggaagcggnngggccnggcgcccggcgggggggggggacgcngggggggnccgggggggcggggcccgggccgccccggcccccgggcgggggggggcggcgggcgggggcgggggggggcgggggggcgggcccccgcgggcgccggggcggggngggccggggggcggggggggggggggggggg

SEQ ID NO: 53885 - DNA, 381 bp, Triticum aestivum
  unsure (1)..(381): unsure at all n locations
  Clone ID: PAT_TA_53885
gacccagcgnccgcccagctttcggcccaagaggcccggagacaagccccngcgncnnccccnncaggaggggnacaagannggnggcannggaaccgngccngnnggacgcgnngagacnggngncancaagccnggnanggnngnnaccnnnggccccacnggncngacaacngagggcaagncngnngagaggcaccacgagncccnccnggaggcgcnnccnggngacaangncggcnncaacgngaagaacgnngcngncaaggancngaagcgngggnnngnngcanccaacnccaaggangacccngccaaggaggcagncaacnncaccncncaagncancaacangaaccacccnggncagaacggcaacgg

SEQ ID NO: 53886 - DNA, 344 bp, Triticum aestivum
  unsure (1)..(344): unsure at all n locations
  Clone ID: PAT_TA_53886
cgccgcgcgcggggcgaccggaccgncaccggcgaagcaacaccggcacccanggcgcncgccnccaccgccgccaccgccnccgcggccgngcccaagaacccgnnccncggcgcgaggcgcgcgcncgcnaangccgccncccncggcgccgccaagcccggggggcggcgcgnggnggncgncgccgcggccgncggcaagaagncgnggagccccgcggncaagagcgangccgagnncancaacccgacngggcncganggcacgcnccccggggaccaggggaagaacccgggggggcnnggcaaggacccgggcggccagaaggggggcagggaggc

SEQ ID NO: 53887 - DNA, 326 bp, Triticum aestivum
  unsure (1)..(326): unsure at all n locations
  Clone ID: PAT_TA_53887
gacccacgcgnnccggagagcaaacggcggagacaagggccgggcncagcngaacgancnncgnngccgacnacaagaagggngaccncaagggggacgagnncancacccaccgcaagacccncggcgagacnaacaacgcnnncgacacaangaagcagggcgacggcaaacgngcagacgacgacaagcaaaagcacgagccnaagaaacaangacccaaaangcagcanaaacaaacgacaancaaaaccccacgccgaacgacaaaacnggcccccngaaaaaaaaaaaaaaaaagggcccgacgccccaacaggacccaa

SEQ ID NO: 53888 - DNA, 425 bp, Triticum aestivum
  unsure (1)..(425): unsure at all n locations
  Clone ID: PAT_TA_53888
gacccagcgnccgcccggngccnacaaggccaccgacgaggacgccaacggcgccaacnacaacggngcgaaggccnnccccangcccggccccaagggcnggggnggngcnaccncngccggnggcgcnacgggcggcaacgangcncccgcnnccacncccgcggccggnaacgacgcncccgccaccacccggggcgcgggcaacggngccgccgcnccngaggccggnaacggacagcagcagggnggngagcagcagcaggcnccaccacagggcaaccagggngganaccccggacagcagcagggagaccaggggggcaaaccnggagcccagagcgcngacagagcgngcaacggaaaagcgggggccgggaaggcggggggggggggggggggggggggcgggggggggcgggggg

SEQ ID NO: 53889 - DNA, 155 bp, Triticum aestivum
  Clone ID: PAT_TA_53889
gcgactctctcatggcggctgtcgccagcgctgcctctttcagcgtcggctccgtgcacgacaaggccggtgccatcctgagctgtgtcggtgctgggaccgtgcgaggctgggggcgtgatgaggggaagggccgcgggggtgggcgtgcgggg

SEQ ID NO: 53890 - DNA, 493 bp, Triticum aestivum
  unsure (1)..(493): unsure at all n locations
  Clone ID: PAT_TA_53890
gacccacgcgnngcgcccacgcgnccgcccacgcgnccgcgggcgcgggggggcgcncanccnncgggacacggggccgancgcanccacccagaaacccnagccggacggaccanggcgcggcgaaccgccccacaccaccggcgcgaacacaccccgggcccaacacccccccacgcaggcgccgagacccgccgaggggggcgacaagccgagccccggagacggggccccgggcaccggggcgccganggccgggcgacggggngggggcccggcggaccggagccgggcggcggggganggagggagngcgcgcgccgggggggcggggggcgggcgggggggccgggggggggcgggggggcggggggggggcgcggggggggccggcggggggggggggggggggggggggggggggcggcggggccgggggggcgcgggcgccgcccggccgggggggngggcgcggcggggggggggggggggg

SEQ ID NO: 53891 - DNA, 238 bp, Triticum aestivum
  unsure (1)..(238): unsure at all n locations
  Clone ID: PAT_TA_53891
agccaccaggccngccaccancgccnacggccggnncgangaccccnnncagccggcccccnncaaggcccacancgccgagnncaacnccacccncaacnncnncnncgccggcgacggcacngccagcgccgacaccaaggggagcggcggcgcgccgcaggacccaaccgggcngaacgccgaggcgaacagccacggcaacngaccgaacaacacggacaccgacggcaccaac

SEQ ID NO: 53892 - DNA, 159 bp, Triticum aestivum
  Clone ID: PAT_TA_53892
cccatttttccgagcttccgaaatcttaagctccgtaagcccccctcctcgtcagcgccggccggtttgcacaccggtctgcaactcagtttattggtgaccgtctgggttgccggctgcgcccgtggggccggcgcgcgctcggcgggggggtgtgcc

SEQ ID NO: 53893 - DNA, 374 bp, Triticum aestivum
  Clone ID: PAT_TA_53893
ggcggtcacaaaatgctggcgaggaagaagtaaatgacggttgtgccatccagtcaaccacagccacgactcatctctccgtcctctgcatccgtcgccgccggcgcgcgacccccacacgccacccgccatggccgccgccgccccctccgccacggcgctcgccggcgcagccctcccgctccccctctccgcgcgacctcaacccgctcggttctccgtggcgctcccccggacggcccctcctcccccggccctgcggctccggtcggtccggcgcctggcggcggcggaggggggaacgcccggtatgaaggagacgctggacaaggtggtgttttgttcacaaggttggtgctgtgtatgaaggggac

SEQ ID NO: 53894 - DNA, 353 bp, Triticum aestivum
  Clone ID: PAT_TA_53894
cagttactgcctaacactgacatgccagcttcaggaccctgcccgccatcttttgctgacggaactggaacataagaccaggcagttgcaagcaagatgatttactgggggggtggatacaggaggtcagagcaaaatggtcctagaagaacaagatatgatatgataccaagacgctgtgtgctgtaaggccaggggaagatcatgcaacactgagccttggtgggaccactaaggaaccaacacgtgtgggcccgagatgatgctgatgggggatgctatggtgatcgggagaatagctcggagcatcaggctttctgcttatggaaggatctggcccatgggagatgaac

SEQ ID NO: 53895 - DNA, 269 bp, Triticum aestivum
  unsure (1)..(269): unsure at all n locations
  Clone ID: PAT_TA_53895
cgccgngaacngnngaaggggcaagagnaggangaancaggnnagcgaggagccaaggganganccgnccaagagggngagcggggccgcgccggcggcggcacgcgccggcggcngcgacggcaacancngccnggacnacgcggnggagccggnggacacccncggcggccaacacaacggcgggccnngcaacaacgaggggcngcgccgcgacaccgacggcgggaccaacacaacagcagggcggacgagccccgagagcaagg

SEQ ID NO: 53896 - DNA, 230 bp, Triticum aestivum
  unsure (1)..(230): unsure at all n locations
  Clone ID: PAT_TA_53896
ccggggncgacccacgcgnccgcggacgcgngggcgagcgcccgcgcgaaagccaagcgagcacaccgcgcaagnagcagcgncagnnncagnnncagagcnccgcnnccgnaagccgccaagccngcccacgccaagcccgcngcccgcccggccaagcccgccgccgcggcgccgaagccgaagcccgccgccgccaagcccaaggcggacgnncnagaggaaccaag

SEQ ID NO: 53897 - DNA, 256 bp, Triticum aestivum
  unsure (1)..(256): unsure at all n locations
  Clone ID: PAT_TA_53897
ggcgacngaaccgagggacagacgaacncnncgcaaggnggagaagcacganggnanccacaacgagnacangnncccngaggccagcgaggggcaagaccnngngaggagcaagggccncnncncnnncnacgaggacggacaccaggagngcngcagggngaggaaggggcggcccnngaggagggcccacaagggccacaaggccnggancaccgggcagaggaaggancagnccccnggcaccagagccagc

SEQ ID NO: 53898 - DNA, 248 bp, Triticum aestivum
  unsure (1)..(248): unsure at all n locations
  Clone ID: PAT_TA_53898
gacccacgcgnccgggnnngaagaagcancngaagaggcgcagagccccggcncacnnggagcccgacaagcggnggnggagcnnnngcccccaagccancancnggnccccacaaggccagggagngccnnccccnganccccanccngaggaacagacngaaagangcacncaccaaccgngaagngcagacgagccggaggcagcgngacaccacggcggagggaaaggcccgaaccgacaagac

SEQ ID NO: 53899 - DNA, 260 bp, Triticum aestivum
  unsure (1)..(260): unsure at all n locations
  Clone ID: PAT_TA_53899
gagcggcgagaggacggggggagagggcggcgangaggngcagcggcngacanaccgaaagcgccacagccacgccaccaagncgaaccagacncgcggcggcaagacaccaggggggaggcnngngnaccagnanaccaagaagcgggcgagcgggccaaagggcgcgggggccggcaagaaganccaaggaacnccacaccngaggccgacggagnacaagaggcccagangggcgaggaacaggaggacggggaacc

SEQ ID NO: 53900 - DNA, 429 bp, Triticum aestivum
  Clone ID: PAT_TA_53900
cattagcatagaaacagtttctcctctccagtccagtgcactcctcacacttgataaatcaaagcgccggtaaccatttggttccgcaaatccacaccgctaataatcaaccaagaacgcccgcccgtggcactaccactctgctatcctagcacacacgcaccaaagaaatgaagaaatggggaaacttcgagccaatccatcaaacaaacgagctcagaaccagcgccagaccggctacactagaccgccctgaggagcgcggcgaggacggtgacggcggcgtagagggcgaccccggcgcgcggtccggcgagcgcggcggagcggtggtgctgctcggagggcggcggttacggcggcggcagattctgggacttgatggccagccgtattccggcggggcagtttccgaagctgccgatgaag

SEQ ID NO: 53901 - DNA, 437 bp, Triticum aestivum
  Clone ID: PAT_TA_53901
ggggaaaaaagacatgaaccttgcttatgcctggggggatacattcaacacattcaaacttcagttgcaatatcacccttacattttaacacatttagatgtacatagagagaaagggaaaatgaaaaccttgttgcaaccaaaagaaagaaaatccctccctcccccatctgcctgcacctgcatgcttccttattgaatccacagctgtcggcactttgcccttccaaaccaacgccatgctgcaccagaatcatcacgtcacatactcgtggtgaactcgatcgatcgatcgatcactatatctcgtatgtgatcccgactttgagcagctgatctttgggaatggacaacaccttgtgcccctttgagaagaacttcctaaagaaggggtaaacatggtaaaccacgaccttgttaaagatggaggacttgaa

SEQ ID NO: 53902 - DNA, 460 bp, Triticum aestivum
  Clone ID: PAT_TA_53902
gcccccggcataatataaacatcagtcgacaaccaaacaaatagttgcaaggcaaagagggtcataaacaggggtcaagcaaagtaggcgaaaaccccccacaggaaaaaaattttaagctcctagcaccatttctccggcagaaagggtagctcaaccccagtcccacaaaggggaacggcggctttttcccccctcccaaaaaacaagcgtccaaaaaacaaaaacagaaaaggggggccaagcatccccccaaaaaagaaagccccctgctctgctgctgccgctgggggggcggcggtttctgcccccaccgcggcgggtaaccccgccggggggaacccgcccgcgggtaacccccccccgggggggggtagcccgcccgagggtaccccgggggggggtatccccccttgtccccgtaaccctgcggggggggcgcccccacggggggccgctg

SEQ ID NO: 53903 - DNA, 343 bp, Triticum aestivum
  Clone ID: PAT_TA_53903
aagaggaacacaaagtactttacttagatacaaaaagacgggtggtaactaagatatcgtgtatcgcggaagcacaaatggtctcctacacacagctcaagatcatcctacgacgagctcccacctgcctttctcctccacgccggcggcgatctcgtcgatcatcctgacgacgtcgggcatcttgggccgcctgtcgggctcgacagcagcgcacatcagcgcgacctgcgtgagcctcaagatgtacccgtgccgctgcagctcgccggcgatctgcacgtgtagtatgtgcgaggaccactcatggctcaacgccaaacgcgcccactccgacatgtag

SEQ ID NO: 53904 - DNA, 431 bp, Triticum aestivum
  unsure (1)..(431): unsure at all n locations
  Clone ID: PAT_TA_53904
ggcaacncnagaggnnccgcacggccaanacagcnaacaggcgggggcaccaacacgcgggggannggannanncacacccanaannagaaaacaaaaccccgcaaaaggacgngcaggggggggggaaancanccngccgccgccncancagnagggggagcccnncgggaacaggcccnncngggccncgncgcncncgcccncgccgggggagcggccgagcggcgccaacgagngggccngggcgcggaccagcagggccnncggcgccgccnncgagggcncgggcggccccggccacgncnncagcaccgagnncgggagggcccgggcgnacgagaaggacacgngccacgggngggcggacgggnncancgcgnncaggggcagggnnngccnccagcncggaccggnccgccggaaaggaac

SEQ ID NO: 53905 - DNA, 629 bp, Triticum aestivum
  unsure (1)..(629): unsure at all n locations
  Clone ID: PAT_TA_53905
gggggggggggggggggaancaaaagcccnngcggagggggccnnaaannacagagcncagacnananannacagggnacanacgcgggagaaagaaagaggacgggannccccanncgagggacacacaccaccccaaagaagacacggacacagagggggggggggggcnncnncgaccnccagccgancccaggcaanccgggcggccgagcngangcanggcagcaaccccgcncccaccacgcgcgcaagccaaaanngcggnganaggccgagcgcgccgaggggcggcgggcccgggccggacaggggggggaagangagcggggggggcgnggggaggggcgagggcngggncggggacaccnggggccggacgggcggcggggggggggggggggagcgcggagcggggggggggcggggggggcggggggggcggggnncggggggggcggggcgcgggggnccggngggggggggggggggggggggggggggggggggggnngggggggggggggggggggngggnnngnggggggggggnccgggggggggggggggggggggggggggggggggggnggggggggggggnggggggggggggggggggggggggg

SEQ ID NO: 53906 - DNA, 319 bp, Triticum aestivum
  Clone ID: PAT_TA_53906
gcgtgggcccatcgcctttactctacgtttctccttgagctggtctatctttgcaaattcatacgcttgaaaaaatcctgctgtatcgcctggagcctccgttgccattctcctggcccagacggtggctgggggcgcggccccattcggtcttctgtcttgtcacaggccgctgtcgccggttaccctgggctgcgccctgggtgcggctcgcggggcccttgggcaggtcctgttggggcctgttgtgcgttgcgcgggatttgtgtggcgatgccggcccctttggtggagggtatggtgctggggaccggcttgg

SEQ ID NO: 53907 - DNA, 297 bp, Triticum aestivum
  unsure (1)..(297): unsure at all n locations
  Clone ID: PAT_TA_53907
aaacaagggaaaggcgcaaanncncacancagcnagggaggcaaaagagancgnnncnnnanannnacgancnnangggcggggggggcggggngnnnccagnnanaacngggcaaannncgggggaggggcncaaannanncggaagcaaaaccagaaagaacgcaccggaagaaaaacaggganncgcngaacaaaaggacaagcnaaagcnacaanaaacgaaaancagnccggaccaacggccnaggccgaggggcgcaaaaaaacgagncgcgaaaagcacgcaangggcgg

SEQ ID NO: 53908 - DNA, 430 bp, Triticum aestivum
  unsure (1)..(430): unsure at all n locations
  Clone ID: PAT_TA_53908
aagcgngagacnaaaacancaaaacacgagccacgggnaccagaagaanaggccggggccccggggccgnacaacgcaaaaccggagacncgacagngacnggcncganccgggggggggggggcggcagncancacnacncggcnnncnnnccaagcccaagggccggcggcaggagcnccgncaccnnccncgcggccggccgggccnngagccccncccaccacgcgnncacgngggggagcnccgccaccagcggcgcgnaccccggcgccaggaagnagcgcgcgaaggggaagnggccgagggcggcgaggcngangncgnccccggcgagggaccnggacgccgacagccgngccncgngcaccngcaggaccnngnngagcgnggcnacgggcncgggcaccaccggcggggcccgcgcgcc

SEQ ID NO: 53909 - DNA, 449 bp, Triticum aestivum
  Clone ID: PAT_TA_53909
gggtttgtttttttttttttttttttttttttttgggttgttctgaaaacaaaaaaacgcacgccattacttagggaggtgtgaaactatttcaccactgggtacgctgagactgcaggagatatgtgtcaagcctacgcgggcgatgaccgtggggggggggggggggaaaaacaggataaattagggatttccccctttttttctaggggacagatcacatcatcaaaccctggaggatggctggatcgcctggatttccggacccttgggttgggcgacggagctcccatgccctttgagagtttgaagctgcctgaaccttggaatctcggccctctttttggcctgttcagccctgggaatcacgtgatggtgagcccctttgtccgagaacattttaacttgcgggggctggaacccatggagggtccactgagggggagccc

SEQ ID NO: 53910 - DNA, 482 bp, Triticum aestivum
  unsure (1)..(482): unsure at all n locations
  Clone ID: PAT_TA_53910
ggggggggggggggggnncacanacgaagggcagagggccagnagannnaacananaccagaaaccacnaggacgcgagagannaacagccccacagcaggacangggcnacancggggcgcaacaanagcancaggggaggcggaccaancccacagggggggagggccacaggaccaaccagaaanananagcaaggaaagaaagacacaggggcgggacnagaggggacaggangggcgaagcnccgcgncagcnncncagaccacaagagcaagagcaccggcagggaggggannaggcccccaccaagaaaggccagcgagcgnngcnggccngaacgcggcgcccanaccgcgacaggaccccgccgncgcngccgagggcgacgcccggcgaggggnagccggccgacacanccccangcgagnganccacngggaccgacgggggcnggggggacagganccacgccaggaacg

SEQ ID NO: 53911 - DNA, 418 bp, Triticum aestivum
  unsure (1)..(418): unsure at all n locations
  Clone ID: PAT_TA_53911
gggggggggggggggaancanaangagcacaanaaagaggcagcggcannganaagnncagagacgaangacncggggacgaaacggaggaggaccggcacaggccngaggaacnngnaacagggcaccaccacagggggcacaancnnnccaggggcaaggggggggggaaaaggngggcgacacacaaaanaagccganaancncgcaagccggaggaacaaggaagaaggagcnncaggggccacngggcngaanncncaaaggcanangcaaaccggancgacaaggggggccgaaaagcacaaggnccggccggcccgngggnanancganagcncaancggcgaccgcagggcaacaggacaggccnannagggcncaccagggganggacaaggggggaaagccgaacaga

SEQ ID NO: 53912 - DNA, 233 bp, Triticum aestivum
  unsure (1)..(233): unsure at all n locations
  Clone ID: PAT_TA_53912
gtgggttttttttttttttttttttttttctttttggggttttttttttttttttggccgggcccttttcttttttacnattcccccggctctccctttgtttcccaaaccttttggttttgcccccccctctctcgcgggggtcggccgctctattttgcgtgtggggggctcgccccttctttctggtctttgggcggagttctgcgccctgtgccccgccctgggtagag

SEQ ID NO: 53913 - DNA, 330 bp, Triticum aestivum
  unsure (1)..(330): unsure at all n locations
  Clone ID: PAT_TA_53913
gcctcaagagaaatctctcacggcaggtactgttgatctcaaatgcctataacagtgcgaattncatctcataacatgccttaagtttgtgatgaatggctgntgatnttgtcgtggacccaagactaatacgacttgcttgtggggggggtgcttaactcaggccgagctgtctgctggctttgnttcttcgtccttcactttggtgggggtcttgccatcgctgcccctttcggccttggggtcattgatgctcggctccggttcatcggttcttgcgcccgttgcgtctgtctttgtggtgatgttctctgtcctggttgggaacct

SEQ ID NO: 53914 - DNA, 463 bp, Triticum aestivum
  unsure (1)..(463): unsure at all n locations
  Clone ID: PAT_TA_53914
ggnnttcngatgcgggtgttaaaggttccngatccaaaacattctcttgggcttttcatcttccaaggtnttcttcttntcangaacactccttaggattctggngttgggcccccncagtnntccaaagctatgcgggggctgggtcaagcagcttatcgcttcttggtgaccccaacagtctttcctctcctgcctgtggtcttggtgtgctggcctcggtcacgcacgccccagttgtgccgctggccgcgatggttcctgttcttcttgngcctctcgtggtcgtccctgagcttcatgtcctcggcgttggtctcgtcctgggagaacctcccgtccttgtgttccttcttgctgttggggggcctttccggctccttgttctggcgcgggttgtgctcctcctccgttgcggctggccctctcctccgcgggttgctttgcggccctcttgttcctg

SEQ ID NO: 53915 - DNA, 749 bp, Triticum aestivum
  Clone ID: PAT_TA_53915
ccccgcgtccgcccacgcgtccgcccacgcgtccggggcatcacactaagcatacacggaggagagaagatcggagttgttggtaggactggcagtgggaaatcaacactaattcaggccttgttcagaatagtggagccttccgaggggaagattatcatcgacggtgttgacatatgcaccttaggactccatgatttgaggtcacggttcggtatcatacctcaagagcccgtgctctttgaaggtaccatccgaagcaacattgacccgctcgaggagtactctgatgttgaaatttggcaggccttggaccgttgtcagctgaaggaagccgtcacatcaaaacctgaaaagcttgacgcatcagttgtcgacaacggcgagaactggagcgtgggacagcggcaactgctttgcctaggccgggtgatgctgaaacacagtaaaatactgttcatggacgaggccactgcgtcggtggactcccaaaccgatgccgtgattcagaggatcatccgggaagactttgcggagtgtaccatcatcagcattgcgcacaggataccgacggtcatggactgcgacagagtccttggtagtcgatgcaggactagcaaaggagtttgaccggcctgccggcctgatcgaaagaccggtactctttgggggccttggtttcaagagtacccaaacccgggtcgtgtggacatgttagcccaatgagaagcgaaatgggccaaattttt

SEQ ID NO: 53916 - DNA, 576 bp, Triticum aestivum
  Clone ID: PAT_TA_53916
accacgcgtacgaagatgcttacttggtatttccttggtatgggcgccacgggcttttcttgagccttcacgggggacgaggatactgtcggagatactgcctctggcctgaccggactactgaccggagcgttgagcgggatccaagaagagacggggcacgtgctgcccccgcgcggggaggacctcgccatggccggacgaagactccccggaggagacaccggacgccaagccggactcccacttacccgggtcggcagaggcgaactaatagagctacacgtatgctaactcctttcccgtccgaagtaccgcgtcgtactgagatggagtgagggcaactgttagcatgctatgataactggggctgataatgtgctaaaagtaacagaatgagacaggataggatcatgatgcagcttgctagtaaccaatggggtgattaaataataaaacatcttaggggtggacaccatgtggattacctcttacaaatctgatgaggaaggaagcatagcctttgatgtctaagcccggacaaggggtacaaacaaggaaaggatacttttccac

SEQ ID NO: 53917 - DNA, 309 bp, Triticum aestivum
  Clone ID: PAT_TA_53917
cgggcgcatgagtctgcactctacccttcacgcggcgaaggaaacaaaattccaacaaaagaggatggggtcggcgcgtcggcgtgcccaatcctctccctctgccagacctgtgatactgcgcgccggggcagggctgccctccaggcaactacggggaaaacggatttgaatggatcgaagcttactggactggagcccatccgagccgagcggatcggactctgatggcatctagcgaacctcgaggaggggtcacctccctgcaccgggcgcacagacactgccgcgcccggcacggacggcaac

SEQ ID NO: 53918 - DNA, 657 bp, Triticum aestivum
  unsure (1)..(657): unsure at all n locations
  Clone ID: PAT_TA_53918
atgttatgtgccaatggagctttgtgtagtttgtgagggtcagaagtttcttggcaagctctcagatgaacaaacctccaaggttctcagaatggggtgccaaagaccaagtgaaagaaagggaatcataaagggcattgtcgaagaagaatttggtgctggaagtaattcttacgccgaccaattcaatctccaagtgtcgaaggacatgacacaactctctgggagggttctcttgccgccaagactcaagtttggtagtggagggcgcattacggatatgacgccacaccgatttgatcgccaatggagtttgctggacagccatgttactgatggctccaagattaaaaactgggccttgataagctttggtggtaccccggagcagcactcctacattccaaagtttgtcaaccagctatcaagtcggtgcgagcagcttgggattcttctaaacaagaaacccgtcatcagcccattgtttgagcggattcaacttctcaataatcctggcattttggagagtaaattggggaaaattcaagaagctgcatcaggcaacctgcaactactaatctgtgccatggaacgtangcaccgtggctatgctgatctgaaacggattgctgaaaacgtcattgggtgttgtgacac

SEQ ID NO: 53919 - DNA, 356 bp, Triticum aestivum
  Clone ID: PAT_TA_53919
cttgcgtttcttcttccctctcggcttctcctccctctctcttgacggcgagcggctatggcgacggcacaggcggcggccaaagggaccctagtctcgccgtgcggcaaccgggccgcaggattaggagtccggcggcgcggcgccgaggcggcccgcatgtcgccctgcgcgccggcggccgggcggatcggcgggaagagcccgcttcttggcgccaggctcacgggcgggcccaggagatcgaagctcggtcctcggaatctagccccctcaccggcgcagacgaaccctgcgcccgccaaacccaccaagcggcgggagaagggcatgcagcccaacacgagggagaccga

SEQ ID NO: 53920 - DNA, 1189 bp, Triticum aestivum
  unsure (1)..(1189): unsure at all n locations
  Clone ID: PAT_TA_53920
cccacccgcccgcccgcccgcattccatttcccttccgtttcgcgattcgatcccgtcccgacccaggcccagccccggcgcggcagcctgatcacgcgcgcggccatgggctcgacgccggggagcanctacnactgctccttcaaggtgctgctcatcggcnactccgccgtccgcaagagcancctcctcctcagcttcntctcccccgccnccaccaaccaccacatctcccccaccatangggnggattttaaaatcaannttctcactgnnggngataaaaaannnaannnnacaatnntcnacacccctngccannanaggnnnangacaancactannncctnactacancangnccccctnnnnancatccttacccctatccatccccccccaccacacacaccttccaccaccaccccccccccccccccccccggccccccccgcaacacacnaaacccccccctccccccccccacaccaanaanccccccccccccaacaccccccccccccccccccacccccccaccccccccaccccacccgcccccccccgcacccccccccanccgcccccccccccaccccaccaaacccaccccgcncccccccccccccctccccccccncccccccccccccccnccccccnnncccccccncctccnnncccccccccccncnncccncccacccccnncccccccccccccccccnnncccccccnnnnaannnaaaaaannnnnnnnnccccccccccaacacaccccccccccccnccnnnnnnnncccnnncncnccccccccccccccccaccccccnnnnnnnnnnccccccccccncnnccccccccccccnncccccccccnnnncccccccnnccacccccccccccccccccccccnnnnnncccnncccccccnccnnccccnccnnccccnnnnnccccccccnncccccaccccncnccccccnncccccccccccccccccccccccccnncccccccccnnnnnnnnnnnccccccccccccccccccnncccccccnnnccccccnncccnccnncccccccccccccnnncccnnnnnnnnnnnncccccnncccccccccccccnnnnnnnnnnnnccccccccccccncnccnnnnnnnnnnnncccccccccccc

SEQ ID NO: 53921 - DNA, 375 bp, Triticum aestivum
  unsure (1)..(375): unsure at all n locations
  Clone ID: PAT_TA_53921
cttctcctccccttccgggtcgggttctggttcggttcgggttcggntcgagagagaggccgagtagctagcctagcctagggttccggtagagaggaagggagatccatggcggagacggagtaccgctgcttcgtgggcggcctcgcctgggccaccgacgacaacaacctccagcaggcctgcagccaggacggcgagatcctcgaccccaagatcatcaacgaccgcgagacggggaggccccgccggtcccgcctccccacgctcgggagggaggagcccgtgcgcccggccatcggggagacgaacgggccaggagcgccgcgggcgcgccatcacccggacccgaggcccccccccgccgcctccggc

SEQ ID NO: 53922 - DNA, 583 bp, Triticum aestivum
  Clone ID: PAT_TA_53922
cccacgcgtccgcccacgcgtccgcatgattgccaggggagttatgcttggtgcagaccagcctgttattctgcatatgctggatattgaatttgctgctgaagctcttaaaggcgtcaagatggagttgatcgatgccgcatttccacttctcaagggagttggtgcaacaactgatgttgccgaggcctgcactggcgtgaatgttgcggctatggctggtggattccccaccaaggaaggaatggaaaggaaggatggtatgacgaaaaatgctccaatctacaaagctcaagcatctgcgtctggaagctcatgcagcccccaacagcaagggtctcggccgccgccaacccagcaaacaccaaggctcgcaggctgaaggagtgcgctccatctatccctggagaagaacatcaggggctcgacccgcctagaccacaacaggggaactcgggcagataaccgaggagacccgggccccccacatccctccccgcacgaacgccagcagccgggggggaaggaaaaggggccaaaaaaagacccgggagagaaaccaaggggcccccccgaacacccc

SEQ ID NO: 53923 - DNA, 655 bp, Triticum aestivum
  unsure (1)..(655): unsure at all n locations
  Clone ID: PAT_TA_53923
actgaaacgacaaaaactctgctgcttcagtggacatttttgacccatctaatctgtacacaatcggcaccaatttcccaagtaaatcaattcagattcacaacaacacctgtagtttaaattgctcgtaacaaatatatgcattgttattgtgagaataaatgccagtggtgatcgtgggatgccaagctttccttgatcttctccangccttcttgagtatctctaggaaagatggtctcaaattgacatccgcagcccaacatacctcagtcaattctttcagctcagcggtatgtccttttgaacggaaagttgggcgatgcccatctgatacatacttagcagcctcataagggttcataacttggaaaaagggtgaattccccttccaacatttttataaagttttattggcaaaagggaaaaatttttaaccttttttttggaaaaattttcccccgcgggggttttgaaaaaaatttttctaaaaaaagaaccccctttttttatccccccccaaaagtatttttttttcggcgggggtttttttttttttcggggggttaaattttttttttatataaaaaaaacaaaaatagagggaacggggccccggggctggttttttttttttatttttnttttttttttt

SEQ ID NO: 53924 - DNA, 696 bp, Triticum aestivum
  Clone ID: PAT_TA_53924
cccacgcgtccggcaaaacattcagcttccactagtagtaccaccgtgtctcctcactagtatgtgagtgtgtgtgcttggtagtgttcgtgctagtgatcctcgtccagatattctgctcttcagtctggtactaactagtctgtagttcgatcccggcgggagagctagctagactgtagttgggctaacaattggcatcagagccttaggttatatgccgaaagaaggcgtcgccggcgacggctccaagaccgttgagcagagctcggctgaggaggcccgtgcggcaaacgcgctcgtgctgcgaggcaggccgggaggcgagctgggtgcgccacgctccgtgcgagacgtgggcatgtccagtacctccttccctctcctcacgcggaccaactaccctgatggaagtcatcatggaggtgcggcatatgtggaaagccgtggaaaccggcgatgtcgggtacgaggaggaccggttggcgatggaggcgatcttgcgctctatcccacatgagatggtgctcacccttggcgccaagaagaccgccaaggaagcatgggacaccatcaacactcgggacccggcgctaccccaatcaaagaaacgagccggaaaggcccccgcctttttgcaccccctaagaaacgccgaggacccaataaggcccggaccaaaaaactgggcccccc

SEQ ID NO: 53925 - DNA, 473 bp, Triticum aestivum
  Clone ID: PAT_TA_53925
cccacgcgtgcgtccacgcgttcgtgcacgctttcattccatcaccacactgaccacgcgccaccacgagcaacacccatggggcgcaccggcgccggcggtgccctctacgtgctcgtctgctgcctcctcgaagggtctgtgccggcgcgcctccccggcgagctttcgacgcaaggggcaccggaagccgttgacctcctgggcaccgacgagccggttctggccaagcaactggacggctgccgaggtggccaacccaaccaaagtgcactccatgataacataggaggaggagatggtggttcaccacgcccgccagcgcccccagatcatccggtgcggtggcagagacgacgaggaggtctccgacaagacggcgcgcttcagcagccacggccatccaacgtggaagagctaggacaaagagcacggtccggaacaagaacggccccgcgaggactctagaaccg

SEQ ID NO: 53926 - DNA, 650 bp, Triticum aestivum
  Clone ID: PAT_TA_53926
cagcagcccgcctcacatcccacccaaacccagcctccccacacgctccaaccaccagcacgcatggcacccaaggcggcggagaagaagccggtggtggccgcggagaagaccccggcggggaagaagcccaaggcggagaagcgggcgccggcgtccaaggaggccggcggcgagggcaagacgaggggcaggaagaagggcagcaaggccaagaagggcgtggagacgtacaagatttacatcttcaaggtgctgaagcaggtgcacccggacgtaggcatctcctccaaggccatgtgcatcatgaactccttcatcaacgacatcttcgagaagctcgccggggagtcggccaagctggcgcgggacaacaagaagcccaccatcacgtcccgggagatccagacctccgggcggctcggcctccctggggagctcgccaagcacgccgactccgagggcaccaagggccggcaccaaggtcacttcatcctaggccgccgccgggtgttccatgaagttgaagggcgggcagggcatcccggcacggaggcggggcaggaggctagaagagacgaagcggggggaaaaaaaagggctgactagcggcccctcaaagaaaaaagcgacccccccccccccgcgcc

SEQ ID NO: 53927 - DNA, 516 bp, Triticum aestivum
  Clone ID: PAT_TA_53927
catgcagctccgcctctcctcgccggcgggggcgcccttccgccacggtgaaccccggctgctgccgcgtgctctcgccaaaggtccatgccgtttgcgcggcaaaggagatgccggcggcacgcgcgtcgctcgacggaccagcagcgtatccagtactcctaccaaagtacctgcagggctgcaagcgaaacctgccggaaatgacatccagattctagaacggcccgaggaagaggaagcacgcgacctggacgggcaccgagtgattcctgggacagagctcgagcagccgctgatcgaccgggtgaaggccatgctcgggtcgatgggcgacggcgagatcagcgagtcggcgcacgacacggcctgggtggccctggcgccgaggctcgacggcggagacggggcccagttccccgccgccctccgggggatcctcgggaaccaactgccccaccgctcctggggccgacgcggccctcttccccggcctacgacccgggaacaccaaca

SEQ ID NO: 53928 - DNA, 752 bp, Triticum aestivum
  unsure (1)..(752): unsure at all n locations
  Clone ID: PAT_TA_53928
gcgtcgtacacagtactatgaagttctcattcactgccgctgctcttttggcagtttcgcctttgactgaggctaccaagccgcctgtcactgccaagaagctccaaaagctcatcaccgagaaagggttgatgaagaacttggaaacgctcaacaagatcgcctatgctaatggtggaaaccgtgcctttggtcttcccggttacgccgcctcagtagacttcatctacaaggaaatctccaagctcaagggcttcaagacatggaagcaggatttccctgcaaacttcacccaaactctagccgctgaggtcaccgtcgacgacgagactttcagaacggtcgctttgacctacacacccagcacttctgaagagggtgtcactgctgaacttatccacgcccccgagggtgaggatgcatgtgatgttgccaactacgagggcctggatgtgaagggaaagatcgttctcgttgaacgcggtctttgtcctgaccagaccacatttgctggcaaagtcaagcccgccgctgctgccggtgcggccgtcgttgtcatctacaactctgacgaggccaagctgactgcaggtactctgtctgctattagcccggattacgttcccacagctctcatcgaccaagcgcctggcaaagctctcaaggctaagctcgaagctggagagacgatcgaaacctttgcgaagatcattcagactatcgaaacacgaatcacacanaacgntttttgc

SEQ ID NO: 53929 - DNA, 624 bp, Triticum aestivum
  Clone ID: PAT_TA_53929
taaattttgatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaagggacccaagttaccgaccgcgggcaggcaacgaaaaagctgtggaagggggcccccaaaataaaatcaacgggccggggtttaaaaacggggagacgggaaaaccccgggggtccccaaactaaaccccctgggagaaaacccccctttggccagggggggaaaaagcaaaaaggccccacccgacccccctcccaaacagggccccaccccaaagggaaaagggaaccccccctgaaccggcccataaacggcggggggggggggggtacccccaagggggacccccaaactggcaaggcccaaaagccccgcccccttcccttttttccccttctttttcgcggcacggggcggcctttcccccggaaaaaacttaaaagggcggggccccccccttaaggggccccaccaataaaagggggggtgaggggggacccaggggcccccaaaaaaagccggggagagggggggg

SEQ ID NO: 53930 - DNA, 210 bp, Triticum aestivum
  unsure (1)..(210): unsure at all n locations
  Clone ID: PAT_TA_53930
cggaagcgtgggtcgcccacgcgtccgcggacgcgtggctgccatccccctatcacaacggccaccttccttctcccntgaaaaacaaccnancattancactccacaacancaacctctccactnctattacagaccacagaaatatcatgtaaaccataatacatagaaacaataatctgccctcttttcccctaaatanacaaacct

SEQ ID NO: 53931 - DNA, 674 bp, Triticum aestivum
  Clone ID: PAT_TA_53931
cataggggtcatcaataggactgaaaaaatcacgggcacaatacaccatataccatcttcagctctagtagtgacagaaaaactccagcttaatgggttgaatgaaatcttggaactaatctatgcggatcatatgcctatcgcacactggcttctccttgacctttctcaagatcaatcaccgccggtgacatgttttttaggacttggtgttcaaagtacgagcgcaggttgctcatgccacctcctggagaaatctccatccctgaatccctcccaagtcttgaagcaaaaaattggccattcgctctcattggctacatgtcaaacgaccggtttgcgtactcttgaaccaatgccccaaagagtgacggtctttcgatcagggcggcaggccggtcaaactcctttgctagtcctgcatcgactaccaggactctgtcgcagtccatgaccgtcggtatcctgtgcgcaatgctgatgatggtacactccgcaaagtcttcccggatgatcctctgaatcacggcatcggtttgggagtccaccgacgcagtggcctcgtccatgaacagtattttactggtgtttcagcatcacccggcctagcaaagcagttgccgctgtccccgctccagttctcgccgttgtcgacaactgatgcgtcaagcttt

SEQ ID NO: 53932 - DNA, 537 bp, Triticum aestivum
  Clone ID: PAT_TA_53932
gtagcataaaagaagaactgaacactacacctctggggtaaaaggacatatgcttcacatacatattgtaaaatatatcagaggttttaatctcggattcaatacccgcatgtctccaaaccacctggaaccgatataaaagagtttagagtatccttacaggcacaaatagatagccgcttttgacgaaactacggaagggcattcattccattcgaagccctgaattacttcatataactgtacttcatatacgtggagtacatctcacatgcacccacacactacctccttgaagccaaaccaaaccacataaggcctttgtttatataaaccgacaacgaccaagctgtattcccttagtttatatcccccagatccgggtccttgatctaagggctcaagtcccacagggtgcttaaccaccagtacttcatcaaaacccacaatgctgccaattgcatcatctaaaccatctgccatcaagaactctattggttgttcctaagcagcaagataaaaattatcctctcccat

SEQ ID NO: 53933 - DNA, 509 bp, Triticum aestivum
  Clone ID: PAT_TA_53933
aaaacagaaaacccaaggtaacaacagcagctttattggtccccaagacagcaaggcaacaagggttaaataactccattcattggagacgggccctggggtcttaggaccataggggaaaaaaaggggaaaatttgaagcttaaacatatgacggggggaagacaagaagagggtttttggggggctaccactcgaactttgggaagggggagagggcgttgggcatcttggcgacccggggggagctggcaaacctgcccccggggacgagggaggggacaagccccttggccttgggggggggggaggggcaaagggtcccgagggggcaaaactcaaactctaaaagggtgtagcgggagagcgtctcggggacccgggggaccgggttggggtttttggaacggctgaagcgcttgacgtaagccttcaaattcttgaaaaactgggaaacctgggcggggccaccggccgacaaggggtgaaaatgttcccacttgggctcca

SEQ ID NO: 53934 - DNA, 627 bp, Triticum aestivum
  Clone ID: PAT_TA_53934
agcagcataggcggtacgtctctagaaatgcaagcagtttggcatcagaattttgcataatgcaaccaagcaccaacatccaaccactgtaagatgccactgccatacgcatgatcattgtccaaggagacactatacatgtttcctaaatatataaattcgggtagatgcagaatacactgcagaagaagaaaatacgcaaaatgccatgagatccaaggcacacagcagagcatcagcagtagaacatgagccttttcacgctgtcactgagcttaggcaggggcgtcgtctgcaatggagtggatctgtacagagtcgtgcagctggtggccaccgaatctgacctctcaaggtacagcctgcccctgtacgcggcgagatgcgcatagtacgcagggggcacaagggacaccggcctggtgcaccgcacgaaagtgtagcaaagattgtgtatcagctgctgcacctcgtcggactggaacctgttctcgtccacaggacgtggtaatgagttggacggctcgtccccttggtgccccagtggctgcacaggtagaagtcgaattccctcgggtgtgtgatcaccgtgtcgacgaccgtcccccgcggtatgttctgatcgga

SEQ ID NO: 53935 - DNA, 584 bp, Triticum aestivum
  Clone ID: PAT_TA_53935
actggatgcacactaacggtggctagtgccaacatgctctctactgcacaaaaactgcactaatccagtaccaccaacagagtgactcctatagtctaaggaacaaacaggagcaacctgatgactagcagtgccagaatcaggcagacctgtctgtacacaaagcaatctcctaagcgattctccaattcgagtgtcgaacaatcaccttcctactatctcagaccctgatctatgacccgaagatccactaccttttggtgcccaaaggatcgcccttggccacactgttcgacttaaagcatgaccatatccaaacagggttgctgcctacagccatgccttgcattatatttgattctgcaatgcatcactcccaccataacagatcatatttccagtcagcacaggcagtgtaacgaaaccgccaaaaaagctcaccgcatcatccttgaaggcctatgcgttgattatccctgcaggatccataagagcgaccacgcaggcaatcatcacccaggaacaatgaactcacctctttgccttaacaaaggtatgccgccaccacaaccaccaacgctttg

SEQ ID NO: 53936 - DNA, 518 bp, Triticum aestivum
  Clone ID: PAT_TA_53936
gggccccagaaaacagggggaaaaagggaagggggaaaaaagcatgctttttggacaaaactaaaccgcccccaaatacgggtttactagagacccaaaagggaatcaggggggcttgctccctcaccaaaaaaaccaaaatgggggcccggggggacatatccgccccgttaacaaaaacaggggggacattattggtcgactaggcctaaaagcttcaaccatagttcattccacaaggtaaaaccccccccctttcaaaaaaacaagggcaaagggatcatgtttcggatgcaggccccatttagtatggcccccccggggcccggaacttggggccggaatacacagggggggggcccaatttttcctcgatcctaaaaagctggttgtacttggaaagcccctttgagcgggagggagccccatttttgatctgacccggggacaaaccaacagccaaataagcaatgaatggggccccagtcccaccactccggggacggggcatcacaccc

SEQ ID NO: 53937 - DNA, 661 bp, Triticum aestivum
  Clone ID: PAT_TA_53937
ggattgtggatgcaagtaactctcatagagaatgccacagaatgttctacttacaacagcaaacaaggttgatctagagagcatgtctaaattttacaatatggtgtcagattcagtacaagtggatacacttcaacaagacaaccgcgaaccaccacaacctctaactccggtttaacatctacagtagcttccatcaagtcttaccttacaataattctcaggaaaaaaacaaaggctcaaatttgactactgctttgaacaatcatcttcttttcgtagttttctcagaagaggtatcttcagattgtgccagagtcagcttggaatcctcattgatgttccattagtgggtgggtttgtaagctcttccggaattgcaagggcagaagagtattgcttaatcctcaaagaaatgagaatgctggacacaattccaagtattgggaacaaataagaatagacatgagatttcttagatcctgtagtggaggccaccgctgcatcagcaaggcttacaatggaaacattctgtaggatcattggtaaacagccaacaattgtaggaaggagaaaatctccaaaaaatccaacatctgtggcagatagaagcgtagttgatgatgtacgaaggcagaggagaagatctagcgagtaacac

SEQ ID NO: 53938 - DNA, 617 bp, Triticum aestivum
  unsure (1)..(617): unsure at all n locations
  Clone ID: PAT_TA_53938
gccaacaattcttctaaatcaagcaccttcaattcttgactctgcaccctctcttcgataacttgcttttcctgcaactgttcttgaagttttacttcatactctgctgttagctcctcaagtttcttcttttcttcggtgatttgaatcagtgagtccataagatctttctcctttccacttgcagcttccatcacagcttcaagactagctgattttgtctggtaagcttctacatcatcagaaaggtgggaaaccttgcttctgtactgttctagttctgcttcaacctccttgaacttcgcttgtgtggcttcaagttcctgctccagctcctgtcttcgggagtgtgcaccatcagcatcagactttgatgtatgaagcaaactcgccagttcaatacttctttcgtgaacggaatgagcttgttcttgatgctgtgagaatctgtcagtcagatccttgacttcttcttcaagtagaagagttttagatgccgaggaatccagagaagattgcaattcattcatcttctccttgtatgcctctgcattgttcactgcttcttcaactgcttttctttntctgctgaagaagctgcttcttgntggacctgc

SEQ ID NO: 53939 - DNA, 395 bp, Triticum aestivum
  unsure (1)..(395): unsure at all n locations
  Clone ID: PAT_TA_53939
ggggggngcggggnnngganncaaacagcaacagcacgggggcnncagggccgcaagcagcacaanncnnacagagangggaacancacacggcggccaacnacanacacgaggccggccgccancaacncaggaaacaacgacaacgccnaggangaaggggggggggggacggccnnggngcccccggagacggcgngcnnggcgagcnccccagggaggacgaggcggacggagggcnggancccccgggacgnganggggggcnncnngnngnaccgcgccagcnnggccgacnccccggcgagcnncncgaagangncgnngangaaggagnncanganggacanggccnnggaggagangccnacgnccgggngcaccngcnncagcac

SEQ ID NO: 53940 - DNA, 698 bp, Triticum aestivum
  Clone ID: PAT_TA_53940
agaagttcaaagatatatattagaatttctatctaagagagaccattgcatttaataactcccagacatgcgcaattgctcatttaacttacaacacaacgtaacaaattgttgatgtgcatgggttcttcaccaacatgtagcgccgtttgtgccaataaatcaataagcttctcaagtgcgcccacaagaatttccacttttgcatctcctttaagccatgatatatcattatttccttcatagaggccaccatgcataaaccgttccaccattttattacccgacaaatcgctacgaagatatttagaaataatgttggccatcactgatgctttggcccatgcaagtcgctctgtggcacgacttggttcaaaaatgcaagcggcagctagaaaataagctctcaatacatctcttggagccaccccaaaagcctcgaggccattctttttgtaggctatgccactcaagctgatgttggatttggcagcgattgaaatcacgctttgccagctcgagataggtgttgttgttcacaagtggcatcctgtagagtgtcttcccaatccagacatcatcatcaccgccatattgatctaggtagactcttgcttctacacgcggcaagcttgcataccaaggaaagtccagtgcatattgtacctcgcctggtagatcctttgaaatgatccatt

SEQ ID NO: 53941 - DNA, 714 bp, Triticum aestivum
  Clone ID: PAT_TA_53941
acttcattatttgcactactaaaataataatctttcttcaatcttctaaataaggtcatggtcacaaggcttaccctccgcattattgacttcgtggaaatgcaacgaagcctcatctctaaccctcttgataaatcccaccgtggtgttagccggaggcttggagagaagctccacaccatcgatggcaagcttgctgagaacatgtgcggcagcatgggcattggtgtgaagtgtctcaggaacggggttggtgatgttatcgcaggcctggtggtagcatgcatcttgctcgagaccagtaccagtgaatagacctccaacgggcttcttgataacctcgcggaaagcaacgtagtcggttccgcctgtaagaccgacgggtgtgacctcgatatcctcagcctcgaagtactcgcggaagagattttcgataacatcagaacctggaggtccgcctgggcctgccttttcacctgtaccgtcaaagacaccgaagaaaccgcgagagaccatatcgaagttgacgtaagccaggaggttgtcaacctcatccttcttcatgttgttgacgtagtagcgagagccaactagaccgttctcctctgcaccccaccaaccaaagcgaaccttgaggttggtagagaagtgctgcagagctttggcagtctcaagatgagtgttgttcccgaaccatcatcattgataccgggt

SEQ ID NO: 53942 - DNA, 642 bp, Triticum aestivum
  Clone ID: PAT_TA_53942
gcagggccaaaatttatcggatggatcatggaacattacattgcggggcgggatcgctgtcgccatttacatgtctgctaattctcggtgcgctaagctacgtaacttgctgctagctaggctaatggtaccgctcgctaagcccaggccgtgcttctctggtttgacagttgatgctgcgacggcgagcctgggcttcgcgtcgtgctcgtcggcccgtggcggctcacatgacggagcaggcgttggggttctcgtcgctgaacatctggggcgcgtgggcggggtacgtcgcgtagggcggcgggtactggggaccggcgttcgggtagaagcccgggttcggcggcggcggcgccgcgccgtagtagccgacgggcgccggggggtacggcatgtagccgtactgtgggggcatctggtacatgctcgggtccgccatgggcatcggcgccacggacgccgcggacttgtccttcttgtcctcgccaccgccgtccttcttcttttcgccaccgtcgccggctcccttgtccttcttcttctcgccgtcgtctttcttgtcgccgtccttcttgccaggggtgacgacctccacaggccgactgagcttgtctctgaagtagcccggcagggcggctg

SEQ ID NO: 53943 - DNA, 166 bp, Triticum aestivum
  Clone ID: PAT_TA_53943
agctcccgagaatgggcccaatctagtcattttaccgccaaaagaggacataagggggccggacgattagcgtccaaacaatcacaggcttgggtttgcccttattgaacgcaagcactggtttttcggttgattcccccccttcccctttcgggtgagggggaac

SEQ ID NO: 53944 - DNA, 460 bp, Triticum aestivum
  Clone ID: PAT_TA_53944
aatttgtttcatttcaaccttttttttccgatacgactgtcccgtatcgactttttcaagaccgctcttaatggcggggcctgtattagaacgtccgcggttgcctacttacctgcgggcccaccaattttggaccaaggacaaggatgggaggccccgggccttcaagcccatcaaaggaggcgcggccaaagacaattccacaatgtgggccatgacggacgtgagcaagcatatcctgctgggaaaccacaacttttctgcgagcaagcgcgcccactactgtaaatccatggcgctctcccttgggaccggctacgtcaaggaaggaggaaaattccacgccggagcgcgctaatgtgggggatcctgggatggcctgtctaccacggcgccacgccgatcatcgtctggtgcagccagttcagcgcctacctcagcctgataaaggtgtccgggc

SEQ ID NO: 53945 - DNA, 604 bp, Triticum aestivum
  Clone ID: PAT_TA_53945
ggctttggcaggtacatcttctttgttacattactcagcattcctgagtcaagcttcagtgcggccttcaaaatgttcgacgttgatctcagtggacgtgttttgtttactgaagctgctaaagttaatttctcttgtcgcccagaaaaaaagacctgctctttatgagcatgttcaatcatctggcttgttagttgatggtaaaacaaggggagatagacaaagaagagttcaagaaagtaatggcattgatgcggtcctataacagacaaggagctgcccataggcatggcttacgtacaggatttaaagttggccagtctgtggaaaatggtggggtggttgagtatttctttggtaatgatgggaatgaacctttacactttgataagttcacaagttttttgaaggaattgcatgaagagattattcgtctggaattcagtcattatgatgtcaagtcgacaaacaccatccctgcaaaggattttgcactgtccatgggtgcttctgctgacatgaatcacattaccaagctacttgatagagctgataccttgggcaatgacccttatctcaaaaacttgcgcattacctttgaagg

SEQ ID NO: 53946 - DNA, 557 bp, Triticum aestivum
  Clone ID: PAT_TA_53946
aagctactagaccagtttccttggaggaaactcgacgagatgcgcgaccgcgtcgcagcaccggaggccaggctgcctcctgggcctcctctccgtcgccggggccttattcctgaccccgacggccttggcggcggggggaaagaccggccaggcgacggggttctggggacggagcaggggcgagggctccctgcgtgaggcctgcgactacagcttgtgcaccatggtcaccatgtccttcctggacgtcttcggcgccaacggcaagtgccacctcgacctatccggccatgacctctcctccgtcggcgccggcatcatgcactgctcagtccaagggcgcacctgtctccctctgcattggcggatacggtgccggctactcgctgacgttcaaccgatacgcgctctggctcttttgccacctctggaacttctacttcggcgggtccatacctggcgtcccccgctccttctgtgacacacggctcgaccgtgtagacctctttctggagcacggcacgccaggggaccgctactacgatctggcgctg

SEQ ID NO: 53947 - DNA, 629 bp, Triticum aestivum
  Clone ID: PAT_TA_53947
cccacgcgtccgcccacgcgtccgcccacgcgtccgcggacgcgtgggtggaaacatgatgcaaggaattccttatagtggtttgaatgtgcacggtaactccatgcaaatgcattcttcaagctcaggaaaacagctgttcaaccaatctcagatgctagggagtttcgcaatgcctatcaacagggctacagcgcctgataaccctggatttcaatttggagaacatgaaaaaaaggatcgccgccaccaccaccagcagcagcagcagcacagtcattactctaagaactccatcagtgatgaggaggagcacgatatgaccgaggatgttactgatacccagaatgacaaaggcaagaagggttcagcatggcatcggatgaagtggacaggttccatggttaaacttttgattaccgcagcatcctacacgggggaggatcctggggcggatcaaggcagaaggaggaacattgcaatagtgcagaagaagggcaaatggaaagcaatatcaaagggcatgggcgaaagaggctgcagtgtgtcaccaaagcagtgcgagggataagttcaatggatctcaacaagagatataaaagggcttacagatatccttgggtcggggg

SEQ ID NO: 53948 - DNA, 634 bp, Triticum aestivum
  unsure (1)..(634): unsure at all n locations
  Clone ID: PAT_TA_53948
gngaaggacctgtccggctccttcgccttcgtcgtcttcnacaaccgcggcaggtcggggtcgggggcggcggtgttcgcggcgcanagcacggacggcggcgtgcccctccactgcggccnggccgcngacgggtcggtggtgatctgccaccaccgccgcgtggccaacgccgggtgcgggcggncntacncnccnntcccncccggntgcatgttccacacccagggccccctcaacaccttccaccaccccatcaaccnnctcaaggcnttcccccccgtccacacccaggccctcatgtcccgccccaacttcaangcccacccattcaccaacatcaactccatnccccncnntccgcagcgccaccaactggccccccacctggcaccacccccccatctaactgggcttgctgtccatcacctccccccgccccccctcccctaactcgnccagaacttcttaaactcnggccttacccgcattttttactttactctttttttcctccccccaatctcccacccccctcccccccccctccccccatcctcccctcctcccccccccccctctctccccccctccccccccccccccccccccccccccacccccccaccccccc

SEQ ID NO: 53949 - DNA, 606 bp, Triticum aestivum
  Clone ID: PAT_TA_53949
cggacgcgtgggcggacgcgtggggtgagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgaggaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgttgggaggatctacgaattccccctacttattcaaaaaactttccaagggccgcctcatggtatccaagttgaaagagaaaagctgaacaactatcggtccgccctttattgggaaaatactattaaaccaaaaaaggggatt

SEQ ID NO: 53950 - DNA, 482 bp, Triticum aestivum
  unsure (1)..(482): unsure at all n locations
  Clone ID: PAT_TA_53950
cccacgcgtccggggcggngacctgcggcgacgtgacgtccgccgtcgcgccgtgcatgtcctacgcgacggggcaaacgtcggcgccctcggcggggtgctgcagcggggtgaggaccctgaacgccaaggcctccacctcggccgaccggcaggcggcgtgccgctgcctcaagaagctggccgggtcgggcatcaccatgggtaacgccgccaacatccccggcaagtgcggtgtctccgtctctctccccatcaacaccaaactccactgcaacacccttcactaacttatctgccagcatcatcatcacaccacgctagctagcccactccgcgcctactgctgctgctccctgcatgtgttcgctgctgttttcagcatgtgtacgacctgcatctgttgcccctgttacagaccgagcaagtgaaataaaatactgtgttcgaggcttaatcttgtactgctatcacattggcct

SEQ ID NO: 53951 - DNA, 524 bp, Triticum aestivum
  Clone ID: PAT_TA_53951
gtgcaaggacgtcccctgtgaactacaagctacctagctagtgcggctattagttcgtacgtacgtgctcgagccactgagctgagctagtttgtgcgtgcgtgctattacgagctgttgccaggtggtcagcggcagctagccatggagaggacgccggtgatggtgaggcagggcggccaggaggtgctcaggcagctgccgcccgggttccgcttccgccctacagacgaggagctggttgtgcagtacctccgccgaaaggccctcgccctcccgctcccagctgctgtcatccccaacgtccacaacctctacagcctcgacccctgggacatccccggcgcgagagagggggagaagtactactttgcggtccggccggacggcggcgccaagaggggtggcaggaccacgacggggagcgggtgctggaagcccgcgagcgcgagggagaggccggtggtggtgtcccggtgcggccggagccaccttgtttgggtgaagaattccatggttttctt

SEQ ID NO: 53952 - DNA, 568 bp, Triticum aestivum
  unsure (1)..(568): unsure at all n locations
  Clone ID: PAT_TA_53952
cggccccgccaacccccggnnncaaaccacacatccacccacacatccancaatacanatcttactggaagaatccaccccacaacgccatgcgctatcttatgacaaagatctatggcctcgaattaggcacaaagccccggcagaaggggacaaaaatanactcaccacaagattagcccaatctactaggagccacttatgctgctgacttcttcctgtgggtctgccaactgcatcccacctcaccctgangcgccaatcgaacgaactgttntntaccgcaaaaaggcagcacggatgcactctccattatcctatacaataaactcacacatacaaaaaaataaacaacaacaaaaacacangcaatacacaacacacacaccatccataccacagattgccatctgacctccaaaggcgcaaagtcttttctatttccttttctttataattccatgcttccaactaccttcacattggttttacaaatgaatgaataaagggagaaaaacctaaaaatatccattgctcccaaaaacatcccccatcagaactttttatt

SEQ ID NO: 53953 - DNA, 633 bp, Triticum aestivum
  unsure (1)..(633): unsure at all n locations
  Clone ID: PAT_TA_53953
gggccgccgccgcctgcagctccatgcctctgccacgcgtgccgtcacgcagatctggaggcacacctctccacggcccagcgccccgcgccgcatgctgaccgcaccgacccacgcgcccgcgcttcgcagcaggctctcccgccggcgccctgaaccgcccctgcttcgcccaggctcgcgctcatcccctgctcgcgctcatcctttgggagctgcagttcccaatcgaagcagcagcagcagcagctccttttcgagctgccatcctcaatcgaaggaatcaagcggctcctctccgagtctcggttcgcaatccaagcggctcctttttttagcggcaatccggaatcaaagcagtccttcccgggctgcaatcagaaacaggtcctgtttcagttttaatataagtctccgagctgctgctataaatctggtctggcggcaaccctagtactcccttgggcggccgactgccagatcgatggccaaaccatccgtggacggcctcngcaaatcctccctcgatatggtggaggacgatgaagttgacaggctcagtaagttgcccgatgacgttttgctcaacattgtggagcgacttgatatcgctgatgctgcacgagccaccat

SEQ ID NO: 53954 - DNA, 494 bp, Triticum aestivum
  Clone ID: PAT_TA_53954
ggtacgaccaactgtcacaattgtttattttttatatacaagaacaagccttactttgttttagcttgccacagttccttaggctcaaaccgacggcaatgcaagaagccagggttgaggaattacaggagctcaggggtctgacttgatacaagctgttgaaatgggtctgcttgtggacacattggtcccatcagcatgatgccgccgcaaatgatcttcttatgcgccacctgcccgaccccgtagagcacgttattggggtgtacccactggcgggacttgtcgtccgtcttgagcccaacagttaaccaggtggccgggttcgccgacttccacttgttccatgagcccttccacccaaggttattgttgcaccacttgaggaatatcgtaagggctccaagggactcgctagaaaatcccatttgacagatgccgtccgacatgctccctcaggatgctcccggaccagagcaaccacgcaaggtgca

SEQ ID NO: 53955 - DNA, 498 bp, Triticum aestivum
  Clone ID: PAT_TA_53955
attaacttctttgttatggttctttttttctttcattgttttcttttttatcacaccacatagatttatggagatacaaagcaaggcgacggcgccctgagagtccggggaggccctcaggtactcttgacggcgacaaagatgaaaactgggacgactgtccaaacaatgcccgccaaaacaagcccgacggacaggaggcttaacatgatgggcttgacccacggggacagaccgggggacccggcctaagggacctccgacagaacctgggttttccccacagtcgtcgcgggcagcccagacccgagcatattctgcacggtctccgaggacgcccgggcgacctttttcctgggggaaggaactccggccctgaccaccaaaaggggacgaatctacgtggcctttttgagcccagcgactttacaggggcgggggggcggactataaggacacggaggaggtcttggcacgcgtgcctcataaatgcctttc

SEQ ID NO: 53956 - DNA, 467 bp, Triticum aestivum
  Clone ID: PAT_TA_53956
ctcatggaaacatgaaggggtaaaacatcattgccacctggggcacatgagatgttcataacacagggctctttcaaggctccaagacatacaagctgtttcaaggagtttgttaagactacaagtaaacctagaccctttgcggccttccccaaataacaccgcatgaggaccaccccagactggttcataatcctctaaagcaagcatacttggaatgcaccatcccatttgggggattggcgggcgccacatgcaaccttacagtgagtaaaaaccctggattttcagacatgagctccacaaggaattccccaccatacactggcccttttgatactgctattgcaaacaggccatttttggtgcctgatgtgctcaactaggaaaagggtgatcttctcacccttaccggaggaccatttttaacaagcctcacaaaccatccataattcatcctgtccata

SEQ ID NO: 53957 - DNA, 397 bp, Triticum aestivum
  unsure (1)..(397): unsure at all n locations
  Clone ID: PAT_TA_53957
gtgccttgtggataactgaaaccctagctatcgtaactcaaacactgaccaccttttccctatatttcataatccgtcaaagattgacaacaagagtgtgtccggcgacagccggcgagagaagaataagccgtgataaaaagaaaaacaagcctttgaaacattgttcatggaattgaacctgttctctgactcgacaagaataaaccagtgcttggtattcaagaagcctcttggttgaagcattataccgacatgagaggacgtaaaaacacgatacgctgtatcgccccgatgcaacaggcaacgaaggatgaatatagtacaggcaaaaagcaagcagctaatcccgccgcgtttccgccgcannggtttcccggggacgcgtgggccggac

SEQ ID NO: 53958 - DNA, 580 bp, Triticum aestivum
  unsure (1)..(580): unsure at all n locations
  Clone ID: PAT_TA_53958
acgggccgcatataaaaatttactagtcaggcctttttatcggatatgctcgagccgaaaaaaaagcaaatcgcgtaaaacgcccggagttatacgggccggcgaggttttacagatcagctagagttgttcttatggctggtaataaactgatatacggcaatgctcgacagttccggtaaaatacacttttagcttcccatgaaaatcccacattgatatcgccacatctgttataggcatacaacaacgctacccaatgaagcactttttttagcaactacgtacgtatgaagcacttgcttgtagctttgctgagcagaagaatggaccacacacacacttgcgctagcgtggggtggaggccggcggcaggggctggccccggaggaagtggtagagcatggcgagcgagcggccgggcgcgaagagcggcacctggtgcccggcgccgcgcaccgtaccagcgtcagcccctccttgtacttcaccggccacccggccacctgttgccggtagaaccacgcccttcacccgccccttgcccgcgcccggagntttatcgcgttcacgctgtacc

SEQ ID NO: 53959 - DNA, 559 bp, Triticum aestivum
  Clone ID: PAT_TA_53959
ggggttctacagagggcagggatattgctccatgaagcaaaaaaatattccccgcagggggtctaaaccatttgaaacattacattactttactttcaatcaggacacaaaacaaaacaccttcctcatgtgaggggcgtccgttcttttcattatttaccggccgggaagggaatacatacatacatacatacatacatacaagttaccgatgataattaccacaggcaagatcagatgctactactatctccttccttccttcctacagagagcagccaagccacatccgggagaaggcgtccgtccgtctgtctttttttttaaaaggaaaatgggttgccctcctcatcatcctcatcatcatcttgatcatcaccagcagcaggaggcttggccatttgcacgtagccctgaccctgatgggtgcacacgcgctccggctcccccttgaaccacaggttccgcagttccccgggcttccaccccagggacattagcgtccccagggtgaatggcacgatgtaaagcagcgccggctgcccatgcccgtccatta

SEQ ID NO: 53960 - DNA, 613 bp, Triticum aestivum
  Clone ID: PAT_TA_53960
gttggaaagaccacagtgctaggcgctgacattggctgacgacatgtactgaaacagcggccacacatagcacagggcccgttaattactcatgcttctctgcccctcacgatcacgaagccgagcgggcgcgctaaacaggatgcggtggggagcgcatcagcctgacactgggactgggactgctcactgcggctgagccttcccctgaccttctctcactaacccttgcactgacctcttactgcgccatgggataccctcaattgccctgtctcattacactaatgttgttgctacccgcaacaccttggccataaaattttaatgtaccctgcacttgaccacgcactgtctgaccgaaaatatggctactcatatctgcttaacagccagagccacaagcaactgagcattcgttggccacgcttccagcccttctttcatggggataggcacctgcccgacctataaaagatgagtggaatatgaggccacacttcggggtgtttccaagcgttttaagagatctgaacatggcctcctcattatctacgatctgtagagtggtggcaggacctttcgcaatatgcgcaatactgccctcatgaga

SEQ ID NO: 53961 - DNA, 668 bp, Triticum aestivum
  Clone ID: PAT_TA_53961
cattggccaaaatacttcacactaatgtcaagagttactccttatcctcctcgactcagtacaatctcaaaacagaaataatttaaaaggttgactagtgacgattaatcgatgcatacaacaactccggggggcggcagcttgcaacccctcaaaaaaaaaaaacgcagcttgcagctcaagaccagtactttggccaagtaaaaatttcccctaaacttgggaactgaatccggacgagcgaagacagcatccccttgctgagtttgtagctaagcaacgacttttccttcaacgtccactcctggagcatgtgtttgcaattctcacacactggactcttataaagttgtatgtcctcgagattcaccgctgcttccatcacattcctggcaaagcgcacgatattttcttctgcttcaaacctcccatagattctgagttcggcaaggttgtggtgcttgaaatcagatgcagatggttcccactctagtcccttgtccttctcctcgctaaaggcatacttttttctccgctcccccgttaccatttcacataaatggtcccgcaccaagatgcgtagttccttaagggtgggtgcaccttgaagtatgaacattatccaactcagatcgcattcttcagaatgttaatcaaattcacaagcc

SEQ ID NO: 53962 - DNA, 602 bp, Triticum aestivum
  Clone ID: PAT_TA_53962
gggcaatgctttcattcaacatatttagaagatcaattaattttcttcactcaagttatctacaaccatttaggaaatacacaagggggacatataggatgggggctcttacaaaatatgatggccaatatcctaaggaaccaattgttcattcacttgactaatacaaaaaattatggaagggaccaagtctttgatcaccaagtcaacatcaacttccatatgaccaaaatgtgtcgactttgttatgaacaaaagtgatcaccagaccatcataaatcatcttgggggcttactttttgccatttggcccatatacgtttgggcccttttttttgctaatatcctagggacaaagcagccaagccaacatcaacttccatatgacaaaatgggtcaaccatgttctgaacaaaagcgatcacgaaaacattttccatcaacttggggattttctactttctaccatgtccctgcaaaagaactaataatatgtttcaaccatcttaaaaatagtagaatttttcaaatttgtgagttgtctttgaatccaaaggtctaagaaacagtagatctacacatattggcttggttaaaaagga

SEQ ID NO: 53963 - DNA, 465 bp, Triticum aestivum
  Clone ID: PAT_TA_53963
ggcatttccgcggctccgccaatataaccctccgccctcccttttctctctccaaccactccgccccgccccgcctccctgtcctgtgcgcccgtcgcgacaaccatctgactaagcagcgccccgcgctcgcgctccgcgcagcggcccatggcgccggcggtggggatcaagcggaccggcggggcgcaggccgtcacggtgcaggcgccgccgccgccgcccgacgcgcggctggtgcgcgaggccgtgcggacctccacgatcgccgaggccgacgcgcccgcggccctggaggcgcccgcgcccgcgctcgagggcttcctctgcctcgaggaggcggagggccggcggtggaagtacgtggaggatgcggacccccgcacagggcaaggcgaagggccggggcaggggcggatccgccgaccccctgggggcccccgccaggggcggggcggtccaggc

SEQ ID NO: 53964 - DNA, 787 bp, Triticum aestivum
  unsure (1)..(787): unsure at all n locations
  Clone ID: PAT_TA_53964
gccgcaccccaccactcccaccagatcatcatccaccgcggactgctgcccggccggattcgatctgtcacgagcgcagcagggaggccgagcgatcgncggcatggagaagaagctgccgctgccggctgtgcacggggaggggctgtgggcgcggccctggcggcgggccaagacggccttcttgctcggctccatgctcgcctcgctgctcctcggctgcgcgccgccgctcctcatcggcctgctcgacctgctcctcccgcccgcgctcctctccaacttcctccgagccgacgcccaccagcacgccgcctccgcgcacaccctcctggaccaggccaggggctnccacttccgctcctccctcgccgacctccccgccgggtgcggcggccgctccctgctgagcctctgcgcgtacacggccgggcggcggccgcgcggcctacctgcggggggcggcggcccgcaccgccgggctccctctgggtcgggggcgggggggggccgccgccgggcgtcgcgcccccccggccccggcgggcgcccgcccgcgccccgggcgggcgggggccgggggccggggcggggcgggggcgggcggcgcccgcccccggcccgggcgcccgccgccccccgccgcccgggcggccgggcgggccggggccgggcgggcgccccggcccccccgcccacccccccccnnncccccgggncgccccccgggcccccgccgcggcngcggccccgggccgccncgggggcccgccccgccccccccccc

SEQ ID NO: 53965 - DNA, 821 bp, Triticum aestivum
  unsure (1)..(821): unsure at all n locations
  Clone ID: PAT_TA_53965
tccgccatttctctcctcctcctcctgccaccgatcccgaaccagggaggaacccggcgcgaggagggcaaaggaagagaagaggagatcaccgagcccagcgcgcgcacaggacagcaggcgccgcgatctcncgcaggagcggagatggggctcacgttcacgaagctgttcagccggctcttcgccaagaaggagatgaggatcctcatggtcggtctccatgcggctggtaagaccaccatcctctacaagctcaagctcggaaagatcgncaccaccatccccacaatcggntttaatgtcnaaactgtaaagcacaaaaacattantttcaccgnttgggatgtccnnggtcaagacaagatcaggcccctgtggaggcactacttccacaacacccagggtctcatttttgccgccgacagcaatgacagacagcgtcttgcccgaggcaagaccatgagcttcacccgcatgctgcaatgcaagatcgagctgccccgacgctggccctcgctcggtgctccccccaacaaggcaaaaaacttccctcaacgcccctccaaaccccctgctcgaaaaccaccccccccaacccctcggcccctgccctancttctncccccccnccnaacaattgnnccaccctccccaacaccccccacccccccccccctcccggccaccaggggggcccgccccccacgggcccccccccccgggcctcnccccaacacaccatnnncccaacacaaagcccccccaccccccccccccccccccggccccccccacccccccccccccaaccacccccc

SEQ ID NO: 53966 - DNA, 632 bp, Triticum aestivum
  Clone ID: PAT_TA_53966
cccacgcgtccggcgacggcgaggctgcgatccgcgtcggcgtcctccctccgggggatcctcctccgccactgctccgcgggacccgccgcctccggtgcgcccccgcgcgccttctcagattttcaggttcctggatctgcaacatggaggcatttctcaacatgcaagcctaatcctcttgcaaaagggaacagttttggctcaatggcttctctgtacagccagacaagatgggcttctcaagccaccgctgttaaagaaactgaccccagtggcggcaagataagcattgggcccaaatccaagcagatcaaggaggaggacaaagatgatgatctggtttatcagggaccgatatcatcaaccatcaagaaagtgaagcttgtgtccctgtccacctgctgcctctccgtctcgctaggccctgtcataacattcatgacttcgcccgacatgaatgtgatcctcaagggaggagtcgcatccaccgtgatcttcctcagtgccaccacaactgcagccctgcactggttcgggagcccggacatccataagctgagatgggggcgagggttcagacagcttcgaggcagagataaagtcatggctggctacacccctgaagaaga

SEQ ID NO: 53967 - DNA, 506 bp, Triticum aestivum
  Clone ID: PAT_TA_53967
acctggcgcgtcctcaaccgcgtgttccacaacaccacggacacgcacgtcgcgcaccacctcttctccagcataccgcactaccacgccatggaggccaccaaggcgatcaagcccgtcctcggcgagtactaccaggtcgaatcgaaccccctcgccagggccacatggcgctcggccaaggagtgcatctacgtccagcccgaggatcgcaagggagtcttctggtacagcaacaagttctagccgccatgatcccaccaagtaatcccatccatctacctacatgtatgattacctgttgggagtgccttaggctcagacgactgagaaataactactctactggatttactcaatcggctgacgtcatcgtagttctgtcgcccgtgttgtcgctaccacctacgtgagatgtcgacggctggtttttcaccctcgggctggcttcttcttccgccgctcgtcgggctgggtagggcttggattcggaaccatttgccaag

SEQ ID NO: 53968 - DNA, 698 bp, Triticum aestivum
  Clone ID: PAT_TA_53968
acacgctgggcaagcgtctgctgaagctcatctacccgaagcggagcgcggtggtggtgctgcgccgatgggcggaggaaggccgggcggtgcacaagtaccagctcaaccgcgtcgtccgcgagctccgcaagtaccgccgcttcaagcacgccctcgagatttgcgagtggatgaggacgcagccggagatcaggctgctgccgggggaccacgccgtccacctcgacctcgtcgccaaggtgcggggcctggccagcgccgaaaagttcttcgaggacgtccccgagcgggccaaggggccgtccacctgcaactccctcctgcacgcctacgtgcagcacggcgcccgggacaaggccgaggccatgctcaaggagatggctggcgcagggtacctcacctgcgcactcccattcaaccacatgatgtcgctctacatgtcgaccggcgagctggagaaggtgcccgagatgatcaaggagctcaggaggtacaccatcccagacctggtcacgtacaacatatggctcacctactgctccaggaacaacagcgtgaaaagcgcggagaaggtctttgatctcatgaaagatgacagggtggtccctgactggatgaccttcagcctgctggccaacatttacatcaatgccggtcttcatgtcaaaggccgggatgcgcttgtggagatggag

SEQ ID NO: 53969 - DNA, 540 bp, Triticum aestivum
  Clone ID: PAT_TA_53969
ccccgcgtccgcccacgcgtccggcgaccggtgcactgcctcgaccgatcagttcaacgatgacgatggccagcgttgcgtcgggcctggcgatcatggcgctgggcgtcgtcctcctggcgtcgccgtcggagtgcgcgcgcgccttcttcgtgttcggcgactccctgggggacaacgggaacaacaactacctgatgaccaccgcgcgcgccgactcgccgccggacgggattgactaccccacgcaccaggccaccgggcgcttctccaacggcctcaacatcccggacatcatcagtgagcagatcggcgcggagcccacgctaccgtacctgtccccggagctccacggcgcgaagctgctcgtcggcgccaacttcgcgtcggcgggcgtcggcatcctcaacgacaccggcatccaatttgtgaacatcgtgagggggagccggcagctgcactacttcggcgagtaccaggggaagctgcgtgcgctggggggcgcggcccaggcgacgcacgagcgggaaccgggcgctg

SEQ ID NO: 53970 - DNA, 790 bp, Triticum aestivum
  unsure (1)..(790): unsure at all n locations
  Clone ID: PAT_TA_53970
atttccttggagttttgcagaggccacccctccctccctcctctctcatccgatccaagctacgagtagacaagtcccgcactgtgctgtggtgctccatctagccagcttttcttgctcagcttagcttccaaatctgctccacagctccggcggcacaagaggaaaatatccgtgagtccgcgagagggagatcgtccatggagaaggacagccacaaggagggggagggggcgacggcgtggatgacggtgccggcgttcggggactgggacatgaagaacggcgccatgccggactactccatggacttctccaagatccgggagatgcgcaagcagaacaagaaggagctctcccgcgccagcctcggcggcgacgacgacctcctcgcccaccacaagcagcaccaccaccagcagcagcccgccgccaaggctccccagcagcccaccaagctcggcgctccggccaaagaccacggccgcgaccactcgcccaccggaaggaagaggttcctgagctatttccagtgctgcatcaaggcctgaagaccggctgctgccaccgccctccgtcgaggtaccgcagcatgaagcggcttaacaaatttagcctaggctcctttggtgtttggtcaagcttgcaatgaacgaaatgtgtaatataattccacgcccctgacgctaccctgtttagagaaccagacggttttatgtggggaaaaaaattggttggggaatgtcaagggttactatccttgccttantagtaattaattttttacttg

SEQ ID NO: 53971 - DNA, 331 bp, Triticum aestivum
  unsure (1)..(331): unsure at all n locations
  Clone ID: PAT_TA_53971
cggacgcgtggggaggagaggagaaaaacacaaagaaacaacaacagcgcgccgctccagctccagctcccgaggcagctcaccggcggccaccgtccgccccctccccctaccccgcccatacccgcggcgcccccctccgtccgctcgccgccgcctgctgatgctacggacacctgcccccggcgcgtngataccggctcccacctagatctggcccacaagaggaccccggccggaatgaggcggctcacgaacctgcactggctcctcaaactcacccgaacgacagcacaagcactgaccacaaccaccgcaaaagacaccaagg

SEQ ID NO: 53972 - DNA, 462 bp, Triticum aestivum
  unsure (1)..(462): unsure at all n locations
  Clone ID: PAT_TA_53972
ctccgaggctcctgaaagagcaacctctccctctcggcgaattcgggggtttctgaagcgcgcgaggaaaaccaaggctttgctcatggctcgcactaagcagaccgcccgaaagnccactggaggaaaggctcccaggaagcagctagccaccaaggctgcccgaaagtctgctcccaccactggaggagagaagaagcctcaccgacaccgccctggaactgatgctcttcgngagatccgcaagcaccaaaagagcacggagctgctcatcaggaagcctccattccagaggctcgcaagggagatagcccagaactacaagactgacctccgctaccagagccatgccgagctggcccttcaggaggctgcagaggcctacctggacggtctcttcgaggacaccaacctgcgcgccatccatgccaagcgggtggaccatcatgcccaacgacatgc

SEQ ID NO: 53973 - DNA, 522 bp, Triticum aestivum
  Clone ID: PAT_TA_53973
gtgagaaatcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtgtggaggatctacgaattccccctacttattcaaaaactttccaaggcccgcctcatggtatccaaagttgaaagagataag

SEQ ID NO: 53974 - DNA, 694 bp, Triticum aestivum
  Clone ID: PAT_TA_53974
gcagcagctcccctctagtaggtgtccccgcggctcgctcctcccccacccccccgcccccgcggccaccgagaagacgaggacggaggggggcgaccctgtcaccggccacatcatctccacaaccatcggcgggaagaacggcgagccgaagaggacaattagctacatggctgagcgggtggtaggaactggttcatttgggattgtcttccaggctaagtgcttggagactggagagactgttgccatcaagaaggtgctgcaggatcgccgttacaagaaccgtgagctgcagcttatgcgctccatggaccatcccaatgtcgtctctctgaagcactgcttcttctcgaccacaagtagggatgagctgttcctgaaccttgtcatggagtatgtccctgagactctatatcgtgtgctcaagcactatagcaatgccaaccagcggatgccgcttatctatgtcaagctttacatgtatcagctttttagagggctagcttatgttcatactgttccaggagtttgccacagggatgtgaaaccacaaaatgttttggttgatcctctaacccatcaagtcaagatctgtgactttgggagtgcaaaagttctggtacctggtgaacccaacatagcatacatatgctctcgctactatggtgctcctgagctcatatttgggggc

SEQ ID NO: 53975 - DNA, 754 bp, Triticum aestivum
  Clone ID: PAT_TA_53975
aactcaacagcaaaacgcttccgattattacaacaacaagcaggtactagtatgtacaagcatcgacataaaaacactctccatcccaaaaactgcaacttacaacaagcggccctacaaaggtgaatgacgaacagtcgaacaccatatcccgaagtacggcaggtcaacaaaaaaggaaacagctcttcctacattccgaaaacgactccgcagccgacgaacaccactcacgaacaggctacatacagttagcaagtcctctccatcacagcgacgctactaccagcaaacttaaatatacgtccctctagggaacctactcctatgcagttagcagttggaggtcgccctcggtcttcgcatggctcggcgcgagcatatctcgtcccgcgttattttttccacgacagcttcttggtgtccccggatttcggcaggtgtagttgatacagcggttagggggttgcacgagatgataggctcgctggttcacacctaggccgggctccaacacatgttagttcagctaccaacaactcatcagcatcatgtcccatcttcgtcgaaaaagctagaataacagctagagatggtatcatccagtcgatggtaaatggaaatagtgaagtcactgcggtctcgtgacgcataatcgagccttcccagggttaagaagtgactccgacattatccaaccctgttctttagctttcttcctgaatggtccgtaagaggatgacacaattttgca

SEQ ID NO: 53976 - DNA, 514 bp, Triticum aestivum
  Clone ID: PAT_TA_53976
aaaaaaaaggggggggttttttttttttttttggaattcactcaaacaaaggggggcgcgaacccattatttaaaataggggggggaggccccaacttttttaaaccccccccagtggcagcagcggttttgaaacccgggggccttggggggaaagctagggcaaaaccgggccattcttttttgaaaaatttttttagggggcccgtttttttagggggggagggggggtaatgcccctttaaacctaagccggttttctgcccttactggggggcaccagggggggcggggggacctttcccaaataaggggacaaaaaaagggcggtttaaaaccctaccccggcccaaggcagggagcacggttttgacccggttgttaattttggggggaaaacaaaaatcggcccggataaaccccacttttaaacagccgggggggttggggattccacgtttaccccaacagccccggtccttggggcccgggcttatccttcccaggtgggggg

SEQ ID NO: 53977 - DNA, 543 bp, Triticum aestivum
  Clone ID: PAT_TA_53977
gggccccaaatttcccgcctttttaaaaaagcaattttttttggcgaagtttcaccaacccaaccgaacaattctttgaccacaggaataaggagttcgaacactggtcgacacaaaaaacaaaagcttaacaaggtcgcaaattcgttaacacgactttaaccccccccggttaccgccccccccaccacagatgggggaaagtaccaagaacgacgcccccgcccgacaccattttatttttttttggccgcagccttggtcaccttggggccggggggatcctttttttccacagccttgataacccccacgggaaccggttgccttatgttacccacaaaaaaacggcccaggggggggtactgggcgaaggtttccacccccatgggcttgggggggatcattttgacaaacccgggattaccgtttttaaggaacttgggcgccgcctaaatttccttgccaaaccgccgggaaatcttggtgtggatctcaacaaactttacggggatgtgggacgtgtggcaatccaccaccggg

SEQ ID NO: 53978 - DNA, 647 bp, Triticum aestivum
  unsure (1)..(647): unsure at all n locations
  Clone ID: PAT_TA_53978
gacaaaaagataactaattttcagtctgtaaccaaattctcggatgatcaagatcagaagatgatatcaacaatgtttaatcaactctgtcttgtagtcatagcgtataggaggggaatatgaaggaacaagaacatgagcagcaaacaggagcatattatgaggtggctactcgaacttcttgatgagtgagaggtcgttgagcatcttgtcgacccggtcgtcgctgtcgaacctgccgccggggacgagggaggggacgagcgccttggcctcgtcggcggtgtcggggcagaggttgccgagggtgcagagctcgaactcgacgaggctgtagcgggagagcgtctcgcggacctggcggacggcgtcggggttcttgtagcggctgaagcgcttgacgtaggcctgcgacttctcgaagacctgcgagacctggtcggcgccgccgtccgacatgtgctgcagctgctcccacttgtgctccaggattatcgccacctcgcagttcatcaggcacttggccttcagaaactcttcgccgatcttgagctcggcggcgttctcctcctcctccnatgccgacatggctgctggcgctcgatttcttcttctccggctgccgctgccgcgattcggttcggcgt

SEQ ID NO: 53979 - DNA, 641 bp, Triticum aestivum
  Clone ID: PAT_TA_53979
gttgcacaatacagtttttatttaaaaaaattggcaatgtttattgcgtctttgtgggacctgggtcctcagatgccttattccacaacgaataaaacacatctaaaataagctcatacacaaactaatggtgattggtattcactttttgaaaattactacttttaatttagttacaacaacagtactgtttcatcggcttcacatggaaataataactcctaaaagttggtgcggcaatttttttttaagaaaaagagcgatcgacacgctatgcagcaacaggtagcaggccgttgtgcctcagcagtggctccggcgaaggctcccgtcctcggaaagcaacgaaaacctcgagcggagatttcccgcctccaagtgcaagaaccgtttctctgaatcgtctgcccgtctcctcaatggccttctcgttatccagaccaacatcttcaaatgctgagaatgcatcggctgatagcacttcagcccacttgtaactgtagtatccagctgcatagccacctgcaaaaatgtggctgaatccacacaggaatctgtcctccggcagaggagcgagaaacctggttttctctgcaacccttcggtcaacatcatacacggacactggtccacttggatca

SEQ ID NO: 53980 - DNA, 656 bp, Triticum aestivum
  Clone ID: PAT_TA_53980
gcaacacaccgacattcattcaacaccagtaggagtacaagcaattggcgtacatagatatattttggggtacctagctagagctagctagtcggtgaagctgcaacacacgctagttcaactagtaccacgagcaacgacgctgcatagccgattttgggacgacactgtcaatcagaccatccatgcagaggataaactgtagcacaaccattggatgtagtgtcgtctccaaatcggccagcgtgtgtcgtttgctaagtagtttcgtagatattttgggcaagctacctagctaaggtagctagtcggtgaagttgttgaggcatgcgtgtggctcggtggccttggctgcgggcgtgggctcgatggtgggggagggcggtacaggcgtgcagagcagctcctttggcaggtccgggatgcccttgaggtagaaggtgtagaagatcttgaaggggaagacgatctggttgagcttgacctggccgtagacgccctcgaagacgccggagccgccggtgacggcgaggtaggactcctcgtaggtgaggtagggcccctgcacggtgatgtggccgtagtcgccgaatagatgctgtagatggcctcgtagcggtcgccgttgcgctccggcacgtgctggatcaggatgc

SEQ ID NO: 53981 - DNA, 692 bp, Triticum aestivum
  Clone ID: PAT_TA_53981
atgcctgccatcattctgcttcagatttgtaaatccaaatgaaccatgacaggtcatatcaacaagcatcacatcctggagcgtccaatctaacacagcctattattacatctcaagacattattgttgaaacttcaccaattgggtacttgctagtcgatttcaacaatctcctagtttcgtcatccattgagaccttatcctcgtccattcgttcatcaattatcagaggcatcatttcagctttagcgtacgtgcgcaggactgagttatatatctcagttgtgacatagcctgcatctctaagcacaacgaggagctcctctgcagcttcaatgtcacctctcttctcaatctgcgaaaaaagagccgcgacgagttgcgggtttggctcccatttctccaagcttgacaatgctttcttaaggcattccataactttggccgtcctctcgtcgttgccaaggtaaccccaaacgaataactcccaagtgctatagctgggcttgactcctttctgcacaatgtattgaagaaaactctctgccttctccatgttgccattcttgatgtaaatgaaaggatggtgttttgggatccttgaatcttttgttcctgactctgactcccattcgccgtaaacgcactctgctgctgcaatatcgccaaaccttgtaagcgaagtaagcatg

SEQ ID NO: 53982 - DNA, 655 bp, Triticum aestivum
  unsure (1)..(655): unsure at all n locations
  Clone ID: PAT_TA_53982
gaaatacaagagaagcacacattcatactgtcatcttgtaatctttctacaatccagaaaaggcaccaacaaaaattcgaaaaaatgttcctgccataggattacactacggccatgaaaagaaaaatgttcctactgtgtcttgtgtatatatgtacttggctaagctatttactgttcaccaattggcgattgtgcaatgtaatcttgaagccctttgcgagcgatcatgagatgaccgtcttgagcctgtagttcttgacgatgccgctgtacacgacgaagttgagcgtgcacattgcagccatggcccagaagaagtagtcgaggtggcccttgttgaggtcgtcggagatccacccggggctgtctcccgtcgccgtgaaggcctccacgatggcgtagataaaggagctcatgtagctccccagcgcgatggtgagcagagccagcgacgtgcacatgctcttcatggtgtccggcgcctcgtcaaagaagaactccagctgcgcgatgtagcagaacacctccccgccggcaaggaagaagtactgnggcagctgccacgagatgctgatctcttcccacgcgccgcgctgtcaagccgcttcatttccacgagcgctgccaccgccatggtgagcgccatgaggag

SEQ ID NO: 53983 - DNA, 730 bp, Triticum aestivum
  unsure (1)..(730): unsure at all n locations
  Clone ID: PAT_TA_53983
cccacgcgtccgcaaagccatacccaaacatggctgctaaacatcaaaacgagggcgctgataccgcttcagaagtcaagaagcccaagcatggcttcagagttggtccagagaatttgccagacggtccttggcgaagaaaagctaccaaagccaagaaggagctgattcacaaggcaaagggcaagaaggcctatgcgaagatcaaagctcgcgaacaacaaaatgcccaacccccaaacacaacccaacctgctcaagatgacactccaccacacggcactgccaaagacaaccaaccacaaaaagaaccccanaacacacaccccacacaacaacacacacaaacaaaccaccccaaccccccaacacaccccacccccaccaccccaccaccccacaaaacccaaccacccaaaccacaacccacccaacacaaaaaacccaccccccccccccccccccacccccccccccccccccccccccccccccccccccccaaccccccccccccccccccccccccccccccccccccccccccccccccccccccccccccccccccccccccaccccccccaaaacaaaaacccaccaccccccaccccacccacccccccaccccccccccccccccaaacaaacccccccccccccacccnccccccccacacccccccccacccaaccaccaccaacccccccccccccaaacccccccccc

SEQ ID NO: 53984 - DNA, 614 bp, Triticum aestivum
  Clone ID: PAT_TA_53984
gaccccgcgtccgccccgcgtccgcccacgcgtccgcccacgcgtccgccagcgcaaatcctccagtcctcccacctcgcgcccccaacccgatccctcgtcctctccacctccgccgaaaccgtcatggcgcccaaggccgagaagaagcccgccgcggagaagaagccggtggagacggagaagaagcccaaggccgagaagcgcgtgcccggcaaggacggcggcgccgacaagaagaagaagaaggccaagaagagcgtcgagacgtacaagatctacatcttcaaggtgctcaagcaggtgcaccccgacatcggcatctcctccaaggccatgtccatcatgaactccttcatcaacgacatcttcgagaagctcgccggcgagtcggccaagctggcgcgctacaacaagaagcccaccatcacctcccgggagatccagaccgccgtgcgcctcgtcctccccggcgagctcgccaagcacgccgtctccgagggcaccaaggccgtcaccaagttcacctcctcctagattgctgccggccgtccgagtctgtttctgatggtctggcctgaatttgaacccggggtaaaacatattacaggggg

SEQ ID NO: 53985 - DNA, 713 bp, Triticum aestivum
  Clone ID: PAT_TA_53985
cccacgcgtccgagcaggtgcaccccgacatcggcatctcctccaaggccatgtccatcatgaactccttcatcaacgacatcttcgagaagctcgccggcgagtcggccaagctcgcgaggtacaacaagaagcccaccatcacctcccgggagatccagacctccgtccgcctcgtcctccccggggagctcgccaagcacgccggctccgagggcaccaaggccgccaccaagttcacctcctcctagacaggtgatgcgacagatgtagctggctgctggcgcctcctggtagaggccgctgactctgcttatgcagctgcaagcagcgggaggagcgggcgcccgcgcgccaacgactaggaggctagaaggcagcgagaactgaaagcgccaaactatccgaaaaggccaaggtccaagcacaaagcgcctccccgccgaatccggaaaaaccaaaaaaaaaagggggcgggcccgccctagagggaccccccccccccacccccccccccgccacccccaaccgccaaaacccccccaccacatgggcgggcggccgcaaggcccaaaccccacggcgcccccccccccacaaccaaaacgaccccaacaaacagaggaaaacacccccccggggggcccccccccccccaaaccacccccccccccaacccccaccccccccccccccccccccccccccccccc

SEQ ID NO: 53986 - DNA, 818 bp, Triticum aestivum
  unsure (1)..(818): unsure at all n locations
  Clone ID: PAT_TA_53986
cggacgcgtgggcacgatttgaaaatatacagttcagatgaaggacgtgttcagatgtctgctgcagcatttgcgaaaggtcttcttgatttggaaggacaactaactcccatactggtctntctagtaagtaaagactcatctatgctagatggattggaagatgctagcattgagatggatgaagctaaggctagattgcatgaaatcatcatttcaaatgctaaagcaaanaataccaatggatcggnggagtttccatggatggttgatggtgcaggattgcctncaaatgcttntgaacttnttnctaanatggncacnttgacaaaacaagntactgnacaantaaanctgnttgctgaaggcgaagatgagaaccttgcgctgacaagctcattttctaaataccaccaaacaaaaactcttgggaaaacaacaattgacgctgctcctattgcctgtgggttaaccttgggggaaaagaaaagcttccttttgatgtttgctagggggaaaaaaaactagaaaagaaaattataaaaatgaaaaaaaaaaagacccaaaanaaacaataacaacaaaataccaaaaaannatataaaatnaangacaaaatataaaaccannnnacctanaaagntaaaannaaaaatatataaagggnnanggaaaaaaaaattaaacaaaannnnnnnaaaaaaaacctnnnataaaagnnngnnnaaanaaaaaaaaaaaaaaaaagaaanaacaaccccaaaaaaaaaaaaaaaaaaaaaaaannnnnaannaaaaaaaaaaaaaaaannnnanna

SEQ ID NO: 53987 - DNA, 661 bp, Triticum aestivum
  Clone ID: PAT_TA_53987
cggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttggtcctaaaaatatgagtatgtacatgttcatgtaccaacatggctcgagaaagcatgctcgcatgagaatgctaacggagggataagtatataaacggacccccaaaaataaacaaaaaagtcagaact

SEQ ID NO: 53988 - DNA, 499 bp, Triticum aestivum
  Clone ID: PAT_TA_53988
cccacgcgtccgccacgcgtccgaggaaattgatgatccagaggctgctaagcctgaggactgggatgatgaggaggatggcgaatgggaggcacccaagatggacaaccccaagtgcgaagtggcacctggatgtggtgaatggaagaagccgatgaaggataaccctgcctacaagggcaagtggcatgcccccctgattgacaaccccaactacaagggaatctggaagccccaagaaatccccaacccagagtactttgagcttgacaagcctgactttgacccaattgccgctattggaattgagatctggacaatgcaggatggcatcctatttgacaacattcttattgccgataatgagaaggtagccacctctgtccgggagaagacatggaaacccaagtttgatgccgagaaggaaaaacagaaggctgaggaggctgcaccaggtgcatcaaaggggcctttgtggaaatccagaaggaggatcttt

SEQ ID NO: 53989 - DNA, 376 bp, Triticum aestivum
  Clone ID: PAT_TA_53989
ccgcgcatcgcagtgctgcgagcacagagaaagccggcacgcacgccgagagaacagcgaacccgcaccatgggcgaccacgtatggcagcggcgagaacaacagggaggtcggggtcctgaacaagctgacaaatgccgacttggctgcccatactgggaggagcaaagaaggctgacagcgcatgcgaacgggacctagcacaagccatacctgggggcaagacctatagcggagggactagaacaacatgctcgcctccgcggcggagacaggaagggactgctgtggcgacacacagaccactgatcaagaacctcagcatcagaggaactgcataccggatcaagcggcggctcaccgcatcgatgaaagg

SEQ ID NO: 53990 - DNA, 598 bp, Triticum aestivum
  Clone ID: PAT_TA_53990
cccacgcgtccggcgggtcgtcggcgtcggcgcggcgggaggaggaggacctggaggccatcgcggcgcgggagcagcgcgcgttccggtacgaggcgctggcggcggccacgcgcaacttctcggagaagcagaagctcgggcagggcgggttcggccccgtctacctgggccagctccccgacggccgggacgtggccgtcaagcggctgggcgccgggtccaggcagggcgcgcgggagttcaagaacgaggccaacctgctgtcccgcgtccagcaccgcaacgtcgtcaacctgctcggctactgcgcccacggcgccgacgagaagctgctcgtctacgagtacgtccccaacgagagcctcgatccagcgccgacaacctcctcgattacgcctggaagctgtacaaggaggagcgcagcatggagctgctggacccgtcggtgaagtcgtcggccgcgccggaccaggtgctcatgtgcgtccgcatcgggctgctgtgcgtgcaggcggacccgcggctgcggccggacatgaagcgcgtggtgatcatcctctccaagagcagagcacgctagaggagccgacgcggc

SEQ ID NO: 53991 - DNA, 762 bp, Triticum aestivum
  unsure (1)..(762): unsure at all n locations
  Clone ID: PAT_TA_53991
cccacgcgtccgaccttcacacggtctgcctcgccgtagctctcgtttcgctgctcatcatgattgcgggccgccggcgctggggggcgcgtggcgacggcctgcgtatggcgcctgggccgtggcagctgccggtgatcggcagcctgcaccacctcgtcctagccgggcagctccctcaccgcgcgatgcgcgacctgtcgcgacgctacgggccggccgtgctgctccagctcggccaggtgaagacgctggtggtgtcctcccgggagggggcgcgcgaggtgatgaagaaccacgacaccatgttcgccacgcggcccctcagcaccaccatgcgcgtgctctcctacggcggccaggacactcgncttcccgccctacggggagtactggcgccagctccgcaagatcgccccgaccccaactcttcacagcgcgccccgccctactcccacccccccatcccccaggaagacgccgccacaacaggccccccgcccccacaccaagcccctcccggcccccccccccccccgaagaaccccccccgccccccccccccccccccccccccccaccccccccccccccccccccccccccccccaccccccccccccccccacccccaccccccccccaccccaccccccacccacaaccccccccccccccccaaaaccaaaaaaaaccaaaaaaaaccccaccacccccccccacaaaaccaaccaaacaacaacaaaaacccccccacccccc

SEQ ID NO: 53992 - DNA, 843 bp, Triticum aestivum
  Clone ID: PAT_TA_53992
cgctgcaacaccacccacacttatataaaggcccagccgctcaagcctctcctcaagtctttctccgtgagctctcctgcatccgcacagccccggaacatttcttggtctgttggtcgatcggttccggttgccttcaccattagtacatccacctcggagctcctatggctgcgcaatcttggaaccctttctcttgctgcgtccgcggggcagccgtggacggcgacgaccactgcgagtcgcggagggggaataagggcagcccgaggtcgccgctgaagaacctgagctcggcggggacgctgccaccggaggagctgtcgctgacgctgtccggctcgaacctgcacgccttcacctacgccgagctccgagcggcgacggcgagcttctcgcgcgccaactacctcggctgcggcggcttcggcccgggctacaagggggccgccgaccacaagctccgccccgggctggccccgccacccggggccgccaaggacctcgaccctggagtgcggcccccgaggacaccaacagtggctggccagaggttttcttcccttggggcccccgcagggaccaagaacccgggggaagactgggccgggggccccgggcccgggcgaccagcccccgaacgccggggggacccaggcccacggaccccccgggggcgcggggggaagcccccccctcccaaaacggccgcaggggtcctccgccgccagggccccacccagccccgaaccacccccccccgcccggcgccgggccccggggggccccccccgcccggccgccccccccggcccccccccccccccgccgggcggcacccca

SEQ ID NO: 53993 - DNA, 396 bp, Triticum aestivum
  Clone ID: PAT_TA_53993
gaaggtcttctcccgcatcgaccacaagttcgacctgatgtacgctaagcgtgccttcgtccactggtacgcgggtgagggcatggaggagggtgagttctctgaggcccgtgaggatcttgctgccctggagaaggactatgaagaagttggcgctgagttcgacgagggcgaggacggtgatgagggtgatgagtactagagcagatgagtttgcgacctgatgtacgtcaagcgtgccttcgtctactactatcctgtgatctgcccaagcggctttatctgttgtctgcctgtttgaatgtttgctgtgtggtgtttggtttaaaaaaaaaaaacaagaagacacaacaaagaaaaaaaaaaaaaaaaaaaaacaaaaaaaaaaaaaccaaa

SEQ ID NO: 53994 - DNA, 611 bp, Triticum aestivum
  Clone ID: PAT_TA_53994
agctaattactacaacctctacgctgcttcttcttgctctccggcagcaaagctagctacctccacttcattgatcaagccacacagtcttgctcctaaaaaatgggcagcttggacaccaacccaacgaccttctccgccttccccaacgacaaggcggcagcgttcgagccgctaaacccggaagatgttcgtgcatacctccacaaggccgtcgacttcatctccgactactacaccaatgtcgagtccatgcccgttcttcctaacgtgaagccgggatacctgcaggacgagctcagcgcgtccccgccgacctactcggcgccgttcgatgtcaccatgaaggagcttaggacctccgttgtccccggcatgacgcattgggccagccctaacttcttcgccttcttcccctccaccaacagcgccgctgctatcgctggcgacctcatcgcctccaccatgaacaccgtcgggttcacgtggcaggcctctccggcggccaccgagatggaggttctcgcgctcgactggcttgcacagctccttcgcctccccaccaccttcatgaaccgcaccagcaccggtcggggcaccggggggggggg

SEQ ID NO: 53995 - DNA, 571 bp, Triticum aestivum
  unsure (1)..(571): unsure at all n locations
  Clone ID: PAT_TA_53995
ctcaaataatcatctggccttgaattgatgtgattatagcggccgtttggtatcaaacttgtgtgtcaacttttgtctaacccaataacaaatctctcgaacgccctctcattctctttcatgcgcaagccaaaccaaatcagaccaaaccatgccgctcggtctctttacttcttctcagcgaccatctttctgaccttgtcgagcagtaacgaactctccctgccaagtttcttgttgccattgcgatcccgagtcttggccatggccttcttgtagcggtctctgtcggccatcttttgctcgcgctcttcgcgtctgcgctgaaactcagcttgccgcgcctcttgttcctggcgaagttgtgccgccttgccaagttgcttttcgtagtagccaggtcgtcgagtgcgccgtctgttgccatcactactgggctcaccgactgaattctcttgggcctttgcctcgtctgccaacatgagatgtcgcgtggggtgcatcttctcgccctcctcttctggttgcttgncctcgccagcgccctctactggagtctcatcctgagcag

SEQ ID NO: 53996 - DNA, 694 bp, Triticum aestivum
  Clone ID: PAT_TA_53996
ggagctaacaccacataaaaacattcccccagcctgattttgtgtgctatgcaaggtcgagcgtgagccttggagttacttcttaatcaacgatgatgatagaagctcccaagtcccaagcacgacgaccgtgaaccaaccagttagctaatcctcctgatcaagaaaagggtaatcggtgtagccaacaacagggtcggatgtgtagaacgtgctcctgtcatacttattcagagcggcgttccttttgaacctctccggcaagtcggggttggccaggaagagccgcccgtacgccacaagatcggcgtagccatcggcgacggccttgtccccttcctcccggtcgtacgccccgttcaccatgaaggtgccgctgaacgccctcctgaacggcagcaggcggcgcgggatcatccgctcgttgacgcacatccgcggctcgatcatgtggcagtagaggacgccgagcccgttcatgacgccgatcacgtgcagcgcgagcgcctccgggtcggagtccacgcagtcgacgtagtcggcgaacggggagaggcgcacgccaacgcggcccgcgccggcctcgtggcacacggccgcgatgacctccgcggcgaagcggcagcggttctctaggccgccgccgtactcgtcggtccggtcgttgacgccgtccttcatgaactggtcgatc

SEQ ID NO: 53997 - DNA, 165 bp, Triticum aestivum
  unsure (1)..(165): unsure at all n locations
  Clone ID: PAT_TA_53997
gcttagaccttcctccgtccggaatcgagtccgctgaatccgcggccgatctcatttaagaggcaagaacatcacaaattgaagnaaatcacatgggatgcttacagttattgagtgtgttcgaggctttcaattgttgaatcgatggaggctggcgctgcgttc

SEQ ID NO: 53998 - DNA, 532 bp, Triticum aestivum
  Clone ID: PAT_TA_53998
aacttcataaaaaaccgacacatctataatggtttagattccattttaacagaacacgcaagatctcttctctaccttccttatgatctccgagtacaaaacctatctaggtgatgatccaaactcagaatactctcagactgtacaaagttagacaagcgccattcttatatagatactggacaccaaatgacaatgtacacgaaccatccactccatacaatataagccttagatcatttaagacctaacgatcagagtcatacgactccctgcatgttattacccatcgccgttggctgggcttctgctgaattttaataaactctcaataaccgacagattagacaatgatgatgaagaccacacaaaacgatgttcatgatggcacagcgcttccaattgcacttgacgttgtacaccaggtcaggcttgcacgaatgagaggcacttcagagagccccgacatttgatcacgatcttcaatggatctccgacgatttaccagtcccgccccattagataatgcaca

SEQ ID NO: 53999 - DNA, 631 bp, Triticum aestivum
  Clone ID: PAT_TA_53999
gaacaacaaacttggccaaaatctgaaccaaacttttgtatgtttgccactattttgaagagaagaaagaaacaccatccacaatttctaaacaaacgatgtgataccgcatcacatctcaatagtatgtacatatacatacttctatctacaatcatgcgcacttcccctaccatactcttaacttttaagcccctctttcccgggggtaactcaacgtcctctgttgtcgccgcaacgcaccggtgaacccggcaacctgtctgttgtctccatggatcacaatgtcaccgtggatcgctgattcggggtacttatgtcggtgcctatcctgatggttctggtgatggctttggtgcttctcctcagtctccaccttcatgtccatcaccttgtcatcctcgacaacgatggtgagcacgaacggtcccgctggaaaaaagtcatccatgtcgagtacaggctccaatgccttgacgacctcacgcatggatggtcgggacttggggttttggctcaaacacttgtatgtcaccagcgcagccacttcagcacccttgcacgagtactgacactcgagggctgagtcgatcacctggtgcagtttgtccgaccgtttgagatagggcct

SEQ ID NO: 54000 - DNA, 206 bp, Triticum aestivum
  unsure (1)..(206): unsure at all n locations
  Clone ID: PAT_TA_54000
gggggggggcgnnnngaagcnngagaaancncggggggcaannnannannaaaccagagcanaggaaggcccannncagnacaagancnagacaggancgcaagcacaagccngaacanncaacacgaggagacancacaagaacacacacncggacaggcgcggggggggggaaacacaccncggcnnannncgcgacgaacgag

SEQ ID NO: 54001 - DNA, 380 bp, Triticum aestivum
  Clone ID: PAT_TA_54001
aaaaaagaaacatggccccctttgggcaaggggaatcgcatatccgagttttaaacaagacttaccccccggggacattcatttaaatcacccatgaaatgagactgggagcaagctgctaaatgaccccgggtttttgtttcaggaaagaccctttgattatgtttgacccgccaaggggtcaatcaggagccgggagccctaaggcccctttgcctggggtcccccccccccccccagagtaggaacgtttgccttcacatccagaaaagcagcgatctggaaaagcagggggaaatcaaaaatccccttgacaaaagggaaatgcttggcaccatccatggggctcctgaaagcgtttgccggcaaaagaattcccc

SEQ ID NO: 54002 - DNA, 577 bp, Triticum aestivum
  Clone ID: PAT_TA_54002
cacaaaaccccttagttgataattcattagccaagaggaagcagggggtttcccctttgattccgattacatcaggggcccaggatacaaagggaaacagtttttacatttaaccacactggaaccataagcccaccgcactactacaatttaggccttgggggccttttggggggactggggggcctttttgggcaactgggggggggttttttcggccttttaaggggtttttttggggagcacccccgggttgatgttggggataacccccccgggggcaatggggaccccggacaaaaccctcccgagctcctggtcgttgcggatggccaaaaaaaggggcctgggcacaatgcgggtttttttgttgcccttgggggggttcccggccagttccaaaacctggggggggaggtactcaaggacgggggcaaggtaaacgggggccccggaccccaccccctgggcgtaacggccctttttgaggaagcccccaatgcggccaacgggaaactggaggccggccttgacggacctggtcaccaactttttcctcgggcccccgaattttttc

SEQ ID NO: 54003 - DNA, 675 bp, Triticum aestivum
  Clone ID: PAT_TA_54003
gtgcaaagtaataataatccaaatcatagcaaaaaaaagataaacacaaaagaataattataccccaaatataggggtttgtgtggcttctggaatgattcacttaatccatgatactgctagtagtcttcttgatgaggtcccaggcactcctcacatgcctctcctcctgcagggacgaccccacggcgaaccgaagcacgaacctatcaccaaccaccgtgtgtgcaagataagccttaccggtcttgttcagattctccattagcacacggttagcctcatcggcatcctcctccgtcatggctccagtcgccttgatcctgaagcacacaagagcaaagttccttggtacgaccacctcgaacctgtcgtcggcacgaacaaaatcttcaaacatcttggccatggcgacgtcgctacggatatgctcttggagctttgcggtaccataggtgcgcatgaccatccagagcttgagcccacggaagcgccgaccgacgccgacttgcatgtccttaagatcggtgacctcgcctgactctgtagcatcgttcttgaggtactctgggttggtctccagcgagtcgctgaggcggtgagcatcacggacgtagagacaggtgcaatcgagacatgtgagaagccatttgtgtgggctcatgcttatggagt

SEQ ID NO: 54004 - DNA, 738 bp, Triticum aestivum
  unsure (1)..(738): unsure at all n locations
  Clone ID: PAT_TA_54004
gcgtccgcccacgcgtccggctcgcaggctgcggcaatggcggcgacactgcagttcatcagcctgctcggcacctcctccgcccatccagccccttcctgcagcagcagcaacgagaagcagcaccgctctgtccacctgccgcagcagcagcaggggaggaggctccgcgccgtccgcgccgtcgagacgggcgccgagcctgccaccgccgactctgagacgacggtggagccgccgtccgtcgactttgcgttcgtcagccctcggttgctgccggacgggacgccggacgtgcactaccggacggcgtgcggcgggcagaagctcagggacatcatgctccaaggttacatcgacctctacgggccttacgataaattgctgctcaactgctcgggaggcggcgagtgcgggacttgcatcgnggaggtagntgaaggcggcgaaatgctttctccgaaaaacgaagtaaaaaaggaaaagctcaaaaggaaacccaagtcatggaggctggcgtgccaggccacggttggcaacccagattcaacaggacagatggacatacaacagctaccagagtggaaggtacacaagtgggacaagtgactggcgtttaacattatgatgattatgcagtaaaccttatgagatatgacccatgaaagtataaagcaaagaacaacacttaggacaaaagaagaaaaactaaaggctagacttgcttagaaaccttaa

SEQ ID NO: 54005 - DNA, 134 bp, Triticum aestivum
  Clone ID: PAT_TA_54005
agggcttgtggatctggtgaccgctactaggctctggcacggtgcttacagtaaaacgagagaggtgccagatcccatcatatatcccgaagagctacattcatacgtgcaacgccacatccgtgcatctggat

SEQ ID NO: 54006 - DNA, 568 bp, Triticum aestivum
  unsure (1)..(568): unsure at all n locations
  Clone ID: PAT_TA_54006
acccacgcgnccgcccacgcgnccggnncaaaaaggagaaaagnggnagaacngaancgncganggagcgaaagaaaaagcangcagaacctaaaagcaangctncgactgaccatcctncgaancccaagncagcgagcgcggaacacccacggagaagaagctngccatngccggaagatgngcagaccaagaaaanntncgntataatgcagctcgacgagaccaagtcggnagccctaccagagctgaaagtcaaatccccccaaacccctgccgctgtngttgagaaaaacaaggcggcggataaagtanaaaaagaggagccacgtgttggacctaaagcacatgctacttcacaaagtaaagatggaaagaaatattccaatggtaaagtttcaaggntaagacaaaatgataacaatgtgntggttgaaaagaccntanagatgnttgaaaacaaagtggattataaaactactgttgatctacctcctggaagaagtgcaaagagaaaaactanaaaaaaagaccgaatgnactattccaatctggaacaggagtatgt

SEQ ID NO: 54007 - DNA, 291 bp, Triticum aestivum
  unsure (1)..(291): unsure at all n locations
  Clone ID: PAT_TA_54007
cacgcgaccgcaccgaggagngagaagcaggcggagcagcaacagagggccacaacaccctccctggcaggccgaacgccnccaagcccccccactnccagcgccgcccctcgccggcgccaacggacccgagcccgccggagccccccgaccagcgccgccggccctgccgaggggcgaacgccaccgggccccggcgcgagcgcagacagggcggggctcaccaccaccaccaccagcaaaagccgggaaaggaacgagagccagcaaaccaaaaaaacgacaccaagc

SEQ ID NO: 54008 - DNA, 715 bp, Triticum aestivum
  Clone ID: PAT_TA_54008
cggacgcgtgggcgtggatcaaccaccacacaacccacgaccccctccccagatccaggcggagctgctgcgctcgttggaggaagccggcgccgcacagagactcgcggaccggacggcgagcttggccattcccatggcgcaccggccgcccccaaggtcgtcggccaccttgacaagtcacacacaccgtccacctcgacaaatctcagcgcgccgccccactaccctccgcagcctagctccaccgaccgcacctgcacgagcgagcaccgtttgtcctcagggagctcgacgtcctcgatccgccgccctgctcccttcggcagagctgggatagggttcttcccgggctcaggctccctccatgtgcctgtgccactaggcttgcttttattttaagcacacaaactaagcttgcgagtagtctttcaagttgaactgcccacgccgttcgactctgatttgttaattgcttaagtagttagttattaatcccttgctagatatgtctgtacatgtatgaggttttgggggcttcaattgaagatataatggatttcctcttgaaaaggaaatgtgtgagagaccttgattatttaggcatttagccttcaattccctttcttggccctggtggttggttttgggagtattttagcataggcgattcacctaaaattttttatttcacgggaacactaatgtgctttta

SEQ ID NO: 54009 - DNA, 200 bp, Triticum aestivum
  unsure (1)..(200): unsure at all n locations
  Clone ID: PAT_TA_54009
gacgacgcccccccgcggcgacgccgtcctggccaccgcggaacagggcggacgaccccagcctgcacaacccgctgctgcgtctcgagcggatgggctgtggctgggtcggcgtcatcttcgagtgggagggcgtggtggtggaggacgacncgcggnnggagcggcaggcggggcggggcgcgaacccgagaccagag

SEQ ID NO: 54010 - DNA, 549 bp, Triticum aestivum
  Clone ID: PAT_TA_54010
gggttttgttttttttttttaatttttttttttggggttttttttttttttttttttttttttttttttaaaaaacgcaaacgggggattatataaaaagaagtataaagggcctatggcccggtatcgaaaaaaaccagaccttttattagggaaggggggggagcatatggggcaaaaatgggcaaaaaaaaaactttggggggtcacttgggaggatcaaaaaactgaaaaaaggcatttcgtttactccctcgaaaagggggatgccccattggacttagctatgggggattttcctaaccctttaaaaaaggggtacgggagttccaaaaagctcaacgatctccttttttaaaagggggatgaaaattactccaggccgcctataaaaccaactgggtgggggtggatcccaggcaaatctagcagggccactcacaggggaaaaaagccaaatttgtctgtttggggtttgcttgtttacaacaaagggccccaaaacgcctagcctcaatgggagaacttggttcccggaatctatgggga

SEQ ID NO: 54011 - DNA, 426 bp, Triticum aestivum
  Clone ID: PAT_TA_54011
ccacaaacagaatcatccgagaacagattgaatcgttcgatctacaggatcatgtcccatgtggcattggggctttaacattcctgaacaacaaagcaggaagaaagacactaaacagctcgtgaggttgggagagcagcgagcccctcatgtcgataagctgccgccgccttgctgccagaggttgttgatgtcagtggcctggttgagaaggatgatcatttgcttctgcgagatccattctttctcctccagtttcgctctcagttcctcccatgcttctttccggggccggaagttgtccgggcttaaggggatgcttccaacccccggacccttctggtcaagcgctttgccggtgttcttgtccttccttgtgaactttgggcccagctttgggtcctgcttttctggccccttcccctt

SEQ ID NO: 54012 - DNA, 525 bp, Triticum aestivum
  Clone ID: PAT_TA_54012
gaaactgcattttagtcccttatttctcattctcctccatctccatctccatctccatctccatgggtgggttcacccaacaatccgactaacgaccaaagcacacaggcaggcaggcaggggataaacaaccatcaagattggttttacagagcatcaaggttctactcaacacaaccgggggagccagaggtgagacccctaatacaggtcgccctccttgtgggtgtggatgacgcagtccgacttggggtaggcgacgcacgtcagcacgtagccctcctcctgctgcgcgtcgtccaggaacgacccgtccgactggtcaccagcttcaccttgtacgtggccgccgctgagacatccagcttcttctttgaggaggacctcaggctcggcagctgcagcgcgcctcggccaaggaagctcacacggctcttgagcgctttctgggggacatcggttgtccgagcattgcccaagagcacgcaggaggtcacaaacgtacaggttggcatgttggaacct

SEQ ID NO: 54013 - DNA, 247 bp, Triticum aestivum
  Clone ID: PAT_TA_54013
ggaacaaccagggaaatctctctcattccattcagcaccatgacattgacatcaagtcaccatgcgtttttacatcgggtcctctcctactttacactaggctcagatgcacatttactctactccccgggctgaacaatgttggccgggtcacccgggtttggtggagaaaagaatcaactggcaaaacacaagagatgctgggtggcagctgtgtgttcaagggtcgtccttttttccagcccgc

SEQ ID NO: 54014 - DNA, 329 bp, Triticum aestivum
  Clone ID: PAT_TA_54014
aggcgacagattggttaaatatattatgggcatgggcatatacatagccaccggttggattcaaatacgagcatgctttttcgaaacatgtggggacatgaacatgggcatacacatatttttaggaacaaacaagaaagataaatggggaaggaaaacccaaagcaatggcagagttgacaaaaccggaatggcactttatatggggcccggggggagggagctgtttaagccttgccggactccttgaaacccgggggcttgaaggggataaaactgacccactgcacctggggcatgttaggaaatcccatgatgcggacataccc

SEQ ID NO: 54015 - DNA, 535 bp, Triticum aestivum
  Clone ID: PAT_TA_54015
cgatcaatccacatcaagtttgatatagatagtgtacttttcatacaggaaaagaaagtcacaacagcagtgtgagacaaagaacctatatagttccacaaaagcatatttttggatacatacacctgatcgtcttgacgttcggcgttttatacgccacatcacatgaacctgctatgagtagtttgttttgtcacttgaaacagataacattttccccattgacaacagagttatgaaccttgaaacaaacttttcaaagtttgtattatcaatgatggctacctacacgtggtgtcgagaccgaagacacataagagatttctttcaacctttgaccaaccccatagttattgtcgctcttccgtccacaccattcatcagacggacttgccccatggcacatgcatgaccctgccaacacgacacaatgcaggtgacttgccccatggcgcatgcatgaccctgcttgtcatgaaaccatgttgtgctgacgggaaggcagcgcgctgggggggggggtgtggggtgtggc

SEQ ID NO: 54016 - DNA, 732 bp, Triticum aestivum
  Clone ID: PAT_TA_54016
gcctcacatacagatgtgttctgcaaaacctcacatatttgatggctgatatgctaccaatagattccaaatttagcaccttcagactgcaaaatatggctggcagcctgttcctgtggctactacagagcgaatatggtgttgctacgctaccctgacgctctgttcagtacgttgtaaaggcaaaagcaaaataagcttgtattcggcctaacaactgtactatttgcatccgtaactcgataatcccgtgagcaaacataactgggacagggcatgtcattagcacattcgcagaataatgagaccccgtattgtctttgcctgattttcatcatgattatcgtcctagtaccaatcaaaaacatccagatccaggccatcatcagcattcccagcaacatgctccacctctctgacctcagattggcgcgcgctcagctctttagctgaccaatttgaatcattctcttcctccatgaaatcctgcaacgcatgctcatttccagtgtctccttcaattgatgcaaccacttgtttatgtgtactgttgatgtccctctgcagatcttcaatgttgagctgtttgattacttgctttaaatacaaattatctcttgagcgatgaagtatagcatcgtggacttgcattggatgctttttctcctcggttttaaacttctgccgcacctgatcacgggacttatcagggaataactgctgtatcattgc

SEQ ID NO: 54017 - DNA, 361 bp, Triticum aestivum
  Clone ID: PAT_TA_54017
agggttagaaacttcagtcctttattggcattttggcttatactgcagcaacaatcaatatacaaaaaataatattctcaggccattagttaagactgctcagctaattttcagacacagactgaatcaattcctccaaattgttgtacgacgactccccttccttcaaagaagtgtttgctttcactttacatgccagagccttcctcctcgtgtcctccgcttcgacccctccgtccatcagcttctccagagcgctgttgacttgctccgccccaacctccgccttcgcctctccgctgccatgcttgccagcggtcaggacgttcgccgttggctttgtcacgccgacggatacccc

SEQ ID NO: 54018 - DNA, 528 bp, Triticum aestivum
  Clone ID: PAT_TA_54018
gaaaagatagattatcgtcatcatgacatttcataacctctaattcatcttgtacaacatgaacatgacatgaactcattgtcccggccccaattcccagacccgaaccagcccgtgccacacgaccctgctccctactccgacaaagcctagagtccgccgctttatgtacagtccggccatcaaggcgtagtaaatcccttgactcattaccaccagaacccttttcaaacgcccaaatagcctttctaccagcctcccagaggacagcagcgcctactccgtcgtccccttcaatgccgcgcgcagactaaccatctcgcgcttgagtcgcgcgttctccttcttcattcgtgctgtctcgtcgctttgatcgcgcagccgaaccatcagttcttccttttcctctttgcccttgcccttgagagccttgacaattgtgccgagctccccggggaacttgtcgggcagtaattcggtctctgctgctggctctttgggtagggggtcgattgctgggaccttggc

SEQ ID NO: 54019 - DNA, 459 bp, Triticum aestivum
  Clone ID: PAT_TA_54019
gggggcaaactcaaaacgaacaactttttattaagaagagaatacatgtagtttcaggggggcaaccaaagaatttacaccatattcagataggtggcttaactgaacccagattcttcgggaacagccgaatcaaggagacggtcgtaaaggggagaagaatatcggggggtcacaaggcattcaggagagcgtgtcttgacaccgcttgctggaaccgattcgttgccatctcagttgtcggcataacaccttctaaaaccaaccatgcttataccgggggggggggcctgctaacaagcctgcaactccatgggttacttctcgacaaacgattcgactgtcttgagccaccggagcatctacatcttgtgcttgttcgccacgtgggcgggcaagaactgcggaagctcggcgggcacctggctgtggtgcgggaactggttgaccggctgcctc

SEQ ID NO: 54020 - DNA, 743 bp, Triticum aestivum
  Clone ID: PAT_TA_54020
cattcgaaggtgaagaatctgggcagctaactggtttgcatctagcttctgagcattaactgaaggtgccatctttgaagtatcctcatgggacttttcctcgtcatactcagcagtttccataagatgtcagaagaccgtgatcaaggatcttttccataagtgcctgactgtcagaagacatatcatgtctactccttttccacggcatggagtcaagctgaggttttctaattagatgatgccaagaggaagcatcctggccaccactgcccccacttcggttgccctccttagaatgcatgtaagcacctgaagtgccagctgtagatgctgctgtatctaagctgcctaaagagcccaatctcccttcaacaacttgctcctgacaaacatcaactcttccccatggggtattcttccatggaagttacgtcacctacataaagacagtcttccgaacattagattatagcaaactagaagccaagagtgtagctaccttatataatacccaaccttgagacaaactggacaggaaaaattgaatgaaaatgaaataaaaacaggaataaaactgcacacttcgattgatagggataatgtggatattcaatctcaacagaaaagcaaagtattcccacttaatttccaacttatgtttcactctgatcagacagggtagtaaagcattatgttcctgaataaaaatttagtgtatcgctatcaaaatacccaaaaca

SEQ ID NO: 54021 - DNA, 509 bp, Triticum aestivum
  Clone ID: PAT_TA_54021
aaaaaaattcaacaaaaatgggccttttcggaaacaaacctggccaggggggccttttagcatttcagggggggccaattagacccttcagtcccttcccagttcttcctctggaactgcttaacccttgcccctggcgggccctggtgccaaggccccctaaaagtaaaaaaccccccacacccaaacatgattggtcactggccaaccccataaaccaaacgggggagcccccaaaggctctcaagcggattgcttttgccttctaaaagggttgaaccccagcgagttatactggaaactgcctgaccaagctttacagaaatccaagggtcatcaaagtctttggacccccttggaacaaaaatgcagttcctctttcccccccatttttcagggttcatgcaaaaaaaaggagggctcttcctatcaagggtgataaaaagggcccagttttccaacttctccatctttggccacttagctgggtcgggtgaaaaacaaagcgg

SEQ ID NO: 54022 - DNA, 657 bp, Triticum aestivum
  Clone ID: PAT_TA_54022
gcaaccgaccaaacatactattagtgcgtttaactgactcgatacagaaataaccaaaaactcaatggtgtaaacaacaggcaaatacgaaaagtggaaagacaaagactgacacttatagaacactcatcaaagacactcggtagtagggtggtagggaatcgcagtactgcctctcactccttatcggcagattcggcgctctggagccactccacgaccggtttggcgttcttcacgacctgggagttcttgccggcagcaacagcttcattgtaccactggacaatggtttcttcctcgaggacgtctccatcatagagggccttcaggacgacggggacttccttcagggcttcagcactgcacttgccacagaacgcctctatagcctggagcaggagcatctgggacccttcatcaggcaccgcagtggaaaggtacttcttgttcttcaccacttacttcgcaaaccccttgcccacgccatggaagagtgcctcgaagagagcatgcatcacgtccttggggggtagggccgatgaggagaggacacccttgagctgagctgcggtggcagcattgcccaagttggccttgatctcttcaaccagttcatcgtaaggagtggtcttgggcccagtctggttgccattg

SEQ ID NO: 54023 - DNA, 332 bp, Triticum aestivum
  unsure (1)..(332): unsure at all n locations
  Clone ID: PAT_TA_54023
gctggttatgcatgagctgtggaagcaaaggtgtgtgtcggctggagctgatttacggggctgtcatttggatggtaccaaactataataatacagactcccactcaaaatttcactgcaccaaaggctctcgtcaggatggcaaacctagggagttcaggcaccatgaaacataacttcctttgccatcggagagaaagaagacggtaggcgcgctcaggagatgacgcagcaacaaccgtcnagcggaggttgtgtttggaggcgaccaggagagggtggagatcccacagctcgcgggcgaacgataagaccggacgacgagggaagcg

SEQ ID NO: 54024 - DNA, 643 bp, Triticum aestivum
  Clone ID: PAT_TA_54024
cacgcctcgcccatttcttctcccaactgggcatctggccgcgagggtgtgcgaggagtgggagcccaggaggaggaggactggaggagggagagtgctcgccgttgcgcgaattgcgtggacttttgcaactagtactgtaattctgtaaagttgtgaagaaatgctacttgagttgtatacccagtaactcaatcatgtcagactgcgccaggaatagattcaatgaggaagaagacttccaagttgttttgggcaaaggaaatcctggagagtcatcttgccagcaacataccaagtggatggcacactggaccagagcaagcagcagtccatatggcaagagctgtagtcctttggaggatgccaacaatagcaattgcacaaaaaattctgagacttcaccttttgagcttaggaaattcaccgtggctgaaaggctaatgttgggaagaaaccatgaaggaatttcaatgaagaatgtgccgcgattagaccctaacatgtgggggcgtggcgcatgatgcttggcaagaagctgaacagaccaaaattgaatggcgagatgggcattttcaaagctgttagatccagatgcagaaagatgaaaattttttgccaaagagggtagtataagaaacac

SEQ ID NO: 54025 - DNA, 510 bp, Triticum aestivum
  unsure (1)..(510): unsure at all n locations
  Clone ID: PAT_TA_54025
cggggccggnaaaaccgggnncgacccacgcgnccganccacgaaagaaccgnncgancaagagagagccaaaggaggaagaagcggnnncgccgccccaagcgcaagannaagaaagagagggccaganccaaanaaacgcanngnannaaaaccagacnngacacaaaaaaaaagaagaaacgaacaagaacgccaaaacgaaaccaagaccgaagcagggcacaagccagacaggcgccaaagggaacaaccgcaacgcaaagagcagggaaaagacaaagggaaaaacaacaaggaggaagaaccccacacaagagcggnngaagnggaacacaaagaaaannanggnggaagggaaaaaaacaannaaaaggnnaggaacaaggcggggnnaggagagagcagnaacaaaaganaaccaacacaaagaaacacaacaacaaacaaaggaaaaagaaaaacagaaaaaacccngagccaaaaaaaaaaaaaagaaaggaaaagggc

SEQ ID NO: 54026 - DNA, 253 bp, Triticum aestivum
  unsure (1)..(253): unsure at all n locations
  Clone ID: PAT_TA_54026
gcgcaggccgccagggnaaagagagagaaaaaaaacaccagnncgacggnagggnnncgggggcagcgaaggcgacggaggcccggaagaaggggacggncaagcggaacaacgacaccaaggggaacggcaacaacacccccgccgacggnagcgaggaccacaacgagcaccagaccnccagcaaggccgacggngnncacacgcagaacaagggcaaagagganggaggaggcggcncggagggcgacga

SEQ ID NO: 54027 - DNA, 218 bp, Triticum aestivum
  unsure (1)..(218): unsure at all n locations
  Clone ID: PAT_TA_54027
gacgacanagcnnnnnnataggggcaccgaaanncaagacaggggccgaagaaaaacaacgccgngacagggaaaacccaggcgnaacccaacaaaagcgccgggcagcacaagccccgagcgccagcaggcgaaaaagaaaaaaggcccgcaccgaacgcccnacccaacaggggcgcagccagaacggcgaaggggaagggcaaagaagcggagca

SEQ ID NO: 54028 - DNA, 418 bp, Triticum aestivum
  Clone ID: PAT_TA_54028
gggaaaaaaaaccagccccgccttttttttttcgttttaaagggggaattggaaaattgggggggcctttttccgattttacccggcccccccaaaaaaaaagggggggggaaaacttggggggtaaaaaaaggggggggggaaaaaaaaattacagccgaaatttccctcccccaaaaggtttaaagctcgcaaccccggggattttttttccggccaaaagggtgttgatgtcgaggggccccccatttgaaaaaaaggggtccaaaacgaaaaacccctttttttcttaaaaaatacccaaaattcctttggcccccaaaatttttggggccaaaaaaaccccccccctggggttgggggaggtccatgccttgcccaaaaaaggggggggggggggtattttcgcccgcccaaa

SEQ ID NO: 54029 - DNA, 255 bp, Triticum aestivum
  unsure (1)..(255): unsure at all n locations
  Clone ID: PAT_TA_54029
acagagaaacccaggttgctttattaacaggtagtatagtatatatagttgtagatagatatagatatagatatgtataatctctactattaaagggggatcgaacgtcgtgatggttcgacctcgttcgatccccctcccttcgaactcccacacgcacgcaggagcccaccaacatagcccacgtncgaaaaaacaccaactcagcgcccgcaaanaaaattacaacaacttagcccacgtnggagatccaca

SEQ ID NO: 54030 - DNA, 663 bp, Triticum aestivum
  Clone ID: PAT_TA_54030
ttttttttttttttttttttttttttttttttttttttttttttttttttttttttttttttttttttttttttttttttttttttttttttttgggccaagggaggaagatgcaaaaaagccggtgggggcctttgagaaaaaaaaaaaaggggggggggcagcaatacacaagagcaacatcaggggggggaacgaaaatgtttggggggtcttggacacgttaaaattcttatgagctctccggggcctcgggagattccggggcctgctcctttttcttgggtgcctttggctcggcggggttcttggccgaggggggcttgaacaggttgctttaactgcccctctccttgaacaactgccaaaaggggttctgggagtataggatccccttaagggggggccaggatgcggccctaaagatgcaccccccgggagcccacttgaaacagggcttgggggagggctccccctccaagggcattttttccaagggggacacagtttttttggaggcagcacacttgtcctgagttccaaaaaacacaaagccatacttgggggggaccttaaactggtaattatttgcctttgggcatggggggaaattttttttgaagctggctggttccttgaaaagctggtaaaaatgaggcttgc

SEQ ID NO: 54031 - DNA, 288 bp, Triticum aestivum
  unsure (1)..(288): unsure at all n locations
  Clone ID: PAT_TA_54031
cttggaacaaagttctgtacttgtgtggctacaatattctcgccaggtgaatctcaacatgcatgacatttcaacttgaactgaaattattatttttgcaaggtacccacagcaccatgtctgtacaagcatatgaacttatgggggggggggggaacgtgatgtcattgcatacagaagttgcatctatcctgtgtccggggccntgtggcggttatgaccacccgggagaacctgggctcgctgggggtgggccgggcgtgggggggggtggggggggtgggggtg

SEQ ID NO: 54032 - DNA, 370 bp, Triticum aestivum
  Clone ID: PAT_TA_54032
gggggggggggtaaaaaaagagggcaatcagggttaaacgggggaagctccaacaatggaaagaagggggggaacaaaagaccacggaaaatttagccaaaaccaaagagaaaaccaacctgcggggcgggaaaagaaaaaaagccgcaaacccctcattgttcttgaaaaaaaaaagcattttgggcgaaaccagcggggcgtaaaaaatgaaaaactttttgggggaaacccaaaacaaaaaacctttcgggtttttgggggtagccgaaggggctaaaccggtcgcacccggacaccctttgggccacaacggaattggggaaaaaacaccctcggacggggcaaaaatttactggggggtttttgg

SEQ ID NO: 54033 - DNA, 590 bp, Triticum aestivum
  Clone ID: PAT_TA_54033
caccacacatgtatatgtattggcctttggccctcagtaatgttagttgccattcatccaacaatatgcaagtgcagcactgataccttttgcatcaaagatgaatcggtgcctgctgaggactttgacacatgttgtgaatctccatgcattgttttagctttaggtgagaattggttctgggctccaaataaaggactgcaagaagacagcaaatctatcgggtacgtactttgtgatttggaagggattgtcagcatttcaaataaacagggaccgttttgttcaacaaaatctgtaaatctgtccactggttgtctttcacgggtcactgcgccacccttactatttgttgccagtatgcttgcagctggatcagggaacatgcaggagtccgttacattcgctgcatattccattctgtgggtattcagatcatggtgcttatcagatatcaaatgacttgcaacataaaaatcctcatcatcctgcttgctgttcataaagtaattgattgctttggtctcgtattctttaccaagtactggcgtcgaaagcatgactcctgcagcaacttcatgttttctgag

SEQ ID NO: 54034 - DNA, 514 bp, Triticum aestivum
  Clone ID: PAT_TA_54034
ggcaatagaaagtaatacatttcaattcctcgtgtcggttttgacggccagaactgcgaggctaacttattcaatcgtattacaactgcatgcatgcgagcttaaccagaagcttatatacaagtctcgtgctgtgaactagtattaaatttcgctagcgtagcatgcagatcggattatgtattgatcatcttgggcaggctcttaggaggcctggaaagacccaccggcgaacctggacttgagaagttcgaccaccccggcgtccacccggagagccctagtgagcaccggcgtggggatgggcgggtcggagccgaagagcgtgagcggcacgaagacgatgccggggttctggctgttgaaggagacaaacatggtggccacagtgtcgccggtgttgaactggaagtgcatgaggccgcgcgggatgaggaagttctcgccggcgcgcaccaccctggagtggagcctgtggccggactgggggctggcggtgatgcccacggggggc

SEQ ID NO: 54035 - DNA, 633 bp, Triticum aestivum
  Clone ID: PAT_TA_54035
ggacatcatacgaaatactttccaggatcagtacaggatttgctttgcagcaaagatacaattgggacaataatttattagcaaaaacgtgtgaagctttacaaattttaaaaaccaaggcaagaagacactttcagggatatcattcacctttttatatcttcatgtaatgactaattttttggacttctctaaaatatacatttgaaagattgccctttgtaaatattacaaaaccaaataattttacgtgtagggctaaaaatgactttgagagtacttcgccgtagtaattcccatggagcaattgtcgggcactgaaaaacaaccacactgtcacaccaataatgccatacgctgcagctcgaaccacgcaacacaacaatcctaagcttggacactatatgcaaggcaacaatgaagtacaacacaatggaaaatatgtgtccaacggagttccttaacaagatgaccttcccaggaattccaaaccacgagcttaaactgaaggtaggtttgccggtgatgctcctaaaatcattatgtcaccaagcgactcgaagtggcccttcgtgcacatgtccaggtctcggcaaaaaatggccaccagcatgatatccttcaagctttggc

SEQ ID NO: 54036 - DNA, 387 bp, Triticum aestivum
  Clone ID: PAT_TA_54036
gggggggcaccggaccaaaccggcccaacccaaaagcccctttcccaaagggcccaaagggttcaaccccttccaaaccaccggaaaccaaggggccccaaccacttttggcaaaaccgccctttttttttgaccaaaaccccaaaaaaggttttaaaaacaaaaaaccacctgcaacccaaaaccaaaccttttaccaaaacaatgggccccccgggcccccccttattcaagaaaattaaccccccccccgggaagcccgggggccttaaggaaaaaattccccaccccccccggaatttcccccctaaagccccccctaaaagggggcccaacaaaatcccagggccccccagtaaaaaaaaagcccccaaaattcccaacccc

SEQ ID NO: 54037 - DNA, 277 bp, Triticum aestivum
  unsure (1)..(277): unsure at all n locations
  Clone ID: PAT_TA_54037
agcggcggggtggtgcccactgcgaggggctcggtgcgggcgagcgggcgacggcgtangcggcgggggcggcggcggcggtggtggtgaaggcctctctgggcttttttttatgcatnnanntnctccttgtgggggggggggtcaattttttttttcccacncannnnctccaaaacngggagggagccaccttcttcaanccngcgcctgtcccggccggattcggcgcgctcggacactacncgcagcccaacaaccggccgctcttcagcca

SEQ ID NO: 54038 - DNA, 670 bp, Triticum aestivum
  unsure (1)..(670): unsure at all n locations
  Clone ID: PAT_TA_54038
aatcagtcaaaccacattggatagtaaaacacgtcagaaccgtgcggtccggacagtttaagcgtccgtgttgaaaatgtgctaagcactatttaacatcgagaaatgtcttcctggggatcatcaacggcagaaattacaatagctaaagcaacaagacatgcactcgaggggatagctagcctggtagcgaacacatgcagatgtccaacacagaactacacacgtagaccaacaacaacacatgcatcatcctctgcggttaacagcatcgatcttctccaggattattgccgcatgatctagctagaagcctagaactgctggaagaggagcacccaggccagaagagtgcctgttatgacgagcgacccgcgcgccggcgcaggggcgcccgcatgcgcatgggccggcgccaggtccgggccacccgcatgcgccagcgccgggtccgggccacccgctgccaccggctcgaatgtcagctggccgccgtcgccatgaatgtcgtaggtcatggtcctgcccgtctgcagcaggctgcccaggacggccgcgccgttcggcgacggcagtatggtgaggcacgtgcgccattcgtcgtagatggagaagtagttcttcacattgagctncatcgccgcgtcggcgtcgtcgaacaccagcgcta

SEQ ID NO: 54039 - DNA, 419 bp, Triticum aestivum
  Clone ID: PAT_TA_54039
gggaaaaagacaacagggattgaattcccctaattttcaacaaaatttttttaaattacccctgggcttaccgggggggtttgaagctaaaataaataagccgaagtgaaaatttaccacagggcatagacaaatttaagttaaatcctgcatttgttttgtttgatcaacatcacaagggggggaaattgaacaggggggggtgcatttcctggcataatggatcctggatcccctcgcaaaaacactttaaagcttgaacttcttcttaaggagaggcattttcggagcctttttcttattgttattcaaaacaaaatactggtttcttttaaccgggttgaacatttaaaacatgaacatttaaaatgccatggggggcaccttttttggcgggacacttacccatttttacttgg

SEQ ID NO: 54040 - DNA, 320 bp, Triticum aestivum
  unsure (1)..(320): unsure at all n locations
  Clone ID: PAT_TA_54040
gaaggaaaaatattanattttttttatgagntaatgggaattttttgggggaaggggnngattttttttaatgggtggtaaaatggtgggagaggaaaaaatttatttttttgtaaaatgaatttggtttgttaatnttgattgaattgaaaaaggatnttgatggagnaattttattgtaaaagttttnntgtgtgaaaatttttgggtggttattttnnngatggttattaattnaaattntatagtttnttntnagtaaaagtaaatgttggaggagttatggaagaaaattaatagtggatnaatatgttantttt

SEQ ID NO: 54041 - DNA, 521 bp, Triticum aestivum
  Clone ID: PAT_TA_54041
aaaaaaccaaaaggggggttttaagggaaaccggggggcaaccaggggaaaaaagcccaaaaaacaaaattaaaaaggggggcaggacaaccggtttaaaataaaaacccaaaggccggggggggcaaaaacccaaaaaaaaaaatttttaacccccgggggaaaaaaaaaactaaagggaacaggtttttgggcaaagggccggttttaaaaaaaaacccccgtggaaaaacaacccggggggggaaaaaaagcttttaactgggggggcccccaaagggaatggggggccccccaaaagttgtggggggggttaaccctttaaaaggggggggccttcctttggtaaaaggaaaactttttggggggtgttttttttgggagtttggggaggccccttggtttttttggcccgggggggaaaaaaacgggggggaaaaaaaaccttttggaaaacggtttccatggaaaaaggggaaaaccccctttggggggccccacggaagggaggggggaacttt

SEQ ID NO: 54042 - DNA, 726 bp, Triticum aestivum
  Clone ID: PAT_TA_54042
cagtccagaatcatcagttacaaggcaaatcagtttctcatgatatgtcacaggctcacagccccagccacgacagcaggacataacaccaaggttacagtacactgctagatcaatgaaggtactacacaagatacacgtatacatggggtgtactgagcaacagaccggacaagatcacaaaattcttgcttggttgcgcaagcacaactcggggtgtggctctacttgcgccttgccaatatcggcacagcagtccttgcacttccagaaccggtgctctgccgcgaccacgacgacggctttgccctgcccgccatcagcgccgacgctgcactagcttttatattccgcctcttcagcgcaaggtctagcttgtctttcgaagctgagcctgatggctccgggaagatggaggcggccttgatcgctgctctcttgtccttcctgttcttctcgaaattcgaggcgaacctcacacgagctgcagcggcagcatcctctgcggagggtggcagaaggcgtactccgagccccatcttcctcgctgatttcttctcttcagcaactctcttcttttggctctacataaataataggacaacaagtggataagaatcctgacagttagacaacttactgatgaaaaattatacaaaggaattcactagatgaccctaaggcggtcgcggagggttctgttcagggaaatatcatcagaatgac

SEQ ID NO: 54043 - DNA, 612 bp, Triticum aestivum
  Clone ID: PAT_TA_54043
cccacgcgtccgcccacgcgtccgcggacgcgtggggtcaccgacggcgagaaggggtgcaggtacttcaccaaggacttcaagggctccgtgcccggctactctgtcaacaccgtcgacaccaccggcgccggggacgccttcgtcgggtccctcctcgtcagcgtctccaaggacgactccatcttctacaatgaggccaagctgagggaggtgctgcagttctcgaacgcttgcggcgccatctgcaccaccaagaagggagccatcccggcgctgcccaccaccgccaccgccctggagctcatcagcaagggcagcaactagagacgcattgtgtcgcgccgccagtcggggttgaatcttaggggagtttagctgcacttttattattagggatgagtcgagtttagttcgtgtgtcaagtgtgtgacctcgtgggcgcttaataaaaagcaagcatgtgtggtgattttggttgcggtctttgtgtaaggaggctactgattgttgaagccttcacccaaaactcatttatcgaagtctttaatgaatggacaagcttatcacaaaaaaaaaaaaaaagggcggcccgccgacgacgccccaagc

SEQ ID NO: 54044 - DNA, 782 bp, Triticum aestivum
  Clone ID: PAT_TA_54044
gggacccgtaagtggctctccagcctgctccagaccgccgggtggccgctcctgctcgcgccgctcagcgcctccttcctctcccgtcgccggagtcacaaagaccgcggctctgtcgcgccgctcttcctcatgtcgccccgcctcctggccgcgaccgtcgccatcggcttcatgaccggcctcgacgacctcctctacgcctacgggctggcctacctcccggtgtccacctcctccatcctcatctccacgcagctggccttcacggccgccttcgcgctgctgctcgtgcgccagcggttcacggccttctccgtgaacgccgtggtgctgctcagcgtcggcgccgccatgctggggatgaacgccggaggtgaccgccccgcgggggtgacgcgggcgcagtactccgccgggttcggcatgacgctgggcgccgcggcgctctacgggctcatgctgcccgtcatggagctcagccaagcgaagcacgcggcgaggaccggcgcgggcgtcacgtacaccctcgtcatggagatgcagatcgtcatcggggtcaccggcacggccttaagtgcgggcgggatgcttgggaacaacgatttccccggctatcccaagagaaagcccggggggttcgggctcgggcccagatgggctactaccctactgctgggccggctggggcctttgggggaccaagttgttttttgcctcgggacccattggggggcccttctttcttatgggttaaaagggcttgctcccccccggggggc

SEQ ID NO: 54045 - DNA, 285 bp, Triticum aestivum
  unsure (1)..(285): unsure at all n locations
  Clone ID: PAT_TA_54045
gncacagncaaacgcatntggngnagctaggcgcccctnaagtgcaaaattttngctgggttggctnngnaaaaccggttatggacgnnngataggagggcgcggnacgggctgnaggacgctcnttnggnatgctacacgtgttgccaagaggaggataacgnggatcgcatnttggnataatgggnntttgcgaggcaagggnggnacggatgntnngagnatnngnaagnnaacatacacatnccnagccatggngannncttnatggannggnggggaaag

SEQ ID NO: 54046 - DNA, 390 bp, Triticum aestivum
  unsure (1)..(390): unsure at all n locations
  Clone ID: PAT_TA_54046
gggccggnaaaaaccgggnncgacccacgcgnccgcncacgcagcacncccncagcnccggcaagcaacaccagcgcnccgcnccccncgcnncccggcggnaaggacgaccgacgnggcccgccgagncccggccccngagggggaggngaccgccgaccccngggnggagaccacggccgaggccgccgccggcgacgcgaagccggccaaggagaccaaggccaaggcggccaagggcaagaagcccnccgccccgaggaagccccgcgcgnccgccggccacccgaccaacgccgagaaggagnnggaggccancaccgaccagaaggancngacggggncgagccagcgcgncaanaacaagaaagannaggacaagcacaaggg

SEQ ID NO: 54047 - DNA, 489 bp, Triticum aestivum
  unsure (1)..(489): unsure at all n locations
  Clone ID: PAT_TA_54047
gcccgccgncgccgcctnctcctctccgctccttctccttccttcgagtttcagccatgggtaaggagaagactcacatcaacatcgtggtcattggccatgtcgactctggcaagtcgaccaccactggccatctgatctacaagcttggaggtattgacaagcgtgtgatcgagagggtcgagaaggaagccgntgagatgaacaagaggtctttcaagtacgcctgggtgcttgacaagctgaaggccgagcgtgagaggggtatcaccattgatattgccctgtggaagttngagaccaccaagtactactggaccgnnattgatgcccntggnnaccgngacttnatnaagaacatgattactgggacctcccaggctgactgggctgggctcatgattgactccaccactggggggttggaggctggggtcttcaaggatggccagacccgggagcacgcgctccttggtttgactcttggag

SEQ ID NO: 54048 - DNA, 424 bp, Triticum aestivum
  unsure (1)..(424): unsure at all n locations
  Clone ID: PAT_TA_54048
gtcgacccaacgccgtccgcttgccatttcgccggtacccgcgagggtccccgtccgtccattccacnngtcgcctatttaaagcgnnaccgcggcncnnggcgccgcttagaagngggtactgnnnatcatccacngncgatcgatgccccggtagcnttttcttcccccaagtgtgcgaagatacatagggtgcggccgacgcgtactgcacctgtctatcttcccgtgcgcacccacttcctttccttctacagactgctgcggtgctttgctcgatagatcggccccgcgttacatttcgggcccccgctgcgggatgggcgaccggacgcaagagacgtggccggacgccgagtgcccggtccccgcgctgcggggtgaatccctggaccctgggcgaaccaaggggggntcgtcggca

SEQ ID NO: 54049 - DNA, 463 bp, Triticum aestivum
  Clone ID: PAT_TA_54049
acccacgcgggcgcccactacaccagccctcccctacacctcacgggcgagcggccccatgcccatgggctcatgccattaaacctcccctccgccgcctgctactcgctccgacgctccatctacgcctccctccggaagaagatctccccgatggcatccgcccccggctccgactccgcagccctctccacggacgaccccgccgacaacggcgccgccaagcccacggagcaacggcccgcacaggcggagaagcgaccggagaaggcgaaaacaacaatggtgacgcagaggagcatgctcgcggcgaagcagggagcaacaaacctaggacagggctagccaaagggcgacggccgggaggtggggaaagaggctggtatcgaggctatcaaagctggaaagaatcagcatgcaagaggatggggtgtgcctgaactgaactcagctgaggccgaaa

SEQ ID NO: 54050 - DNA, 271 bp, Triticum aestivum
  unsure (1)..(271): unsure at all n locations
  Clone ID: PAT_TA_54050
aacggagggagcagcacagaaagcaaaaaccacnagacgagaaaccgcacaaagaacaaagaacccaagcaaagaaacacagcancgagggaacaggccnacaaacgaacgcaggacaaaaccaaaacaggccaagacacgcaaacaaacagcagaggggcagccacggcacccccgaggggccacnagcaacaagcaccaggggaacgaaaaccacaaaaccacaaaaacggagagaagaaaagggcaccgaggggacgcccgcaccagg

SEQ ID NO: 54051 - DNA, 534 bp, Triticum aestivum
  Clone ID: PAT_TA_54051
cccacgcgtccgcccacgcgtccgcccacgcgtccgcccacgcgtccgcccacgcgtccgcccacgcgtccggcagcagacgacgacttcgccttctactactctttcttccaggacgccgccgccgcgtcgccgctcccactcgcgctcgacggagccgccctgcctaacaaccgccggaggaagcgcggaggggacgacgactccgccgcggagcccatcaaggacggtagcaacaacggaaggaagcgctccatcgccaccataataacttcgctcgccgcgctcgaggccgaggaccacgccgacagcgcgggggccgccgacgcctcccgccgagagctcgcgctcctcgagtccaacgccgacaacaagtcgcaggccatgatggactacttcgccaagatggagggcaggtgtgatgccgacgccgactccgaggccgctgaagcgcgcagcggcctgtcggcggagggaggggcagaggccggcggggctgccgaggaggccgccactaataccgggcgggggggc

SEQ ID NO: 54052 - DNA, 532 bp, Triticum aestivum
  unsure (1)..(532): unsure at all n locations
  Clone ID: PAT_TA_54052
aagcaagcgccataaaccaaaacccctttatgggttggggaatcaagaaagaattttgggggaaccgggccagggccccaaaaataattcttaccccccaaaggggaaaaaaccccggggggaccaaaatttggtgaacccagggacaagaccccccccgaaggccaaaaaaagggcgaccctccccttgggggggcgcgacggcacaaaaaccataaacccctcgaccgggaaccccggggggaggaacccccaagggggtccggttccaaaggcgagctgagggaacctaaaccccacccagctttccccctttgggtccggacaaagcatggccccaaaacttgacgtcccccggagctggtctccgttgggggcccccacaccccccaaggccacaaacgacggggagtacccggcgtngatgccccccccggggtcccgggtggcacctaccacgcagccggagtttaatcccagcacgtcccggacctgaagcctggggaacccccaaagcaccatgttcccaaaa

SEQ ID NO: 54053 - DNA, 626 bp, Triticum aestivum
  Clone ID: PAT_TA_54053
aggcctatacaataatattttaccagatatcagttttttggcaacaaagtaattcgtagttcaatataggaatatcatattgaatacatgcatgtatgatcatctaagggtccaaatgctccgtattcaatggtttgtcagagtggggcgccttggctcggatctctccatataagtaggagacgaagccccagagggatagcgcgagggcgacacctttggtaccgttgaatggctcatggaagaataggacagcaagcacctcagtcactgggatgagcacggtcatgatgacaccggcgagcagcgctgagccatagaagatggcaccaatggtgccgaggaagaagaactggtacacaatggccgaggcggccagcagtaggtagtagccaatctggccgagcccgaactcccgggcttctcttgggatagcgtggaaatcgttgttcacaagcatcccgaccgcactgaaggccgtggcggtgaacccgatgacgatctgcatctccatgacgagggtgtacgtgacggccgcgccggtcctcgccgcgtgcttcgcttggctgagctccatgacgggcagcatgaggccgtagagcgccgcggcgcccagcgtcatgccg

SEQ ID NO: 54054 - DNA, 703 bp, Triticum aestivum
  Clone ID: PAT_TA_54054
aagtacagattgatgacatataggttgttgctgatgctacatgttttacataagatccaaaatgaaagtgtcagcaggtgcttacagtaatactaagtcagatagcaaaggattcttgtgatctgcttagattcgatagttaatcatgcagaggcctttggaggtgcacttcaatgtgaaagcatatatttctgtcatcatggctgtttgaaaagcatagtacacagcagtctaagcaggaaataaccggtagttaaacgcacgggatggtctcaggtgattacataagatccaaaaggatgataaacatagaagtcttggtaggcatctataacaatcaggcgcaatcccttggaagtgcatttgaaggcgaaagcatatgcttcctttgttcatgtgtgcctgacggaagaagtcgctccagcctctagtcttggtggcccttttgtcaacacccttgataaagcgggctgtgacagcagtagttctgtcttcagtagtgattggcggttcaccatggtcagcatccatgagtttgaatctcaagagtgtctcaggaggccgatgaaccagagataggaagaagcacattcaggttcaacctttgagccctcatagcgttgtctaggtgatgagggaggcgactggacatcatctcgacccaaccatgcattgtctgatttttgtttccacttgagcattc

SEQ ID NO: 54055 - DNA, 476 bp, Triticum aestivum
  Clone ID: PAT_TA_54055
aggctaaaaacaaactcattcaacttaaactcattgccatattaacagcagcagcaacagcaacaacttttttttttttttttaaaaaaaaactcctatttcttctgggggtccggtacctaattacaaatttacttgaactaacactaccctactttgccaaggaaggcgaaaccacaaaccattatcttgttcaaaaacccccccccaaacccttattacattggagcaatcaaaaacaccttaggcggcctaattctccatgcggatgatgcaacggatgcccttttttttttccattaagtcgaacccctttttgatctcccaaaaccgcaccctttgtttgataaacttttccacctccaacttcttttttatttacatttacaccacattgggcaagtcggtgccccgcttgaaatttcccaaaaaggtgcccttaaaagtcctctttttcaagaaattcatcgggtggg

SEQ ID NO: 54056 - DNA, 577 bp, Triticum aestivum
  Clone ID: PAT_TA_54056
accgaaaaagggtttcgccccgctttttttttaaagccccaacccccaacaaacgggtccggttcaaaccacaacacacaacacgggaaccacactttacccgggccagatacataggtcccaaagggccacaacaaccccacaccggcagttttaacgttgacaacaagagaagacaggaagctttacttcgaagccgccgacccccttccgatgaaatcatgatgaggggaagttgaaaattgtcgacaccgggcacaccaaaacggggcctttaggaagggcaccacaccgtagtgcccccaccccccgatccaaaaatcggattttcatccggggcacgacaaagggggggggcaaccccaacagagacttcaggaagatgacgacccccacaaaccccgccttcgtgggtctggcctaaaccaaacagggttttcaccccggtaagcatactccgcctttgttaggacgacgaaacacctaccaccacaccggccaagcgggcatgggggttagccccccacacctgagatgggggcttagcccacgagcaccggaggtcccaccacctggg

SEQ ID NO: 54057 - DNA, 622 bp, Triticum aestivum
  Clone ID: PAT_TA_54057
ggttccttttttttttttttaaaattttttttttgtgtggttttttttttttttttttttttttttttttttttttttttttttcgccccccaaaagtgccccctttttttataaaaaaaaaaaataaattttccaataaccctacccgatcccaatttgggggcgggccccccccccccacctgagaaaaaaaaccctttcccatacctggaccccaaaaatttgatcccccaaattaccccgcccccttatttggccccccccattaaaaccccccttttccctttccttccctaccccccaaccttccccaataccaaaggagccaaacccccttccccacccctttaaagtatcccaaacctttccccccccccccataaaaaaacccccatgccccggaattttttttttaccttccaaatccccaaaacatcccccccccccttccctcccaaaaccccattttcccaaaatcccacccacgttatcccccccttgccaccccctgtaccatcccaaaggagcgtcctgcagcccgtcccccccccccctataaaacctccatacccggttttgcaaagccccccaaccaaaaattttccccttgaggggccccta

SEQ ID NO: 54058 - DNA, 596 bp, Triticum aestivum
  Clone ID: PAT_TA_54058
ggcaccagatcgatcatcaaaagctgtttatatgtgctaatcggcaacttcggatcactctgctttattcttagatttttctgatacgaagttcattggtacgcacgggggactatatcccccgctccttattgttacatccatcgcctgcctgaaatccctacttcttacatgggtttactagcaccgcgaggagatggattcgatggagcttaacttgacgataagctggtctggtaggcctgccacccttgggcgcggtactccctcgcggcaccggcaggatcgctcacctttatgatcgcgcgcccgaccacgatcacgtcgccgccttgctcgtttacgaccaaatgaggggtttcatactgctgaccaggaaaattttctccagcgacaacatcaactccggttttgacaacgtggaccaacgctgggctcggcgctggagctggccaggatgcagggtttaccgacaagaatccgataaccaaatcagaatgttgctcggcaaacttcacggctgccggggtgtaatcttcatgagcaaggttgctcggggccctcatttcagcaaccaagagtaacccttttccctt

SEQ ID NO: 54059 - DNA, 486 bp, Triticum aestivum
  Clone ID: PAT_TA_54059
ggacaggcatgaaaattctaccaggcacaggagcaccggttattaccagagctctccaaaaaccatttttaaggccagggggggaaaattaaactagggccaccactggggggtttggtacaggatttctcgcaacgggaaaaagtttcagggaaaaccgggggcaaaaaaaccaaaaaccaaattttggcccccccttgaaaaaattgggggtggaaggtgccttgccaaaaaaaggttccccctcctttacctggctggtggtaaaaaaaatgatgctcaaaactcgtccttcaaaggctcggggggaaccggttaaactgcctttttgggcgccgccgctgccccctgcccggaaatctccttggtctttttgaaggaggcgaaaaattcgggggccggcctggcgccctaaaacaaaaactttttcccgctaggagggaccaaatagagggggggggaaccctggacataaaactcgccggg

SEQ ID NO: 54060 - DNA, 637 bp, Triticum aestivum
  Clone ID: PAT_TA_54060
cctcagccgtaaaaagttttttatcagcacacattattaaagaaaactggatgcaatgcgcaagcaacgctcaacaggtgcagactgtttgtttagcctcaaaggaaacaggtaacctcaaccgatgcaatccaaaaatgcacaactcagctctcggcaaacctaaaaggtctcttgcatgtatcccgccgatgcccttctatgctgcagttcttgcatctgccgggtttccgcggtttctttggcgcatcccctctccctgggcatgtggtcctcttgtggccctcacggcagcaaatgctgcaaaacctggttctcttactcagcccttcgtacggggccttctccctacagttcgtcggcctgccagcacctttacgcttgtctggcgcctcgaggcactgcagggcattcacatttacagaattcgcagcactgtggcatggttcagctccatgatcaaccaaagcaggctcgccattcgcagcctgacagccatttccattttgaatgagacgatcctcgaaagccaaaccgtcccttgtgaccgccagaggtgctccagaacgtagaagagaatccaggccggcatgcatgtgctcatagcatgcagtgcttgcgtcccccattcgcacta

SEQ ID NO: 54061 - DNA, 747 bp, Triticum aestivum
  unsure (1)..(747): unsure at all n locations
  Clone ID: PAT_TA_54061
tcggctgccgcggcgatcgcccacgccgtgtcgtacgaccagagcctcgtcacggtcggatcattgatcatgtcatcgtcggaggccgggttgtcccgccggaacctcgccctgaaccgcgccgagaagttcttgacctggctcgtgagctcaacgtggggccggaggctgacgacgccctgcatggcgtcgacgtcctcggggctgagcctgtccaccaagcttccgacgccatctgtgacgacccaggcgtagccatcggacatcatcccggcctcccccgctcgccggaagagccgcgtcgccaggcggaaattggcgtgcacgacgaacacgcgcgtcggcatcgcattgaggcggtagagcagcgcgtcgagggcgtcgtcgtgcgcgcggctcggcacgggcacgcgttccacgatggccgcgctgtcgacgctctggagcgcgtcggcgagcgccgggaggatgccggtgccgtagggcgagtcctcgtgcaggacgacggccgcgcgccacccgaagtgtgctaggacagcggcgacgggggtggcctgcaaggagtctttggcggcggtgcgcacgaagtagggcgtctgcgccggcgagagggacggggaggtggcggagtangagagcacggngacgtgggcgcggctgccgagttgggcgacgaactccgcctccgctgatgtcttgggcccgatgatggcctgcacctgcgcgttcttgatcaggtccaacgcg

SEQ ID NO: 54062 - DNA, 612 bp, Triticum aestivum
  Clone ID: PAT_TA_54062
attatgatccaagataaattattccagagttaataatggagtgaacattcacaggcgcgcgcagagtaaacctcgtgtgacaccagcatccctacaacatctttacatggacgccgctccggcgctctccggccatgtcacggcgatggggctcgtgacattgtgcttgccgtcgctccacgtgaccgacccgaacgagtacttggcgtccacgatcaccgggttgccggacacggccagggtgatctcgtacgccaggctccggtgctcctcgtcgaacaccagcttggccggcgtcaccttggcgtccacgccggcggggctctccaccttggcctcgtagaccgcgttcgcgtcgccgccgacgttgcgtaccacccggtggtaggtcaccgagtccttgtacgacgagaagacggccgcgaaggccgggtagttgaggtcgccggagcgggcgggcttcttcgagcagtcggccacggagccgtccctggtgaagacggcgatctgggacggcgtgtagcccagcgcgcagaggaagccgatgtagtcggcggtgtccgcgtcgtcaccaggccggggtcgagcgcgccgttggggtccacgtgcccg

SEQ ID NO: 54063 - DNA, 601 bp, Triticum aestivum
  unsure (1)..(601): unsure at all n locations
  Clone ID: PAT_TA_54063
gggtcctgggtgggtaactaaagattttgatataagcggatactgtacagaaaatatgtgatccagaagaaaatccaacccaagcatgacaaacagggacgatcacgaaaacttttgaaccactcaagtgcattacaacgggcacacgaaatccccggggggggggggggcgatgtcgtcgatatcggcgaaatcaatgtcatctgggggcaggctccccaggcaggcaacctgcccagcaattcctagggcgttatcacccggtttctgtgcctcgtggatgatcgccatgggttcttctatgctctgtgatggcgtgggcatgtctgccaactgcntgctcctttggtactcatcggtgatctgaacgggcagntggttgaggaaccatggatggttcttgatctccggcatggttattcgctgctgggggtttccaacgaaaatgcgggacagcnggtgcgtgcggtgcatcgggacttcgacgtnggccggaacagaatactgggcgctgggggtgcggggggtcggggggccgggnngncctggggtggtngggggggggggncgggtgtggggggggcggngtcgggtggggggg

SEQ ID NO: 54064 - DNA, 714 bp, Triticum aestivum
  unsure (1)..(714): unsure at all n locations
  Clone ID: PAT_TA_54064
acttacaacaacagtacagtacagtttccaattgtttcttcactgatacatcatcatttgcagattatacaagatgacagcaggaaagagtctactagcagtaacatacacagacatcaaacaaggctgcgggagcttttattctagacgcagagagttaagcatgtagaatctgactgcttgaaggtgtgagatcgctgaacgccctgggaacctccacatcctgccaacgaaccaagtaatcacaagaagattgcttcttaacatggccgatcaccacatggagaccacggccaacgacgacgatcttactctccaggcagctcacggacagaggcttcatgatccgctcgggcatgggaggcccgtcgacagggtcccaggaatccatctccggatcgtagaccttcaccttcatcctctcgtactctgaaatgacgaagaggcgtccgtcgatgaccacgctctgccccgtccacccctcgcgcatcccggccggcatcgcctcccagcggtcggccttgggatcgtacacctgccctctcggcgaggagaagaagggccacgcgcagccctcggtgacgtagagcctgccgccgatcacggcggagtccgaggaggccatgttggtgcccatgctggcgattggttgccacacgccgttcaccggatcgagaacctncgncgagtccagctcgaactggtccgtgctgt

SEQ ID NO: 54065 - DNA, 356 bp, Triticum aestivum
  unsure (1)..(356): unsure at all n locations
  Clone ID: PAT_TA_54065
agaaaagtgttacatgcattgnaccggaatgcggatcagatcaggcaggcctttattcaaacaatcattttacagcttcactaaaccgcccccccaatcttttttgggggagcttggccttttttctgtccaccgnggccctcancgtgtggggggacttgcagaaggtgaacctcaccaggttcttcccgtcctcgggggtgaggtanaacacgctcgggtggatggccaccacgcccaccttttggatcaagtgctcgcagaagtcggtgtcgntgtcgaaccctttttttttgtgggcgaccatcacgaattatgttccgcttggcgggtggacgatgaagcccgcgggctta

SEQ ID NO: 54066 - DNA, 322 bp, Triticum aestivum
  unsure (1)..(322): unsure at all n locations
  Clone ID: PAT_TA_54066
ccccgcgtccgngctcagcagattgagtctgaagattcatcatccacatcaaccactggggatcagccaacagggctagatcctgaagtcttagattcatctgtttcttcagggagttcttcacatgtagntgattccgcggcgagaaatactgcattgaggactaaaccacgtaagcagaaggataaagaggaaatagggccgggtaaaactcaaactgcatgtacttctggccatcaccctgacggacctcgcaagaagggcattggcgccaaagcagcaaaagccccccccccccgcccacaaaggggggggacaaaaa

SEQ ID NO: 54067 - DNA, 314 bp, Triticum aestivum
  unsure (1)..(314): unsure at all n locations
  Clone ID: PAT_TA_54067
cccacgcgtccgcccacgcgaccgcggacgagtgaggccccctcgccgacgccccgctgacctcaaccagccgccggcgaanaggcccctaagcgaggcggcaaggcgccgggcccggcgaagaagaaaacggagaaggcgaccaacccgctgcccgagaacaggccgcaacaatcccgcatccgcggcccccccccgcccaagaagacccccaccggcagcataagcggcccaagggcgcgcgcacccaacgcccgacccccccccccaaccacccccccaaccagccccccccccccccccacccacccccc

SEQ ID NO: 54068 - DNA, 634 bp, Triticum aestivum
  Clone ID: PAT_TA_54068
ttggctttgtggaagttggctctgtacacctcagcctcaagagggaaatcctaagccgcgaatattcagattgaaagagcatggtgctgtagtcaatcgctgcgggttcaacagtgaaggaattgttgtagttgctaagcgtcttggggcacaacatggtaagaggaagatggaggaaacttcgagctccagtgatgtaaagcaaggagggaaagcaggtcctggaattttgggagttaatcttggcaagaataagactagtgaagatgctggtgctgattacgtgcaaggagttcattcgttgtcacagtatgctgattacctggtcataaatgtttcttccccaaatactcctggtcttcgccaattgcaaggtagaaagcagctgaaagaacttgtgaagaaggtctgtggtctttctaattggagtggatcttttcttcatttgcatgggaaattagtatgacattactggatgtgcaggtgcaagatgcacgagatgagatgcagtgggctgaagatggtccaccaccattgcttgtgaagatcgcgccagacttgtcgaagcaggatcttgaggacattgctgcggttgctcttgcttccaaattggatggcctgattatatcaaaca

SEQ ID NO: 54069 - DNA, 541 bp, Triticum aestivum
  Clone ID: PAT_TA_54069
ctccgccagcccagcccagccaccccgccctccatccacctgctcctctcctctcctctgcgcgcacccaacccacggccccgggatcggacccccgcccccgcccccagatccgctccgcgcatccgacctagctctacccttgctccgctcttcggccggggagcaccaggagcgggcgagggcgaggggatggagggcctggcgcagcgcgcggcgctgctgcgggactcgctcgggaagagccaggcggccaccgacgccgtcgtctccatcctcggctccttcgacagccgcctctccgcgctcgacgccgccatgcgccccatccagctccgcacccacgccgtccgcaccgcccacgagaacatcgaccggaccctccgctccgccgacgtcatactcacccagttcgaccgcacaagagaggcagagcgcgaaatacaaaaaggtcctaatgagaacctccagggtttcctagacgcgggcgaccgggtgcgcagcatcgaggggttgtttagttacaataagagctacagca

SEQ ID NO: 54070 - DNA, 394 bp, Triticum aestivum
  Clone ID: PAT_TA_54070
cccacgcgtccggatgtcctcctcccatgtgccttaggcggagttcttaacaggtaattgctattatccttctgcgcttttgatgtggcctaaatcattttcactagatttcaccgtacgtcacggtttccccccttttctgttacatgtttgttaagtgttttcttctgctagttttattgcgaatagcaaaaattgatgtgcgaatattgtgataatcccgacttaatgaattctgcagataagttgatgcattttttattcaatctttgtacctgttgagcaacctattttctgattgcttcctggatatatacttatagtttagggcaactgatgatttgctttaattatctgaagggaaaatgcccctgatgttaaggccaaatttata

SEQ ID NO: 54071 - DNA, 288 bp, Triticum aestivum
  Clone ID: PAT_TA_54071
ctctcggagcagcagcaggaggagcttgcaggaacaatggcggcccagggtcttctctctgggaggcagctgcttgggaggcctctgcagtcttccatctccaggtcgtcttcctcccggaagtccgccttcgccgtcagggcatcgaccagcccccctgccaagcaaaatgacaacaggcagcctgcggttctcgcccaagcagcccctcacctacctggacggcacgctgaccggcgactatggctaccacccctcggggctggccgacccggagggcgccggggg

SEQ ID NO: 54072 - DNA, 406 bp, Triticum aestivum
  unsure (1)..(406): unsure at all n locations
  Clone ID: PAT_TA_54072
tcgctgtccctctccctctctctctctccttccgtgtgatctgctctcgctccttcgcccactcgagagggcgacctcttccttcgagctcggcaaggcccctttcctcgagctcagccggcagcggagtcgagctgcgtggtgcggagggcatggcgacggggggaggcggaggaggaggagcggcggacttcggggcggcggggggagcgggcggcaggatgccgacgtggagggagagggagaacaacaagcggagggagcggaggcggcgcgcgagcgccgccaagagatggtgnggnctgggggcgcacggcggggacaagctgcccaaacagtgcgacaacaacgagggcctaaaggccctctgcaacaaggccggctgaggaaggagagcccgacggga

SEQ ID NO: 54073 - DNA, 797 bp, Triticum aestivum
  unsure (1)..(797): unsure at all n locations
  Clone ID: PAT_TA_54073
gcgtccggccgcaggcccttccgccgacgatggccgcgcgcttcgggtactactactcgacgggattgcagtcgccgttcaagttcgagtccgccatgtacaactacaagaaagtggagatccgtccgccggcggcagcgcgcttcgggggaagatcgtcgtgcaaggcggggcgcaagttcaggcacgacgaggtcaagaagtactacctcgacgcggccgacgtcctcgatgggcagctcgattatcttcatgacttcgattcgtgagcgctcggaacggaggtgcattgtccggtccctatgccaacagaaggatttttgtttttgctcctcaagttcgacatgaggaatggggagttgtatactggatccagtggtgtatctaataaaaatgagacttttttgtgtgtgaatgtaataaaaatgagacttaagttcgtctttttgttttttgaacacagtacagacacgagcgctcatacatatgcgcatacactcgtccctatgaacacacacgcacagcctacccctatgagcacttccaagagattgaccccacatattaatcttgaaaagaaagcaccaaaaagcgaactcgacaacaaacgaaaacatctncctccaactaaaaaaggcattnaaccaaaaaacccagaaaaaaaaccaagaaaaggaagaaaagcaacaaaaaacttngaaaacccaggaggggcataagagaaaaacaaccaaaacacttaaaaacataaaaaaaaaacaaagaaaganaaaaaaaagaaaaaaaaaaaannaaaa

SEQ ID NO: 54074 - DNA, 583 bp, Triticum aestivum
  unsure (1)..(583): unsure at all n locations
  Clone ID: PAT_TA_54074
cccacgcgtccgaatcaatcaatcatcagcgagcgagcgacctaaacctccgctccgtctccgcgcaaaaccctagcggatccatcgacctcgcggagaggcggagagcggagagcggagagagggagtgggtccgaagatgcagatcttcgtgaagacgctgaccggcaagaccatcacgctcgaggtcgagagcagcgacaccatcgacaacgtnaaggccaagatccaggacaaggagggcattcccccagatcagcaaaggctaatttttgctggaaagcagttggaagatgggcgaacattagctgattacaacattcagaaagagtcgacgctccatttggtcctgaggctcaggggtggaactatgatcaaggggaagacacttactgggaaggaaagggagagtgagattgagcccactgacacaatcgatagaatgaaggaacgtgttgaggagaaagaggggattgcagctggtcaacaggaggctcatctatggctgggaagcaaactcgctgatgacaaaagctgctaagggctacaacattggaagggcggggtccaccgcggcaatctt

SEQ ID NO: 54075 - DNA, 451 bp, Triticum aestivum
  Clone ID: PAT_TA_54075
tccggaaaccacagattgcgacaagagagggggcggggcggggaaaacagagcctcgcccgccaccggcgtgccgctcacggggcgttccagctcacgcccacgcccacgccacgctatacgctcgcaaccgccagaccactgtatgtatagaccgggccagtgcttgtcagaggacagaaaggaggcctaactggcactgcgagcaatggccatggcggggcgagctccggacctggccacggcgctgctgctggtggccaccgcgacgctgagctggggcggacatgtataagcgcaaacgccggtgtacgggtgcgacgcgtagaacaccacgctggcgtactacaggtgacacaaccgcaaggcggaccggggctgagcgcgccaaggaccgggaggctggactgacactcgccggagaaggagggatgccatcgaaaacaaccaac

SEQ ID NO: 54076 - DNA, 272 bp, Triticum aestivum
  unsure (1)..(272): unsure at all n locations
  Clone ID: PAT_TA_54076
ccccgcgtccgcccacgcgtccgcccatctccgtatcgcgtcgcggcggcagttccactccctcgccatgggcaagatgaagatcggaatcaacggctncggaaggatcgggaggctcgccgccagggaagccctccagagcgacgatgtcgagctcggcgccgacaacgacccctaaatcaccgaagaggacaggacctacagggccaagaacgacaccgaacacggccaccggacgcacagggacagcaggcgcaaggacgacaagacgc

SEQ ID NO: 54077 - DNA, 284 bp, Triticum aestivum
  unsure (1)..(284): unsure at all n locations
  Clone ID: PAT_TA_54077
acggcccagggaaagaacacacacaggcacaggcacaggcagagaggagaggcaanggcgaccactaagacggcggcggnggcgaacctggcggcgctgctgcagagggcagccgcggagccggctgcggccacgccgcccagcangcagacggcaagaaagccgcagaggccncnccacacgaaaggcggcngggcagaggcaaaggtgggtcgcctaccaacaagaggagggggcagggggggggcaaaggaaggcggggggaacgggggccgaaaagaacc

SEQ ID NO: 54078 - DNA, 619 bp, Triticum aestivum
  Clone ID: PAT_TA_54078
gggaaaggcgtcttcgtactcgcctctctccgcgcaaccgagccttcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggggacaagaccgctgggggaggcgatgatgctttcaacaccgtcttcagcgagactggcgctgggaagcacgccccccgcgctgcctccgcagacccccgaacccactgcgaccgaagaggcgaggacaggcgcccaccgccagcctctggcaccctgacagctccaccaccggcccgggagggacgcccgcccacaacagcccgcccccgtgagccaccaacacccacccgggcaccgcacaacaccagcacgcccctccccccaccacccccctacaagcacccccggccacacacccccccccccccccacctgccccccccggcaccacccgcccccccccgcaccccaccccccccccccccccgccacccgccccccccccccccccccggcgg

SEQ ID NO: 54079 - DNA, 523 bp, Triticum aestivum
  Clone ID: PAT_TA_54079
aagggactagaagggatggcgcctatgaaggtgtacggttgggcggtgtcgccatggatggcccgggtcctcgtctgcttggaggaggccggcgccgagtatgagatcgtgcccatgagcaggagcggcggcgatcaccggcagccggaccacctcgccagaaacgtagctattgtacgaagtaagaaactccctggacctgatgttattatggtgatgcctgctaataatctccaagtcaggcataaaaaaatctcgtgccatcgcaaggtacattcttcgtaagtacaaacccgagcttctgcgagcaggcaacctcgccgagtcggcgatggtggatgtatggctcgacgtggaagccctccagctcgagcctatagtgcggccaattgtggctaactgcatcctctacccgctcgaagggcgcgactgcgaccaaaaaatcattgacgaaaaaatctaaaagttgaagaagctggtggaggtttaagagttcagggtttatgctgcaggcaagttttgg

SEQ ID NO: 54080 - DNA, 686 bp, Triticum aestivum
  unsure (1)..(686): unsure at all n locations
  Clone ID: PAT_TA_54080
agacgagattgttgtgcgggaactgtccaatctcgcctccacctacttcgccggaagaccatctgcaatccgacgttgctctacacatcgccggaactccgagtgccggttctccatgagagttgaagtacactgcaatctgcactgggatgtccgtaagcttaatctcatttatccattgaaggaggtcgtccttgtgatcactggaaacatgtttgtgattgaggcacacagcaaaatggctcacactcaccaccattactcgaaggaccatctccatatacgagttgctttacctgaaagcagatttctgaagatatatattttttgtatttgttttatatttttggacaactggttgtttatattggtggagatccagtgctttacagagcccgcatataaaggtaatgtgtattgctatttttcttacttagtagcattagaatctccccatctctttatacggaggtgatggcgaaggaggaagagttgtgtcaggcccagctcaagctagatgaagaagaggaggccagaaagagagaatcagcaaggcagaagccttttgatctcaaggcacgattctgcgggttggtgagctactaacaaagacacancctctattttggaatttctacttgaaaaaagatggaccatcagctacggaattatgttcgatgttgaca

SEQ ID NO: 54081 - DNA, 477 bp, Triticum aestivum
  unsure (1)..(477): unsure at all n locations
  Clone ID: PAT_TA_54081
agtcaatctactcttcctcccaccgccgccgccgccgccgccgccgccgctcgtcgtttcaagaggccgcctccaaccgcagcgcagcaggatgagtgaagaagactcgacgagccggccagctccgaagctcaacgagaggatcctttcgtcgctgtcgaggagggcagtggccgcgcatccgtggcatgatctcgagatcggncctggggctccagcggtgttcaatgttgttgttgagatcacaaagggaagcaaagtgaaatatgagcttgacaagaaaactggactgattaaggttgatagagttgtgtactcatcagctcgatatcctcacaactatggcttcattccgagaacactttgtgaagacaacgatccaatggatgtgttggtcctgatgcaggagcctgttattcctggctttttcctgcaagctagaccaattggcccttatgccccatgattgatcagggg

SEQ ID NO: 54082 - DNA, 263 bp, Triticum aestivum
  unsure (1)..(263): unsure at all n locations
  Clone ID: PAT_TA_54082
tttcgggggccggnaaaacccgggaacgacccacgcgnccgcgcnncaagnncaagggacgaccgcgaaggcggcaccggngggggacgccgagaaccngcgccaggncgacagggcgcgccgngcccnccgcgcccacaacgccancaagggaagcgcccccancaagcganggcaagaaaggaacgangcnggcacgcaagaagngaacacaagaacaggaggcgcaaanggaaaaaggagagacgaggaagaggacaccc

SEQ ID NO: 54083 - DNA, 321 bp, Triticum aestivum
  unsure (1)..(321): unsure at all n locations
  Clone ID: PAT_TA_54083
aaggaggagaacaaaaacggncgnncccgcacggcgagggcgagaagaacacggngnggaggcanggagccccncccaacnacgaccncgngaacaagcacnncgaggaagagcggaccaaggaaagggccgaggggncngaggaagagagggngcagcgcnggcgcaagacccgggagacggagcaggaccacaaggggcggnccgaggaccagaaaagcgcccaccccaagaacnacnccgccgccaccaaccggccgaaaccccccacgcgggaggaggggaagggaaagggccgccacaacccgcggggggcgacca

SEQ ID NO: 54084 - DNA, 434 bp, Triticum aestivum
  Clone ID: PAT_TA_54084
ctcactcggtctcactccacagtccaccgctcagagcgaagaaggatcgtctcttccgtagaaacgtcgctccctctcctccatagctcgcagcttcctcttgccaaatccgggcgcaaacccgccggagatctatggcgggccaaaagaaaccggcagaccagcagaacaagaggcagcgggtttccgagaacgccgagagcagcaacaagaagttcagcatcaaggaggtagttggttcgggggtcaccgggacgtggccgttggcatcgcccagtccagctgccaaggcgaagccaatcgcggcggtgaagccaacggccgctacggcggcaggaaccggaccaggggccaccatggcaccggcatcggcagcgcccaccccgctggccaaggcgaagccaacggccgctacggagacaggaaccgggcca

SEQ ID NO: 54085 - DNA, 281 bp, Triticum aestivum
  unsure (1)..(281): unsure at all n locations
  Clone ID: PAT_TA_54085
atcatatatattcacaagttggagggccttgatttgaggcagtgcctacgatgtctaacatggtnttatggtttgttcatactactctgaccggccgcagttgtctgtttcttctttgttctctctttggtttttttttttttttgttccttgtctttttttttggggccgtgtgcgttttttgcctttttttcttgtttcctccttgtccggttgtgttttttgtttgttttcggttgttttcttttgccccttttttttttgtttttttcctttttttt

SEQ ID NO: 54086 - DNA, 508 bp, Triticum aestivum
  Clone ID: PAT_TA_54086
gaggccaaaataacctttttgatattaaaatccagaaatttttggtaaacattcaacaactctgaaggtttacaatcacacagaactagtagatcaccatagttggcaacccagggcagataattagctaacagaaagaacaacccagggcagataattagctaacagaaagaacatcccagggcagataattagctaacagaaagaacaaacccatcatctctgtcatgtgcactgaaaattatttcaattggactcctggcatgccggcaacttatgatgaatttaccaaatcaatgatggtggttataagaactgtcatccaccacggtgtcgggcatggattattcgatgaggaatctggaattcctcatgcctcccagcccctcaagatggtggtgcgtgctacccggttcactcccaaggtgaatgctcccatcctaaggtggcgatctggagacttgcgcatggccttgttgttctggcacgcgctgtcgttgcccttttg

SEQ ID NO: 54087 - DNA, 481 bp, Triticum aestivum
  Clone ID: PAT_TA_54087
ggggaagcaacatgggggggatcaagggcacaaaaacaggttggggcccaccagacagggggggggggacaggaaaaacatccgggttggcttccccaaaaaaagcctttaacctaaaaccgactcggacaggctttgggtttaaaaggtttggttggtaaaaaaaacaaaactcatgaacccttttttactcgaacaaaacggcattggaataagggagggggtgggccctttcaaccccaagctcaaccttgggctgttggtgcatggccaggtcaaagggcacttccggggggttaagggccacaattttcacaaaaggaatggtgggaacaccaaccagttttcttggaagggaaaggaaggggttttaaaaagtggagttgcttttgggagaaatttcataggactggagggtttttttcctggggaaaggcacccggttgggcttaaacgggctggtttttaaataaaccttggt

SEQ ID NO: 54088 - DNA, 536 bp, Triticum aestivum
  Clone ID: PAT_TA_54088
aagatattaacaaagtgatatctatttacaactgactacactatacatgctgactataaaattaactataaataatatgtcaataacatatagccaacaacttgctgtactattaaccatgctctaagtaacatcggagccgccacgcagggtcgagacaatgataaagccagcgaacagtataacataatgcgcagctctgaataaaagcaggttgaagacaaaagcgcccaccactggatattgttggctgatacgcctgcggacgacaccaccttggcgtcctctgaaaccgcattgccacaggaacttgcacattatgaggtgcgacaccggagggctgacaaaggcggagagcacgatgaagagcacgacaaggacgagattcacgacgaagaccctgatgtcgtagacccccacggcgctcgtcacggctgctttcgcccgcgtgaatgccaggagcatgctgatcagggacatccatatgcattgcagtgccgccggtgagcttttcctccaccgggcggtgcgcgagg

SEQ ID NO: 54089 - DNA, 433 bp, Triticum aestivum
  unsure (1)..(433): unsure at all n locations
  Clone ID: PAT_TA_54089
aatagaatctggatagctttagatcacaaccaaaacaggaaaaacattctcagttcaacctaggactcgaacagtttacagaaaatggtgttcagtatgtctgcaaacatgacatggacgcaacatctaagaaaatccaacagggggcatgcagcagctcttcagcctaagctgtggcacccttgcccttcttcttctggagcttcctcatgtagaactccagctccttgccctccaggatgtacccatcagctctgccacactgtccagggcgagacgaaaagcaggccagcagccttccaccggtgaactgctgctgaatgtgagagtgcagggnacgggcctgctggcgctggtcaagcttgctctggacattggggctgttctttgctggctntgnggcnggaggaggggcctgagactctggggcctg

SEQ ID NO: 54090 - DNA, 545 bp, Triticum aestivum
  Clone ID: PAT_TA_54090
ggttctttggtttttttttaaaaatttttttttgggggttttttttttttttttttatagccaacaaatacacatttttttttttttttttgggcggaacttacacatacatttttgatcaacgttcacaaactaaaaaaaatataacactttcaaaggggggaaatttcaaccacctatgtggccagcacccttgatccaaaaccttaaacactttttgatgcatccaaaatttcacttgatttacctaaacctgggaaacacctaaaattgcacattgcttttcccaacattgcagtttaaaaaactgtgcaacatcacttttccaacaaaagttacttttttttatagccaattgatcatttaccaatatatatattggtaagggggagttggatttcttgatcttttctgagctactgcgtgcatggaaaaaatcccctccattatttcattgccccttttttccgtcctttattaggttgcaaacctcggagcactccaccaggcagtactttgcacttcggaaacctttctttaacacc

SEQ ID NO: 54091 - DNA, 501 bp, Triticum aestivum
  unsure (1)..(501): unsure at all n locations
  Clone ID: PAT_TA_54091
ttattcgatgccgtcgaattggagaacgtttgcagccaaggtaggatgggggttgcatcaacgccattaaccatgttgttagaatgcgggaggaagggcgaagacgcgccgctggggaatgaagaggaggtagggctcgcattgtatgatgcccgcggacttgggtgatatgaggaacatgggcttggtgacacggagcacccaatcccatccatgcgttctgcaggtctgcatcccttgcggtaggtggtgccgtcgggctcgacgacccagccggcctcgttgcagagggccttgaggacctcgttgttgtcgcagtgtttgggcagcttgtacccgccgtgcgcccgcaggccggagaatatcttggcggcgatcgcgcgccggcgccgctccctccggttggtgttctgcctctgcctgcacgtgggcgtgctgccggccggtggccgcggcgccgggggggcggggggggggggcgccggcgngcggcgcgggggg

SEQ ID NO: 54092 - DNA, 464 bp, Triticum aestivum
  Clone ID: PAT_TA_54092
gatcaaacatagaaagttgaatacatacacgtcgtcatacggaggcactatcttggagtgtcattttaagacgaactgaagccgcgaaccaacctgtgcttgcaaggttagagggacagtggtatccccagcccaccaggcttcaagtcctggtgctcacatcattcctggatctatttcaggatttctggcgatgcacttttagttggaggagatgtttccgtcgacgacgagtcgcctactgtgacttcatctcaagatgatatgtcggctcaatctctcggaagtgctcataggggtaggctgtgcgtgtgtgttcatagggacgagtgtatgcgcatatgtatgagcgctcgtgtctgtactgtgttcaaaaaacaaaaagacgaactggagtctcattggtattgcattgacacacaaaaaagggtggttgttattagatacaccgctgggtccagggt

SEQ ID NO: 54093 - DNA, 406 bp, Triticum aestivum
  Clone ID: PAT_TA_54093
gggacagaccctgaatcttatttaaaataagccaagctaatagggctgttactaccggagtacgtacgtatgttatgaaacatgcaaaggaggggttacaaattcgggagcgacaggggcacagcgccccatggacgatctcacgactggcaagctaatacatcagcacgcgggtgctaatcccgctgttattgcaaccaactgccgttggggaggaacaggagctggtgtgggccccggtggccccaatgcccacaagccggaggggggcgagccgtgtggtgctggtggtgggggcggccctaccccggcgttggcctggcccccggggtggtcggcgagagcgggggtgttttggcccttgggaacaggaacccccttttcttgggggggtgggggccggccc

SEQ ID NO: 54094 - DNA, 630 bp, Triticum aestivum
  Clone ID: PAT_TA_54094
aatcttatcaagcgcatcgccatgtttttccttatcttatcttactggacaaccaaagtttaaactttggtcaagagcaggagatagaaataatatatttgccgacggcaatgaccaaacgatgcaggccggtgaggaggagggagctttacgttacgtgtgggtggctatgccatgtcatgtcacacaagcaccggcttgtcaaggatctcttcttccttttcctgttatctactgtggtcggtcggtctacggacaagttcaaccatcgctgatggcgatgttgctacgaccagcgtaattccacgcagatgcttgaaaaaccaacgatgaaagcctagacacatcccgaaggtgctagtaatctcacggaaaacgtggcttgcccacaaaaagaattgttgctatgttctttcatcatctaactaatggcttccaaatcaactttgttgccgtgcttttgtcccaccgaacggcttgcttgttttagatcattataaagtaactactagtaaatgcgcacgtgcaacacacgttaatatttaggcaatatattaatatcacgtggatattaggtatgctattgtttgtgtgataattttatgattagtgtaatatttgatatgatat

SEQ ID NO: 54095 - DNA, 292 bp, Triticum aestivum
  unsure (1)..(292): unsure at all n locations
  Clone ID: PAT_TA_54095
ggactcccaggcataaataggcccgagtctgccttattataggaccatcagcaacgaatgcacatccaacaatacacgacccattcagtctcacacgcccacacacccaaaacaaagttctcaactctggacaaccaccaaaccaaccccaaattatagtacaccacccaaacaagcgccaccgcggtcaggcgctgctccgggtgacggnggcgaagatgtnggngtaccccaccacgccgacgaggacgggggnctgctggggctccgggtccgtgacccacacgtgagc

SEQ ID NO: 54096 - DNA, 244 bp, Triticum aestivum
  Clone ID: PAT_TA_54096
atacctcgaaaatatatacaaatcttggactgagcttatgcacaaattcatatcctagaaattcccacttgtctgcacacagagagatcatattgtctatcaacaactgctattctccttgggggggaggtggaaattcataagtgcctttttttttttgaaattcggtagaatatttttgcttcaacttggccggggggcaccttgggggggtggaggtgaatcaggggccacattcttgttt

SEQ ID NO: 54097 - DNA, 531 bp, Triticum aestivum
  Clone ID: PAT_TA_54097
ggggaggaaaattgtggctttaaaaacagggcccaagcttgggggggacatcaattggggaaataaaccaatttggtccagggggtttcaacccggaaagaattggaaaacaagaattcaactaggcaactggcccggtgggtgttacttacagcacacatggggaaaaaccactaaaaaaactctgcctgatggaaggggggggctttagggagaaaagccccaacctgccggtaaacgccatttatcctgccgcagtaattcaggggcagcactacatgggctcctcgcctcctcagacttttaacaaactggtcgattgctccacccgcttgagccgagatcaaataagcctctgtttattttcaccacccatcggggtgtcccgaacccaagggggggcctgggatccacttttttcggtcactttcggataacgaacctgaatgcctgaaacagtaaaatttgggttttcaaatttcaaacgtgttgggggcctttttttgagggggttggtttttttcgggggtt

SEQ ID NO: 54098 - DNA, 464 bp, Triticum aestivum
  Clone ID: PAT_TA_54098
acaaatacagtgcttgttcgctccgccgtcgccattgccattgccgccgccgccgcaggcgcagcacacgacgtgtccattcccgcacatgaatatgggacgcttgaggggagcagggcacgcggcgcagtgaaaccatttcttcttcacctctaagatgacggcctcctcttccgctggtgccacagctaccatggctgctgttacttgttcatcgagttcgagcacgcctccgtcttccggctcatgcttcaccgtggccggtgggttcaccacggcggccagcgtcgccgtagccgccagcgtcggcgtcttcgttgacactgcactgggctccgctagcgccggcgtcttcgtgtccacctgactgggcaccacctgtgccggtgccatggtggccactgcactgggctccgccggcggcggtgtcttcgttgccaccgtgctgggcgccacctgcgccg

SEQ ID NO: 54099 - DNA, 724 bp, Triticum aestivum
  Clone ID: PAT_TA_54099
atatccaacaactcaattatacttgtcattgctcaatttcagatattacatcacactcacacatggtttggcaatcagaaacaagatacaacacagtcgtcagacccaacaccatccgcgactaaaccacgatgaacgaccatcaccagcaaatttattgttaaatctaaggcctaaggcacactcggtcctaaacttttgttctcacatcagagtacacgtaccctacttccagtttctatccgtttaaacctcggagaatcaatcaaggcatgtacgtacgtcgtcacagtacagcggccgtttgagaagttgagagtaactcttcgcacctgctttaagcaggcccgctactcccttgaccatgaaagaagcgcacgacgacgcaggttatgttgtcgctgctctcccgcttgtaggcctcctgcaggagcctcttcgcagcttcctctgggtcttgtatggaccgggtcatgtcgacagcctcctcgttagagaccacatcccagagtccatcgcttgcaaggatgagaaactccagggactcgtcaacgatttcctcccggatctctggatccacaactacatactgctttaagagcttgtcaccaaaagcgcgagaaacagcaagtacaccaccaacacgccatgttcctgcccacataacaaaaccttcagcttctttcatacgttgccgctcatctgtctgatcaggcttgtgatc

SEQ ID NO: 54100 - DNA, 635 bp, Triticum aestivum
  Clone ID: PAT_TA_54100
gccgcccgccagaccgaagttcgacataaagcacaacaagatgacattacagttaacatgttcaagaagggattcgactcttgctgcccaggcagtcattagatagtggtgtaaaacatgctactgacacttgacactcaaacaagttcaggtttcctaatcatggccatattaaccacccatacaggttcaatcaagtttagatgtcgttatgcagaaggcaaatctcagatagctgtgaatcttcacgggctggagctggaggcctggaaggtgcctggcctatgtttctccatcaaaccggtgagagcggcgtcaaactccttctcgagctccacctcctttgccatgtactctttcttcagctgcaccttcttctcctcgtgcgcttttatcaattcgtccctttcaacctcaaactcttgcacgtccttaacctggcactctatgaaccgctgtacctgttccttccttagcctgcgattttcagtagtcccggaatccacatcacactgtctagcctttgcacgctcctcctgcagcaacctctcaaactcgctttccttgtcttctgtggccttgtgaatgttctctatctgatcatggaagaatttttcctgggatttcatctcttc

SEQ ID NO: 54101 - DNA, 479 bp, Triticum aestivum
  Clone ID: PAT_TA_54101
cacaaactgttattgctcgtaaattcgaataatacgtgtcttccggaaagacgatgcttacatttctaataatcaaatagtcagagttggaacatttcatgggggtaactactactcgtagtaacaacatgcagttgaacatgcgtgggacagtgcatacctacgtctccaggcatccatcttggccagcagttttccctccgtcttcaccaacaggtttacctcgtacacggtggacaccggcgtcgggctccatacggccttgagaacgcagtacccgcgcgccatcctgaacgcgccagtgccgcccaccacggcggtctcgtaggggccctcggagctcacgatgctgcccaccataaccagcgtgctcccggcgtgctccccggccgtgaacacgaggctggtcgccgtctgcatgccgggtggcgtcaccagccccgcgaaggcgatgagggactggtaccgccccacctgcg

SEQ ID NO: 54102 - DNA, 438 bp, Triticum aestivum
  Clone ID: PAT_TA_54102
aggggccccaacaaaacaaattacaatcccaaggtaaaaacattcccatttcccgggaaaaagggggggttccctacccccgctttacttgggtacggcccaaatcggaaaaagggtttcaaccccccacccctaagggaactgtacttggggggggccggggctccagggaaaattcctgggggcccaaggggcaattccatcctgttttgcccccatgggggggtggaccggttaacagtttgcgttcaccacggggacttggccttgacgaggacccccttgtaaaggtgggggggttgcccccaggtaaagtcctgggaaaggccgcgctcctggggccccccccagctttccttggggccccggggggggcggggggggggcccgagccccttaaaaagtttttggccctttgggggggcgaccgcccccccc

SEQ ID NO: 54103 - DNA, 506 bp, Triticum aestivum
  Clone ID: PAT_TA_54103
gtgacatacgagcatgctttctcgagccatgttcgtacatgaacatggacatacacatattgttaggaacaaataagaaagataaatggggaaggaaaacccaaagcgatgtgagaggtgacaaaactgcaatggcactttatatatggcctgtcgtgagtgagctggttaggccttgccggactcctagcagcccgggggcttgaaggggatgaagctgacgcactgcacctggcgcatgttggcaaatcctatgatgccgacataggcgggagggtactcctttttgacctcgggggggggggtgatcacctgcgtgggggctgtgcatccgaacataggcaggttgcacattggtcattaccggccatggtattacccaggggatggggtgagctaacggaaaatgaacccaaccttgcggaactggaggcaaggggcccacttggagcgcgtcaagtggtacaacctggttaacgaggggctgcgtgctgagggggggcaac

SEQ ID NO: 54104 - DNA, 632 bp, Triticum aestivum
  Clone ID: PAT_TA_54104
ttttttttttttttttttttttttttttttttttttttttttttttttttttttttttttttttttttttttttttttttttttttttttttttttttttttttttggggaaaaagggggcacccctttttaaaaaaaaaaaaacgggttaaattttttgggggcccaaataacctttattaaaaaacagggggggccccccattgggaaggggaaaggcccccctatttagggggggcacaaaaaaaggggcccaaaaaaaaaatttggtccaaaaaacggaaaaagcccacccacccaatgggggaggattaaggaaactaaaaagccccttcccaaaaagcccaaaaaggggtcccccaaaaattttttccttgaaaaaaaactttccccccaaaaaaaaaaaaacccccgggctttgccaaaatgcaaaattttggggggggaacaggccaaattcaccaaaaaaaaaaatcccctttccctttaaaaaaaaaccacgcttttccaaaaaaaaccttgggggggaaggaaaaaccacaaagggttttaaaccacgggtttgggttccaaaaagctaaacaccatttattttaaagacggggggggggttttttttcatggggaacctc

SEQ ID NO: 54105 - DNA, 453 bp, Triticum aestivum
  Clone ID: PAT_TA_54105
ccaatgaatttccgcaaaatacatgtgcacaggtcacaacgtaaatggacgggagcaggcgtttccgcactactgggaatttttgcaacatccaaaaccatgcattttgggggcgtccacgcttgcttagctagtaaaatagacaattctattttagaaatacattaaaaactaacaacaatggggcaaaataattatactaggggacaacactcaggggcttgctacctacttgctactttattattgaatctgcatgcacaagagtttaatcgatgagggccttttaataattaactacccactaattggtcgaccaccatcaacggggatgacttggccggtgaccaaggatgcccctggcatgcaaaggaacgacaccactggaggcacctcctttggctcaactgcccaccaaattggagtcctccggaactggggctttttaatttc

SEQ ID NO: 54106 - DNA, 452 bp, Triticum aestivum
  Clone ID: PAT_TA_54106
attacacaaactgtaagggcttgttacacgcgaacaattaacgggccttgtagcattgactatactggggctgactatgtactactatgtaataccaaagtgacactgtggcaaaaactactaccagtactaaccaaccttcctttcacgacatcagagggaccttctcttgaccgtgggcagatgattacgtcaagccaggtgggttcaccctcttacaagggaaaaatgcttttatcctcgccttgaccttggtctaccaggcagttttctttaggggcaacctcttgcctgccttgtggaagagggggtcaaggaaaccggacaccttcagagcggtcacgaggtcatgggtccaggcacgcgatcatctgaacacatactgttggggaaggcaaactcggtggcggaaacttgtggatggcctgggctgagtgaggtgttggcgtgtg

SEQ ID NO: 54107 - DNA, 122 bp, Triticum aestivum
  Clone ID: PAT_TA_54107
gcgacctatggaatgcgcagggtattcatgtagctagaaagatgggaacttaaacatcatgcctgttaatgcacatcaacagatgaagaggagtgtgcagaggagaaaatatgttgatttgt

SEQ ID NO: 54108 - DNA, 143 bp, Triticum aestivum
  Clone ID: PAT_TA_54108
ccaaaagaaggatcacttgtccagaaaattccttccgctgcacataactatagaagcgggtataatcactactctttatatgtgtttaccgcggggggtcttaggtggcgagacttttattggtcttatgagggcacagggta

SEQ ID NO: 54109 - DNA, 495 bp, Triticum aestivum
  Clone ID: PAT_TA_54109
aaacagggtatagcacgggtcacttttttattcacccacaccctttttggaagctactggagtttacctcacacagggaagcaggcattctcagggcctattttatttattccccaacaatttccatgtttgggagggcagcccacgtaaaccccccctccgccgaaaacaggacggtttcagctttgacaatctttttttggggaatctggcccatcttgcccaggtcgtcgtcggcgacccaccagtcaaaaaacccgaggttctccttgagcctctccttggtgaagcttttgacaatcgggggcaccccttggtcggagatccacctcagcgctacctgggcgagggtttttcctttagccttggggatctccgggagcaccttggagtccaacacggggtttccgtcgccgttccagttttgccctcccaacggggagtaggctgccacggggatgccctttttggggcaataccccctaaatttccttt

SEQ ID NO: 54110 - DNA, 191 bp, Triticum aestivum
  Clone ID: PAT_TA_54110
aattcaaacaagggccactaattcaaacaaggtggggccagccccacataagtgggtggaaatttggggtcttgtggagcgtaaaaaactttgtgactgggtcctataaatgaaaaccatgtgtaatcctggcccagggaagggtgctaacaactggggggaggcttgggggttgttctggggggtggggg

SEQ ID NO: 54111 - DNA, 460 bp, Triticum aestivum
  Clone ID: PAT_TA_54111
ggagaaaaaacgaccccaaacatgacgactttttttaggggcaacatcaacgggcatagttcccccaacacaaccgaacgagacaagggccagagcaaaaagcagttccaacactggtcgacacaaaaaaccgaagcttaacaaggtctcaaaacgactagaacaactatcaccaccaccaaataccgccaccgcccccccccccatagaggcgggaaaaaacctgacaccatttaatttttttttggccgcagccttgggcaccttggggccgggcggatcctttttttccacggccttgataacgcccacgggaaccggttgccttatggggggcacagcaaaccggcccaggggggggtcctgggcaaaggtttccaccaccaggggctggggggggatcattttgacgaacccgggttcaccgtttttcaggaactggggcgccgccttaatttcc

SEQ ID NO: 54112 - DNA, 646 bp, Triticum aestivum
  Clone ID: PAT_TA_54112
ccatcaacaaaatttactatttatgttaaaaaccaagcaaccttttgtacaaaaaagggaccgggccctatagttcctaacccaacaatgtttgaccaattatgttttgaaaaaatcagggtttgttctgctgtatcctaattttttttttggtttggacactgcaatgcatcacctacaatgagcttatgatgggtcctacagtagggaaattgttcccaaacccaacgccaaaccattttcgggtcgcgtcggggagcaaagtatcattcacctcgaaaaatttttttgtccaaccgaccggttagaccgcctaaaaacccaggccgggggtccggtccttggactgaaggttcaccgggtcggtccagtccgccacgtacgtaaacacccggggcctgaacttgaccttgaactcctcccaagcttggaacttgaaggggttcacgcggacccgtttgttccacttgacccggaacccgggccggagcgtgaattgatggatcaagttgagcaacttgtcatccgccgcgttaagccgaaaaaacgacttgtgccgttcctcggttcgcctccggaacgggtagccttgggtgaccccttctttcgggttcgccctatgaccgggagggcaaaaatgggggca

SEQ ID NO: 54113 - DNA, 210 bp, Triticum aestivum
  Clone ID: PAT_TA_54113
ttttgtttttggcacaagttcagggctcatttattcattcaagttcatccaaatctgctgcagcacagcataaagttcagacacagccagatataacgctagaccacaacacggtagcaacaaagaacaagaccagacgaggacacgctgacaatcacaacggagtacacagaaagacaaccgactcgtgagcccagagacataagcagc

SEQ ID NO: 54114 - DNA, 556 bp, Triticum aestivum
  Clone ID: PAT_TA_54114
ccgggtatgcaacggcactactatcattggacgttgcggggtgaacaacatgggtcactctggcacgtaaccttactataaaagcgccctatgacatacaggaacccactttggcacaactatatggacgcatggtctaatcttactatcacagcgaatacctggttctagctccatagtaaacgatagaacctagtattatgagggtacatatgcacaggtttggcctaggcggactggtggataaagacccaacccataaatccttgttcatagcactgagcctataccttggatgggccaggaacacatccagcaaaccgagcgctagctcaaacaacgcccacatgtactcggcataaaacacaggctgtataaacctatccttgtcgacgactatgaacactgtataaactggacttctaaacacgccattgacaaattttctagcacagtccgaataggaaaaaaacatggggaaaggtttgaccaccacatatggcagagcaccatacatatgaagtcccaggccaccaactttcttgtccttgtttag

SEQ ID NO: 54115 - DNA, 294 bp, Triticum aestivum
  Clone ID: PAT_TA_54115
gaaagccaaacttataacacaactttcaattatcaattctttttgggggtaactaataggagcaaaatataggatatctggcaaggatccgattcacgaaccaacgggggaactgaagcgcttggtcttgttgctggtgctgtggggggaggacatgaagcagtacagcaccacccagtttgcaagggggctcaaaattgctggcgggggcctcacatctcctgaaaaggcgtttccaaagggacaccacgggacgcaaatcaaccggggggggggggcccgctggttggagca

SEQ ID NO: 54116 - DNA, 520 bp, Triticum aestivum
  Clone ID: PAT_TA_54116
ggggcccccttttaaaccaaaaaccggggtctttggttcccccccccactagaacaagaaaaaaccccccccggcctttccgggggggccggacaagtttaatcttcaaccatcccccaacattaaaaaaagaacccggggacccccggggggggggctcggcaccttggggtatgccaccccgggggttccaaaagagggcctttaggccattcaaaaaactaggggaaaactgggggaattcggggggatccccattcgactgggggggcccccccaggggggggggggggggcacttaaaaaaccctggggggaatggccaggggacctttccttccaggaatttttccttgaaactggggctgggaggggcccttttgaacaaagaaacccaagggccccggggggggttaaaatttcaacaaaattctcgggggggggaagcccccacccaaaccgggtttaacggtaaaaaaaatccggggggttttaaaaaagggggccaaaaagggggcccc

SEQ ID NO: 54117 - DNA, 244 bp, Triticum aestivum
  Clone ID: PAT_TA_54117
aagggcaattgccgccaccacatccgttgcaattgcaacggccgcagcaagcgaccggagcagatatggacccgcccgccaggatgccggacccggtgccgtcgccgatactgaagcactcgccgtccgtatcgcgctcgctgcggtccgcgccagacacctggtgcgtgaccttcggggacgacttccggtcgccctgcaagccggaatgcacctggcgcgggcttggagcgggttgcggacc

SEQ ID NO: 54118 - DNA, 447 bp, Triticum aestivum
  Clone ID: PAT_TA_54118
aaaaaccaaccggaaaggcttttttgccactgaccccgaaacaatgatttcagaccagccgggcaatgggataaaaaatttcggcgccccctggttaacatttccttttgggggtggaaaaaccctgttttaagttacatgggcggaaatttgaacttcaaatacattttacatgggggggacaaaacaaacgcagggtgggggtaaaaaaacttaaaaaaaggcccatgcccatggaaaaaaatatttagggggaatcattccccccactggacggaaaaagggaaaaaagggggacttttgggaaaagaattcaccggacgggggaggccacggggggcccccaaagccgggggttttccttaagggcaccgccgtcggggggggccggaatcctaaaggtgttaaaaatccggctaacctccgcctcctcggcctcccacgcct

SEQ ID NO: 54119 - DNA, 548 bp, Triticum aestivum
  Clone ID: PAT_TA_54119
ccccaaaaacccgcccaaagaaatttaagaaaaaaccccccgaaaggaaccattggggggtaatttgggggttgaaccaacccgggggaattttcaaaattaaaaagccaaaggggggccaaaaaaataaaacccccaaggggggctccccaacaaaacccgcctaagggtttaaaacaaaaattggggaaccctgcggggccacggggaaaggaaaaaaaaaaggggccaaaagggccattaaagggggggggcccttggggggaaaaaaaccctccccccggcccaggtaaaaaaaacccacaaccgggcctcggtgggaaaacaaaaaaaaataaggggggtttgctctaaaaaaaaaattgggccccaaaggcccgggaaaaactttaaaaaaccatgggctggaaaagggggcacccccctttgggggttaaaaggacctcccccgggttggggttggagggggccaacctaaggaaggtcttcctgggcccccatgaaatattgggccgaaaaaacggaaatgaaacggcacaggggggggg

SEQ ID NO: 54120 - DNA, 457 bp, Triticum aestivum
  Clone ID: PAT_TA_54120
gggcaccccacctggaggggcaacgggggactgagttttttacaggtccccccaaaaaagtttaaaattcagttttcgttaccgaaaaagccttacaaaaagggggctgaaaaaaattgcgcttcctggaaaaaaccattgggatctgaggggctacacctttattagagggaaaaaaggaaaaataaacgaaatttcgagacagggaattttaaaaaaaagggtagggcaaaaaagaaatttttggggaagggggctaaaaaatgggtaaaaaaattctcgaggggcccaggatgagtcacaaacccttgcacaaaaaatccaagcataaaaaccatgggcaacctcccattttttatttctttcagcttcactccattgggattctgtatatcttgggggggcgggcctggcggggaagtcggggcgcggcggggggcggggcgggggggggggg

SEQ ID NO: 54121 - DNA, 447 bp, Triticum aestivum
  Clone ID: PAT_TA_54121
gaaaagggaaacggggtttatcacaaaccaaatcaacaacattgggggggcaaacacccaaaaacaggctcaccccttttaggaaccccccttaagcatggcaggggcttttgaaaagccgcttggtccatatatccccccccctccccgggcaaattcaaagaaaaaaagctaacctttttcccggggcaagggttcccccccacaagggggggctcgttcaaaccccccttaaggcccccttgggaaaacccccccccagtttgcccaaatcaaaaacgggggggggggggcccaaaaaaacctcccccaagacccaaaaaggaccccgggggggggggaggcccatgggtgggaaaccacgggggcccggggcaagggctccttccccccccttaaggaaaaacccttttgggttaaaggcaaactttttgcccccaaggggga

SEQ ID NO: 54122 - DNA, 162 bp, Triticum aestivum
  Clone ID: PAT_TA_54122
cttgcaaatgacattttattgaatggaatataatacatagagtgactaaaaaaactgagcaaatagtttgaccggctcacgtctacccgctgactataacacgcacatctcactagctactatactacactcagttttgtagctgcatgcatgcaagccaca

SEQ ID NO: 54123 - DNA, 500 bp, Triticum aestivum
  Clone ID: PAT_TA_54123
aaaaaaaaaaaaaaaaggcttttgaaacccgggggggcataaaaaaaaacaggggggacaattttgggacagaaaaacatttttgcccctgggggttaaacagggggggcctcccggtaacatagatggatcccgacataaaaaaggggggcccccaacacaaatagataacccccagttctgggccaaaacaggccctggtagatagttagacttttaaactaaaaaaaaaagggggcctctcaggggggaatttttttccactggggattttcagctcaccccaaggggaaaaaaaaaagtttttgttttcaaactcggaatcatcataggcctaaaaatcatgggcatactcagaattattatccgaggggacaaacttgatgtaacccaagggggtttgatcaacatcaggggcacaaacagggattttgacattttaaatgatcttggcccactgggccttgggccaagcatttttttttttcctcgcttcaacg

SEQ ID NO: 54124 - DNA, 564 bp, Triticum aestivum
  Clone ID: PAT_TA_54124
caaaaaacatttggaaaaacagttcgactaacaattggccggatgggaatcaaggaaccctgtttccaaaactcataaaaagaaaccgacggtttcccgatttgggcaaaaaaaagaaattccactttaaatccattattgcccacctgatggcccaaaagcgacccttttccagggatcaccctttttttccaactgggaaatctggtcttccaattaatccattttaatcgccttgcgctcccaaaactttcgggcggaaagagtgttgcaagcacccttaatggcaacgatgtcgctaggatcatcgatgatgatgggaggcaaaggcttgtctcgcttgcgggcgttaacaccagccacaaaaaaggggcgaggggatggcaatgtacccaacttgcgacggttcaggggaggagactgaaaatcaaagcccaactcgtcaaacttcatctaaggggaggtctcaacgctcagctgaggaacagccgagggttccgaagggaacaaaaaaaaccattctccacccggggcgtaaaactcggcattgccaaagttggggga

SEQ ID NO: 54125 - DNA, 624 bp, Triticum aestivum
  Clone ID: PAT_TA_54125
ccagacataattatgattcaggggtaggcgatgagcacatataacaatacaaaattacatcgcagcatgtcccaacgaaactcggccagtctccttgcatactagtactacatgaccccaagagaaaatacaagtaataaagtagttaaaagggatgctagagctacaaattatgaagtccggtgcttggacaaaacattgcatatcctaataatattggcaaaccggacatattttccggtgggcaccatgcatcatccttcgaacaacatccatcacgtgaggcggggagtcgtcttctttgttggaagctagatccagcatcttggttcgggggcgtgcaaatgctgttccttcatcggaaggacaaagggcaagcatccctagttgaaacaaacaaaaccacctagtttcttctacctcctcttgaccggggttcgagatctggaccgcttcttcctgcgatgattagaaatagtttaacaaatagagtgcgattacagggcaggtgctgtagcacacacagggctccagattaacacgggtccgcattcctgaaaaggtctaggatgaaccacggatggaatgccgaccctgtcatagcactccacgacaaaatacaat

SEQ ID NO: 54126 - DNA, 712 bp, Triticum aestivum
  unsure (1)..(712): unsure at all n locations
  Clone ID: PAT_TA_54126
gctaaaagatcatctcttgttttcttttaaatataaaagaagacaagtctgtcttagtatgagttcttcctcctccatctcatcatgtatcctacatgacacttctaagatagcatcatcgtacattcctaataaaaatcgatcggagctgctaatccatgccatgctttgcagtagagaccacactacaaatctacgcagcaacattatttttcccaaacgacacgattaaagcttcccaaaagacactgatttaacctcccctgaagtatccaaacctccatttcttcgcttaatttgcagtaataaccaaaacagaaagtactaacaacgggtcgaccccgccccaccacccaaactaataatcaacgaacgaacaaaatgagcaccgtccatagctgtcaatcaacacatgcccctcagcgagtgacgccatcattctcgatcttcttctgcttgtttttttctcgatcttctgcttgctgctgctgcgcccgtctccgtcgccatccgtacacaacttattctttcttccagagacggcgcagaatcttggccttggctttggttttgcgattgctgcgctattgggtgtgcggcgggtggtacggctgctggctcgagtcggaccaggaggccgncgccgtcgtccccgggtagggcgccagcgcgctctcccagcttcactccgccgncgngtngccctgctgct

SEQ ID NO: 54127 - DNA, 420 bp, Triticum aestivum
  Clone ID: PAT_TA_54127
ccactggcaaacaaaaattaaagacgcaggagatcactaaagggaatcacactttaatccggggggcacattaaatagatagaaggggaaaaaaatcttgcccagctaaaaaaaaaaagctttttcgccgctggcgggggggaagaccccgaacggggcggcggggaggggggccctggggtcgtcgccgaaaaaaacgtcaacctggacgtaggggggcccgtcaagcttaaagtcgggaaggaccctctaagggggggcccgctcggccttgagggggaccatggagcggaccgtctcggggaggttgggcaggggagggcaaggctttttgtcccactcgagcagccattggagggagcgggtccgaggggccattttcaccatccttttttccttgatcgcaaacccctgggacgg

SEQ ID NO: 54128 - DNA, 406 bp, Triticum aestivum
  Clone ID: PAT_TA_54128
ggggttttgggggtttttttttttttttttttttgggggggttcatctcattcaaacggtgagatggcggccgccccaggaagataaccaaggcggccgggcagagatccagctgcccaaagagtccacctaaaaccctgctaaaccaaccacgggggtgggggggggcggccccggggaagacacgacccgacacacgactctcttatttggatcgacggcccgacacgggacacacggggcggggacgacgacggcgaaaggcgacccgcgcgcgggcggatctagagctggccgggcggggggatgaccacctgctgggagcaggtgccgttgggggagcccaccttgggcgggggggggtggccggcgggggtggccctggggcgggcgcgggggggggggc

SEQ ID NO: 54129 - DNA, 661 bp, Triticum aestivum
  Clone ID: PAT_TA_54129
cgggaaacccgcccagagctgggggcgaacaacagatccacaagcccttgacagaactggtccagccacacatttcgatggccaaaggggggggataaagttcagagtaacacataggaatggacccgacgggggcccactaacaagggatcaaagatcatgggcttatttaaaaaaaagatggcaaatctgcattctgaaaagggtcccatatctgggcgacgttgggcgggaaaaatgacattttagcccgggagcccgatgattccgaaagcaacacgggcaccagggtttccagggcttttgctaagctaatggccacccttgccaagatcatcagcatcaccatggacgaaaacaggacggccaaaaattgaatttggcccagaaagggggatatggcagtcaataatattgatgctagcaacaccatccactccagggggcacatttccaagaacaccagcaggggggatttaattttggggggccccatgcacatgaccagggggggtgaaggggggcccaagtgacatgcacccattggggggggcgccaaaaccgggcacatggaaaccggggagcccttccttgaggccggggacacttcccggaaggggggggggggcccctctccttccggggggaaaaaaagggggcc

SEQ ID NO: 54130 - DNA, 545 bp, Triticum aestivum
  Clone ID: PAT_TA_54130
gcaattagaagattcaagtagctatatacgcaggtggcacaataaaatgcactagacatgataatatagagcattgtgtccaggagcacttcttagtgatagtggccaattacatcatatactccctccgtccgaggtgatgaaacctgcctccgcaggtgatccaatccaaatcatgccaggccgatgaacaaaaatggcatgcaacatcacctaacacacacatgtgagctgaaaatcaatatttctttggttctcaaaaagggacagtaccagcaacaatggctgatgatagctgcaagcaaagcagtatgcatcagctgggagcaaaaaccacggttgcactttcatattattaacaacaacaaggaatgggaaactggttaacttgaagtatacctgaaaagaaaacacggagttcaatgtcattggctgacctgccagaacattgggggtccaaaaaagggaagcacaatgaataaaatgaataggaaaacaccatacaaaggccttgcctagcatccaagatccaactttatgcctac

SEQ ID NO: 54131 - DNA, 507 bp, Triticum aestivum
  Clone ID: PAT_TA_54131
gggaacaacatatgagtacatgaacataaatcaggccctagttgcagattcacacatacatacatacgggactcgctccatcactccggggaggatatatactggatactactacaaaaaatttattcttccttggggaaaactagctcatcagtacctcgatcttgagctgatccatggacccatacaggcccctggaggttggtggcctaatcgggtacatgctgggggccctactcctcaggggtcccacaacgagagccatggagccgatgaagtcccccaactccaacaagcaaagggccaaaaggaaaaatgtgctggggaaacaacatcctgggcatgggtcggcaaaacggacaaaaacaacggcgccgctggccatccaagggccggcggcagcgagcgtgagccaaaaccaaagcaagggaagctcggggtggaggggtgggaacagcaacgccagcgccgccgcggttgcctgggacccggtgcaaaacaaggccc

SEQ ID NO: 54132 - DNA, 479 bp, Triticum aestivum
  Clone ID: PAT_TA_54132
ccccgccccccgaaaaaggtccaaagaaccaaaccttgaacaagggacaaaaagccaaggcctgggacaatggaaaaagatccaaaactcccgatgggaccttaaaaccaagggggggagcaaagtggaaaaattgatcaccggccaatctgcgcttaagggcagggacactgtttctttggaagcctaaaaacacatctttcggggccaagggttgatgacacttattcgttccacgacactgggctatctcaccacgaaataagttgaggggggtggacccttccaaaaaactggcctagctctgtgggagagtaagctttggggggatcaaccccaagggcggcttgaaaggttccttggagggctttcccgtgggaagaccaaaaccaatggtagaaggaacctctgtggacagagtgtcaattttaacagccccaatccccctgtggatgcacccactgaagagaaagcggtcc

SEQ ID NO: 54133 - DNA, 503 bp, Triticum aestivum
  Clone ID: PAT_TA_54133
ggggaaggaaacaagtttggaaatttaaaaaacccggcagttaaaaacctggctaaacttttgattacacccaacttgggcgggaaagggggtccccccacaacatataaaaggggaaaacccatggtgttttttatcgggggggccgggggggacaaacccccccatgggacaaaaaaacaaacagggttttttttcccctgacaggcccctactttaatttgaggccttgccaaaaccggccctgtagggggccctggactcaagctttttggggtaattaaacttccccccccccttcaaaaaatcttcgggggaaaaaaaacccccctttgtttaaaggggggccatcccacccccagggcaaacattggaaaaatcggggccattgaaacccccggccaacttaaccacagcctaataatcaatttcaccatgcttggggaaaccaacaggggggattttcaggaccccggccctggattggtcattcgggaggggaa

SEQ ID NO: 54134 - DNA, 232 bp, Triticum aestivum
  Clone ID: PAT_TA_54134
ggagggaaagggaggggggtaaagttccccaacaaaggggggggaacgaatcggtttccatccaaaaaaaaaaagggaaatgttgcttgggcaggggaaccacggggctggggggatcatagaacaaggtagggatcatgcaaaattgagggggggataatgggggatgccctttttgggcccaacggcctaaatggcctaaccaagggggcaggcggaccagcatgaaggg

SEQ ID NO: 54135 - DNA, 705 bp, Triticum aestivum
  Clone ID: PAT_TA_54135
ataataacattactcattgcaccaaatggagcaaggcgcaaaggccccacttcaaaccaagagttatttgaaaataaatgcttgataatttagcaatgataaggatgcttttaataatgaaaaataaaagaaacatagcctcaaactatgtaatagcaaaatgcgggcattctctctatacaattttgctatgttagctggaacttaggaaaccaggtcacgctttgtccttgatgcattgttggtaaattctcccctcccactcctctgggtccatagcattttgtccttcacagcccctttataggttagatgcattgtaattcctttattttttaaaggacctgaagaaacaatgccttgcaaaatgttcgtcgtctcttcagtgatggagccactctctgccatctcttcttttttgaagggaactggacaaacaatgaccaacaccatgtttatgacatgttggtctaattaggaaatacctatacggtccacggtgtgattctcccttaacaatgcagtatgggacctcccaatttcctgcacagggctgggaaccacacaaccagctcaactgggtcaacatcatgagcgatgatgaccagctgagggttgctcgcaagcgtttgcctgcaactttaaactgaaccagcaagttatcctttcagaagcttacagtagtaatgtaaatagagatggttg

SEQ ID NO: 54136 - DNA, 483 bp, Triticum aestivum
  Clone ID: PAT_TA_54136
gggaaggggcccctctcgggtggatgggaagccctcttgcccaaaaggcctaaaaaggggccccacattgcccgtgcgggaccttgcaagcttgttgacttaaacctaccgtttgctggcaaagtttctcaaaatgactgggagggggcgataaaataacttgattccctgtaccacaatttcccagggggccaaagcataacggttgggtggccaaactggggggggcataataaaacaaaaaacaagctgggcggccatttttgggtcttatttttccccccgggttttacactttttccttgggaaagggctgggtttcccttttaccccaccgtcaaaaaaagccataggggcacccccatacccaactgggaccttgaaagaacccaaaaccaaactttttaacggacgggggagggaaatcatgccccggtgaaaaacactgggttttttctttttttgaaggtcgacccacctttt

SEQ ID NO: 54137 - DNA, 593 bp, Triticum aestivum
  Clone ID: PAT_TA_54137
agaagcttcttaaaaatcttgcaattaatggaacgtccggccggtggcccaaagtaacactgctacccatgtcaaactaccaccctttactgactacggacccgatcgatcgtcctctgttggaggaaaagccaaatcaaatgtagaatatggggcaagtggggcgcccttgcacccctggttaacaacaaggtggatacgcgaaaaccggccaatgctgcatgctgcttctcttctacctactcgatcgaaccacgctgctctccatcatccctccctcaccgatcccaataatccctttccttgttgccgcgcgccaactcttttgcttctgccgccatgtcacctcgatctctttgcacggttgcgccttgatcgctctccggccatggaccacgcgcgcggcttggattggagggaggattgagatcatcttggatgcggcggcggcggtggctgcagctcgggcttcacgccggaccggccgtggcggtccaggagctcccgcgccagcgtctgcaggtcgccgctgccgctgccgctgccgttgcccgccgatccctccgccatgctgctggagccgcccctgtgcg

SEQ ID NO: 54138 - DNA, 669 bp, Triticum aestivum
  Clone ID: PAT_TA_54138
catacaaaaaaagataatctaattgatacatgcataagtgatccactttatatagtgatagtgggtaatggaaggacgaagctttgcttctcttcttagacctaacatattgaccctgatgtagcgatagtgagatttacatctgaatcaaaccactgctgctggtcctaaaagacatatcatcaacagccaatctattcaagtcgatccagcgaagcaggtggtacgctgcaaccatctgaccgtccatgaaccaacaaactggaagcacactattacgggagaaaagtctatgcaggtgatgacacactaaaatattgtttagcgtctatataggcttccagatgaacacacattttagtctttactatattcctataactctgtgtggagcaaaggtactgaaagcaaatgcaaatattttagtcttgactatattccttgaacacatcgtaattcagactcgctgacgaagggagatgaccgaagcaacccacctgatcccgagctgcaagttgagtaggagctcctagtgcttgcgtcaattacgatggtctcctcctgctgcttggcctgccgcggggacacccacttggcgatgtgtggcgcccgggacgacggcggcagaagcgccccgctctccccgccgtcctcacgctcctacgcgcg

SEQ ID NO: 54139 - DNA, 565 bp, Triticum aestivum
  Clone ID: PAT_TA_54139
ggaaaggggagggggaacaaaaaaaaaaagggggggaaaaggaagccaaaaaaagggggggtcccaaagggggggggggcccaaaaaaaaaaaacagcaaaggggttaaagctttttttcgctaaaaggaaaaaaaaaacctttttagggggcccaaccccagggggccccattaaaaaattccccttacctaacattccaaaaggggggaatcggcgggggagggtaaaccctaaggaaaaaacgcgggttggcaccaagggggggccctcttttaatattaaccccggggccccccggcccttttccccaagggaaaaaccttttttggcggggggaggctgggccttttgggggctgggggcctcctttttgggcacccccttggttgggggggcatttgcctttttggccccaaatttgggcttttccttttcgcgggggggggggccctttttccccaccccccttggggagcgggggggaacccccttggccccggggggcgttttcctggggggggggggcgggccctccccccggaggggaaaaaaagggggggggg

SEQ ID NO: 54140 - DNA, 769 bp, Triticum aestivum
  unsure (1)..(769): unsure at all n locations
  Clone ID: PAT_TA_54140
cttgtcctcggacttgtacttcccagcatcccgcatcatgcgatttatctcctccttcctcagcccacccttgtcgatggtgacgctgctcttgtttccagtcgtcaggtcctccgccgacaccctcatgataccgttcgcttcgacttcatatgtcactttgagtcatgccatgcccttaagctctgggggaataccagagaccgtgacctgtcccaggaggttgttgtccttggtaaacgccccttcaccctcgtacaccgggaaggtcacgctggtctggtagtcgtatatggttgtgtaaggcccatctctcttaacggggatggtggtgttcctgggtatcagcacgctcatgataccagggtcacccatgataccccttactatctctaccccgagcgagagtggtgtgacgtcaagaaggatcaagtcctgcaccttctggttgccctcgccgctgagggtggcagcctgtacagcagcgccaatggcgacagcctcgtcagggttcatgctcttgcataatttcttcccgttgaagaaatcattaagcagctgctgaatcttggggatcctggtggagcctcccaaaagcacgacatcgtggatttgaggcttctccaccttggcatcgctgaggcacttctcgacgtgctcaatgcacttgcgaaagaggcccatgttgagctcctcaaaccnggcacgagtgatgggcccatagaagtcaatgccgtcgtggagcgagtcaatctcatttttggcctgc

SEQ ID NO: 54141 - DNA, 526 bp, Triticum aestivum
  Clone ID: PAT_TA_54141
gctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaactactcct

SEQ ID NO: 54142 - DNA, 750 bp, Triticum aestivum
  unsure (1)..(750): unsure at all n locations
  Clone ID: PAT_TA_54142
cgccgctcgcacccgggagcggcgccattgttggcttctagccttctattcgccgctcgcacccgggaggccaccagcctgcctcctaacccttctctccgtcgtcgcggccctatccctggccgcgccgggcctggcggcggggaagaccggccaggtgacggtgttctggggacggaacaaggccgaggggtccctgcgcgaggcctgcgactccggcatgtacaccatggtcaccatctctttcctcgacgtcttcggcgccaacggaaagtaccaccttgacctctccggccacgacctctccgccgtcggcgccgacatcaagcactgccagtccaagggcgtccccgtctccctctccatcggcggctacggcgcccgctactcgctcccgtccaaccgctccgcgctcgacctcttcgaccacctctgggactcctacttcggcgggtccaagccgggcgtgccccgccccttgggcgacgcgtggctcgacggcgtcgacctcttcctggagcacggcacgccggcggaccgctacgacgtgctggcgctggagctggcgaagcacaacatccgcggcggcccggggaagccgctgcacctgacggcgacggtccggtgcgggtacccgccggcggcgcacgtggggcgagcgctggcgacggngatcttcgagcgcgtccacgtgaggatctacgaggagagcgacaaggcgtgcaaccagtacggggcgtgggaggaggc

SEQ ID NO: 54143 - DNA, 637 bp, Triticum aestivum
  unsure (1)..(637): unsure at all n locations
  Clone ID: PAT_TA_54143
nnttttttttattnnttttttattttttnntttttttttttattttttttnttttttttttttttttttttttttttttttttttttttttttttttttttttttttttttttttttttttttttttttttttgggaaaaaaaaaaaaatggcctttaaaagggggggggaaaaaattgtttaaaaaaggggggggcccaaaaaaaaactttgggtaaacccaacccccaaggggggcccattgggggggggtttttttgcccaaaacaaaaggattatgggggggggggggcaccccaaaaaaggggggtaactaggaaccctggggaaatttggaaaaggggaaaaattcccattttttggagggaaagggaaaaggggtttggccctaaaaaaaggggggtccatttcccaatggggaaaagggggaagggggggggggtgggccttttaatttgggcctggaaaaccccatttttgaaaattgggggaaacccccctatggggttaaacccaaaaggggggggggaccccccctgaaaacaaaaaattccccccattgttttaaaaaaaaccaaattgtgaacaaaggggggggcaaaacctttaaaaagggaaaaaactgaagggccctttt

SEQ ID NO: 54144 - DNA, 444 bp, Triticum aestivum
  Clone ID: PAT_TA_54144
gggcccaaacaaggggccaacagggaaaaaaaaacgggggaaccaaaaggggggccaaaaaaaaaaccaggggaggcaaaaggggggaaaaaaagggcaaaaaaacagggggggccccaccaaaaaagggaggggaaaaaggaaaaacacccgggtggaccacccaaaaaaaagccttaaaccaaaaacccactcgcaaaggtttgggctttaaaaggattgggggaaaaaaaaaaaaaaactcaggacccctttttaacccaaaaaaaacggaaatcgaaaaaggcagggggtgggcccttgaaacccaaaactaaacccttggctgttgctgaatggccaggtcaaagggcacttccgggggctaaagggccacagtttcaacaaagggaagggggggaccaccacccagcttccttgcaagggaaaggaaggggtcccaaa

SEQ ID NO: 54145 - DNA, 323 bp, Triticum aestivum
  Clone ID: PAT_TA_54145
caagcaacagactttggcattaaaccttgggccttaacaaaagggggggacaaacaaaaccaggggcaggcatgcaggcccccgcttaatcgggtacgtacgaacgggcccgggcgaacagttttaaaacactcgatcgggggtacaagacctaacagtttactggccgggcacaaagggggggggaaaggcccaggcgttgttgttgacggggccggcaagggggccggcaaggttctcgagggggcccttgccggggacaagggcctgcacaaaaaaccccaacatggaaaacagggggggggggccgtttttgatctcct

SEQ ID NO: 54146 - DNA, 548 bp, Triticum aestivum
  Clone ID: PAT_TA_54146
gaaccaaaaaaaacagaccacaataaacaggtcggggccaagaaaaaaaaacaaggaaaaaaaaaaaggggccgaaccccgcaccaaggaaccaaaaaaaaacaccaaaaagggcacaaaaaaaacgaaaggaaaaccacccaggtaaaccaacccaactgaaggggcaccaagcgacccctgggaaccaaccgtaacaggggggggggaacccttaaaaagggggccaaaagggggggaaaaatggaaacaaaggggcccaaaattaacaccaaaaggggccaaaaaaattggacgaaaaaaaaccccggggggggggaaaatgaacccacccaaaaaccccaagggtttgaaaaaaaaaaacccgggcaaacgggaggagccccccccaaaaaatatggggaaaaggaaaatgcaaaccccctctcccttaaggaaaaaaactgggacaaacacaagcccataaaggaaaaaggtttggaggaaaaaaaacaaaagcggaagaggggggggggaaaaacacaaaccaaaaggggggggggaggggg

SEQ ID NO: 54147 - DNA, 224 bp, Triticum aestivum
  Clone ID: PAT_TA_54147
gggaaaacggggttttcctttaaacatttaaggcagttaacaaaagacatccccataaatgataaatacataagggccacccatgaacaacaatgttgattgaactctacaaattaaaaactgcgctaacgaaggggggcggacacatcaaaaaaaaaaaaaacaccgcacaaatacgggtgcaaggggcgtcactgctgggggttgcactcttaccttgcgaa

SEQ ID NO: 54148 - DNA, 509 bp, Triticum aestivum
  Clone ID: PAT_TA_54148
aaaaaaccacaagggggggtttttctttttaaggaaactcaaaaaacccacaggcaaccttttaaccaacccaaaggacccaagttcataggggcccgggaacaaaaaaccccaaaaacccggaggaaaacaatttggaacaaacccaaccggttagttggacaactttttgcaaacaaccctttaggggcggggggatttttaaaaaccaaaaaaaaccctaccggggggggggaaacctttctttggggggggggccaaaccaaaaggagccggggactaaaacggggggggtttttaaaactaaaggggggggtgttaaacccctataggggcctaaggggatttgggacggcccaaaacgggggggggaaaaaggaaagcccccatttggggcatgtaaaaaaaaagaacagggggcatggaaacacccccgggggggggacccgggggatcaaccgttttttttgcccttttggccctttcggcctttttcgacccaaattttt

SEQ ID NO: 54149 - DNA, 661 bp, Triticum aestivum
  Clone ID: PAT_TA_54149
gcaaaggaaaacctgaatgtgaatcagcatgcgaggatacaatcgttcacaataagcatgtgtgccaaattcaagctgtaagctgtactcctatgcataaatctcaccattgtccccgtgtactatataagataaaaatacgggacagcaaggggaaagaaaatattaaagtacaggcatggctcttctgcacatctcaaagcttcggccttggggtttgcccgggtgtcttggccctcctaatcaacgccttttgggtcagcgacacgatgagctctccttgccggttgaacatacgtccggtgacgaatcccctaccaccatgtgcggatgggctgtcgatcacatataacaaccagtcatcagctttcacaggcttgtggaaccacatcgagtgatcaagactgagagagtatgtcttcaaacccctcttccggtgcggatttaggctgacgcctgaatatagtagatccgaagcatatgctacaacgcatctatgcagagctggatcatccgaaagttttcctctagctctaaaccaataatgcaggcttggttcatgttgagatttagaatcttggcagaacctcatttcaatgggccaaggtacaaactttttcttggcagctgagttcctatattgcatcggaaaccgtgggat

SEQ ID NO: 54150 - DNA, 215 bp, Triticum aestivum
  unsure (1)..(215): unsure at all n locations
  Clone ID: PAT_TA_54150
ctccgtcggcgccgcccgccgccgagtcctcctcctgctggtcgccgaggtcgccttcgtcgcgggggtcgccgcgctcgtcctctccctcgcccacacccacgaccgcaggtccatggtcgncggcatcctctgcgtcctcttcggcaccggnatgtacgccgcgccgctctncgnatgaaaatggtgatccagaccaagagcgtggagnacat

SEQ ID NO: 54151 - DNA, 572 bp, Triticum aestivum
  Clone ID: PAT_TA_54151
cccacgcgtccgcccacgcgtccggcggagctcggtaaggagaagctcgccgggacggtcggcttccacgagcgccacgtgttcctctgctacaagggccctgaggagtggccgtcccacgtcgaggcctccgagtccgaccacctcccccggcacctcgccgccgccatcaaggcccgcaagcccaatctgaagaagagcgtgagcatttcttctccctctccctctcggtttgctcgtaattggctgattttgagttgtgacgtggtattggtatgcttctgctctggtagtgttattttattttggttgttgggagtgggaactgcttgctggtcgctccgagcgtcggatttagctgctactagtactagtattaggctagcactgcgtatggtggtgctgggttcctgaagctgcaggagatcgcgacccttaaagctaatcagtcgatccgattgcgattagtgtatttagtttccgagtgctcttgtttcagtttattgtttctgaattagccagtagaactcgcttattatggtgattagttgtgttggtatgcttactatttc

SEQ ID NO: 54152 - DNA, 247 bp, Triticum aestivum
  unsure (1)..(247): unsure at all n locations
  Clone ID: PAT_TA_54152
gacccacgcggccggctggtcctgaattctattgcatgtgggggagccgcggcggtncttccatgggtccccngcgctgctgctgctgttcattccggctgttggaccttgnttcttccctctcgtccacgcttgttcaaaaggcgggtttttttggggggcgagaagctggggatttctttaggggtccttcttggtttgtccgggtcccccctttttttatttggggctggtgggacctcctggc

SEQ ID NO: 54153 - DNA, 647 bp, Triticum aestivum
  Clone ID: PAT_TA_54153
ccaaaaccctagaaccttctccattccgctccctcgcggagcttggccaccatgagcgctcccatggagatctccttcgacccccacccttctcatcccgcgctgcccgccttcccctccagcccacccctggagcccgcagccgccgccacccctcccgcggtctcgtcctcgccgcagccgacggcggaggccgtagtcgcgcccaccccgccagacgacaaggtcctcgtctcagttgaggtgctgctgcacgccacgagtacggcccgcgccgaggacgtccgagtagcggtcgagaggatgttagaatctcgaagtttaagctatgttgatggtcctgttcagatacctccagacaattcttttcttcttgaacatgtcaaaaggatccaaataagtgacactgatgagttgattgagaaccacaaaatcctgttgttttggcaagtcaaacctgtcgttcatgtattccagttgaatgaggatggtccaggtgaagaaccaagtgaagatgacacactctctagcttcatgagtgggcgctacctgccaaagaattgatggatatgggaaagctactatatgaagtgggtctcaagcagaggttgctgagatatgctgctagtgctttgctatttactgaa

SEQ ID NO: 54154 - DNA, 118 bp, Triticum aestivum
  Clone ID: PAT_TA_54154
accggtctcgtgccagctcgccctccagggttttagtcttccttgatggcggacctgatgaagctcggaagcctggttaggcagagtgctgaggcgagcaatgactagaccgggtggg

SEQ ID NO: 54155 - DNA, 625 bp, Triticum aestivum
  Clone ID: PAT_TA_54155
aaaatataaaaaaaaaaaaaaaaaaaaaaaaaaacaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaggatccaaattttactaccccgtcctttctttttttaattttttttttggggcccccaaattaaaattactggcccgttttttaaaaacccggaacttggaaaacccctggctttccccaatttaatccctttgaaaaaaatccccttttccccggtggggtaaatacgaaaaggccccaccccattcccttttccaaaaatttgcccaccttaattggaaaatggaaccccccttttacgggccttttacaccggggggggtggggttttccccccatgttaccctttaattttccaaaccctttaaccccctttttttttgttttttccctttctttcccccccctttggggggtttccccgttaaatttaaaaagggggcccccttttggggttccgtttttttttttacggcccccccccccaaaaaattttttagggg

SEQ ID NO: 54156 - DNA, 654 bp, Triticum aestivum
  unsure (1)..(654): unsure at all n locations
  Clone ID: PAT_TA_54156
ggccgcgctgccgctctactacggcacgcccgcttcttgctcagggttgagctcagtgagggggcccttcacgccgtcgcagtggatggagctggagcaccaggccctgatctacaagtacctggcggccaacatcgccgtgcctcacaacctcgtcgtccccatccgccggagcgtcacctcgctctacccgtccgcctactttggctcctccacattggggtgggggcctttccagctgggctactccgggagcgcggacctggagcccgggcggtgccgccggacggacggcaagaagtggcggtgctccagggacgccgtcgccgaccagaagtactgcgagcggcatatgaaccggggacgccatcgttcaagaaagcatgtggaaggccagcctggccatgccgcgaaagcgatgcctgcgacggccgctgctgccgcccagcccggtgctctcgccaccgggggcggcggcggagctcccgccggcgccgncatctgccacgagcagcaaccgttgaagaactacgccgccagcaccattgatccttgttcactgcaatataacaggggaaatggtgagcaagcagcaacacgagtgcgagcaagtgcaggactccgacaccctcttgatgctgaccttcatgagcg

SEQ ID NO: 54157 - DNA, 141 bp, Triticum aestivum
  unsure (1)..(141): unsure at all n locations
  Clone ID: PAT_TA_54157
gcgnaaaaaccttcaacggtggcatccatggaggtcggcgggccgcngaagccgacgcgcacaggcggctgagccagaccacgcgagcgctgcctatggatggaaaatggtcacgggcctgtcccttggtggtgccggtgc

SEQ ID NO: 54158 - DNA, 625 bp, Triticum aestivum
  unsure (1)..(625): unsure at all n locations
  Clone ID: PAT_TA_54158
attctctttctcttttgttaagattagcgggggagcttcttgctaattgagcaatcacttccagtaaaccctcctttgcgtttcacttcaattttgtgccaatggaggccagagacggcggctcagcgcccctgccgtgctcctacgcgccgctgccggaggatgccgaggccgccgccacggtggggcgcgtgcgccggactgctggcctgctctgtgccgccctgctgctggcgacggtggccgtgctcctagtggtagccgcgctcgccggcgtcagactcgccggccagctgcccgcgggtggcatcgtcgtcatgtctggccaccagacgacggtcgacacggcgccgatgagcgccagcagccgggggcctgagtctggagtctcggagaagacgtccggcgccggcgcgcgcggcggcatgctgcgcgcggacgccggcggcaacgcgttcccgtggagcaatgccatgctccagtggcagcgcaccggcttccacttncagcccgagaagaactggatgaacgaccccaatggtccggtgtattacaaggggtggtaccacctctttctaccagtacaacccggacggtgccatctggggcaacaagatcgcatggg

SEQ ID NO: 54159 - DNA, 100 bp, Triticum aestivum
  Clone ID: PAT_TA_54159
cggacgcgtgggaagtaaaagcgacgagacacggaccaaacaccaaaatgctgtgatgcaccgatctccggccgatggcgacggagacggggacgacgct

SEQ ID NO: 54160 - DNA, 203 bp, Triticum aestivum
  unsure (1)..(203): unsure at all n locations
  Clone ID: PAT_TA_54160
gcggttcccacgtggtcttcagcggtggcatcgactgcctcaccaactgcgtcgtcgtcagctggtcgacctccagtgccgatacatcatgtccaactatttcaggtcgatcgaccatgaccatcatgatgcgncatcttgacaaggggggagaccacatgcctgcatactaagnaacatnnncagatcaacatgcaactaga

SEQ ID NO: 54161 - DNA, 269 bp, Triticum aestivum
  Clone ID: PAT_TA_54161
agggcgtcggcatggccttcagcagactgagccccgacggcgcggcgacccccgccggcctgatctcggcggcgatagcgcacgccttcgccctgttcgtggcggtgtccgtgggcgccaacatctccggcgggcacgtgaacccggccgtgaccttcggcgccttcgtgggcggcaacatcgcggggttgcacggcctgttctattgggtcggccaggtgctgggctgcgccggcggctggttgctgctggggtggctccaccggggg

SEQ ID NO: 54162 - DNA, 550 bp, Triticum aestivum
  Clone ID: PAT_TA_54162
tttttttttttttttttttttttttttttttttttttttttttttttttttttttttttttttttttttttttttttttttttttttttttttttttttttttggggcgggggggtcaacccggaaatcccggcccgggccctgggggggacccacttttccttaaaggggggaaaataaaagctggggaaaaaaagggaaaaaggtgtttcctggggaaaattgttttcccataaaaatcccaaaaaaaaaaaaacccgaaaaaaaaaagggaaaagccgggggggccaaaggggggagctaactaaaattaattgggttgccccaactgccccttttcaaaaagaaaaaccggggaggcaaattgaataaaaaaaaaggccaaccgggggggagaggggggtaggaaatggggggcaaggggggtttttttttaaacaaagaaaaggggaaaaacgggttagccctaaccccccggggcctggaaaaaggggaaaaaggggacacacttggttagcccaaaaaagaaaaaaaaacgtaataagggggg

SEQ ID NO: 54163 - DNA, 498 bp, Triticum aestivum
  Clone ID: PAT_TA_54163
aaaacaccaaccataaaaaaacgggaaggacccccggaaaaaaaccgggggaaaatggggttaaacgcccaaaaaacgaccgggggggccggggaaaaaggggggaaaaaatcaacatggaggggccgcccaggggacccaacgatgggtttttaaatggattctacccggcccactcactcatcgttccaaacagggggtttatagggccaaagttggagctttccccaaccaaacgggaaaaaaaacaaaaactaggggggaaaaaaattaacatatgcattcaatcccttccatggaaagggcccaaggataatgatgaggacggggaggaggagaaccagtttcctccacccccccacggctcgcccttttaaacttgttttttgaaaaaaacccaaacaacccccccctggggggggaggccaaccaaaaaaggaccaaaccccctttctcaacccctaaaccccccaaaagaaaaaaaggaggtttctccct

SEQ ID NO: 54164 - DNA, 393 bp, Triticum aestivum
  Clone ID: PAT_TA_54164
aaaaaacactgggaagtatataaaacagggccttaaaacaaaaaaaaagggcaaccagcttataagggcaaaaatccccagtttatctttgaaaaaacacaataatccatgggttcagagcccccccccgccaaatgggcgagctaaatgcaagggcccagcacacggggccactggcggacctaaaaaaaccagggccgaccttcgggaaataatagggcccaacaaaaaattgggagggccggggggaaagccccggaggcggcccctgggggaatggaaaaccaccttgggcaactgggggaacgtagatctccgggtttgggaaaaaagaaaccccctctcaagcggggggggggggagaaaaaaacggggtgggggcactccccttcc

SEQ ID NO: 54165 - DNA, 491 bp, Triticum aestivum
  Clone ID: PAT_TA_54165
ccccgaagtttggctttcatgtaggtaaatccccgcaagaaaaacttattgtttgtaggtaataatgcggcgtccttcgaggggtagtgcatcctaccgtaacaatttacaggaaaaccaaaagtaatgcaacagcaacggcacctatatcctggagttcctacttttttaaacctaaaaatggaatggatttgcttgtatctaaaaacaacaaacttcgaattacctcaaactatgcatcatatcaggggcaaggtactcgtatccgaccgttagccatttgctcctccaagcaatacgcgaggaatcttccgcgtgattccaagagctttttccgcgcggtttgaatcagcgtgtgcataaaagaagcagcgtcacagcacgaagggttggaaacaaaagcgtgtgccaggaaaggaagttttctaaatgatcttccgctaaatccgtcgaacagttttgcaccttcatgcagtaagttggaaagatga

SEQ ID NO: 54166 - DNA, 411 bp, Triticum aestivum
  Clone ID: PAT_TA_54166
gggggggaaaccgggataaagctccctttggaaaaaaaaaggggaaagggttttaacccgggcgggggggttggtcaaacaattttataatcattggaaatagcaaaaaggggttataaaaaaacaaggttaccactcatgctagcctttattgggaactcaaaactgaaacaaaggaataagcaacccccttaaaagaggtcagccctaaaatttgacactttaaaaaaaatggtgtttggggcggaagcacccttgaactccccgcctgggaacttggagaacaagacggggcttcctggggaaaccgacaaggggtggcttttggcttccttgtggagagagcccggaccaacagatacaaatggtccaagggggggcttctccttggggggctggggggaggaaaaa

SEQ ID NO: 54167 - DNA, 439 bp, Triticum aestivum
  Clone ID: PAT_TA_54167
gaaccaattgaaggagaattccaggtcatagtcaaaaacatcacgaccaaatagctccaaacataaaaaagtgcatacatgctaacaacagtgataaagggacaaaatgacaagaggataacccatgaaagtctaaggcctttcagctaaagtactcataacaccaacatttgataaatataaggggatagctactatttcctcattccttttcctcatcaccaccggcgtcccccccaccacttgccttcttctggttcttttttttccccctgcctgcagggcctccgccgaatggacttgtcaaagaaaaatcaatgtgcttctcaaattcaacccttaccttgaaccacgggacattgacaattttgcctgccaaccctgatgtgggtttgccttatcaaaacacgagcttggggggtgggattttgcccttccc

SEQ ID NO: 54168 - DNA, 424 bp, Triticum aestivum
  Clone ID: PAT_TA_54168
aaaaaaaaaaccccagttttttttttaaaaaagagggctaatttttgggggggagagaccccgaggttgaaaccaaattttacatactgaacatgacccaacaccggaaaaaaaaaaagttttaaaacagaaccagatgtttgcttttaacccttttaaccccaaaaccctaaaaaaattcatttaaactgatcagttccctttgcccccacaaaaatttttggggttgaaaaaactgccaaaaacaaaagggcccaattgtttaaaaaagaaacaaaaacacccactttaaaaaaaattttaacaaaaaaaaaacaaaaaaccttttcccaaagcacaaacaacaaaaaaaggggaaaaaaaaaaaaagcaaaaatgccaccctttgctaaaaaccggagggggaaggaaaaggggcacgacc

SEQ ID NO: 54169 - DNA, 593 bp, Triticum aestivum
  Clone ID: PAT_TA_54169
catgaaacaagcagttgcataaacttgcgtttaatcccagttacatacagaggctaatcaagtcactcgattcattccaaattcatatacagaggctactcgagatttattgtcgttcggtcaatccatccatgtcatatagaattagaagtcgcatcacaaatttgtgaaacaagcattacatccggctaatcccagttacatgtcgttactctaggttctgtagcagaaacaaggggttgcatcacaaatcagtgattataaaatcgatctgggcatcacttttcttctttgcaagtaccaccttcgaccgcaagcttctgttggagctcttcagtgatgagcgccgatttttgcttgttttggtcaccggtctcttcatcatcagataggtatattacattagcagaagcctccatgtcatggggatcactgggcagcccaagacctgttagccattcattcagtgatgctgaatcagaatctgactccgccgagcctgatgctgaaggcccaacacctttacttggcaacacattcaacgcagctgatgaaacgctagatgtcgttgtcaaaccttgctgggatggtta

SEQ ID NO: 54170 - DNA, 521 bp, Triticum aestivum
  unsure (1)..(521): unsure at all n locations
  Clone ID: PAT_TA_54170
gaccacaggatgaaacaggagctgnntnattgngtaagcacaggctgnaacaaaacccacactggatcaacattttgaatcctgagcaaagncacatttnattggaaaaagccttttccanatctttttnanaagattttttttacactggtaagagggttttgccttttttgaacagatgctccaaacataaaccattnanngggagcnggtttnctttgnnccanctgnnnnnngggnnattttnccnnncacaaaaacnacnnnantnnannntttttttttnnnnacacccacaccgtatatctggaaataccgggggtgggcttttaaaaccctgttacccaggccaggttgtgtttttataaagaaagggcgaaaaataaaaangtttttttttttggnggnggtttnaaattgaaaaatatttttaagggaaaaaccccaaannattaaaaaaaaccccctcgggccctttttgggggggnttttttttttttnnggggacttccctttttttc

SEQ ID NO: 54171 - DNA, 372 bp, Triticum aestivum
  Clone ID: PAT_TA_54171
gatatgcaaatttgaggtagaaaaatgttcatttttcccaggtactaactcgcaactggtctgcaaatagactgactaaaaagatctgtagattaaacatgagatcctactgacaaacacgaaatgacattctattctaggttcaaatatgcaagtagtgaccaccttaattagaagggtctcctcagcctgaggccatacaagtaaggcggcccctgacaaagaggatctcatgctccatgggcaattctggtatccttcatttgcatgtactactctgggccatgggcctcttccctggtcagtttcttcgcatgttggcagcaaacacactcatcattgctcacacgtgcgccgctcccgcgcccatca

SEQ ID NO: 54172 - DNA, 698 bp, Triticum aestivum
  unsure (1)..(698): unsure at all n locations
  Clone ID: PAT_TA_54172
tttttttttttttttttttttttttttttttttttttttttttttttttttttttttttttttttttttaaaccaaaacaacaacgggattatacacgggcgcgggatactgccgcgccttctgcctggtaaaaaaaaacaaggggactcaagaaacaacactcatcaactgcaagcaggatttttagactactggtgggacacgagggctaccaacagctacaggctacagctacaaatttacatttataatcatgcagttaaaacccataccttattttaacatatatgcacaccatatttgccaagctattaaaattgatcgggtcgggggttgaaactaatccctattgtaattaaaaagggagttaacatccgggggcaccacaaaatgctgtttttaaatctccccaaacgggaaaaaatgtttccttttagggtaaaccggtactggggggctggaaaacccgaattccgggcctggggcaaaaataaaacacggcatctcccaaattcaaattaaccttgccaattttgaacaccaaaaaatttccccaaaacacccccctggaaaaaaaaaaaaaaaggggaaacccttttttaaacccccaaaaaaaagggcccctacaccaacccaaaaaaaaaacaaaggagaggggggnnnaaggaaaagaaaaagaaaaatnnnggaananggg

SEQ ID NO: 54173 - DNA, 439 bp, Triticum aestivum
  Clone ID: PAT_TA_54173
caggaaacaagtccggccggcatgtttctattaagacaactgaactcggatacaggtgtcggtaggctgaaaagcttgattattccaacattaaatataagcatgatcgggatacaatagcttatagtcatggttactcagtcatgactgtcctagtttggaaaacgattatgcttggcatactatgcactataataaggacccacggcgacgagcgtcgagaagccctccgacgatcaacgccggacggaggtagaagacgatgaacaaatcacaactccctcaaacacatatacatagaggtacacacgcacacacgcagcacaacctcggaataactctcacatcgaccgggcgcgtactacagtcccgacgaagactacatcttctttgggcccctccccctcggctcggcacacactgtcaccgtagcgcggca

SEQ ID NO: 54174 - DNA, 200 bp, Triticum aestivum
  Clone ID: PAT_TA_54174
cgcgtgcggggacggaagcccgttgctaacccaaggcgccgtaattaaccgaggccatgtcacagtacgacggcggactcaccggagtgtaccccgaggaggaggatgaccgcctaggcgacctggggggggactccgactacgaggactacgagtacgtccagtgtattaccatggcgggagaggatacatgtgctatg

SEQ ID NO: 54175 - DNA, 677 bp, Triticum aestivum
  unsure (1)..(677): unsure at all n locations
  Clone ID: PAT_TA_54175
gtcgccggctggcgtgcgccgctccactagccgccgccgttccgggggctcgacaggatgacgacgaagctggcccacagactgccgccgcggcccgtgactactacgtggacatgttcggtgacgacgcagtcgatgtccgtgccggcgcgaaaacggcggtcgatccatgcggtggacatgcagctaacccggatcagccaacagcgcagcctgatggttccggtgcgacgacggaggaggaagccggcggcgtggcgggctgggactacgtgtacgatccggcgtcgggatactactacagcggcagcacggggcactactacgacgccgcgtccgggtgctactggtccgcgtccacgggcacatggttctcctacgacgtccacggcgaggaggcgagcactactccggcgcgcacgtcggaatattggatgtggtcttcgtcagatcggctttccaagttcaagttcaaagtgaccttcctaagatcaggtttcggtagcgcggagttcttgcacatgtgatcacctttctgacaacatggcgcgtttcaatctacagaatttcacttggcagtcactatatgagcttttcggatctcaaaatgctggtggtctcatagctcgcagatgtgatcccctttgctgancagatggcgtgtgactacaagctac

SEQ ID NO: 54176 - DNA, 601 bp, Triticum aestivum
  Clone ID: PAT_TA_54176
cggacgcgtgggttttttttttttttttttttttgtaacaaaggggtaacaaagacttcatcgattattgattgaatattcacgtagcattacatcgttggtaacaattaatagaagcaaactcgcaaaataaaaaaaatactccacgcacgagacgcaccacgtacgtactcatgccaatgcgtgcaccgcagatcactttcactcgtacagtcgtatcacacacaggtactataggcaccagcacaaaccatatgaacgctgcgacgtcgatcgatcgatcaatgcttgtcgttggcctcggtggcgccggccggcgccggcgcgtcgtcagcagcggcgtcctcgtcggcgaaggcggcggcggggaaggagcggccgatgccgacgttggacttgaagtagaccttgtcggcgccgtcgaggctcatctccacgatgggcacccagagcatcatctgcttgctccggaccccggtcatccgcttcatccgcccttcctccacgtacgccgtcacctcggcgtcgtagcgcacccgggtgcccgtggcgcggaagtggtgctcgtagggctttccctgccgcatccacacgtacccgg

SEQ ID NO: 54177 - DNA, 768 bp, Triticum aestivum
  unsure (1)..(768): unsure at all n locations
  Clone ID: PAT_TA_54177
gagaggggaagcgcaggtgggtgcgtgatggccgccgtcgccggagccggaggaggcgacgagatgctgctgcggcgctcgcgccggcggctgcccctcgccgacctcacgaacctctcctccgccacctccgccatcacccgcctgaagcgcaatccccagcaccgcacgagccccgccagcagcgccagcagcattggctcctccaccgttccccgcatccccacgcctcctccgcccgcggccctctccgtttctacgactaagggcaaggataaatccacaagggagcttcaaagttccaatactcatctaaacaagattcaaaagatcagtaaacctaaggtgaagactggaggcgtgctacctgggacgtcatctcctcctagcaaaaacacaaggaagataacaaggaaagagcagccgcgcacagagtctttgatctcccccttgtatgcctctagtaaaacaaaggcgaagactagtggagacgtgctgcctggggcatcaacacctcccagcaaaaagataatgaaggtaacaagggaagagcagccgcgcacagagcctttgatctcccccttgtatgcctccagtaaaacagggctgaagactggagacgagctgcctggggcatctttgccntccagaaaaaagacaagcaaggtaacaggcagcagcgggaaagagcagctgcagatggaggagatgagttgcgatgagtccctggtaccgagcgaggatttcatcaaggagcggagggcctac

SEQ ID NO: 54178 - DNA, 532 bp, Triticum aestivum
  Clone ID: PAT_TA_54178
cccacgcgtccgtatcactccggcgagcgagcggcagccatggtgattgctccagtcgcgacctactcctcctcccgagcgccaccgccggcgaggagtacggcgtaccgagcgcgcctcgccgccgcctggctctcctcgagggcgtcctccttcgcctcgggcagcgggctcgccgtggcggcggcttccgtggcggtggccgcgcggcccaggcggacgggcgcggggggcggcgcgctcgggtgcaagtgcctgttcgggctcggcgtgccggagatggtcgtcatcgccggcgtcgccgcgctgctgttcgggcccaagcagctccccgagatcggccgcagcgtcggcaagaccgtcaagagcttgcagcaggcaggcaaggaatttgaaacagaactgaagaaagaacccgaggaaggcggtgaccagcctgcacccacaacccccacggtggtgcaaagcgatgacgatgaagagaaaagggagctacaggcatgttgtaggaaagagagcacatgaggaccgg

SEQ ID NO: 54179 - DNA, 375 bp, Triticum aestivum
  Clone ID: PAT_TA_54179
cagcgtggtctcgatttcagaagttggaccaaaagcaagatcagcaacttaaccatcttgcttttggtccagcgtggtctcgatttcagaagttggcgatccttttctttcagtaatgttgttagcttgctatgtctcggtggctgtagtgttgtttcctgattttgtgatgtttggaacttcctgttggttgtaatgacctaatgggtgacttggatcttaaactcgctaccttagtttatgtcattagctgtaggtgttaagtttggtagtttgtatggaaccctggtttccgttgaatgaaatcagacggggggaggcccctctttctcaaacaaaaaaataaaaaatatatatagcgagtgcccttttttc

SEQ ID NO: 54180 - DNA, 530 bp, Triticum aestivum
  Clone ID: PAT_TA_54180
cggacgcgtgggcgccgccaccgcccccgcccccgacgcggccccctcccccatccccttctccctcgccgccgacgccgacccggtcctcggcaccgcgctcacgctcgccctgccccccgacaccgcctccttcctcctcaccttctccacctccccgggcgcctccgcgctgcagtggctcgccccgccgcagaccgcctcgggcctccccttcgtcttctcccagtgccagtccatccacgcccgctccgtcttcccctgccacgacacccccgccgcgcgcatcacctactcgctcctcctcaacgtgcccgcgcagctctccgccgtcgccgccgcgcgccacgtggcgcgccgcgaccccgtgccctgcgaccaccgcggcgcctgcaacgacgcgctatggtgcgcgcccggtcggatcgtcaaggagttcgagatggcgcaatgcgtgccggcctacctgttgggcttgggcggcagcggagatcgggtcccggagcctgggggcccaggacacgggggta

SEQ ID NO: 54181 - DNA, 108 bp, Triticum aestivum
  Clone ID: PAT_TA_54181
ctaacacaaggcccacttttttttggtcataacaggtctgaagagagggccgaaatccttattcacaggaggtttactgaactgggaacaccaacccggacgcgtggg

SEQ ID NO: 54182 - DNA, 309 bp, Triticum aestivum
  Clone ID: PAT_TA_54182
gaaaaaaaaaaaccggggggggctcaacatacatgtcccacatttttttgccacaaaacaccgataaccaagggggccacaaaccacaactaaggggttctaaattcaaatttcaaaaccctagctcaacgaccaccaaaaagtagtaatcggtagaaaaaaaaacatggcaccatgtcacaagtgtgggacccccctcccaggtttttagcgctaacgggtacttggtatataacgttaacgattgcctacttggtacagaaacacaacctacttccttaaaaaaacccggcgggtcatttcccttta

SEQ ID NO: 54183 - DNA, 279 bp, Triticum aestivum
  Clone ID: PAT_TA_54183
aaacatgctaatgtgtatatattttccttttaatgaaaatgcaacgctcctgccagttcaaaaaaaaaactacattcgttttctgcacagcctcaaagaagaaggaagcagaggaacgccaccatggcgaggaacacccacatttgccgaaacctgcgcgccacccgcctctgttggcgcgccattctccagccctcgccgttgcggtacaactactgtagatgcggccttccagtcccaccggcccttggaggccatgggagtagcaccgccagcgcg

SEQ ID NO: 54184 - DNA, 192 bp, Triticum aestivum
  Clone ID: PAT_TA_54184
ggataatggttatcttgttttattcgtgtatttttcaccctcatggatccaaaacatatgagcaagatgaagtgcaatctatgtggaaagcctactggtaacttacttagttctgatatttcataatagctcttgccagcgaccagaagaaaccaaacacactaaaattgaagacaagcctcgacgatccta

SEQ ID NO: 54185 - DNA, 475 bp, Triticum aestivum
  Clone ID: PAT_TA_54185
tttttttttttttttttttttttttttttttttttttttttttttttttttttttttttttttttttttttttttttttttttttttttttttttttttttttttttttttttttttttttttttaaaaaccaaaaaaatactttttgggggaaagggggaaaaaaaggggggggccttttaaaaaaaaggggaaaaaaaaaaaaaaatatcccgttgggggccagggaaaaaggaaaaaagttttgggtttttaggaaaaaaaaatatcccgaaaccgggggaactttataaaccaaaggggaaaaaaaagggcggcctttttaaaatcagaaggagcttgggagaggaaaaaacccttttttttggccgggaaacactttagggggccccctttggggaccctttgggggaaaacaacggggggtctagaacctgggggggggggaagaaggggccccaaaacgtttaagaac

SEQ ID NO: 54186 - DNA, 382 bp, Triticum aestivum
  Clone ID: PAT_TA_54186
aaggaagttgctctgcactgcaagcaagggagtttgtttaaagcatttatactgggggggcgggtacaaaaaaattggatcaccccatggtacacatatacataatatactaaattataggccccccccttggttatatacctcacacatcggtttcctcggacaccacaaacaggtcctcctcccagacccccgttagcttggaactgaaaagggaaaagtcctccacatgggtgggccctttgtcgcaaaaaaacggcctcaaaaggatttgggggccatcaaacccagcctccaggatctcaatgacctcgttcatatggcgggcgatcaagaaaccttatttgaatacaccataatggccacaacgcaccagtttttt

SEQ ID NO: 54187 - DNA, 183 bp, Triticum aestivum
  Clone ID: PAT_TA_54187
aaaaaacaactcctcttgtcctgaagccaaagggggtttttccttaaactctccagagtacaggccaatgcaccaacaccccttttacacgtcgggataccataccatttcggctcagttaagactagaacgggggaagaagtttggtttgggggtaaagaaagcaagggtggacgaaataca

SEQ ID NO: 54188 - DNA, 765 bp, Triticum aestivum
  unsure (1)..(765): unsure at all n locations
  Clone ID: PAT_TA_54188
gagaattccccatccccacccatggcgtccacctccgtcgtcaccctcaacgtcggcggcgagctcttccagaccaccgcagccaccctctcccgcgcaggcgcttcctcccctctcgcctcccttggcccctcacccgccgacgcgccacacttcctcgaccgcgaccctcgcctgttcgccggcatcctctccttcctccgcagtggccgcttcgcgtctcctcctccctccgccgctctcctcgccgaggctcggcacttctcactcgacggcctcctcctcgcctccctctccccggcgtccaccttctcccccctctctctgcgccccaccgccctccttcccctcaccggccgcgtcgctccctccgccgtggccatatccccctccccgcacgcggcctccctcgtcgccgcgcacggcggggtcgtcaccagctttgacgccgtgctcgcctcccgcaccagcgtcctgacgccgctccccaccatcgactcgctcgtcgcggtgtcccccgccctcgccctcgctggcgcccgcgactttcctggcgtccagctctgccggttcccgggcgacgcccctgccacggcttcggaggctctatattggccagactcgccttcttcttctgtgctgtctatggccgccacagcggcctcagaaacggcgtcacagtggctatttgccagcttcgagtccgcgcgacggaattcgagcgccgtggtgggcgtncgatctgaattctctgtcacctgtgct

SEQ ID NO: 54189 - DNA, 469 bp, Triticum aestivum
  Clone ID: PAT_TA_54189
gtaaaagcactccggctggtggttgctgccaacttataatccaaggtagtcagctgctgtaaaagcagagggttcctgacggttgatcctgtcttctcaagaatttcgtggttctactctttactgctgaatgcagaaacttcagtttcctgccgtaaatctccaaaaaagttacaagacaactgtaaatctaacggcagcggagatgtcatgcctcaggtcatcacgggttccttgtcatgaacaatcgttgtgttgtctttgggctaggagttctcctgtcgaacatcagaacttcacgtcgttaccttgcctgtgtacgaaagacactgtatatactcgtagtggtacatcctgtccgtttctcgtccatggagtaaataatttgttcaggctataaaggtagaacagtgcaacgcagatctttctatacgtgaatttatgctttggcccgcgggttgaagcctgt

SEQ ID NO: 54190 - DNA, 547 bp, Triticum aestivum
  Clone ID: PAT_TA_54190
cggacgcgtgggcggacgcgtgggggagattgacaagtccagaagtccagatccccaattttcctctccctccaaatccgacctcgcttccgaattcgcttctaccccctccctcctgatcccagccccagccccaatggcgtccaccgccgcgccgcccgccgccctcgtcgcccgccgcgccgcgtccgcgtccgtcgccgcgccgctccggggcgcggggctcgcggccgggtgccagccggcgcgctcgctggcgttcgcggccggcgccgacccgcgcctcgcggtccacgtcgcgtcgcgctgccgggcggcgtccgccgcgcgcgggacacgcgccgtcgccaccatggccaagaagagcgtgggcgacctcaccgccgccgacctcgagggcaagcgcgtgctcgtgcgggccgacctcaacgtgccgctcgacgacaaccagaacatcaccgacgacacccgcatccgggccggcatgcccaccatcaagtacctgctgaggaacgggaccaagggcatactgaccagccacctgggg

SEQ ID NO: 54191 - DNA, 718 bp, Triticum aestivum
  unsure (1)..(718): unsure at all n locations
  Clone ID: PAT_TA_54191
cccacgcgtccgaccaaccaaccagtgcagagctcgatcaaaccaacccatggcatgaactccaccgcaaccgcgatccatctacctagcagatggctgccaactactactggggtatgtggggcgccgccactaccagtagtacagctgctacctgcccggcgccggcgtcagcagctgagccgtcttgggaggagcaggcgttcgcgcgggacgccgcgggccaccttggtgccggctgcgtgtggccgccgcgctcctacacctgcaccttctgccgccgagagttccggtctgcgcaggcgctcggcggacacatgaacgtgcaccgccgcgaccgagctcgtctccggcagtgcgtctccccgccagaccatcaagcacagccccagccgacaagccctcatgatcatcatgagcaccttcagccagggatgcagtatagggcggcagtgcgccctaaatctccacaggatcagcaggccagcatgataggcccctctactacctctccttcctatatatccagcatcatcaaagagagcaggaacaaggtgttcatctccatgcctgctgaggaagcctcggaaagcggcgatgagggggaaaggaggaagcgcaggcgtgtcgtcgatcagcctccagcggtggcgctaccgttcttcctgcggtggtcaccagcatcaagtgaaagagagggaatgcanggagctgacga

SEQ ID NO: 54192 - DNA, 650 bp, Triticum aestivum
  unsure (1)..(650): unsure at all n locations
  Clone ID: PAT_TA_54192
caaaaatgtcaatctgatgtgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacgaacatggctcgagaaagcatgctcgtatgtgaatgctatcggtggctatgtatatgcacggacgcataatattatacaatatgtcgactatatacgttntaatggtaacc

SEQ ID NO: 54193 - DNA, 213 bp, Triticum aestivum
  Clone ID: PAT_TA_54193
gcgttcggaaagagaaaggcgaggtagaagataaaatcaagaggggaaacagggtataggcagagagaacagaaggagcgatgccgatctggataggatgagtcggaaacatcactgcaggactggtagccgatggacctgcggaggtcgaagtccaaggcgggcgacctaaagtccggcaaggtggtgaaccaggctctggtgacggtcgcg

SEQ ID NO: 54194 - DNA, 319 bp, Triticum aestivum
  Clone ID: PAT_TA_54194
attccagttttactatatcaagtaaatttccgatttatctgcatactatctattgttcctgtactttcatgtcaaatctgcttgtgtgtgcgtgatgcatttgctcctgttcttggtggtgtcggactctaatttggaaattttgtttcactgttaagtactctgcagaaccaagttggaaggttgagaacggttggataatcttagggtcttgaagttcacgtataagttcacggcaattcactgaaaaactgggttcctgcatttccatatacagagtcagaaagcttgacaagctggaaaggaagtgaactggttc

SEQ ID NO: 54195 - DNA, 529 bp, Triticum aestivum
  Clone ID: PAT_TA_54195
aagatgtgaacataaacaaatcaaagttgatgagacatatgattatctcccacaaggcactttggtgtctcagcaaccaggtcgccaccgaccaccacgatggctcaccgcgatgccctcccgccaccctatatacgacaccagtggcgagatgggcgggatctttttggcgtgccggcacacaggaacgacacacaccatacaacctgaaggatacgttcatcaggcttgacatgaccctcaccgatgccgcattgccgcttctgttgctggagatcagccaaagagttagcttgttgccgctttgcttcaatggttgcttcaatgctcttcgactctccgtaatgagcagctgatggtgcttggacgaaacaattgatcgggaaatgggtagtgttgtgctggtggtcatgtatcagcccactatctataaaacacctaagatgattcttcaggacccgatatattccaattactcatttgggtcttcttactgtgatacatggttttacttagtaatcttaagatc

SEQ ID NO: 54196 - DNA, 218 bp, Triticum aestivum
  Clone ID: PAT_TA_54196
gggctgagcctcgggctcagcaacaacctgctggggtggatcctcctgggggtcttcggcctcatctggtccctctacaccatctacacctctgacctcgacgaggacgaggagtccggtggcctctcgctctagatccacctcctctcctgttaatgatctgaatgtaaacatggtggtggtcatcggtgtaaatttagacatggctatttgcatct

SEQ ID NO: 54197 - DNA, 310 bp, Triticum aestivum
  Clone ID: PAT_TA_54197
ggactggattcaggcaatcttataacaagcatatgcaacacaaggtttatttgaacccactctttatatatcctctggttggtcctcctttttagggcacaacaaacagttacggggccaatatggattcctccacgggaagactttcacctagtcattgggctgaaaaccaggaaaaagtgacgcgacaaaccctatcacgaccagttggaccttttttaagatgcccccaagccaactgggccggtttgttttttcctttgccccttgctggttctagatgcccgttgatgcttctgggtcctgggtc

SEQ ID NO: 54198 - DNA, 533 bp, Triticum aestivum
  Clone ID: PAT_TA_54198
gctacaattgtatcccttatcattgagcaataaagtaaccatgtgttcctcaaaagaaatgttgtttttgccgtcaaccatctctcttcagagtagaaggcgttttctatgccacatattccaattgtttatgtttacaagatcccaaactcaacaacaaccagacacatgacagacagaatgaggtatcactatttcaggtagcagagttaactaccaggaaggcacattacatgaggtacagtttaagagctcgcctcaagacatctccaaggctactacaggctatggtaaagcacatgacaagcactaactctacaacaaatcttctgtcggtaaagagcagctcgacaccgcaataatccacaccaacaaattgctaacggggtggagacccaagaccttttcgcgggcagcaccaccttgagcttgggttgttaaattggtcccgctgcaaacgaacacctttttttggccctgaaatttgctttctctgctttaagttcgcccacacatgaacaaggccatggccg

SEQ ID NO: 54199 - DNA, 340 bp, Triticum aestivum
  Clone ID: PAT_TA_54199
caaaacaggcaacacaatttttttaaaaatttataaatccacaagatctgccttaacatcataaacggggtggtccaaaacagggggcaggacacaggatatcgaaggctgggttttgtcccatccttgaacgagcagggaataacagcctctttctttttttaccacccttccggggggggctgtaagttgggaccggggaaacatcctaaaaacgtccaattttaatgccaaaacgggcaaaagctttaagcccagtttggcccccagaacctggagtttttgttttgtttcccccagtagcccggggtttaaggggcaaaagagtaattccaagctc

SEQ ID NO: 54200 - DNA, 511 bp, Triticum aestivum
  unsure (1)..(511): unsure at all n locations
  Clone ID: PAT_TA_54200
agcagatcagcccacaatagtatttggcatcaaattcattagatgtatcaatttgcacgacttttacaacccaatctaccagagagcaaccggagatttacagatctgactaccatccatcccaaattcacaggtcaaatcaagcagtccccacgaaccatcacttcgttccggcgggcgcgggcgccccaaccgccttgccccggagcttgacctcgagcgcgcgctccatcttggcgagcacggcctggacggggacggccttgccgctctcgtactcctgcaccacctgcgcccgctcgctgatgcgcttggccagctccgcctggctccaccctttggccacgcgcgccttctggatggccgcccgcacgtngccggccacgcgctccagccccgccggctccgtcatctcgtccagcttcctcgcgggcgccggcacggccgcggcggaggccttcttgttcgtgcccgccggcaccttgcgcaccgtctncaccggcgcgcccgt

SEQ ID NO: 54201 - DNA, 612 bp, Triticum aestivum
  Clone ID: PAT_TA_54201
agaaagaccaagcctagtatgtgatttattgaaaatatgatgatatgtctatatacagatggtcaatgccaaacacactgcaaatgatacgtcaatagatttgccggagtggcatttatggtacaaaactacaggcagagaattgcgggcgtggacaatccgtcagagtccagtgctcacatcttcctcaggttatcaagccgtgcctgcaagtcatcatctattccaccgtccatcccgcccgcagcttcagcttgaacaggcgcttttcccgctgcaaccggcatggcgactgcggtagccggggccttgacaagctcagagttgatgtcgatgccgatttcatcgaggacctggctaactagctcttctgtttcttcctcctcctcatcaccctccaaggcatcgtcgatggcatcacccataacctcgctgaccatttccatcttctcattttgcatctcaaagtcccgcattatcttctggagtgctggtagattcatctgcctgttcatctgtgacatggcttttgtgacgcccttcatggcttctcccattgcttgtgttgatttcagggtctgaatacgaagagatacaccttgcaactgggac

SEQ ID NO: 54202 - DNA, 488 bp, Triticum aestivum
  Clone ID: PAT_TA_54202
gcatgagcaaattaaggactggaattatcaccacatcatttgagtatttgagtacatgagaatacaacacaagaggggtacatagaacacttttagtacatggccagcagacccaagtgtaaatgactgaaactatcaccgtccaacaagcattttgatagtacatgacaaaaaaggtctaggagtatcatttttcgtcctgttttagtgcttcctgttaatcgagcttcatccgctggcattccagcttctatacgagagtttttaacctccaaaaactcttatacacttgatcagttcaaactacctagctaagaacaccaaataagtaggtgtcagttagaaacatacatgaaatagcatatcttgagaagagagacattcattatgtccaacttcattcacagctccaaccaaggatacaaaacctagatgtcaaacttaagatgaaattccgaatacacatgtgaccaatcagaataaccctt

SEQ ID NO: 54203 - DNA, 486 bp, Triticum aestivum
  Clone ID: PAT_TA_54203
ggggagggaaacaccaaatttatccttttaaaacttaaaaatgccgctacaaaaaaaaagaacgggccattaactactttgccccaaatccagggaaattttacttaaaaaaaagggttccaaagacaaaaatcgtcaatacaaataaaaagggaaaaaacctcctttcaaaaaaatcctggaaaaatgattttaagtaaaccaacaaagccaaggtttattttttaacaggaaaccagggaaagttttatcctttggaaaaatccaacattggtttttaaactcttatttttgaggatgttaaaatcattttataaaaactttaaaccaccagtgacattgtcaaccattttaaccggcccaaaaataaccataacccttctggaattaagggcaaactgtgtttttccacatcaatgggaatgggaggtgggaaaaaaaaaattttgctctcccttgaaaaaaagcatatttttcttacttttt

SEQ ID NO: 54204 - DNA, 365 bp, Triticum aestivum
  Clone ID: PAT_TA_54204
gccttaggcgattaatttttggcatgaattagctactgctactacaaaagactaatgatacgatgcaacagatcaatggcaacgcatgtgcccgggtgggggatgcatgaactgtgatcggttgggccaagcaatatactggatacatgagatgggtatcaattaatttgatcggggacgtgaacattggacgctagctatgcaagggggagcaagcgtccttcaagacattggaaaggggctattgtgaagataaaactacttcaagtgatattgatgctacacaatataaacaagaaaagtgatctatttatgcttaaaattggggaacagttcgaataacttgatatactggggggatatat

SEQ ID NO: 54205 - DNA, 601 bp, Triticum aestivum
  Clone ID: PAT_TA_54205
aatgcagaaacaagttagcgtgcgtaaggtatctgcagacgtcccaatgataaggtcaaacaccaataagctgaccaactgtctggagaaatggagactggtggaaaaccacagtgcttccgttgaacagcctgaaaaggaaaagagctcaaccagcatgagcctgcaacaaaaacagatgatactaatggtttggaggatattcacaacttcaagaagtgcttcctgaagatgttcgcgcggcacgacaagattgtggttttcatggagactgtcataagctcggtcaagcaacagagacatggcatgattgaatgcatccctgtcccatgcaaagtttgaaacaaagtgcccatgtacttcaagaaggcaattgatgaagctgaagacgaaacctcttagacacacgagttcagttccaccaacaccaatagcattgctttgttgtccatgagacccatatagtcatctacgctgcctcaaaactagaacccatgaagcaagtgaaacttctttcattatcattagatgcttagtctttcttcctacgaagggtgtcttgtggctcattcaccttaactttgctttcactgggcctgtt

SEQ ID NO: 54206 - DNA, 767 bp, Triticum aestivum
  Clone ID: PAT_TA_54206
caggacccacgaggacgccgtcgccgccacgctccgggccggcctcgacctcgactgcggccccttcctggccgtctacaccgagggcgccgtcgcgcagcggaaggtgtccgacgccgacatcgacgccgccgtcaccaacaccgtcatcgtgcagatgcgcctcgggatgtacgacggcgacctggccacgcagccgttcggccacctcggtccgcagcacgtgtgcacgcccgcgcaccaagagctggcgctggaggcggcgaggcagagcgtcgtgctactcaagaacgacggcgctgcgctgccgctctcacgagccgcgcaccacacagtcgccgtcgtcggcccgcactcccaggccaccgtggccatgatcgggaactacgccggtcagccgtgccggtacaccacgccgctgcagggcatcggcaggtacgtgaagaccacattacatcaggcgggctgcaccgacgtggcatgccaaggcggcaaccagccgatcgccgctgccgtcgacgcggcccgccgtgctgacgccaccgtcgtcgtcgttggcctcgatcagaaggtcgaggccgagggcctggaccggacaagcttgctccttcctggtcgccaggcggagctcgtatccgcggtggcgaaggcctccaaaggggccgtgatcctcgtcctcatgtccggcgggcccgtcgacattgccttcgcgcagaacgaccggaagatcgctggcatcctgtgggcagggtaccccggccaggccg

SEQ ID NO: 54207 - DNA, 722 bp, Triticum aestivum
  Clone ID: PAT_TA_54207
ctaacacgttatcagcacgccctctggcggagcgatttcacggccaaactgccggcagcgagtgcgcaacgtcgcgatgccctctggccctgcgtggcaaaggaagccaacgctccagcgctagcaaaggcagcgcatggcgccgcgcacacctcaatggctattccgcggcaacgcggtgttcccggcggaaggcggcacccatgcgcgaccgcgggctcccggcagcgcgtccacaggagcgaccaacggccaacgcttggaccggcggctctgtcctgcgcggcagtcagggcagaatgagaaagaacagaggttgtggatctccatcgattcaagaattgaaggcctcaacaacgaacgccaatggattcccatcgattcattgatgaaaaaggaaaaagcatcgccagcggcgcccgcgtccatgcaccttgcacacacacggctgtccagcgatgcgtcgaggtgtctgccggcctctaacgcggggcacgactgcgtggccttgacctctcaacgcggaggcgctgcgcggacctcgacgaaacggcaacgccctccggcgcaccagccatgatgtggcggcgcggcctcggcgcgaggccgcctaaagcgtgaccgcggagatgccccgcgcacacgtgcatggcgagatgctctcccactacgcatgccgaaaacgacagcctcggcgcccgcggaggcggcacccaaccgcg

SEQ ID NO: 54208 - DNA, 475 bp, Triticum aestivum
  Clone ID: PAT_TA_54208
actcaagccagcggcactcacactacactcatccactcacaagctaatctagcggcgtagctcacttcagtccagtcggcatggcgctcccctccaagtgcaacgtcgccctcccctacaagatcagccccagcgtcgactgcaactcgatccactgaacgaactgaagcgccctggcccgtgtgtctgtcgacgtacgtctgccgtgtgaggagtcccatgtctggagaataaattgctgctactagtactgaagcttagctaggccttggcggccagatccgtgtcgttctacctagtcgttgtgtgtggtttagggtcgatcgagttaattatccgcatgcagttcatggtgttgtggcctgggtgccggtaggttccacgagcagagcagagtggtgaactgatattgtgtgcgtcgtactacgttcgtgtctatgtaatgtgcgtgctttatctataaattatcctcgtt

SEQ ID NO: 54209 - DNA, 753 bp, Triticum aestivum
  Clone ID: PAT_TA_54209
ccgtccgggaaaatttagaggagaagctggagggcaaattgggaaatttagaagagaagatggagagcaagagccaggaagtgaaggagttggcacgttttcattccaatagacacgctgataaacacccaagatcagaaccatatcaggagggtgccactttgagtgaaccgaatgccaacattcgcctgcgtttcctggatggcctgaagactccaatttacacagacaagattatagcatctgagagcaatgcggctatcaggattggcgtctttgatggtgacaaaatgatcaatgaaggcccgctttccaaggcgaaagttgagatcctggttctccgtggcgacttctgcagtgacggtcaggagagttggactgaagaggagttcaacagccacatagcgcaaggccggcacaggcaagggtcagtgctggggggcgattgcagtgcgtggttgaacaatggggaggcatcattgggaaaaatctgcttcagagaaggatcatccaggactcccagtaggaagttcatcgtcggaggaagagtatgcacgaacaggaagatcggtggtattcgagtccaggaagctgtcatggagccggtcactgtgctggatcgtagaaatgaagcaaatgagaagaagcaccctccaagattggacgatgaagtctatcgcctggaagaaatctccaaagatggaatttaccacaggagggcttaaagatgctcagatattcaaagttgaggac

SEQ ID NO: 54210 - DNA, 738 bp, Triticum aestivum
  unsure (1)..(738): unsure at all n locations
  Clone ID: PAT_TA_54210
cttccccagccctctccctcgtacgcacgcacgcacgcgcccgtcgcctttattaacccctttgctgcccaggccattggattcgtggcgttggcgagcgtggtcgccaggagaggaggggcggcggcggcgactgttcgcgggatgagcttcggcggcgccagctccgtcgcggccggtgggaagcggccgttcgagtacgggaggacgcatgtggtgaggcccaagggcgcgcacaaggccaccatcgtctggctccacggcctcggcgacaatggagccagctggtctcaactgttggaaactcttccccttcctaatataaaatggatctgcccaactgcacctacgaggcctgtggcaatttttggtggattcccatctactgcatggtttgatgttgctgatctttcagaagattctcctgatgatgttgaggggctggattcctcagctgcacatgttgcaaatttattgtctaccgaacctgcagatatcaagcttggcgttggtggctttagtatgggtgctgctactgcgctntactccggtacttgctttgctcatggaaaatatggaaatggcaatccttaccctgtgaacctaagtgtggctgttggtctcagtggctggctcccatgcgccaggtcattgaagaacanaattgagagctcacaggaggctgcacagaaggcttcatcattacctcttnatgcttgtcatgggaaagctgatgat

SEQ ID NO: 54211 - DNA, 341 bp, Triticum aestivum
  Clone ID: PAT_TA_54211
cccacgcgtccgagaagctcaaggcttctggagtggaacatgaagtcccatataccctggatgctctcatgccttcatgaacgcgtcgcctgaggccctcaagaggaggaagggcatgggtctgactgatgagaatcagggggccattgacctggcatggtctcgcttctctacttggatgggtcgtttcctgggatctgcatgagccatatggtctctgagtggtgtatatggagtctgtcaggtcacaagaataaaatgtttgggtataatatgtagtcagtatccaatctagacaagtgtgtttgtgttatattgcaaactcatcatggttttgctag

SEQ ID NO: 54212 - DNA, 726 bp, Triticum aestivum
  Clone ID: PAT_TA_54212
cagattttcagcgtcaatcagttgaaaagagggagaaaacccgaagaacagttgatccgctggacatgtctcctgccagctcgttcgcgtcgctttgcctgcgcaggctgatccacatccactgcaccacccgcctcggctgcgacaacccgccagccacggcggcggcgcactttctggcgttggatcggcggagatcgtttgcgtcctctggcctgcgtcgtggcatcagagaaaccggtagcagcggcggcggcgcaggtggcagaggacgacctgctgcaggtttctccacctgggcaagactggcaattggctccactgttgctatcgcggcaccattcttgcactccaaatcggcgtcgattctgcggatcggaaatgaggtggagatggtgaaggacgccgccgagaccgcggcggaggtcgtggaggaggtggccacggcggccgagagggtgtcgtccgaggtggccgggcatttgctggaggacggcaggctgagacgcgccgccgtggcagtcgagcacgcctccaaggaggtcgcggaggaggctcatcttgcacgagacatcatcctcaaggtcgacgaaattgaggaggacgtcaagacaattatcgaaccgattatggatcatgggaagcacgagaggaagcatttacaaaagtagatattttttctttgcagcctagattcgtccgggccggtcacactgtctcatggga

SEQ ID NO: 54213 - DNA, 594 bp, Triticum aestivum
  Clone ID: PAT_TA_54213
cccacgcgtccgcccacgcgttcgcccacgcgtgcgcccacgcgtacggcaaacttataccttctactttgtcaaggtccgctcatttgaggaccctaagctgagagcaaaactcgagcaggctgagaaggacttccaaaataagatccaagctcgggccaagattattgatgctataaaagctaaaaagactgagcgtgctgctgttctcgcggagctaaggccattgagtgctgagaacaggcagtacaatgaagcttttaatgagaagttggaggagatgaaaccttacagaaaccgtttaggcaagttccatgatgaaaataatgccatgcgggcggagagtgcaggcttgtgctcttcactcgaagagcttgagcatgagatcaagagattgaatcaccggataagtcatgagagcatatctttagatgaggagaaacgggtgatcaaagaaattaagacccttgaaaaaaccagaccgaaggtgagttgcaatgctgctaaacgagctaaaatgcaagatacagggggtgaaagagatgccatacaggatcaggggaaactgatgcggggtggtgtacatggagtgaa

SEQ ID NO: 54214 - DNA, 228 bp, Triticum aestivum
  Clone ID: PAT_TA_54214
gaacgcacaaacaagggattattggtcagtacacgtacagggacccaaaaacaagggatcatggcaaacaaaacaccagggtcccaaaagcccaagggcaacccaaaaaaaaaacgacaattccaccagggcaaaggcagggtacaataggtcccaaagacgccggggcggaaaaacaggtacaaaattggggaaagtggcggccagcataaaaacaacatgagattt

SEQ ID NO: 54215 - DNA, 320 bp, Triticum aestivum
  Clone ID: PAT_TA_54215
aaaaccaaaaaaacatgatggaaagggtggcttttttaccctttccagccaaaaattagagttaaattcccgcccgttcataaaaccaatgaaaaacccactacagactgggcatttccatacaaaacccaaccaaccaaagctccttttcctttccctgatataaaccaaagcggggtccgaaaagaattctatggggggggttactccttggggggaaccttttttttgggggacttgggggaggttttttttttggggaaattggccttcttttcggggggggggggggactttttggggagcaacacggagttaat

SEQ ID NO: 54216 - DNA, 199 bp, Triticum aestivum
  Clone ID: PAT_TA_54216
aatagcatacatacttgataggtggagaatattcataggatgggcaagacaatcataaggaccatgctaaatgacatgcttggccttcgagttttggatcagacctgaaaataacgagcacccacatgctgccaagaaacttcagaacatgcaacatataaatgtttgttaagaacatatgatgtactgtgactccaga

SEQ ID NO: 54217 - DNA, 753 bp, Triticum aestivum
  Clone ID: PAT_TA_54217
agcgaatcgaaccccccgcggccccgaaaccctagcccgcttccccggcgagtcgaccggagccggagccggagccaggtcgggatgggcgccgaggaggacgccgccgcccgccgcgagcgcctcaaggccctccgcgcagccaaggagctcctctccacgcccgacggcgccgcccccgcccccggccccgcacccgacgcggaccagcagaatggtgaacatggggcgacagaagaacaggtggaccaaccagcattgccaggtggtcctgtggatgcacccgaggatgcttccaaggagaacgttagccccactaaggaatctaatgaggttgaagacaatggggaggtaccactgaagttcagaaactaccttcctcatgatgagcggctccgaggtggcaaggtggctcctctgtctcttcccaagtttgaagatccgatcgctgctgatgctgctgaaccgaagcagctggagaaccccttcgggaacatcgccccaaagaacccgaactgggacctgaaacgagatgtgcagaagaggatcgacaagctggagaagcgcactcagaaagctctggcggagattgcattggagcagcaaaaggagaaagaggcgctggaggagggaagcgatgcagctcaagagtgaagccctactggcggcgttccaaatatttgcgtaggacaaggcaaggagctgaattgaaacctagatgtgtttgtaatgcccggggtggactggagacta

SEQ ID NO: 54218 - DNA, 470 bp, Triticum aestivum
  Clone ID: PAT_TA_54218
gtggaggttggaggagatggggaggtgacggtgaatgggagcagcgggacgctgcgggggcgagctttctacatggatgccagccgctataccgatgggagcgaggggcgccgccgccacaccaacgggagcgagggccgccgccgccgctcctcctctgatggacatgctgcacggacgcgagcgcgggctgctgcagcagctcgccggaccatctctgacgcatgcgaggcccacgcactaacgtgagtgttggagaaggatgcgttgctagaaaagaagggagagggcggggcgaccaaacaagataggaggagaaccaggcaagatagtcaacttcgatgcggtgcttgagcagagcccatggaattcttattagatctagatgggtctctttaataagttgtggttatctgtaatggtgacctgaatgtcatgtacaaacatatatgatttattattattttgac

SEQ ID NO: 54219 - DNA, 746 bp, Triticum aestivum
  unsure (1)..(746): unsure at all n locations
  Clone ID: PAT_TA_54219
cagaaatgtgttgtgtacccgatccgttgcgagttgctagacttatcacaaattctattgccttttggaggctcgacgggcaccttgtcgtgcaaatacctgggattacctctgagttttagtaagccgaagagggtggatgagcaggtgctgattgatcgcatcgcaagcaagctgtcgccctggaaaggaaagcaaatgacaaagatagcaagattagttctcacaaactcggtcctgatggccattgtgacatacttcctcaccagcttgacactaagctcctgggcaattaagaaaattgataagatcagaagggattttttctggactgcagaagaagaagctagtggaggcaaatgcatggttaactggagacggatttgctcaccaaaagagtttggggggctcggcataaaaaatctggaatgctttggtcgggctctacgcctacagtggctctggttcaaatgggatgataatgacatgccttggaaggggtatgcaacaccttgtgcaggttcagactttgctctgtttgatgcctgcaccaaaatctctgttggcgatggtgcaaaaactttgttctggaaagataactggttaaatggatcggcaccggccaagatggctccaaccatctttaaaaggtcaagatgcanatcaatttccatcaaggagggggtccaagaaggaaagatgatgaggggcctgtctagactgaattctgaagaagactacagcag

SEQ ID NO: 54220 - DNA, 350 bp, Triticum aestivum
  Clone ID: PAT_TA_54220
cccacgcgtccgacgatgggtccatcgttaagatcaggcacggtgaaacatttgacgactacatgaagttctttgatggtcttcctgcctaggtcgttttatcttgttttggccaagcgctagccctttcatttgatgagcgcaccttgtggaagattcgtgtgggaaactattcaggtgtatgttatgttggtcatccccatcaagcgtgtggttttttatttgttagaatagagtccaacaagtttagtgattgtattagagattgaattgacttactggactgttgtcaattcttgtctacgatttaaagggcccgacccctcaataaagttcaagaatagtcgttt

SEQ ID NO: 54221 - DNA, 785 bp, Triticum aestivum
  unsure (1)..(785): unsure at all n locations
  Clone ID: PAT_TA_54221
cccacgccgtccgaaaaaccacccaaagctctccctcttacaaggtcatgcgaccgtagaccactcttcgtcgccctcaatttatattaacgccccggacggaaggcgattagcccaaggcgacgactaaagatgtcggttgtaacaaagaacccttttgcctacctcggcaacgacagtgacggcgaggagaagcccgtcgttcctgtcaagaccgttgacaagaacactgctcgcactactaagcgcaatgtcgagccccaagctcccgtaaaggccgctggtgctggaggaaaccgccgtggccccggtggtaacgagggtgctttccaggaccgtgctactggtagccgacgcaaccagggccgatccactgaggagactccccgtgatggtccccgaggcggtgctggtgcccgtgtccgtggtggacgtggcgccagacgcgcccacgagcgcgatgaccgacacacctccaagttcggtggccacggtggctccgacaagcaggctgcccagtcctggggtgctaacgaaggccaggctgagcttaaggacgagcaggccggcgaggctatcgctaaggacgagcagaaggacgccgctgctgaagaagccgctgccgctgaggctgccgccgaggaggaggccgagaagcaagtctcctacgaagaatacctcacccagcangctgagaagaaggccgctcttgagtctggcctcaaggtccgtgaggccaacgagggcagcaagctcgacaagagtgggccaacgccaagcccctc

SEQ ID NO: 54222 - DNA, 748 bp, Triticum aestivum
  unsure (1)..(748): unsure at all n locations
  Clone ID: PAT_TA_54222
gcagcagcagactcgcaagggggtagggttgtgtactctgcgcctgtgcggacggcggccggcggacggcgaaggagatggatcgcctgcccgagtcgacccggagcatgaggaagtacgcgtcggaggccggcggcctgcgcgcggcgcggcagggcccccacgggcggtcgctgacggcgcgcacggcgcacagcatgtccacgacggcgctgcgcaccaagtccaagtcggccgcgtcgctgctgcgcagggtgcccttcgcgccgctccgccccgtcctcgccaacctgcaggaggtgttcctcggcaccaagctcgccgtgctattccccgccgtgccgctcgccatcgccgcccagtgcgcgcacttcggccaggtgtgggtgtttacgctcagcctactcggcctcatccccctcgccgagcgtgtcagcttcctcaccgagcagatcgcgatatacaccggccccaccgtgggcggcctcctcaacgcgacgtgcggcaacgccacggagctcatcatcgcgctcttcgcgctcatggggggccagatcgaggtcgtcaagtgctccctcctcggctccgtcctctccaacctgctgctcgtgctcggcacgtccctcttctgcggcggcgtcgtcaacctcggctccgaccagccgtacgacaggacccaagcggacgtcagcacgggccttctcantcctcgcgtgctgtgccagtcgctgccgctcatgctgcgcta

SEQ ID NO: 54223 - DNA, 712 bp, Triticum aestivum
  unsure (1)..(712): unsure at all n locations
  Clone ID: PAT_TA_54223
cccacgcgtccgcgctctcccgctccgccggcgtggagccgtcgctcgccgtgttccggcacttcttcgcgctctgcccgttcccgccgcacggcttctacaccctccgcggcaaggacgccaacgggctcctcttcgcccggattcgcgccaagtttgtcaaggggtggaaagaggatttcttcttcttggagtcgtcggcaccgtggccgtgcccggtggagtggggggagccttccaggtcctccaccttcgatccgtcgctcaccgtgcaggagaaggccgtggcggagagcctgctgcgtgctcgagggagttccccgatcgatctcttcgcgtatctccaccaccgcaacatggccgctgccaacatcaccggggtgtcatctccgccgccgccaactcgtcaagccgcgcctgtgcatgtcgccatggaggaagccttggccgcgggcgcctcggcagggaaggtgaaggtgaaggtgaagagcgagcctggctgcgaggtgccgccttgtgcgccgtcgcctgggaagaagaggaagctgccggaggaccgcccggacggcgggagctcggcgtcgtacccctcttgcccgccgggcttctccgcccncagcaagtcaccgcccacgacaagcaaagatggtgactggaaggcggcgaggcggctgctgcagggcaccgtgacgccgtcgcgggagcgcgagct

SEQ ID NO: 54224 - DNA, 696 bp, Triticum aestivum
  unsure (1)..(696): unsure at all n locations
  Clone ID: PAT_TA_54224
agatcagcggactgctggtgatctcgaatcaccttgcaataacacccaagaggattatagacctgcctctccaggaacacaggcgctattgtgtgacgagcagggcaccgcgtttggatcagattatagaacttcatttccatcagcatttcatgatcaggacactccagagctaagcgctctgcaagaaaagacggtgttgacagggtttcgagactacctccggctgcttatcacacgcgggaagataaatgctaataactcagccgggttgacagaagccaacacatcgtccgagcatgctatggagctggacgctcgaagaaaccatggagcaaccaccggccccggtgtgagttccttcccatcagaagctgtggaaaggccaaaagcccccggcgaccccgagaatccgagaacaagtgacccctccgcatagagttgttgattagaaggccagagtcagtgtgactgttaaagtagtaggttcgcccacgaaatttgtaataacaaagcctccctattcatgtgtatatgtggatagttatagtctctgttgccggtttccggcaaccggcccgccattgtagcaccggtcagtccncgagtgtaaaagtaggcaaagatagaggtgtcccttgtgattgtgtaaataatttgatcgatactaatgattttcatatttcttttcttctt

SEQ ID NO: 54225 - DNA, 702 bp, Triticum aestivum
  Clone ID: PAT_TA_54225
accaaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcaaacaatgagcttgtgaggactcagacccttgtcaagaatgccattgtgcaagttgatgctgcccccttcaagcagtggtacctgactcattatggagtcgaaatcggtaggaagaagaaagctgctgcagctgccaagaaggaacctgctgaggggcaagaggctgaggttgctgctgctgccacagaggaagcaaagaagagcaacaatgtccagaggaagcttgagaagcgccagcagggacgtacactggactcgcacattgaggagcagttcagtggtggaaggctgctggcctgcatttcgtctcgccctggacagtgtggcagagctgatgggtacatcctggagggcaaggagctggagttctacatg

SEQ ID NO: 54226 - DNA, 671 bp, Triticum aestivum
  unsure (1)..(671): unsure at all n locations
  Clone ID: PAT_TA_54226
gcgggtgaactattcataagttttgatcaggtgcacaaaaactatggtaatatgattaataaaaaagcattccaatacaaatggcatcgccatgcatgtggtacattccacaatcttttctcggtaagcacatgccaattggcaatccagtatagttaccctccaacatacagcagcttacacagcaacaaaaatagttgaatattatttgctatgaaaaaaggcaggaggcacattattgctactggtttacgcatgtagaaaagacttctacctagaagcaaggaagaagtacgctacctgaaggtactgaatagcagctcatggattcactatctttttggataatagcacggagatcggggaaaaacaaaaggtagtaggaagaaacttcattaccaacattgatatcattagtgtcaaaaagcattgatatcatcaaatgtaattaggttagcagcgaaataacaatgcgtctataagaagacagcagccaacttccaacatagcaaaatattgatgtaagaggacagaaaatgttgataagaataagatgcaagcgtgcaacatctacggagctntcttattgagggtggcatgtagataataagcaaccatgtaaaaactggagcagcgtcagggaactcgaccatgcangacatactcgcgag

SEQ ID NO: 54227 - DNA, 343 bp, Triticum aestivum
  Clone ID: PAT_TA_54227
acctgaaatttttgatcagggtattttgtttttttacacaaattgaacctgtttgtgggggcgttagcttgccacaaaaacagcggtccgtgcggtttgggtgggcacccaaaaactgagggcgccgaattactggttttaaaaacctaacggacaaccaagatggggcgtcaagggattaaaggaaaaagcccatatggggccatgaacccaaacagggacaccccggtgaagttacctaacaagggaagaacatcttcatcaccagaatgattcctgagggaaatcctaaaactcctacagaacggccaagggaaattcttactgcggcaaaagcgctccc

SEQ ID NO: 54228 - DNA, 548 bp, Triticum aestivum
  unsure (1)..(548): unsure at all n locations
  Clone ID: PAT_TA_54228
gtaagnctgtgggaagtcctctagaaggcggcgcgcncnncttttttttttnnttttttttttttattattattttttttttnnttttttttnnttttttatttttttttttttnttttttttttttttttttttttttttggaggggccccctaggggtataaaaactttatagggggaaaattataagaacaaaaggactatcactcgggggaaaaaacgaggggagaaaaaccaccaaacccaggccaccaacgaccataaaaaattaaaaagggcaggggcttgccaaaaaaaaaaaaacaccacgtttcaacccatgggggaacctccaaaaacaaactggtccaaaaaaacttaatttggaaacccacccatccaccctaaatgctaaaaaaaaaggggaaaaaaaatgggagaacttgatcccacccaagaaaaaaaccgttttggacacaccaacaacgggggtgcaaagcgcccccgataaaaaaaatggggccacaggaaaccccgggggagagcaacgaggaacccggccatgtttc

SEQ ID NO: 54229 - DNA, 313 bp, Triticum aestivum
  Clone ID: PAT_TA_54229
ctcgactagaccatagtcctccggcgatctcggcttcctcttcctgaacacctgcgccgcctggtccacgggagacagccccgcccccgccagtgccgtctcgctctccccgctcgcggccacctccaacgccttctcccacgcctacgcccgccccggatcccaccttcttcgacgacgccgggggcgggggtgccaacagatacggggtgggacctcgacgccgaggtccgggtctggccggtcgatgccgatgacgcgctcgttggcgccgtgcagcgctgcgagtttcggcgcccgcgcggggggcggc

SEQ ID NO: 54230 - DNA, 427 bp, Triticum aestivum
  unsure (1)..(427): unsure at all n locations
  Clone ID: PAT_TA_54230
cgctgcgcctctccgtcgtcgtcgtcgcggtcgtcgccctctccgcgctcccgcggcgggccgacgccgccccgggcatccggccagggcacaagggaggcggacgtgatcgtcgcgctgccggggcagccgccggccgtgcagctgcggcagtactccgggtacatccacgtcaaccgggccgcggggaagtcgctcttctactacttcgtggaggcgcccgtcgaccccgctcacaagccgctcgtcctctggctcaatggaaggcctggctgctcttccttcgggattggagcgttccangaggttggccccttccgtgtcgacacggaagggaggaccctctgcccgaacccctactcctggaccgccgggcggaacctgctctntctggagagccccgtgggcgtgggcttctgctaccgcc

SEQ ID NO: 54231 - DNA, 632 bp, Triticum aestivum
  unsure (1)..(632): unsure at all n locations
  Clone ID: PAT_TA_54231
ggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacagggcatatataaagtgccattgcaggttttgtcaactctgacattgctttggggtttccttctccatttatctttcttatntggtcctaagaatatgtgtgtgtgcatgttcatgtaccaacatgggtcgagaaagcattcgtcggatgtgaatgcctatcggggggctatgtatatgcacgggcgcataatattatacaatatggcaactatatac

SEQ ID NO: 54232 - DNA, 597 bp, Triticum aestivum
  Clone ID: PAT_TA_54232
gcgccctgccttccccagagctcgttagggttttctcttttttggggggagaaatctcaagaggcggcaccatgctcgtgtaccaggcacaagctttccggcgacgagcttctgtcgggatacgttcccttacagggagctggagaacggcgtgctctgggaagtcgatggccattgggtcgttcaaggagcaggtgatgtggacattggagccaatccctctgctgagggtggtggtgatgatgagggtgttgatgaccaggccgtgaaggtggttgacattgttgacaccttgcgttttgaggagcaacctgcttttgacaagaagcagtttatctctcacatgaagcgctacatcaagaacctctctgccaagcttgaaggggatgacctaaatgctttgaagaagaatgttgagtgcgtcacaaagtatcttcttacgaagctgaaggaccttaagttctttgttggggagagcatgcatgatgatggcggcatggtgttcgtctactacaaggagggagctgctgatccaacttttctgcgctttgcacatgggctgaaagagggcaagtactattagcgctgagtgcgtaa

SEQ ID NO: 54233 - DNA, 628 bp, Triticum aestivum
  unsure (1)..(628): unsure at all n locations
  Clone ID: PAT_TA_54233
gctgattcgtcgtaacgcgcccttgggaagtctctgctgattgcgcacaggtggctgcctggggcttgggtatggtgggcgccggcgagggggttcgcgctggcggcagcggcgccggggtggggggagggcagccgttcgtcgaccggagcaaggtcaggatcctcctctgcgacagcgaccccgacagctcacaggatgtgcttcgcctcctctgcaactgctcctaccaagtgacctgcgccaagtctccacggcaggtgatcaacgtgctcaactgcgagggcgctgagatagacatcatcctggccgaggtcgacctgccagtctccaagtgcttcaagttgctcaagtacattggcaggaacaaggaactgcgccacatccccatcatcatgatgtccaatagagacgaggtttctgttggtgtcaaatgcttgcggctcgtggcagcggagtacctggtcaagcccgcttngcatgaatgagcctgttgaatctctggacccatgtcttgcgaagaaaacagatgctttgttttgggccagaaaaacttcttgattgacaatgcttaggttggtgcgtgtggaacctagtgatgccaatgccaatagcaccccacttcttt

SEQ ID NO: 54234 - DNA, 655 bp, Triticum aestivum
  unsure (1)..(655): unsure at all n locations
  Clone ID: PAT_TA_54234
cccacgcgtccgcggacgcgtggggtctttggacattcatgtcggtccgccgttccagagcgggcgcaactggccgacatgaatgacggtcttgccgacgcgaccggacgactgaccgatgccgcttcatcgcttcaatgcgggcgcggagaaaagtggcgctgaccaatccggctatttaagtaggacaaccgcgccggcaaacccgacataccatcctctcgttcatgcgctcctacatctnctctccaccggactccgctacgcaatgatgggaaagtccgacgacggctcctggtggttcttagtgcccacgggggttcacgaggtcgtccggatcatggggccaccgatgctctctgcctctctgggcccatcggcgtcaaccactccgtcgacggccacggtgatggagaaggtggtgctctccttgggcaacgaaaaactgcaacagtcgcccctcctcgccgaggccgtacaacagggacgaattctcggccagatgctgcctttgatcgagcagtctcgccacgaccgtgggtctggcgcctncctcaccgccgcgcaacgtgcacgtcaaacatgatccaccctcgtnacccgcgcaacgcttgcacgacatccaaattgcacacgctgcgatgaagagtgagcc

SEQ ID NO: 54235 - DNA, 598 bp, Triticum aestivum
  Clone ID: PAT_TA_54235
cgtggcttcaccaaggaccacgtcaaggccatcatcatggacactttcgtgggtggcatcgacacgagctcggtgacgatcctgtgggccatgtcggagctgatccggaacccgcgggtgatgaagaaggcgcaggaggagatcagggcggcggtgggcgagcagcgcgcccgggtgcagccggacgacctgcccaagctcaactacctcaagatggtcctcaaggagacgctgaggctgtacccgccggcgacgctgctgctgccgcgcgagacgatgcggcacgtcaggatcggcggctacgacgtgccggcggggacgagggtcgccgtcaacgcgtgggccctcgggagggacccggcgagctggggcgaggacgccgacgagttcaacccggacaggttcgaggccggagcgaagcacggcgaggtggacctccacggcgcgcacttcgagctggtgcccgttcggcgccgggcggcgggatctgcccgggcatggcgatggcgctgatgaacgtggagttcgcgctggccaacctgctgtgcggcttcgactgggcgctgccggaggggaccaaagccgaggaccctgtgca

SEQ ID NO: 54236 - DNA, 709 bp, Triticum aestivum
  Clone ID: PAT_TA_54236
gaaattcttcaggaacagtgttaatgtctggtaccagtttgttccccagctgatcttcttgaacagcttgtttggctacctatccatgcttatcatcattaagtggtgcacagggtcaaaagcagatctgtaccatgttatgatatatatgttccttagccccacagatgacatgggagagaaccagttatttcctggccagaaaactttacagcaagttttgcttctgcttgctctggtatctgttccctggatgctgattccaaagccatttttcttgaaatgggaacatgagcgaaggcatcaaggacatcagtacgccatgcttgagggtgcagatgaatcagttgtagcagagttgggggagcataatgaagaatcaaaccaccatgaggagttcgagttcagtgaaatatttgttcaccagctgatccatacaattgagtttgttcttggtgcagtctcaaataccgcttcatatcttcgtctctgggctctcagtcttgcacactcggagtttgccactgtgttctatgataaagttctccttctggacgctgggtacaacaatatttttatcctcgctattggggtcgttgtcttcattctgcgccactgtcggtgtgttgcttgtattggagaacctaagtgcattctttcacccctgaggctccattgggtggagttccaaaccagtttatgaggggga

SEQ ID NO: 54237 - DNA, 623 bp, Triticum aestivum
  unsure (1)..(623): unsure at all n locations
  Clone ID: PAT_TA_54237
ggaaattccccggtgtgcgaccccaccgcgtcgcagcatgatctcgcggacncagcactgtcttccagaatggcacccgtattatgtgttcgcggancttncagccccaagggtgcgtggaccatgttgcggggttttgcgggctcttcctcgcacgcgctacagggaactccgttcaaaaaaatggaccatatcgaatctaacctaaacgagctgatgaactctctgtctcctggcggccccgtctatgccgcgagtatcttaggcgacactaacggcggatccggcgatatgtttgtcccacggctgtgccacatgattcactacataggggaaatacaaccagagaggaggtggtgcaggtggcaacgattgaggccctggtgggggcctccgacaaaaacataacgcgcatctttcttggcgatgatggaggcaatgtactacgcgcaatatctacaccgggaggagaccaccaccagaacaatagtatcttaaccttcttgtgggccagggatgaaatcaagtatcaagcttcaacgatggccgtatgccatggaactaccgtactgtcaagctaacacaagccgacactctgccattctgaatagcgaggaatgata

SEQ ID NO: 54238 - DNA, 550 bp, Triticum aestivum
  unsure (1)..(550): unsure at all n locations
  Clone ID: PAT_TA_54238
cganaccttcgccaagaaccgggagctggaggtgatccactgccgctgggccatgctgggcgcgctcggctgcgtcttcccggagctgctcgcccgcaacggcgtcaagttcggcgaggccgtgtggttcaaggccggctcccagatcttcagtgagggcggcctcgactacctcggcaaccccagcctggtgcacgcgcaaagcatcctcgccatctgggcctgccaggtggtgctcatgggcgccgtggagggctaccgcgtcgccggcggcccgctcggcgagatcgtggacccgctctacccccggcggcagcttcgaccccctgggcctcgcccgagaccccgaggcgttcgcggagctcaaggtgaaggaaatcaagaaccggccgcctcgccatggttctccatggttcggctttcttcgtgcaggcccatcgtcaccgggcagaggcccccgntcgaggaaccctcgccggaccaaccttcgcgcgacccccggtcaacaacaaccgccgtgggccctttcgcccaccaaactttcgtcccc

SEQ ID NO: 54239 - DNA, 821 bp, Triticum aestivum
  unsure (1)..(821): unsure at all n locations
  Clone ID: PAT_TA_54239
catcaacatatcttctaccatcctgtaaaaattcacctacaaaagacagctgtggaggcatgtacaaaaaagtaaaaatcgggactcaaaaacacacacttggatcccgcaaaaaaacacaaacatttggagcactaacttttctgttttcttttgacacaaatcactatggacgtcttttggtggcgaaattttgcagaatgttagaacacttgttgatgttcatccacaaaaggtttcaaattgttttggttttttcttttacaattttatcggaaattactgtttatatgggtgcatctgtgctcgggattagagtaacactttcgttttcgctagcacaacaccggtggatatatgtttacacaggaaaggttatttcacggtcagctgaccagcaagggtctcgtagtcactttccgacagctactgtggcaatgtcggaaggacgctcaccacctgcaactctcacttctggttttcgacaactctatttttttgaacacaaacattcagaagttcatctttcaaaaatttccaacaattttaataattcccagcatccaaatttaaatgcacccacatagagaaggtactcttatatttacgaanatatagaaggtaagggcgcatgaatctgctccggagctaaatacacccacttaaacagtaaatccgaaagaatagtaaatggcatttaaaaagaatctgattttttttttattgacataaaaaggcctttaacatcttataaaaaggaaccccggggatccccgcgggcatttgagatatttatttgggcatcaatttaatcaaataaa

SEQ ID NO: 54240 - DNA, 635 bp, Triticum aestivum
  Clone ID: PAT_TA_54240
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggaccaaagtttacttccccgggcttgcaacgtaatattttttttttgggggccccaaaattaaattcacgggccggggtttaaaaacgtggggatgggaaaaaccctggggttcccaaattaaatcgctttgaaaaaaatccccttttccccagttgggttaataacaaaaaggccccccccaatcccctttccaaaaatttgcccaccctaaatggaaaatggaaccccccttttacgggccattaaaccccggggggtgggggggttacccccagggggaccgttacatttgcaaggcccttagcccccgttcttttcgtttttttcctttcttttttccccactttcgccggttttccccgaaaagttttaaatggggggctccttttagggtcccaattaagggttttacggcccctccccccaaaaaactttgattggggggatggttaacgtagggccccattcccttaataaacggtttttccc

SEQ ID NO: 54241 - DNA, 514 bp, Triticum aestivum
  unsure (1)..(514): unsure at all n locations
  Clone ID: PAT_TA_54241
gagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcaacctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacanccaatggatctgttatgtagcttatccattagacctatttgaagagggttccgttactaacatgtttacttccattggaggtaacgtatttggtttcaaagccctacgtgctctacgtttggaggatctacgaattccccctacttattcagaaactttccaaggcccgcctcatggtatccaagntgagagag

SEQ ID NO: 54242 - DNA, 582 bp, Triticum aestivum
  Clone ID: PAT_TA_54242
ctgatgtgctattctcacatgcaattaacttgatctggttagaaagaaccaatggttggtgcttgttaattgcattaatagtagttgttgtgttatgtggtgattatatgtgccacacataaagtatggtataaatgtgcttttattgttcaacaagcaggtatttctgccattttttgttgtctttcatcttgggatagcttacgtatctgttgcatatgttttaggcatcttgggatagctcaaatctgttgcatacgtttttcaaaattaggcggagaaacttttaccaattggtggcaggtccctttttggtttgctacattattttgctgtttattaggcaacgcactaatttccctttgcttactaatgccatgattccttttatgtttattggtaaaaacagttgggtaattcttctgttgcttcatggaattttctgcacgttgtgtctgtattattgtcactgaagattaccttcaactggagatctagctcacgaaattatgtacctaagggtagtggtattattacatatggggagaggtttatgaaaagctactgaaactgattattttg

SEQ ID NO: 54243 - DNA, 665 bp, Triticum aestivum
  unsure (1)..(665): unsure at all n locations
  Clone ID: PAT_TA_54243
gacatcgcctgcttccgcctcggcggcgtccacgtcgttccgatcacatgtgccaagatcgcaagggaggtgctcaagaagcaggacaaaaacttctcatcccgggcactcaccttcgcctccggtgcaatcagcagcgggtacaaggacgccgtgctctcgccgttcggcgaccagtggatgaagatgcgcaaggtgctcacctctgagatcatctgcccctcccgtcacaagtggctccacgacaagcgcgccgatgaagctgacaacttgacgcgctacatctacaacctcaccgtcggggggatgtcatcttcaacgtcgggactagccaacgtcaatgtcaggcacgtcgcgcgggattactgcggcaacgtcattcgtcggcttgtcttcggccaacggtacttcggggagcctcagccggaccgcgggccggggccgatggaggtggagcacatggatgcttccttcgccctcctgaggttcaactttgcgttctgcatcagcgactacctccccgtgtctacttggccttagatctcgacgggcacgagaaaattattaaggaggccgataaaaaagtggatagactacacgacgtgcctattgaagaacggtngnaggcagtgnaacagcggcgaagggcaggacggagtccagga

SEQ ID NO: 54244 - DNA, 529 bp, Triticum aestivum
  Clone ID: PAT_TA_54244
ctctcaaagacccttgttctccccactccctgcctacggcggcgccgcagaaggcgatacctagcaagatgagtgagaaccctgaaggtaggagggcgaagaggattaacaaggtgtatatcacacttgcgatggactgacgcaaaggatgccaacgtcaacctgaaacctgatggtgcattctttttttttggcactgatgtaactgatgggaactactatgaatcgaaactggatgtgaatgacaaaagggatgttgtagcaaagcaagtaagggttgatgtcaggtccatattctctattctggaaaaaaccaacgccaaatggtggaacaagcttgtacgagaagatcaaaaggcaccacactatgagaatgttcattgggacaaatgtgtctatgaaggatcatgatggtgctgatgttaatggtgatggaatggactttaccaatatgagtgggactgtgacggatgcctggcatgatacgttcacgacagcatgtgatggaaatggctggtatgccctcgat

SEQ ID NO: 54245 - DNA, 573 bp, Triticum aestivum
  Clone ID: PAT_TA_54245
cccactcgtccgcagccgcgagggcggcggctggctacgggggcggaggctgcggctgcggcggcagccgaggagggtccggcggaggcaactggagggagcgaatggtggggcccttcactggccagacatcctaggtacccgatccgctgttacctgtctaccaaaatgatatcggtcgctcgctcccgagtatgctagatatctctccgtctagtaggctgccagatgttgaggctaccgttagaagtgacgctgataccgttccgtgtgactgttccgtccacgctctgttctctatgcttataacattgaaatgaaaacctgagcaaagtttgttcgccgcttacaactccaaggacgaccctgccaaggaggctgccaacttcaccgcccaggtcatcatcatgaaccaccctggccagatcagcaacggctatgcggcggggctgtattgagacaccaagctacattgctgtcaagttcgatgagatacataccatatattggccgccaaaatgaaaaggagagggaggcggttcacaagttcctgaagaacaaaaatgtcgggtt

SEQ ID NO: 54246 - DNA, 416 bp, Triticum aestivum
  Clone ID: PAT_TA_54246
gggtttcctcaacggctggtactacgacgggaccaacaacacgctggtaactgcaacgaacctgcctgccatcgatcgaccgccttcgggcttcagcgcatgttgagaaagagaaattctgtcaccacgtactgcaggtttactgggtgaggaagcacgtgttcgtccgggtgtggcactcggagagggtgggcatcctcctctacgtcctcgtctcgcagatcctgctctgggcgctcctcgccggcctcctccaccgggccggggtctactggaagctgtagcgagccaggaagacatcggtgtcactgtttgcttgtgtgtgttggaacttagaattgtgtagcatctgtgtaagaagacaagaaacgagaagaaaagattgaaggctcactgactgcccaaaaaaaagataa

SEQ ID NO: 54247 - DNA, 184 bp, Triticum aestivum
  unsure (1)..(184): unsure at all n locations
  Clone ID: PAT_TA_54247
acccatcacacacacacacgccaccaaattcatcaagaaacctggagaggatgatgngcgnncggaacaccagtgtggtcggcctcaagcccgccgcggcggtgccgcagtccgcctggncggtgacggctaagcgcgtgcaggtctccccgtccaaggaccgtcgtgcggtgcttctcggcct

SEQ ID NO: 54248 - DNA, 712 bp, Triticum aestivum
  Clone ID: PAT_TA_54248
gttgggagccgcaaccacctgccgcatcagccgtcgccgtcgatggaggcggactactacaaggtgctcggcgtcggccgcggcgccaccgacgacgagctcaagaaggcctaccgccgcctcgtcatgaagtaccacccggacaagaacccctctccgcaggccgacaccctcttcaagcaggtctccgtggcctacgacgtgctcagcgacccggataagcgcgccatctacgaccagtacggcgaggaggggatcaaggcgggcgtcgccccgccctccccctccgccgcgcacgcgcacgcgcacgcccacggcttcggcggcggcagcggtcccgggttccgcttccatccgaggagcgccgacgagatcttccaggagatgttcgggggttcgttcttcgggcaggggccgcgcggcccttggagcggaggcagcgctccgcagtctgtcccggggtgcgcagccagcgttgccgccgccgctgcaggattctctcccgggtcaggggaggcgtccggggggtcggcgaggaagggagcggcgatcgagcggcagctagcatgcagtctggaagacctgcacaagggcgccaccaagaagatgaagatcttcagggatgtcctcgactccgtcgggaaaccgatgagtgtggaggagatcctaacaattgatatcaagcctggatgggaagaaggcacaaagatca

SEQ ID NO: 54249 - DNA, 466 bp, Triticum aestivum
  Clone ID: PAT_TA_54249
cgccaactcgcagccccgccgtcgctctcaccaccggcacggcagaccgctcgcccccctcggcgcgccggtggacgtggcggcggcccgcgccgggttggaggccacgctcgtccgccacccccgcttctgcagcgtccaggtgtcggacgacgtgaagaagaacgcgaagccacggtgggtgcggaccacggtgaacctggacgaccacgtcatcttcccggacctggacccggccgccacgtcggccgacccggaccgtgccctcgaggactacgtgtcctccctgtccacgcggccaatggaccactcccgcccgctctgggagttccacgtcatcgacttcccgacctccgaggcggccggcgccgtcgccatccgcatgcaccactcgctcggcgaaggcgtctcgctcatctcgctcctcaccggctgcacccgcagcgccgtcgacccgatcaggctg

SEQ ID NO: 54250 - DNA, 588 bp, Triticum aestivum
  Clone ID: PAT_TA_54250
cccacgcgtccgcccacgcgtccgctccgccccccttcgctcctccagcttcaaacccaggaaaccctcgccttcccttccggcgtgctattcccgccgtccgaatcccaccccaaccggacccgagctagaaggcaggagcacagcaagatgcccccgaagaaggcggcggcgtcgaaggccaacgtcgcgaacaagcataaggtcgtgggaggacaagacctttgggctcaagaacaagaacaagagccaagcaacgccagcaagtgcgagcagtcggtggaccaggccgtccagtccaaaccccgcccggccaacaccgccgccaagaacaagaaggggcaggaaaaggcgcgcgagaaggagcttaaccatctatagaaggtggtcgccaggcatcccaaggtccccggtggtgaaggccccaaaaccacactatgcgagctcttgaaggtcggtcaatgtcataaggggtacaaatgtaaggtgtcacacgacctccatgtaccaaaggaagggaaaggaacattcatatcgacaatgtcctgtgccatgtacaggaagaaagacactggatggctggcgcca

SEQ ID NO: 54251 - DNA, 544 bp, Triticum aestivum
  unsure (1)..(544): unsure at all n locations
  Clone ID: PAT_TA_54251
cccacgcgtccgccgagccgccgcatcgaggacgcctacgtggcgctgcagacctggaagcgccacgccatcttctccgacccgcggaacctcaccgccgactgggccggcccggacgtctgcaactacacgggcgtcttctgcgcgccgctcccgtccgacccgcgcgtgctcgccgtcgccggcgtcgacctcaaccacggcgacatcgccggctacctcccgccggagctcggcctgctcgccgacctcgcgctgctgcacctcaactccaaccgcttctgcggcatgcgtcccggcacgctccgccggctcgggctccttcacgagctcgacctcagcaacaaccgcttcgtcggggcgttccccgaggtcgtgcttgacatgccggcgctccggttcctcgacctccgggtcaacgagtntcgagggccgccgtgcgccagcgcgcctttttcgaccgcgccgctcgacngccatctttcccttaaccacagcccgcttctcggctttggagatttccgggacaaacgatgcggcaact

SEQ ID NO: 54252 - DNA, 650 bp, Triticum aestivum
  unsure (1)..(650): unsure at all n locations
  Clone ID: PAT_TA_54252
gagcgttggacagagagcgagagaccgtgacatgtcggcggttagctggagcattccggcgatcccgcgggcggtcccgccggcgaggtccggcccgcccggggaggccttcctggtggccgcgcgcccgcgggcggcccgatcccgtgccgctcccaggagagtcaggctcgcccggggcggcgtcgtcgtcgcccacgccggcgcggcggaggtgcccgtcgctgattccggagaggccgcggtggtcttctccgagaagttccccctccgccgatgccaaactgtggaagggaaggcgtgggtgagagtggaggcggagccggatgcggacggcaagtgcaagatcgtcatcgggtgcgacgtagaggggaagtggctgctgcactggggtgtctcctaccacggtgagaccggcagtgaatgggatcaacctccttcggaaattagacctcccggttcggttccaatcaaggactctgcgattgaaacaccattggagacttcacccaattcagaaggacatatacttcatgaagtgcaaatcaaatttgataaggacactccagttgccgctatcaattgtgttctaaggaaagaggaacaggtgcatgggttcaacataagggtngggatttcagaataccctt

SEQ ID NO: 54253 - DNA, 558 bp, Triticum aestivum
  unsure (1)..(558): unsure at all n locations
  Clone ID: PAT_TA_54253
tgaagnagagtttttcctctaaatcttgtccgttctcgcgaagattcgtgattctagcctcatgttatcatcctctcgaattattccatttgccagttattcttttctcacctaccgggagtatttcaggagttgtctttccgttttttttcaccggaggccaacgttccagaagaattcttcgtcctcagatttcagctcttgatcccggtgcttcgttcaagtgttcattattcagctcatgatctctttgttctcttgcatctaatcccctcaagcatatgtgttcttccaattcttccggtgattatttctcttttgtcagtcatttccgaattcttatgggggttctttcagattctatttccttgattatcattcaatccttttcttcggagtttggtcttgaggaataaattctagttccgagtcttttcatcttttcttttcccggagttcattttcctccgtcggccgtccatccatccatccatgtctactggcttcgttaannaaaagagaagnaagaagagaaaaaaaaaaaaaaaagaagggcgg

SEQ ID NO: 54254 - DNA, 756 bp, Triticum aestivum
  unsure (1)..(756): unsure at all n locations
  Clone ID: PAT_TA_54254
gcggtggggcggctttcgccgacgtccccggcggcgcgctctgggaggaggtcctccactgggccgtctcgaaccacggcctcgcccccgcctcctggacggactacctccggctcacagtcggcggcacgctctccaacggcggcgtcagcgggcagtccttccgctacggcccgcaggtgtccaacgtggcggagctggaggtggtgaccggcgaaggcgagtgccgcgtctgctccccctccgcccacgccgacctcttcttcgccgtgctcggcggcctcggccagttcggcgtaatcacccgcgcccgcatcccgctctcccccgcgccacaaacggtgaagtgggcgcgcgtggtgtacgcgagcttcgcggagtacgcggcggacgcggagtggctggtgacgcggccggctgagtcggcgttcgactacgtggagggcttcgcgttcgtgcgcagcgacgacccggtgaacggctggccgtcggtgcccatccccgccggcgcccgcttcgacccgtcgctgctccccgccggcgagcccggcccgctgctctactgcctggaggtggccctgtaccagcaccagcacaagcagccggacgacgtggacgagaggatgggggagatgatgcggcggctcaagtacgtgcggggcctggagtacgcggcggacgtcgggtacgtggagttcctgtcgcgcgtgaacccggtggaggaggagggcgcgccggacggcanctgggcggcgc

SEQ ID NO: 54255 - DNA, 766 bp, Triticum aestivum
  Clone ID: PAT_TA_54255
caacagccacagctcaacacatcacttgcaccggtcgagtccttgatcatcacagcaatggccttcaccgacagttggacccacgagatcgaatcgccggtcgccgcgtcgcgcctcttccgtgccggcgtcatggactggcacacactggcccctaagctcgcaccgcacatcgtcgccagcgcccaccccgtcgagggcgaaggcggcatcggcagcgtcaggcagttcaacttcacctcagccatgcccttcagcctcatgaaggagaggctcgagttcatcgacgccgacaagtgcgagtgcaagtccaccctcatcgagggcggcggcatcggcaccgccatcgagacggccacctcgcacatcaaggtggaggcggcggccaacggcgggagcgtcgtcaaggtggagtcgacgtacaagctgctgccgggcgtggaggtgaacgatgagatcaccaaggccaaggagtctgtcacggccatcttcaaggccgccgaggcatacctcgtcgccaacccggacgcctacaactgaaccagttgagagggaacatacatggttatggttatgattatgctgtccctggtttgatttttgtgtgcttttttcccgatctaataaagccgctccaaactcaagtagtgacgcgggagcattgagcagagtgtggagttgacaagttaaaaggtcgtgtattcagtatttgtaactatcaaagggtgcccatgctgttgttgatgatgttgttgcttgcttatgt

SEQ ID NO: 54256 - DNA, 616 bp, Triticum aestivum
  Clone ID: PAT_TA_54256
cccacaacgtcacgcccaaaccaaagtacagtgcgctctcactgatgctgctatccttcttcctcgcccaggtgtacaccggccagggtcggctccgtctctcggccgctcatatatggtcaatgagaataatctagggctggggaaagatgaggatccactctttactcgtggtcttaaatagacgataggatggacttccttgcttcattttaggatcctgaaggtattgactttttatctgcttcgctaggatgtatgccaagatgttactgcgaatggtaaaagacctgatgaaaagactcctctagaagaaggaatcccctctgacatggtaccagaaactgggaacagcactgaatgcctctgacaacaaggacaagaagctctaagtctaaaaagcacaagtgacgaagctattcttgctcttaatctgacagagtatgcgagagcggcagtgatcgggaacacatgatgatgaaggaccgcaaaaggctcaagagaatagccattgtgactctgatggtgccagaatgcgcaagctcaggctaaagacgacgatctaggtcttctattacgagagcgactgggatgaatatgatggcgaatctgaata

SEQ ID NO: 54257 - DNA, 650 bp, Triticum aestivum
  unsure (1)..(650): unsure at all n locations
  Clone ID: PAT_TA_54257
cggacgcgtgggcggacgcgtgggctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcnagggcatcaagaagttcgagaccctgtcttacctgccaccgctcagcacggaggccctcctcaagcaggtcgactacctgatccgctccaagtgggtgccttgcccttcgagttcagcgaagggttngggntgtcantcctttttcgtggagcgaccaacggcgattgctcctggggttaccctacgatgggcgccgggtattgggagcanatgttggnagaagctgcccttatgtgtcgnggttgcacctgacggccacaacaggtgatcaacgaggtggagggggcaagaaggatcccctgacgcgtatgtccgcaatcatcggattcgacacacatgcgtcaggtgcagtgcggtgacgttcatcggcttaagccacccggctgcgaggagtccggcaaggcctataacggctcactcacgacgaggcatatataaagggccattgca

SEQ ID NO: 54258 - DNA, 104 bp, Triticum aestivum
  Clone ID: PAT_TA_54258
cccacacggccggctttaatcctactggtggcgaataaaaacacgcatagtgcactcactaataaatgcacgagtatcttatgctcatctttgtatcccactct

SEQ ID NO: 54259 - DNA, 465 bp, Triticum aestivum
  Clone ID: PAT_TA_54259
atgatctcttagatgcgcttgacttcaaccaaattgtgatatttgttaaaagtgttggtagagcttcagaacttaacaggctgctctgtgaatgcaattttcctgcgatctgcatacattcgggaatgacacaggaggagaggctgacccggtataagaatttcaaggaagggcacaagaggatccttgtggctacggatttgggttggaagggctgggcgttttggaacaaagggcttgcataacatttgttgcttctgcctctgactctgacgtcctcaatcaagtgcaagaaaggtttgaggttgacattaaggagctgcctgaacagatcgacacttcaacatacatgccatcttgaagatccaagtgggggcctaggagggtgttgcttttcagacacagcacctttacatttctattgggttacattaactttgatgtaagaaatgctacaattgtact

SEQ ID NO: 54260 - DNA, 223 bp, Triticum aestivum
  Clone ID: PAT_TA_54260
gcttatcgggaggccggtgctgtactcgctggcggtggacggcgaggcaggggtgcggaatggtgctgcagatgctgcgggacgagcctggagctgaccatggcgctcaccgggtgcgcgtcgctgcgggacatcacccgcgcccacgtcgtcgccgacggcgacagggatccgcccgcacgcctttagattgggaggcgcgctgcgtccggcctactggtag

SEQ ID NO: 54261 - DNA, 480 bp, Triticum aestivum
  unsure (1)..(480): unsure at all n locations
  Clone ID: PAT_TA_54261
cccacgcgtccgctcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacgagaagcagtttatctttcacatgaagcgctacatcaagaacctctctgccaagcttgaagggggtgacctagatgttttcaagaagaatgttgagttntgccacaaagatagttttttagcaagctcaagggaccttcagtttcttt

SEQ ID NO: 54262 - DNA, 780 bp, Triticum aestivum
  unsure (1)..(780): unsure at all n locations
  Clone ID: PAT_TA_54262
cggacgcgtgggcggaaaaaaaatactgggaaattattgcgagggcgagaggaagagggaggaggcggagaagcaagggggaggcgagcgaaggactagaagaatctcccaagacacttgtgtcaaattttgaattctgcagaattgctgcatctgctcattagcaagatgtccattgaagaaaggaaaataagtttgataaacaggacgacttcgttaaatcctaacgcggtagaatttgttccttcatgccttagatctgtgagtgatgcttcaaacagatcggacacaaccaagattcctgtctcagagtcctccaaggaaatcagcacagaccaaccagagtccgtaccaagcaaccctgatgaagaagcacaccggtattggcaacaacagcttccagatgatatcacccctgatttcaacgttcttggccaagatgagactcctggacctgacagtctttcactcacgggcctctcaatgaatgatggctttggtgcttcattattttctccaaaccagacatcaagaatgcagcaccatgcttctccatttgttagggacacgctaagtacacgagcgaagtttgaatttcctggccaagaacagccgcaagctactattatgagtcccactgcaagtactatgagtccaactgctgctccatgggtaaagacagtaagaaatggtggtcaatatggtacanacagaaaggatgctagtcactacgatggagattctagcattggatccccactgcagtctgatgcttattac

SEQ ID NO: 54263 - DNA, 547 bp, Triticum aestivum
  unsure (1)..(547): unsure at all n locations
  Clone ID: PAT_TA_54263
cccacgcgtccgcccacgcgtccgggtgatggtgtgtggcgcacgtatcttaccttggacacagaccagctccttgatccacgacgggaaccaaaatctgtgctcgccaacaataaaatctacatagcaagcgcccagagcgacattgttgtctttgatttgattgcctcgagcatctctatgtttcagctcccacaaggggtggagtatggcgatacagataccatgttggcacaggctcaggatgcttctggtgtgtatctcatccatgcaaagaagcttcagcttcacatttggctccacaagggggacaactggttactggtggacaccatttgtttgcgtgagatggtagctaatatgtggattccaggttacagggttgaagatgattcctacgctcctctccggataaagcatgtgggggaccatgctgagtttatgttcttggagatggggcgatgcgcacttcanttagatgtcaagtgcatgcagttgcgttaagtgtttgtcttggcgggaagaagaagtgcgtctgggtgatatt

SEQ ID NO: 54264 - DNA, 409 bp, Triticum aestivum
  Clone ID: PAT_TA_54264
ccaccgtggatgctgcccccgtacttcctcttcaacgtggacatctacaactatcatccgcgagagcttcttgcggcatacccgcctgcgaccgccgcggatgggacctctgccctctacttcgtcaacctcgtccgaccaaagactgcaacagactcgagaaagaagagagccgtccctgggggcacctggcagtccgagcgatgcccacagacgctcgtctgcgaggccatgcagggagccccgcagacgttctcgttgaccgtatctggccgcgaagggagaggaaatgcggcagggctacattttgcaggagcgtaccgttgccggggacgaaggcaagctcgacgggggtgccgacatgggcgtatcgcagatatacacgagcccccccggcgacaagcccaag

SEQ ID NO: 54265 - DNA, 542 bp, Triticum aestivum
  unsure (1)..(542): unsure at all n locations
  Clone ID: PAT_TA_54265
gataatacaataccatggcccccgccgtgatggcttcgtcggctaccaccgtcgcacccttccaggggctcaagtccacggccggtctgcccgtcagccgccgctccagcggcagcctcggcagcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtctttcgtgagcacaacagctcccccgggtactacgacggccgatactggacaatgtggaagctgcctatgttcgggtgcaccgacgccacgcaggtgctcaacgaggtggaggaggtcaagaaggagtaccctgacgcctatgttcgcggcatcggcttngacaacctgcgccaggtgcagngcgtgagcttcatcggattcangccaccgggtggcgaggagtctgcgcaggcctaaact

SEQ ID NO: 54266 - DNA, 526 bp, Triticum aestivum
  unsure (1)..(526): unsure at all n locations
  Clone ID: PAT_TA_54266
gcggagagagagaggccaaggagggagatccactccgtccgatggcgatggcgccgccgcgtctgctgcggggcctcatcgcgccgatgtcgccggcggactggctgccctgccacctccagctgctggcctcgtccgcctcgctcctgcaccgctggtggctcccctcgctcgcgcgcctccgctgcccctcctgctccgacggattcaagctcttcctcgtcctgctcctcttctccgccgccctcgccgaggtccgcttcgtcgcctccgcctccatggcgcccaccctccgcccgggcgaccgcgccgtcgcaaaaaaagtcacctacatgttccggaagccatctgccggggatgtagtcttcttccgggtgcccgccgccctgcagaattgcgggataaataaagatgttggatttattaagagggggtggtgccacccctggagatttcatcngaggtccgacaaaggcagcttattgttaatggggttgcgcaaaatggacatttacaccgcacccca

SEQ ID NO: 54267 - DNA, 102 bp, Triticum aestivum
  unsure (1)..(102): unsure at all n locations
  Clone ID: PAT_TA_54267
acatggactagagaaagcatgcgtggggtgtntatgctatggggagggtatatatatgcactggacacttgatattatacgaatgtgatggacagttgtacg

SEQ ID NO: 54268 - DNA, 555 bp, Triticum aestivum
  Clone ID: PAT_TA_54268
cccacgcgtccgctcccctctcgcagtcaagtctggtcttgcccgagatgaactgctccttcctcaggcggcggcggtcgccgtggtcgtggccgtcctggcggccacggccggcgcaaactccttcgtctcggccccgcctctccccaccgttttcctcttctcccctccctgcgtcctgtggatcgccgcccaggtcatcgtcgtctcgctctggctcctttgccaccgcggaaccgccgttgcggccggactctcgtccacggccagcgacgtttccgctgccatgggcggcatgctcttcccttcctcggaacacgacgtctttgctgccgctcctgacgccgtcgtcgcgccgccggcgcccgtctcgacgagccggccgcgggaagcgagaacggccaagaggccgtttgaccgcccccgcgtgcggaagaagctcgcccggcgagggcacggccactgtgggaggcgccgcggttgagggcaagcccgaggcctagaaggagacgctttgaggaggagaagtcgagggcctctgccctgctgaccgag

SEQ ID NO: 54269 - DNA, 142 bp, Triticum aestivum
  Clone ID: PAT_TA_54269
aataaaacaacggggggctcccgaaagagggggggagaatttgcccttcccacaccctttatataaaaggggggccttaaataaaaaggcgataaccccacaagacccccatctacaactagaggggggctttagacccccg

SEQ ID NO: 54270 - DNA, 341 bp, Triticum aestivum
  Clone ID: PAT_TA_54270
ctaatttttttttttcatttgcatccaaagatcgcctgtaacaaactgagcgtggtccaaaagcctgcacctgggaatacaacagtgccagccctggaaaaggaaacgatagaactcttacatgataaaacgcatcaccgcattagcttttggggatgttcttgcggacaattttcgcgtccgttatgcggagaaggttcaccagcttccgcaggaacggcccccttgatcatcacaactttgagatcattgtcgaacctgacaatgttgatctagctgatcttggtctcggttgcgcccatcctcccaggcatctttttgcctttatacacccgccctgg

SEQ ID NO: 54271 - DNA, 366 bp, Triticum aestivum
  unsure (1)..(366): unsure at all n locations
  Clone ID: PAT_TA_54271
gccaagcccattgcccttcaatcctctaccgcatccgcccatcgcgcccacattctatccatttcctcgcgggatcccaccaacagcacgcatgggcaccctcgaggaggcggatctaaggggaataagtgttcgtgcgctccgacctcacgcgccggtcgacgactcccctaagatcaccgtcgacacccgcatncgcgcatccatgcccaccatcaagtacctnctcggaaagggcgctaatgtcatcctgtccagccatgaggctgcggcaaaaaggctcatccccaatgctagcttgaagcctcttagtccacccttgtctgagctccttggacttgaagctgagatgcacccttactgcct

SEQ ID NO: 54272 - DNA, 615 bp, Triticum aestivum
  Clone ID: PAT_TA_54272
gcaagctatatacctacatagtacagcccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagccaacgcatcccctgggtactacgatggccggtactggacaatgtggaagctgcctatgttcggatgcaccgacgccacgcaggtgatcaacgaaggtgggagaggtcaagaaaggagtaccctgaccgcctatgtcccgcatcattcggattcgacaacatgcgtcagggggcggtgcgtcagcttcattcgccttcaagccaccgggctgcgaagagtccggcaaggcctaaacagcttactcacgacaggccatatattaaagtgcctttgcgagttttgtca

SEQ ID NO: 54273 - DNA, 362 bp, Triticum aestivum
  Clone ID: PAT_TA_54273
ccgaagaggtcggaaaatgttcacatagagttgcgggacaaacctgtcccaagccacggaccataaagcttatgagcccggagccccgcaattccgtacaataaaccctggcatggcttgcctcgacctcatgggcagctccgcctcgccgaccagggccctcgacctgggtacacaggagaacctcaagagcgtctgcttgcaccgcgctgctgacatggtggattctgggaagaggctggtggtcgtcaccgttggacggccgtgcacgcggtggacctcctcggggccctgctccgcaccggggcgctgggcgcgggcgacggagcacccacctcggtgaagaaggacgtcctcgccgt

SEQ ID NO: 54274 - DNA, 483 bp, Triticum aestivum
  Clone ID: PAT_TA_54274
atccatcttcttgttttgatctattttttcccatggaaatttttattgtttaccacagagaagggcacactggggggagcaaaaagagaactacccattaccaaagctttgggaacaagcgtagatactaagaactggctcaagcttctgctaaagaaacaagcgctctaaaaaccacccttgatatcgttgacgacgtcgaacgggatgggggtgaccgtctcaatagaggtgtcctgcaccatgaacccagggttggcccctgctggatggctgtttgtgctgatgacctcgtcacgcgccttggcctcctccttaagcttgggattggggattttcctcaaaaggaacttctttttgcacctggatggctgaacgtgctccacacccacatggatcctctccttgatgatcctgttgcccacctgcttggagactaaaccccgatggagcgcttggtgacgttccagacgcggtcggtgc

SEQ ID NO: 54275 - DNA, 564 bp, Triticum aestivum
  unsure (1)..(564): unsure at all n locations
  Clone ID: PAT_TA_54275
atcctagtaacatgcataaatctggagccaatatgtaaatagtaacaggatactgtcaggacaaatattatcaactaacatagaaagtataattattccaagcataaagaagtctggagtcttaacacaaacaagtaggtagataagatattctaaaccaggttatatgataattaacaccctagaggtgattctttctccccggaatgtagcagctggggtcttagcggtactggaaacggttcttctcaaatgagccccacgaagattcaggagggtgcgaaggacctttctcagaaactcccacatgtatattgtatttatctccatattgagtagggaaggtcgcttcaggactgcccagcttcatcccatgtgctccacctgtgccccatggtctgccatcaaaattagctaattcggcccgcatttgttgaagttcttgtgccatcgaaatcatactcttttccattgctttcctttgttccaccaactcgaaattccccttctgctncaattcacatgcatttcttgcatgagtaagttccagttgaaggccctcaa

SEQ ID NO: 54276 - DNA, 392 bp, Triticum aestivum
  Clone ID: PAT_TA_54276
ggcacaaaactttttttggaagaacagatgaaaacagacgatgaatacaacacataaagctcaacaggctaccgggctaaaatctggctcaaaaaaacatagaggggggactaaatttaaatgaacagtaaagggggcccgatgggaaggggggaaatccgaccccaaccaaggggaaaaaactcaagtgtcactcacagggggggaggggcgggcaaacgtggggactgggggggagggcagaagcaaggggggggggagggggcagagggcggcgggaacggagggggagaggcgggaagggggaggtaggaagcaagagggcggggggtggagagaggagggggggggggcgaagggggggggggggggggggcgcggggggggagggg

SEQ ID NO: 54277 - DNA, 566 bp, Triticum aestivum
  unsure (1)..(566): unsure at all n locations
  Clone ID: PAT_TA_54277
accattaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccactttgagcggatcaggtagtcgacctgcttgaggagggcctncgtgctg

SEQ ID NO: 54278 - DNA, 349 bp, Triticum aestivum
  Clone ID: PAT_TA_54278
aaacgaggcaggcgcaccagatcacctgcataaccaccattgggtaacacactgatctaacttccgccttgccagcaaggccaaacggctcagataccgcatttaaacctacggactggaacgccaccatccacgtctggtcccacaaaggaaccctgggcggacccaggaattccagactcagcacctgtaggcctaccaactctccttataatgcttacccttagagatcggagcaccaacggccatatatgccttctgcaggaaagtgagatcctctcagactctcacacaactttccatcctgcatgccctaacccaaagaccaggggagcctagcgcgcgtagg

SEQ ID NO: 54279 - DNA, 445 bp, Triticum aestivum
  Clone ID: PAT_TA_54279
ggggccgaacgatttatttttttttcacaaaccccaaccaaaaaagagtccttggttagcaacccccttacaaaaactaaagggggggggggaaaaaaaaagggaacccatggccaaataaaaaaaaccaggcgggggtgggggacaccatccaaatttatttttcgcaaaaaaaaaaaagggacccctttgaccaggccccaaaaaaaaaaacaaaaccctttactgagttttggccatgggggggatcaaggcaacaacccgggtggtggaaccccactcgttggcataccacaaaaaaaacttgaaaaaaggggcgttaaaaaaaattccagccttggaaaaaaaaaagcccgacccggtggcaccgacaaaattaggggaaaccaaatcctcctcgaagaaacccaagaaccccttgagttttccctcggaagcaaccttg

SEQ ID NO: 54280 - DNA, 597 bp, Triticum aestivum
  unsure (1)..(597): unsure at all n locations
  Clone ID: PAT_TA_54280
ctctccactgaacaccttaatccttgtgatgaatgaaaaccaattattgcctatacctgttacaaactgcatggcgtattcattcttcaaaatgaaaaaaaagaacaggctaatgtgttgcttttacagatcgaaaagaattaatccatttccatgccctttgttggcgagcggaaatgggaattgcacatgcctgtactggatcgaccactagccatagatagtcacgcgatgggatcaaagggatgcgagcgtgctgatgtccatcgggtaggcgtcgttgggcgactgggcgcggtaggacctccggccgacgatgatgttggccgcctccgacgggtggaaggcgtcccagaagatgtgctggtccctgttggcgcacggcgcctggtacggcaggcacgtcacctccccgttgttccgccccacgccgcagcacccggcggtggactccgtgaacccgtaggcgccggcgttggccaggatgtcgttgaagatgttgtaggcgttgatgtaggtgaagtgcgcgccggggagggtgttcatctggtccaccagccccaccagccgncggttgaagatcntgatggcgccgtc

SEQ ID NO: 54281 - DNA, 338 bp, Triticum aestivum
  Clone ID: PAT_TA_54281
ggggaaatctgggcggggaccttgcaaaaacaaggcgaaaaggacccaaaaagccccaacccaaaaacaaagggaacaggttgggacaagacaaacaagggaaacccaacacccccccagaaaccacaaaccaaaaaaaccgggggccaaaccataccacaaaacccagcaatatccgctccaaaaatttccaagccctaagaaaactatgcaacaccacaactaaagggcttaaaaaacggcattcccgccactaaaaaaacggtttacccacgaccacattcccccttggggccacccttacctccaattccggcccttccgggggcacccgcttt

SEQ ID NO: 54282 - DNA, 372 bp, Triticum aestivum
  Clone ID: PAT_TA_54282
gcacgtgcgtcgggcagttattaagttgcacaacaaagcactaacttctgaacaacacggggacatagaaagcctctttgttctcgagtgctagccaactcaaacagctgcaacgacagggagattgatccacagtgacagctatcacggggcctcactggggaatcgtaaagtttacaaggtatctgtatctctttccccttatgtatccatatctaaactcctcgccaggtggtatttcaatgtccggctcatccttggatttggttacatactcatcgcagtgataaggatagcgccgacatggcttgtcaggatgacgccaacatggcatgggcacaggccacctgtttaaccgaaacctgcggtccc

SEQ ID NO: 54283 - DNA, 614 bp, Triticum aestivum
  unsure (1)..(614): unsure at all n locations
  Clone ID: PAT_TA_54283
cagggagcaatgatattttccaagccgatgttgcaacgttcgagctcccttttcgtcagtcatcaacgctcacggtgttcaactttgtgggtatgtttccgtggtgcgctccgcggaaggttgtccatagaatgtcagtctccaccacagatacctagttccctccttccttgcggtcctcaaccgaaattggtgaacattgcggcgatctccttcgaggatacagctctcatcgtgttaggatgaggaagctgcagtgcttctaggtaacgacttctgctcagttatgccctgcggatggatattgccagcccaaaggcgcagtatcctttccttgaggactggttgccatggggcatagtagtccttcccatgtcaactgaccaaagttattcgactgctttggttaccggggcacttatgttgccatggggtcagatccctcttcctcttgttacatgctcttctctatccatttcctcgtctcttcgatacatacacctnctnccttttcaacgctcccatcgaccagacgcttctatgaccaccgcatcacagaccangaggattacacgtcacgattcaacagctcattcaatcggtctttcgttttg

SEQ ID NO: 54284 - DNA, 357 bp, Triticum aestivum
  Clone ID: PAT_TA_54284
gggggggtcaacaacagggtacattacaacaaggccaaacaaacaatacgggttatacacccttcgacatcccgggtaagggggcacgacaaggtcaacccttttcaaatctcaaaggggctagaaatctaaaacgaaccgggcttttttacaaacaaaggggggcttcaagctccattgatcggccatgggaccgggcactaaacgaggggctagggcctactggttgcccttgccagggttgatgactctgacagggttggtcaccccagcgggtttttcatttgggatccctcccccctttggaagaacgaacttggggggggtgaacgacctttgcttccctggggggtgggg

SEQ ID NO: 54285 - DNA, 463 bp, Triticum aestivum
  Clone ID: PAT_TA_54285
gggggggaaagagcgaggatgagatgccccttttttcatttcagctcccggtgaagtaaatttaccaccctgaagataaaatgaaaggaaaacgtccctgtaagggggggggtgaaacaaacatagcagtagaccggggggtgaaatggggtaccttgttttttatttggggggcggggcgacgagctttttgatctcctgcagcgcctggatggccaccttgttgtaaaaggcgatgggcgcggaaatggcggccagcgggttggaggccatttcctccttggggtcgtcggcggcggacggcagcggcgccggggggtcctcctcgaactttttggcctgctccaggtgcgtgtccttgcgcggggtggcgaacagccgcacggtgtccatgtcgccgcccctggccgcgttccgttgccggccgtgcgacgttgttgaggccatcgcgtaccggcccccc

SEQ ID NO: 54286 - DNA, 486 bp, Triticum aestivum
  Clone ID: PAT_TA_54286
ggccccggggggggccacttatggaaatccccacaaaaacaaatttttaggaacgggggggggaaaaaaaaatcacacccttgcaacaacccaaaactaaggggggcacagccgggggattggcccatataccggttggagggggattcaggccccaatccttggggggggataaaaagcccacttttttttcggaaaaaaaagggggtggttaaaccccggccccagccttgacggggggaaggtcaaaaatccccttttccatcttggcaaggaaacgggacatgacttccaaactcggttaaaaaaaaaaccttgggaccggggggccctttgggggacgtataaagaagggacccacaaatgactctatgagctggtcaccaagggggttaaagaaatcattgtcccccaggaaaggaaacgaggggattttgatcatggtggggtaggccttatcggctattgggggggaacggaacttgg

SEQ ID NO: 54287 - DNA, 512 bp, Triticum aestivum
  Clone ID: PAT_TA_54287
aaaacccccatttttaaaaacccactgccatgaaggtatttccaacataaatacaaggaaatcctcccgggccaacaaaaaccacaaactggggtgggtaataaacacaagctggggcataggttcataattttgccaatgatttttttaggaaatttttttcatcatcatcatgactgaaaacaggttctgcccaattaacccccaataaaccaaaaatagtacttaaaaaagttgctcctccacgggggccctctttaaaaatgtaaaggaaaaactggcccttgctgatatcgtttccgaaggggttgatccaattttgaaaggccttgaaagggttcccacatttgtaataaacagctttgccctttggagtcataaatgcagaaccctcaccaaaaacagtttaatgctaaatggtccggggacccataaaagaataaacagccctgtgccccatggcacttccagtaccaaaagccatcccctgagaaatggggaacccaatcccg

SEQ ID NO: 54288 - DNA, 634 bp, Triticum aestivum
  Clone ID: PAT_TA_54288
ggctaggtccaagttttgaacaacaaaacaaaagtaaagatgtttgcatacatttacacgctccacagagccgcatggatacatgcaggccggaatgtgtgcttatttacgtacgtacgtaacatttgtagacgtataaatattcaaaccacacaaacataaacacacgcacgtacgtatgcatgtatgatcacactcactcgcacgtactaggcttcggcgtcaagggtgaggaacgcgaacgggcgctcgccgttgaagttgcccgggggattgtagttgcaggtgatgaagacgccccggttccccgtgcagaccacgcgcgcgcagccgatgcgggtcgacttgcgccacaccacctgcgtgtagtgcccgcacaccttgccggcgtcgcaggtgttgctgtcaagatggtagttctgcttctcgtccacccacagcttcaccgcgtcggcggccgtccacgactgcccggaaccccagaagatgttctcgccgaacggcccgccggagtgctgcagccggcaatcgccggcgcgctgcgccgcccagtcctgcgcaaacctggccacgttgttgtcccatgccacggggccgacgccgtccacggcgcgggcgcggttgtgcaggttga

SEQ ID NO: 54289 - DNA, 677 bp, Triticum aestivum
  unsure (1)..(677): unsure at all n locations
  Clone ID: PAT_TA_54289
gatcaagtgaggaaacctagattacacaagagtcatacaacaaaacagatacagttgctcagcagtttacagcaagattcgagctcgcgagtactcgaatcaagaggccacaacattttcaggccaaggtgttccatctctaacactaggtaaaaacaaatagcgcccgctggtaaaagttcgtcatgactgcttgtgaagtttgaagccaaaaacccttgggacgtattgctgtgatggcttctgtggtttcaggtgtgggtatgtcatcaagaagagatgagggaatgtcgtaccaaagtatgctccatcaatgttgccttggtacttggaccttggatagtgtaaatcttcacattttggacaaaacaccttcactgtgcttgacctaggaatgtctgattgccctgctggaagacagggttgaccacagcagtatacacgagggcatctgccaaaatcatagttcttgaacttttctaacattgcagctagacccttgctggttaagatgtaccgtgcatgaattaaaccatacagcatctctgcagatgactcgattaattcattttgctcctcagtgaatacatcaccattagaagactcgatgtctangatgagatcaagtgcataatcataatatggcacctgactgcttangccacagagattgaaat

SEQ ID NO: 54290 - DNA, 368 bp, Triticum aestivum
  Clone ID: PAT_TA_54290
aggaatgggactataacttgaccttcacctcttgtacatgcaaatacacatacagacgacaacagctagcaagttcagctagtccaattcaactgttgatcgataaaacttttatcatagtccagcagactgacattcagaagtccaagttgccatgttttccttgtagactcgacctattcctcctctccgctcgtttgccttgctgctcgccactaccatcagctccagcaccgactttagcggttctccctatgcctagttttggcaagcctcagttcagtccatctagcaggacacacgctttgcataatttctggctagaaatgtaaccgcagcgttcacatgttccttgctctggcattctt

SEQ ID NO: 54291 - DNA, 612 bp, Triticum aestivum
  unsure (1)..(612): unsure at all n locations
  Clone ID: PAT_TA_54291
aactgcttccatctctttattcatcatcatatgattatgtatcatcgccaggaagttaacgcatgtatggttgcaatgcgctgttccatggatgaatgtacatgcatgtacgtgtcaacgtacgtgcccgttacacttggatgccgcattacgtacgtacgtacgtacgagcagcttatttaggctgaagatgtaggtatagtataagcataagagatagctagttagaactggatgttgtaggccggcgacttgtccgggttgaagagcccgaagctcctctccgtggcgtccccggtcttctggttctcgttgaacatggcgaagatgtacgtctccagcgcctgccgcttcttgggcgtgcccccgccgacgtggttgatcagcccctggttgtacgtccgcgcgttgtccgccgacgccgcgaacccgccggccgacggccacccgctctcggaaatcaccaccttcacgcccggcgcgccggccttctccagcgccgngtacacggcgtccaccatcgcgtcgaacagggatgtgtaggtcagcccgttgttctggtcacgcacggtggtgcccggctggaacgtggcgtagttcaggctgatgtcc

SEQ ID NO: 54292 - DNA, 550 bp, Triticum aestivum
  Clone ID: PAT_TA_54292
aaggggacatatgggataatattatgcgtccgggcttatacatagccaccgatggcattaacatacaagcatgctttttggagccatgtgggtccatgaacatggacatacacatttttttaggaacaaataaaaaagataaatggggaaggaaaacccaaagcaatgtcaaagttgacaaaactgcaatggcactttatatatggcctgtcgggagtgagctgtttaggccttgccggactcctcgaagcccgggggtttgaaggcaataaagctgacccactgcacctgacgcatgttgtcaaatccgatgatgcggacatacgcgtaagggtactcctttttgacctcctccacctcgttgatcacctgggtggggtcagggcacccgaacataggcagtttccacattgtccaataccggccatggtagtacccaggaaatgcgttgtgctcacggaagatgaacccaaccttgctgaactcgaggcaaggcacccacttggagcggatcaggtagtcgacctgcttgaggagggcctccgtgctg

SEQ ID NO: 54293 - DNA, 381 bp, Triticum aestivum
  Clone ID: PAT_TA_54293
cccgggcaaaaagggggggggggattaccaaacccaaccctcccggccccggggccaaagttatcccgggcctaaccccccaccaacccggaacccaaggggcgggtaaaccggcaaacccccgggggttccccggggccaaacccctggggccaccttgggcttaaggcggcccccccagccgccggttaggcccccggccgggccccccccggggggggttttgggggaaagcccccccggccttccccttccccaagtcttggccccccaaaatcccaacgggttcccttttaaaagaaacctccccaaaaacctcacaaaagccctgggggggggggcccccccccttttttttgttcggtttccccaaccgggccc

SEQ ID NO: 54294 - DNA, 460 bp, Triticum aestivum
  Clone ID: PAT_TA_54294
agcacaaaatgagtcttgatttttaagtcatgggggaaaaaatctgggtagtccaacagctggagattattgccttgcccttagcatcataactgaaccaaagatgagttaacagaaaacaaccacccaaaaaatagaccgggagactaatggggtgctgcaacagcaggggcaccctcagcttcctccttggccttacgagcagcagctctgatctgacgttgctcctccttgtaaatcctgttcctgcgctggaactccttggagtgggggaggcactcgaggtagtcctcgcggaggaggccccattcggagggctggcggcagcggctcatgcactcgctgaactccaaccaaaagtcgtagcagcggcccttgttcccgttgatgccccagccggacgccatcggcgccctccttttcctggctctctcccgcccggtagggtctctttctctct

SEQ ID NO: 54295 - DNA, 458 bp, Triticum aestivum
  Clone ID: PAT_TA_54295
aagacaaattttttttttggttgggcagaaatgcctaaactggtacaagagctttttcacggggcaacaacagggtttttttaaaaagaaaaaaagataaagactggggacaacaaccacaattggtgggggggggggaccaagtgcacgtacaaccacaaaaggtccggtaaacccatttgagtttttattatcggcacaccatttttttgaacatgagcgatcagttctttttgcagggggggcagggggtgccctcttccccccgtgcattggcgcaccggaacgtttttggggggctcgtttgcacaacccgggatttcacccaaccgtcgggggacttggggccggggttttcacaaaccacggcccccgaaaaaaacctacagttggcgcaacactttgggaactcggggttcgcttgggaaaggattcccatgaccaggacggcctggaaa

SEQ ID NO: 54296 - DNA, 472 bp, Triticum aestivum
  Clone ID: PAT_TA_54296
ggaaaaacagtttctgctttttcgggatttgaccccaaaccctcgggcgggggttccaaaacaaagggccattcagctttgcttttacaaaaccgacaagggaataacgggtcccttgtttgtttgagggcccaagttggaaactgcctcaattcaacttctttagtagctcgttgatcttggccccggggttgcccgagtcgccgccatccttgaagggtttttttttaatttggagcctcctttccggacacttgagcttgaagggcatgaaaaagctccccgtttttttgaagggcggcccgaccggggagatttcatgcacgacgttttccaaacatatgacgccgggttctccaaaagccttttcgattaaatcattgctggccagggggaaaggctccttgtcaaaatatccgcgacccttcttggaaataagctccttcacattcttcaaattggggaacccata

SEQ ID NO: 54297 - DNA, 156 bp, Triticum aestivum
  Clone ID: PAT_TA_54297
aatccgagcaaaattaaccaagttaaattaaaaacatccaggtcagatcagcattcaacacccctccaactcaactgtacaagtttccaaccctcagaacacacacccaaaacgcacatcacctcttgcgcacttcgccgtccccggacgcgtggg

SEQ ID NO: 54298 - DNA, 558 bp, Triticum aestivum
  Clone ID: PAT_TA_54298
agaagatagtagcagcagcagcaacacaaaaacagtccgtaccctcgggtgcgtaccagagcaacaaaattctgcacagtttgctatacatacatacatgcatacatagatgcacatgagtaggccggcaagccgacggcgcgctagccggcgagggtgtggctagttggtgtggcagtcgtagcaggtgcggttgcggccgagctcgctgagcttgtcgtagccgtggcggaagacgcccatcccgaagaggacgccgacgaggagcgcgatgcacagcagcaccagcaggcagcaccccaccctctccttgctgttcaacttgaagcacatccttcctccccctcctctcttttcttcctctatataaaccttgatctctctctctctctctctctctctctctctctctctaggcgagcgacggtgctgcggcgtgagggttttggaacatgcaggcaggcaggctggagcagcgcgggcacgcccttttatcagagaaaattttaacccggcagctacactttgctcgaaaagagagagcaaaactgatggagc

SEQ ID NO: 54299 - DNA, 571 bp, Triticum aestivum
  unsure (1)..(571): unsure at all n locations
  Clone ID: PAT_TA_54299
cttcatctcaatatattaagcccttcaaagaaggaattgcaggttacaatctggcgcggaaaactatgaactgcctttaatgatttcaagaaacagaataatactgggtttcaccaagtaaaagaggtaccatcatttttcttcctaaccggaatgaaccacatcgcacacaaaaccacaggtaaagaaagttgctacaaggatctgctgctccaaacttacagtacaaacttcacatacacatcagcaaactggccattaaaacacaagcggtgaaaaaagaacgcggcaaactgaaggagcatgcagcaactagtgtacagtccggccggtcagccacggcccacgggtacacgggaaaccggccggcggggaacctggccggtctcatctcacttgggcccccagagcagcaggtgcatcaccttggccgtcttgccgttgccgccgttgttatcctccgcgcgccgccccagttccctccccgccgccgngccggnacggggcaggtgctgcctctgctcgccgtcgcgcgccggcgcccggatagcaaggagccgcccccacccgc

SEQ ID NO: 54300 - DNA, 567 bp, Triticum aestivum
  unsure (1)..(567): unsure at all n locations
  Clone ID: PAT_TA_54300
accattaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttgaggagggcctncgtgctga

SEQ ID NO: 54301 - DNA, 476 bp, Triticum aestivum
  Clone ID: PAT_TA_54301
gggcgaataaaatacccaaccacaggattccgggggagtatatcgggcccggcccccccggttaattccccacaacggggggcatgaatatgggcccgcacacgggcgggggcaggaaatttcccacccccccccacaggggggggggtacgggtctggttatgggggcctaaccttggggggttttatggaaaacccaaaacaacggggcctgaaaaaaaaaacaattttgtttctgtatacccaaaccctcctgggggggacaatagccccgggggcctgggccaagaacccccccgtggccggccggttagtccaaaaaaatttcggaaatccaaaagaaaaaaaaggccggcagggacccttggaggaaacccttcccccccctggatttggggcttggccgggccccctttttcccgcccggttggccttgctcccgagacggcgttgggtaccctggcggggggggagga

SEQ ID NO: 54302 - DNA, 569 bp, Triticum aestivum
  unsure (1)..(569): unsure at all n locations
  Clone ID: PAT_TA_54302
gtagaaagttttcggcgccattgcatatttatgagtagcatgtttccacagcacgatgaatacagtgaatactcgttaaaagtacgcgctctgcgggtcaaacaaacagcatgaacaaatgctcggttacgaaacaaaaagttaaacgagagcattgccttatcattgaggttgtggaagaaacaaagatcatctccacatgacagtgacgcccagtattgctggccaccagaactccacataaacagccgctgcccaccagaactccacatacttcctggatatatcggtcaaaatgacagaagctaacttctggtcaagcatcttcttcaatcatgattcagatcaagcgttgctcttctggtcttcgattttcttctggaacgatgtgaaccattgcttccaagccgcatctccttgttgctcgatccatgacaagaaacaactgtctaacaggcagaacaagttcacatagagcagttggtatcgcacgggaatgaagcggaagtttgcaatctgcacagccggccagatggctcccccttaaaccagagcangaatgatgtccc

SEQ ID NO: 54303 - DNA, 485 bp, Triticum aestivum
  Clone ID: PAT_TA_54303
aaaaggaaaaaaacaggggggggttccccccgaattgggggggggtaaaccaacaaccttaaaaaccggccagggggggggccaagcgcgcccaacggggccttttgcatttaaactcgaacttaaaaaagagaaaaaaccggccggggaaaaatttttaccgcccccccgcataattatcgccccccccccaaaaaaaggggggggaaattttgggggggggcatggggaagcaaacgggggggtactttttttggggccggggacccccctttttgacgcccgcctgggggaaccccccccccccaatggcccaaaaggccccaggggggggaaaaaacaccacggaacgggggccggggggggggggccccacgggtgccattttgggcgccggttcttggtggcccttgaccttggggggccgggccaccacaaggccccggggcggggctcccccccccccgtccacccccccgggcggg

SEQ ID NO: 54304 - DNA, 404 bp, Triticum aestivum
  Clone ID: PAT_TA_54304
aaaattctgccttggactaattaccaatttctgtttacaagacacttttcgagtgcacaagctacacagggttttgctgtatgcacaggaatgacctggattctggacacacaccacacctattgcttgtcttgtccaggtatagatccggtgagaatcgggtttggttcatgcacaataagcctgtgacaaggactaccacgaggcgctgcagcgtgcaacagacaaatccaggtgccttatgctgctccaggctgaaatccaggcacagcggatggggtacttattcatcaggaaaaggacctttgggttatgcaaaaatgtcaaaaccccactgagactgtttcatgattcgatccaaaagactctagcgaaaaagggccttgatgataataactgtttac

SEQ ID NO: 54305 - DNA, 445 bp, Triticum aestivum
  Clone ID: PAT_TA_54305
ggggggaaagcaacagcccctcaccactggaagggggtggtcccactttaaaaacttggggctacaaagggcgactgggggcccaaaaacaaaaagacttggaaacaggtcacatgggaaataccccaatttaaggccaatacaagcctaatttacaccagggggggggcacataaacccttaacaattttttttggggacaggttccatcgcccttttagggttccctaacttttaaaaattttctctttatacaaaaaaagaataaacccttttacccccccactgtttttgcagccagctaaaatcacttggagctaaacaaaactgggttggtgacctgcctaaacaagcgaaaattgctgttatacaatggactggggggggggagccaccgggggggagccaatttggcgtaaacttgctcaaagataggccccacatg

SEQ ID NO: 54306 - DNA, 497 bp, Triticum aestivum
  Clone ID: PAT_TA_54306
ggaagcaaaaaattccccccacttttttttttggtggggccaaacaaaaaaaactaaacggacccttttatacggaaaaaaacataacacactcacatgacccacacaagcaaataaaagcaagcaggggggcggggggacataaaccggttgaaaccaacttgcaaaaaacacaaatttccaacaaaactaggggttttgcttgcacaaaaagctcactagcatgccttttccctgacgcattgaaaattattttgagcacttttgccctgagccttccaccccttttttatttggcaaatgcacaaggggcctccaaaggctacacaaaagcccacttgaaccttggttttaccccccaaagtattcctggggggaggggaaattttaataccttttccacagttttggaagcacgctttcacaacattttgatcgacaccgtggaaaaccggggcaccgccgacggaaggtactttttgggccaaagggacggg

SEQ ID NO: 54307 - DNA, 611 bp, Triticum aestivum
  unsure (1)..(611): unsure at all n locations
  Clone ID: PAT_TA_54307
atataggagtaaattatactacttgccacaccacataatttgctgcaacgtgatatgtattcgaacttcatacattgtttctctgacacgatttgcatttagtagcagtgtaacacaatgtgaggatattactgtatccgaacttcacctttctcttcctctaaaatctctcgtaacacaagggggaaaaaaaccacgttcacgtgatcgcgatccggcggctgccatcatcagctcaccctcaccttgctgccgcagcatccgccgccgccggccggcttgcccttcttctcggcgtcggtgcggtcgaggaactcgcggttctccttccacacctcgccgtcgtcgtacacctccttcttccagatgggcacggaggccttgatctcgtcgatcacgtagcggcacgcctccatggcgtcggcgcggtgcacggccgaggtcgccacgaacacgctggcctcgccggcggggaccgtcccgaggcggtgcgccacggccagccggcacagcgcgtgcgcggcgcgggcctcgcggaggatggcctccagccggcgccgcgccatggccccgtacgcctcgtagcggagctccaccacgcgcctnccgtc

SEQ ID NO: 54308 - DNA, 515 bp, Triticum aestivum
  Clone ID: PAT_TA_54308
tttttttttttttttttttttttttttttttttttttttttttttttttttttttttttttttttttataaaaaagggttattgaaaagggccggggccccggcctaaattggggcgggtcactggccttccacacggttcattcttttcaggccggaccaaaaaagggggggggggggggccaaaaacgaggggcaaaaacaggggggcccaccccccccccccccccaaacccgcacccccccccccccccccggggggacaaccccgaaaaaaaaaaaaggccaggaaccccgcccccccccgcgggggggggggccaaagccccccaacccagcgggcggaggggggcacaaaaaggcccccccggggcggacggtggaattggaactgccaaccgggcgggggtgccacccccccaaaaaaaaaccggaggcctacccccaaccggggcgccagggcccgcggcgccggcttccacccccccacccccccggggggggggaccggggggg

SEQ ID NO: 54309 - DNA, 674 bp, Triticum aestivum
  Clone ID: PAT_TA_54309
gcgacagcagcaacaggcggccaaggatgccgaggatgcgcgcgctgggctggtggatggtcatgacgacgacgctgccgctgcgcgcgatggtgcggagcacctgcaccaccatgaaggcgctggccgagtcgagacccgaggtgggctcgtcgaggaagagcaggatggggtcgtggatgatgtcggtgccaatggacaccctgcggcgctcccctccggacaccccgcggtggccctcgtcgccgatgatggtgtcggcggcgcgcgagagcccgagctggtcgatgagccggtccacccgctcgcgcttggcggccggggagagcgcgcgcgagagccgcagctcggcggcgaagagcagcgtctcgcgcacggtgagcatggggtagagcaggtcgtcctgcatgacgtatgcggagatggcgcggaggcggctgccgtggagcggctccccgttgagcgtgacgtgaccgcggaggctgtcgcgcgcgatccggcccgccagcgcgtcgacgagcgtggacttgccggagccgctggcgcccatgacggcgaacagctcgccctcccgcgccttccccgagactccgtccagcagcgccttggtgttggcgggcggcgcgtccgtggaggccatgcggttgctggcgcgcgaggggaggcagcccatg

SEQ ID NO: 54310 - DNA, 478 bp, Triticum aestivum
  Clone ID: PAT_TA_54310
gggaaaaatcacgtcccacccttagggtccttcggaatttacagctcttccaatggacaacgggtttttccaaaatagggcaggttttgaactttcaaccctttttgggcctacaaaatggcaaacataatggccaagggggccttttttgcccccaaaaaaattttatgccctcaaaatttttctgccggttggggctttcaaacaacttaaaactccttttggggtcttgccctctcaaaacccactgaatctgggggtctgcatttaatcatcgcccttgaccatttcagggcccccaaaaaaaaagggtcccgatttgaaaaaataccccccccactgggggggggttaccaacccctcccacttgaataagaaaacacttgccttttccaaatgaatcgcaaaggaacaaggggcccttttccaaatgagtcacaagggaaaaagattcccggcataaccgctaaagggattg

SEQ ID NO: 54311 - DNA, 743 bp, Triticum aestivum
  unsure (1)..(743): unsure at all n locations
  Clone ID: PAT_TA_54311
cgaagattgtctgacgaccagatcatccgttgtttcctggttgtggcattatcaacattcttctgcccgacatcaagcactaaaccaagcaccaaatatatgggagctctagttaatgtggagcaactcaagcaactaaattggtgcatgtttgttcacgattgggagttgatgtatataaagaaataccaaaaggaaaagctgaagcagaaccgaacaatgatgactctaggaggatgtatataccacctagcagtctgttgccttgattttactgattttcgctcaattcaaatcccatctttgatgcccaggatatgtgtttggaagggagatatggtcaagcatttaagtgacatgaccattggaagagatggaaagtatggatgtctgacaataaaagaagtatcagaaacctgctataaggatggaacttttgagtgggcaagtacgattaagaattcaaatttcaggaaagcgataaacaatgttgcagggaattctttgtctgacaaggtcaaagaggatatcttcctcgcttacgaaaaccatatgaagaatgaagacctaaatacttgcatcaaagctaaagggcttcttctagacacgatccgcatcataaccaatgncctctggtgaatcaagtgatacagttaaagtgggctcaacaggaactgaattgaatgcaagccaacaatctaacaactcangagacactgtcaaactacaatcgactgaacttc

SEQ ID NO: 54312 - DNA, 542 bp, Triticum aestivum
  Clone ID: PAT_TA_54312
catcatcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaact

SEQ ID NO: 54313 - DNA, 509 bp, Triticum aestivum
  Clone ID: PAT_TA_54313
acggcatcgtgctctggacggcgtggcacccgacgggctgctacgtcatgtgcctcactgacgacaacttcaacaacctccccgtcggcgacacggtcgacaagctcatcgcggagtggaagacgacctcgcacgtcggcgtggcggacgccgacgggcactacgacgcggagctcttccacggggactaccaggtcaccgtcactcacccggcggcggcggccaactccaccgtcgtgcagagcctcagcgttgacagggagtccgacaacgagtacaccatacacgtctagcctagtactagtatccataggcgtgtagctagcgcccatacggtgatttcagatatgcctgccattgattgttgttgttgatttagagcattgttgttgggatttcataggcgcccgcccatgagattgaattcccagtcctggagaggcggtggatcatgtgttcattattatcattatcaattgaatcaaggagaagtttgatttgttcttctt

SEQ ID NO: 54314 - DNA, 647 bp, Triticum aestivum
  unsure (1)..(647): unsure at all n locations
  Clone ID: PAT_TA_54314
acgggacacaccgagctaggagaaggatgtgttgttcacacgtatgatgacatctctccctattttctgttccggcttttctctcttttggtaatacataaaggcttgcattgtatgatttgaaaattcaaattggcatgaaactagaaatagacgcgagaaagaacctgtaagtttgttccaagataaagtacaagcaaaagtaagtttaggttgctgtggccatgacttgaataacatcactaggtgctggtggaggtcggtactggactactggtactctggttgtatattgtttcagtagggattcagaaatacttcacatcacatctgcaaactaagcatagcttagatggttaggtttcttgtggtggaaccagcccacacccaatctcaagacctgccgtctctctgtactgtttttctccaaaagaaagagatgtacttcacatctctttttaggttcttgatcagggtttattagtttagaaaaggaatgttctcaccatatgaagcacttagttntttgtcaacagttacgccatagccagcagcactcaagtctgaaatttgcaaagntccaggatagtccattgtgcanattcgatgaatgtgaaaatatgacatatcactatatcagtaacata

SEQ ID NO: 54315 - DNA, 618 bp, Triticum aestivum
  Clone ID: PAT_TA_54315
ctcgttagctttcgccatgccggcagcttccacgctcatgcgggtcagtagtgccgggcgcttacctggggtgatcgaatctctctatccccgttcagctgaccgagcggccctctctcacgaaggctgtggcggtcgaatgtcacgctcccaccttgggctcccaccgtgcatgctgcgtagatctgcgtctgcaccgtccttccgttcgacggtcctccccccgccttgaccgcacctgactaccatacgcttaactgcttataagaacaaacgccatatggtatggtgaaactcggggcacatgataaagaccttgatgtcagatgaaacccttgggtccttgtacgatctgctggtgcaatagctttcaaccacaagcgtgaccttgatgagaaggttcgccggttcaacacattctagaacaccgttctgtacatgcacaacaagcctaatgtgggctacatatggagaatacacccaatctgctgatggaaagctaaggaagccctgtagcactgatctgcttgatcgtaacatcgcatatcatgttgacggctattatgctgaataggtaacagatgacacttgcaaactatacaagcgactctacactga

SEQ ID NO: 54316 - DNA, 639 bp, Triticum aestivum
  unsure (1)..(639): unsure at all n locations
  Clone ID: PAT_TA_54316
tgcaggtaccccggtaccggnaattttcccgggngtacgacccaaacgcgtccgcaacaagccatgcttgttcccattccagctcaggacgagcagcgaccaccttccggcgagggtagcagacatggacggcaaggaggaggacgtgcggctcagaacgaacaagtactcggagcggctgcccatcggcacggaggcgcaggggtacgaggacaaggactacaaggagcccccgccggcgcaactgttagagcccggcgagctcaagtcctggtccttctaccgagccggcattgtcgagttcatggacaccttcctcttcctctacgtcaccatcctcaccgtgatgggctacagcggcgccacctccaagagcgacagcgtcggcattcaaggcatcggctggtacttcggcggcaagatcttcgaccttgactactgtaccggcggcatttccagcgggcacatcaaccccgaggtgaccttcgggctggtcatggcgaggaatctgtcactgaccagggcggtggtctacatcatcatgcagagcctgagcgccatctgcggtgctggcgtagtgaatgcgttccaggatggcctgtacatgggcaaacgcggcagcaccaacgtggtggcgcc

SEQ ID NO: 54317 - DNA, 822 bp, Triticum aestivum
  unsure (1)..(822): unsure at all n locations
  Clone ID: PAT_TA_54317
ctcgtagctagcaggctactgctttccttggctggcttgatcgagagagcgagcatggtggagagcgtggcagcaacgccgtcggaggagcaaggccgcggcggcggcctgtcgctgcctccggggctcaggttccaccccaccgacgaggagatcatcacgagctacctcctgcgcaagttcctcgaccctagcttcgtctcccgcgccgtcggcgaggtcgacctcaacagctgcgagccgcgagatctcccaggcaaggccaacatgggggagaaggagtggtacttctttgtgcacaaggacctcaagtaccccaccgggagccgggccaaccgcgccaccaaggagggctactggaaggccaccggcaaggacagggagatcttcaagccccgcgcccgcgagctcgtcgggatgaagaagacgctcgtgttctacaggggccgcgcgccccgcggcgccaagtctgagtgggtcatgcacgagttccgcctcgaaggcaagtccagaggccaaaccatgaacaatcccaaggacgaatgggtggtgtgcaaggtgttcaacaagaagggggaggccaaggcggcgagggccgccgacgtggacgccgagtactccgccgtgacgacgccgaactctagctcggtcgtcgacgccggcgagggcgccggagacttcaccgactccatgttcacgatcgacccgctctgctacatccccaactncgacgagtacacaagcaaccagccgncggccaagacgacgacgttcaccaccaccaacagtgcggcgccgncgtacaacgcggactactactac

SEQ ID NO: 54318 - DNA, 712 bp, Triticum aestivum
  unsure (1)..(712): unsure at all n locations
  Clone ID: PAT_TA_54318
aagctctcgaactaagccgatgtctattcctgatgaagtattaactccaagttaccattatgtacatggatcccctctactagagagcacaacaccatttgattccccggagtttgctgaaaaaactgccgaagctttaggtaggatcttgatcctggacctcattctgagaaatgaggacaggctgcggtgtcggccccttggttggcgtggaaactatgcaaatttacttgttgcctacaaagaagcttatgcaaaccttgattcattggatgatattcatgattctgccatcatccgctacaagccagagataatcaaaagccctaagaaacaaaagcagagaagatccatttcaataagcggcagtgtaggctcagatatctcagagcttttggaagactcttatgatcaaattgagcctgagatttctagctttcatattgtagccattgattcgggtgtaccacgaagaccacccgccagtaaacgaacgaaagatcaagagagctatccaagactggtggaactaacactaaataacctggactattcttcgaacctcttatttgaggtgtccattggaaaacttggtacccctggacccgaagaatatgacatgtcatcctattatagctatcattctnctttgtctgagagtgatatggtagcaatagttaattcctttccgagaggttttcgtagtgctctg

SEQ ID NO: 54319 - DNA, 697 bp, Triticum aestivum
  unsure (1)..(697): unsure at all n locations
  Clone ID: PAT_TA_54319
aaaatcttctcaacgatcaattgggtgaaggcaaacaatgagtctcttcggcttgggaagcaattcggttgatggcaataggaaccaaaggacatttaggcccaagaagaatgcaccatctggtaataagggcgtacagttgaagaaacacattgatgcgacattaggaaatggtaatttgagagatgttgtacggttgcctcctggagaggatctcaatgaatggttggctgttaatactgttgatttcttcaatcaggtgaacatactgtacggcacactgatggagttctgcacgccttacacatgcccaacgatgacagctggatcgaagtttgagtatagatgggccgacggagtgcagatcaagaaacctatcgaggtttcggcaccaaaatacgtggagtatttgatggactggattgagatccaacttgatgatgagtccatattccctcaaaaacttgaaaattgtgagcctgaaggaagaagcccatcttaacacatgcttcaagcattttacattgttcacctgcgagttcaaattgatcgacaaggctgaacttgcaccacttattgatcttattgaatcaatcgtgactgtttgctaagatgtcaacaaggagagtggaacattntccctagtttatttgggcattttctagggtacaatgagttgtgcatgagagtgagactg

SEQ ID NO: 54320 - DNA, 597 bp, Triticum aestivum
  unsure (1)..(597): unsure at all n locations
  Clone ID: PAT_TA_54320
cggacgcgtgggctgtcctgtcctttcttctccaactccaacctccccctctcctcccctccccaaatttggatcaaacgaactcgctaaacttaatctcatccttaaacgcgcggcgaacggaatcggatttgggagggacgaggcgtttggatcccattttgggcgggggctaatcgcggtaagcagtgggtgatttgggccggggttagggtttcggatctggtaataatccggcgatgaacggcgagatgatgatgcggcctcccatgccggcgccgtaccaggtgtgggcggcggcgctggcgcagcagcagcagctcccgccggtggcggaggcgccgccggcggcggggttcaagccggcgaggcccgcgtggaagcgggcggcgcggcagcagtccgggtggaagcagcgcaaggccacggcccatgcgcaggggaggtggggcgggtcggcggcgccgcgcaacacgacgtcgtacctgatcncggccaagcgggcgggtggcgtggcgtcgctggtgtcgccgtgccccgtgacgcccgccgtgctgccgacgccgcggctgtcgccccgcgcggaagtgctggtgg

SEQ ID NO: 54321 - DNA, 99 bp, Triticum aestivum
  Clone ID: PAT_TA_54321
actggatattggataagcttatgtcttgcaaacatatgccacccgaactactgtcatgtacgtgtagataatcactgaagttaagatggtctggtatct

SEQ ID NO: 54322 - DNA, 414 bp, Triticum aestivum
  Clone ID: PAT_TA_54322
gtgccgctgccactctccacctgcccaccttcgttttgtcgaaggcctcgcacgtcgacaggaacgcttctccgccgcgcgtaggacactgcctcctccgccacctgcgtcctccctgcgtcaagcatggcgcagtctcggctgctgagacgagcctgactcgacaccgtgcgccatttgaccgggacgcctcccaaccttgctgtagacttcgtcgtcgagggtactccttcccccgcttccccgcggaggcggctcagttactcacctcttcgtgtactacgcctgtccctcggcgtggccgctgcctctgtctcctaccactcaaggggctgggacactccactctctttatctgtgtgaaacccatgttctagctgaccatggtgtccgactaccacctgggtgggttgt

SEQ ID NO: 54323 - DNA, 676 bp, Triticum aestivum
  unsure (1)..(676): unsure at all n locations
  Clone ID: PAT_TA_54323
cccacgcgtccgggaaactctgngagatcaccatggccgacaaggcaatcaacaatatgactggagaggagctaagtcgacttgtttcagagaagcattctctctcaattctcaaaatcggtggctgctctaatcttggttttcttaatctaagctcttcaagccttaatgttctttggctatcagatctttgctccctttcggaatcggtcataagctgccctaatatgagcgagctctccctgtgtttcacacaacaaagttcggaatgtactgacctggttagtttgatggatggcctgggccgatcgtgccctaacttaagaaatttgcacatatcatcaattcaactatctaatgaagctgtgtccgctctagaggctgccaacctcaggggcttgtgcatgctatccttgattctcggttcaaaaatgacagatgcagctgttgcatctatcgtcagatcttgtgcaagcttggaattgcttgatttaagtggatctagcatcagtgatagtggtgttggtatgatctgcaaggcgttccctcatactttatcgaggctgctccttgctctctgcccaaatattaactacatgtgggatccaggctgcaacagcacaattgccacttcttcagctcatggactgtggaatgagccctacgtctaacttgc

SEQ ID NO: 54324 - DNA, 731 bp, Triticum aestivum
  unsure (1)..(731): unsure at all n locations
  Clone ID: PAT_TA_54324
gccaaaacggtggtgtctttggccagatgatttgaccatcatctatgatctggaagaagaacctctcacacaaacatgtatatttatttgtgaatccaatcataaccagaatgtatttgaccttttacattttccgacagaaagtatgagcacctaaatttcttggaattcagtagctcatgtcttggatacatagctctggaagataatttggggaagagactagaagtcaacaaaatgtgtattgtgattctggtctaagaacattttttcttgtatagcatgtcttggatgagaaaggtcgtgagaacttcaatgaatacttcagcactgccaacagatgctgacaaagatgaaaaaacatgaggttgctgacaacattgagtgtgacttgcttttggtgctactgctgctgaagacaagctccagaaaaaggtactagaatgcattgaaaagctcccacaagcaggaattaagttctgtgtgctgactgtgacaaaatggatagctatcaatattggataatcatcatcccggaagcacttgcaccactgccttgagaaaaacagagtgaaataatctattgccgagttgaacagatgatcaaactgcctttatatttaaaattatcgcctatgttcttgattttttttgatcgaatactggatgtttccctggttggtcttatggtgaagatcagatagttctncttgatgatgatggcaccaaca

SEQ ID NO: 54325 - DNA, 683 bp, Triticum aestivum
  unsure (1)..(683): unsure at all n locations
  Clone ID: PAT_TA_54325
attctgggttgatgctaaaatgctacttgactatgcacactttggcgatgttgtcacatttgacactacatttggcacaaacaaagagtataggccatttggtatttttcttgggctgaaccagttcagaaaaacaaccatttttggtgctgcattgatgttcgatgaaagatttgctgttgctattgcgaggttgcatggagatttacagtttgaggaggagcgcatagtgataggtgatcctttgaccaaaacggtttcatgtagttgtgggatgttcaataggacaggaatcttgtgtgcacatggtctaaaagtgcttgatttgatgaacataaagacattgccggcacattatgtcttgaagaggtggactagagaagctcgcaatggaagtatacaagatagacaaggaaggaatgtggtagaaaatccaaaaatggaagctgaacttcgatacaaggatttgtctcataaatttcacaaaatggcacaaaaagcagccaactctccacaatgttgtattctattggataatgcacttgattccgtcgctccgcatatacatgatttactcaatgcatccactagtgccatgaatgaactatgtaaagnacaagagaatgttgacccanatgtgcagcaagtagatgagttgcttagatctgcacggctgaagaaaa

SEQ ID NO: 54326 - DNA, 601 bp, Triticum aestivum
  unsure (1)..(601): unsure at all n locations
  Clone ID: PAT_TA_54326
cccacgcgtccgcccacgcgtccggcttgccgcggctgcgctccagtggtgaacctgctcgcgtgcgcgccactcccgctcccggcggcatctgctcgaggcccgtcaacatctgctgcaaagggcgcccgacagccatgggctgacggtgcggcgagcggcaccgttggggggttgaacggcaactgcggcctgaagaaaaatgcttcaactggcgacacgttttgctggaaccagcttagacatgagatacaacaagcctgcggtggtgctgcaaggggggtagaggttgtgttgtgttaatgttggaaccggcgtcgagatttgctggaaccagcatctcgatttgctggaaccgcttcgcgggtgtgtcgatttgctgcgacgattgctggaaccggcgtccagaattgctggagcgattctctccttcgacggcgcccacggggaccatggtgaccacggtgtttttttgctgcaaccagccgcagcgtttgctggaaaccgcgcccataattgctggaacgggcttctctccttcgacggcgaccacgagtgcccatgatgcatncagaatttgttggaatgggcttgttccttc

SEQ ID NO: 54327 - DNA, 535 bp, Triticum aestivum
  unsure (1)..(535): unsure at all n locations
  Clone ID: PAT_TA_54327
gcgggctccttcgacgaggcgagcgtgctgatcgacggcgcgcagtcggtggtgacgctgtgccagcggtcgtgcgagggggtgccgcagggggagctcacggcgtgcaccaaaggcgtcgtcgaccaactttgcaccattgccgcatcagtcactcggttggtcgttcagaagtaattataacatctgggttctgcgatgtatacccaccgacatcgttcagctggtcagttatttgatactgacggccagcggcggaggtccccgtgggccaacagggatcggtgaccacacctttgtttgcgatcctttcatgtatatatatagcagagaaattagtacgtgctagcttttgtggaaactcgaggtctgcctggccacacatgagccgggctaagacgacggtttttgtattttatttagggaaatacacacttaaatggtggaatactatgtgtacatgagatttctggtacaaaaatgttacattgtggtttcaaaaaaaaaaaaaaaaaanaaaanaaaaaaaannaaa

SEQ ID NO: 54328 - DNA, 101 bp, Triticum aestivum
  unsure (1)..(101): unsure at all n locations
  Clone ID: PAT_TA_54328
tgttntgtcaaanacactcacctcaaatatcacacatcacattattctaactgcaaccttcaattacatcatgccattgccataatgtcatatagtacacc

SEQ ID NO: 54329 - DNA, 606 bp, Triticum aestivum
  Clone ID: PAT_TA_54329
ttgtgttaatatatgaacttcttgatgagattatggacttcggttatcctcagaatctctcccctgaaattttgaagttatatataacccaggaaggcgtgcggtcgccattttcttccaagccttcggataagcctgttccaaatgcgaccctgcaagttaccggcgctgttggttggagaagagagggtctggtgtacaagaagaatgaggttttcttggacattgttgagagcgtaaaccttcttatgtcttctaaagggagtgttctacgatgtgacgtgacagggaagattcttatgaagtgcttcctttctggaatgcctgatctgaagttgggactaaatgacaaaattggacttgaaaaggaagcccaactgaagtccaggccttcaaagagtgggaagaccatagaactcgatgatgtcacgttccaccagtgcgtcaacctaacaagatttaactcagaaaaaacagtcagctttgtgccaccagatggtgaattcgaattgatgaaatatcgaatcacggagggtgtaaatcttccattccgggttctgcccacaattaaggagttgggccgaacacgcatggagattaatgtga

SEQ ID NO: 54330 - DNA, 652 bp, Triticum aestivum
  unsure (1)..(652): unsure at all n locations
  Clone ID: PAT_TA_54330
cggacgcgtgggtgcaaggcggctgccgagatattgacgagtgcggcgatggtggaatcagttacccgtgctctgctcctggtacctgcatcaacaccccgggaggattcaggtgcgcttgccctgacaagacaacaggcaacgcttatactggcacatgcgaggccaagaaatctcaacttggagcgcacattgcaattggtgttagcatcagcgtagttgtactggtaattagcatgtcctgcgcctacctgatccacgaaaggaggagcctcgccaccgtaaagcggaggtacttcaagcagcacggaggcctcatgctgttcgaggagatgaagtcaaagcaaggagtgtccttcacgctgttcaccaaggaggagctagaggaggcaaccggcagattcgacgagcgaaatgtgatcgggaagggaggcaacggcactgtctacaagggcaccctcaaggacagccgaacagtggccataaagcggtgcaagctcatcaacgaccggcagaagaaggagttcgggaaggagatgctcatcctgtcccagatcaaccaccgnaacgtcgtcaggctctacggctgctgcctcgaggtggaggtccccatgctcgtctacgagttcgtccccacggcaccctgtacagc

SEQ ID NO: 54331 - DNA, 187 bp, Triticum aestivum
  Clone ID: PAT_TA_54331
gcggcattctgctgtgctgcgatggtacaataccatggtgcctcgacgtgatgggtaggggagggttccactgtctggccctttcaggggctgaagttcacagtcgggctgcccgttagtcgtcgcttgagtggtaggctaggtcgtgtgagcactggcggatggatgaggtgcgtgcgggtttggt

SEQ ID NO: 54332 - DNA, 264 bp, Triticum aestivum
  Clone ID: PAT_TA_54332
catcaacctcttgtaatcaggattgacacctcgaacgaagatcacgagaagtaaaacctgttgcttacaactttacatgtacattctgtgggatctgtagcgttgtactccttatattagttctggtttaaggaagacatgggtgttaaaaggttaaaaaggaagggggaaaaagagagggagattgactgataggtgatactacagtatacattgtttcctttttgttttaatccacgtgctgcgactcttattgttgatgca

SEQ ID NO: 54333 - DNA, 146 bp, Triticum aestivum
  Clone ID: PAT_TA_54333
cttgaacaatgtacagacgaaccagcaatttgttcaagagcacattccattctgtgagcacaaaacattaccatcaagatgttcatggaatggaatgtgctcttgaacaatgtacagacgaaccagcaatttgtgtcttccttcct

SEQ ID NO: 54334 - DNA, 710 bp, Triticum aestivum
  unsure (1)..(710): unsure at all n locations
  Clone ID: PAT_TA_54334
cggctctctctcccataaggccggccaccacaaagaggtcggcatcgttcggagctctctccaccttatctccccaacagccgctctctcttttgtatccccactttctcccccggtgacgaaacatcgagaccgcatcggccaccgacgatgcaaggaggacgaagcacgacttcttcccatcccggccaccggcgctgcaaagtcgatgttgcggcgcagcataagccgtagcagttctgcaaggcgggctcggcgctgtgaggcgggagcgcgggctgctccttcggtgggcggtggagctacaacccaatgggcgtgccgctacgcggcgacggcggagctgcaacgtgggtggtgagcggaggagctgcaacgcgggtggtgagcggaggagctgcagcgcaacggccatggtgttgcgcgtcggcgacggagacgcagggcaacgaccatggtgttgtgtgccgtcggcggagctacagtgcaacacgccggtgagtgacagagctgcagtgcaatgggggcatagtggccggcaccagagctgcaacgcaacacacncggtgttgctatggagcatcgccggggggcgccggagttgctatggagcatcgacagggccgttgatgttgcattggagcatcgcctgtgctgtattgaagcaccngccgagtcgccggggctgcaatgaccggtcgccgggggtc

SEQ ID NO: 54335 - DNA, 379 bp, Triticum aestivum
  Clone ID: PAT_TA_54335
cccacgcgtccgcccacgcgtccgcggacgctgtatctgaaattagatcctgctgcttcattattccttaattttctgcacgcatggttatagcgcttcctggcatctccatgcgtacgcacctctggccgtcccaccccagacgctatcgctactgcaagtgctagcagctggatgccataccactgatgcccggccactgctgaacaaatcatactcaagtagtcaagctcacgcactgaagcacatgcagcttatatgttgaataagagttccatttgatgaagtatcagcttctttgctaatctgtatatattcctgccgtaaatctgaacccagagtttgcgtttcagtataaatagaaatcaagacgtggatt

SEQ ID NO: 54336 - DNA, 688 bp, Triticum aestivum
  Clone ID: PAT_TA_54336
tggactcacacatggacgcattacattcagcgacctagcagacaccattcatcggctttatgcaggctagtcttagagaccaaacccaacatggatatcaactgccaaaagtggcccaagatatgaagagggagttagggtggtcactggaacgtggggaccactggcaacacagttctgctaaaaagggtaacgaacaagccttgctgaaaaatgagaacaatttgattagctcgagcgctgttgaaaaggagtatcacatgaaacttcaggagcggcataaatcgttgccataaataacacctaatacacaatttgaagtacccagtcatgtgatgtaccttaagtgcagccatgtgaagatacttctccgttgatcatcactcaagtgtgaactgcctatatgttataaagatgtatcaacgatcaacctctgcacctgacatagtcttactgcatcttaagtagccaagatgatcacgcggttcagcgatttgatattacactatgaccgctgcctaactgctcatcaaacaccgcaagcctaaactcgccttgttacaataacaacttataatactatgtcaacacactgtcccctcatctcactgttcaacagtgaaaggtatctggacagacggcgcctgtgctttctccactggacttgatcagataatcagatgttgga

SEQ ID NO: 54337 - DNA, 176 bp, Triticum aestivum
  Clone ID: PAT_TA_54337
acctcaagaccaacatagatggcagactttcatgaactgcaacaccgacgaacattgtttatgttgactgggggaatgcaaattgggcaacttgtaatagagcatagaacataactgaagcttcaggacccttggacaccaaccacgatgatgatccccaccaccaacacaaaaac

SEQ ID NO: 54338 - DNA, 699 bp, Triticum aestivum
  unsure (1)..(699): unsure at all n locations
  Clone ID: PAT_TA_54338
ctctcttggtggtggaaagatatattttggggaaagttccctcaaccgtcgagttaaaagttgaggagccttgcggccgttgcaatgctcttgaaatctagggcatgtttggcctttctccagctctgagctttgatagggatgctcgtggagcagggcaaggccgtgtcagctgggaatatcaggtgataccaccccttaaatgctcccatgatcacaattttcagaaaaccagttcaattgtctcaaagcattccgattttttttttgtgagggtgcacaagacgtgcagttacatcccctaaaaatttcagacctaaattcgaaatatacatggaggaactaaaaaaaatgcaaatccagcatgaataatgtcacaaaaagacaagcataaatgacacntattcgcgtttggatttgtctttttagtttctcaaatgtatatttcctatttggacctgaattttgtaggggtggtaaacacgtgtcttgtgaacattcacatgttttttggaatttttggaagcatttagattcgtttttcaatggatgcatcgggcatgtgagagttggtcacatgtcagctctagatatgagcgtactgtgcaagaacaagtgatctttaagctagctgggcgtttttggctttgtaatttctctttccttgcaccctnttttatgtaattctgcatgggcagg

SEQ ID NO: 54339 - DNA, 682 bp, Triticum aestivum
  unsure (1)..(682): unsure at all n locations
  Clone ID: PAT_TA_54339
cccagcgtccggtttcgagatgctatcatctcctctattgattatgcactctaacagagatctaaatgttttcactaaacgcaatactgcggatatctactgtttgatgttgattagttgccctggattgagttatattttgggtttggattgcctcattttccaggttgccctgtattgactggtaaccaccattatccttagcaacatgtcctgcaagcacactctatgccctttgttcgaagttcttattaaaagcaactgttagatattctttcatggccgcactcaaactatatttcctcatgttcagagttttatctttcttttttcacagaagtggatcttacctaacctgtgtagattatatgctttaattgacagcataccttgtggcttgtgataatatctgaccctgtttgacttcattcagtctaagcagcactggttacttaatcttaccaagtattcttgtctgaagacttggttcagcatgcatgcttttttctgtcttctgctcctaaattaccacgctatttcttgaaatgccactatctanaacatttttgttgcaactgggtggtcaaatatattccngtatggacatatggatttcaagattcacttggctttatgtagtttatctctgagatctgaaatttttcggaaacttttatccctg

SEQ ID NO: 54340 - DNA, 662 bp, Triticum aestivum
  unsure (1)..(662): unsure at all n locations
  Clone ID: PAT_TA_54340
atggatgggttgtccaatgatgtggaggcgttgtgcttctgatgtcaccgtcgccgccagacgccagctcggggccgcggtggtggttcggttcggcgtggcaccggtaggccgcgggcccgcgggtcagcggcggcgggctcggcccactgagctcctacgcttgctcgttcaccgttataaaagtctagctgcctagtggagcaaaggccccttctttctccctcggttgccactcgctccagaagctgctcctgcccgggccagccgccgccactgagagtgagctcggctaccccagctcttccactctcgaagctaccctgctctctgtagcttcgctccctttctccttctttcgatggcgtcaggggaagcagagccgctgcagtacacgaccaccgtgctgcgggtgtccatccactgcgagggctgcaagaagaaggtcaagaaggtgctccacagcatcgaaggtgtgtacaaggtgacgatcgacgcgacgcagcacaaggtgacggtcaccggcagcgtggccgccgacgcactcgtcagacggctgctcaagtccggcaagcacgccgcgctctggccgatgccgccngcgccgcccgccacagaggccaagaagcccgaggaggcccccgtctgcccgggaagggcgg

SEQ ID NO: 54341 - DNA, 648 bp, Triticum aestivum
  Clone ID: PAT_TA_54341
gttcatagcacagaaacaggagagcaaatagtttaatcgtgagaggaagagatcgatcgaaaacgatggccggggaaggagacgacgtcaagctgctgggcacggtggtgagcccgttcgcggtccgcgtgcgcatgaccctgcacctcaaaggtgtgagctacgaggacctggagcaggacgtgttcgacaagggcgagctcctcctcgcatccaacccggtgcgcaagaaggtccccgtgctcatcctcatccacgacggcaggcccatctgtgagtcgctcgtcatcgtcgagtacgtcgacgaggtctgggccggcgcggccccgctcctccccaccgacccccacggccgcgccgacgcgcgcttctgggcagcctacgtcgacgacaaggtggtcaccgcgatgttaggcatcctgcgcgcgaccaccgatgtggagcgggcggagaggctcgacgccgcgctcgcggcggtcaggcccttggaggacgcctttgccgagtgctctggcgtcaaggccttcttcgccggcgactctgtcgggtacctcgacctcgcgctcgggtgccatctcttctggttcgaggcgctccgcgagatgttcgacgtgatgatcatcgacgccggcaggactccgcgcttgg

SEQ ID NO: 54342 - DNA, 711 bp, Triticum aestivum
  unsure (1)..(711): unsure at all n locations
  Clone ID: PAT_TA_54342
gctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctngggaggcaagggtcaaggaaaatccttccagtgtgagcttgtcttcgccaagatgggcatcaacccaatcatgatgagtgccggagagctggagagtggcaacgccggagagccagccaagctcatcaggcagcggtaccgtgaggctgcagacatgatcaagaggggtaagatgtgctgcctcttcatcaacgatcttgacgccnngtgcggtagga

SEQ ID NO: 54343 - DNA, 487 bp, Triticum aestivum
  Clone ID: PAT_TA_54343
cccacgcgtccggacggttttgtcgaagatatatctaccctcttcactgttgggcaagaggtgtcagtgaaattagtggaagtaaataaagaaacaaggcgcatctccttgacaatgcggacaggtggagattatgtcaaggaagcacctacggctccaagcggtgggaggagcccaactgcagctgcgcctagaagctcaccaaggcaaacaaaggatttcaagaagatagacgaggcaaagtatacacgaggacaatctctgactggcactgtgaaaaattcgacaagaacaggggtcatttgtgacactgcctgatggagaagaaagattcctcccaagggaagaggaagcagcggcactgtttacccttattgggcattccgcactgggaggtggtcaagaggtaacggggaaagtgttgaatgtatcacgaggccaggtcacattgaccatgaaagggggagaagatgatgaccaccagttg

SEQ ID NO: 54344 - DNA, 547 bp, Triticum aestivum; identical to SEQ ID NO: 50394
  Clone ID: PAT_TA_54344

SEQ ID NO: 54345 - DNA, 720 bp, Triticum aestivum
  Clone ID: PAT_TA_54345
cccacgcgtccgcccacgcgtccgcccacgcgtccggggaccaactcaagtcctctagccggatattccttgctggaaagaaggtcatgcagatagcattggggcggtcacctgctgatgaagctaagacaggcctgcataaactctccaagttccttcaaggtgcttctggattgttatttaccaatctcccaagggatgatgtcgagagattattccgagaatttgaggtgaatgattttgcgaggacaggaagtattgctactcaaacggttgagctaaaggaaggtcctctggaacagttttcacatgaaatggagccctttctgcgcaagcaaggactgccagttcgcctaaacaaaggtgttgttgaattggttgcagatcatgtagtatgtgaagaaggaaagcccctttcaccagaagcagcgcacactctgcgcgtgcttgggacgaagatggcgacgttccgactgtaccttgtctgccgctggtcctcggacgactttgaagtgtacaaggaaggcttggcgcacctgggaggtgaggaagctgacgagtcttcttaaggttgttggatcatggtggcgtgcttgttgtctagctgtgttcagacgggtttgtgccatgcctttgtacccttaatccgacaggaatctcaaatatatgatctgacccagttgggcatattgttgagtgccagtatttttgcgagctact

SEQ ID NO: 54346 - DNA, 247 bp, Triticum aestivum
  Clone ID: PAT_TA_54346
cgctggggccgctggtgaacagggagctgataagcgcacggagatggaaagttttcacggagatcaccagcgattgtgtggttgcgcactggacgtgacacattattttcagagtcgggtcacactggccttttcttttctataaaaatacgaataagatgtatgagctccctggtagaagtagttattttctaatgtcaaaactttgaaatttgtttatccatgtacaaatatccttttgtgtgtg

SEQ ID NO: 54347 - DNA, 148 bp, Triticum aestivum
  Clone ID: PAT_TA_54347
gttggttctcatctaaggaaaagacaaacctaaagaaggtgcacgacgaagctcaggatgcagctgaaaaacaaaagggaaagtgacggtcacatttgatttggtgggcccgtaggtgatttttaacagtgatgaaacggcagagtcg

SEQ ID NO: 54348 - DNA, 608 bp, Triticum aestivum
  Clone ID: PAT_TA_54348
cgagaggtcgtcgaccacgaccgcctggctgtctacatcatcgacgacgtgatgattccgagagagccagagattggattcccagccttgcttcttttctttgggctcctggcgttggcagcgctggtgctcgcgcaggtattattgatcttcggtgacgtctgagaagatcgtttcgtgtcaagatcgctactacctatgttgtggctccatatataagcgacaaggaccttagttcatgattgtttcatttacatcagctggcctaatgttaactacttctgcatcgacattatcctgctctgcgtcatacttgtgtgcttaagaagtgagtgaggtgcaacggtgtgctcatgcgtggtcggtagtgatcttgcattggattccctacttgtcatgtcctgctgtgatgggtttcaagtaattcctttcgtctcatctgtgtaatatcatggtggtcttagattattatgctggttgaagaagtgatgattatatgtgtgttgacctgattgatgtctgattgtatgtatatttcgagtaaattgcttagtaagagtacaaacatcattcttttgttcgaaacctggccatgtatatgttgcgtt

SEQ ID NO: 54349 - DNA, 611 bp, Triticum aestivum
  Clone ID: PAT_TA_54349
tgcaggacctggagctgcgccgccgccgctcgtccaggtccaggagggtcgccgtctcaccgtctgccagcccagcgaccccgcccgtccggcgacaccgcgtcctcgcctgcccgctggtccgacgaccccgcccgcccgcccgcccgctcgtctaggagagccaccgtcgccgactcaccgcagacgtcgtctgcctgcccgcgtacgccagtccgcaatgagggtgaagaggcgatcgcggcaccgcaaggtagtcaagttctactccacctgcttcggcttccgcgagccctacaaggtgctcatcgatggcaccttcgtgcaccacctcctcgtccaccaactcctccccgccgacgacgccctccgcgagctcctctctgtgtccagggcgcctccgctcttgacctccaagtgcgtcgtcgccgagctcaggcgcctcggcaagtcccactccgaggcgttcgacgctgcccaactcgtcgccaccgccagctgtcagcatgacaaagtggtcagtgcggtggactgtattctgtcacttgttggtgataagaatccggagcattactttgttgccaccccagattctgatctccgggcaaagc

SEQ ID NO: 54350 - DNA, 692 bp, Triticum aestivum
  Clone ID: PAT_TA_54350
cacgcctacccccacgaacccacagagcgcacccgacatccgcagccgaagcccgtgagagcagcgggacgcgagatgaacggcactgaactagttagcaacaaaaaagagggaaaatgtctaccgctgaggcgaccctggaggagaatgcgaacatggccaacctcctcaaccaggctaagcgttacgaggaaatgtgtgaaatgatggagaaagcggtaaagaccgctaatgtagtggagctcactgcagacgagcgcatcctgctctctgtagcttacaagaatgcgattggtgcccctagggcttcctgtacgatcatctcctccattgagcaaaacgaggaaacccgggctaacgaggtctatgttgcttcaatcaaagagtaccggaccacgatcgaaaccgaactcagcatgatctgcgatggcatcctgaatcttatggactcccaccttgcactctctgacactgcaacagagtccatggtgttctatctgaagacgaacggagactaccacaggtaccttgcggagttcatggcaggtgctaagaggaaagaaacactttagaacactcctgttgcatacaagacatcccactacgatgctcttgttgacttgactaccacacactcgataaggctcggacttgcactcaacttctcagtgatatactatgagatcctgaac

SEQ ID NO: 54351 - DNA, 193 bp, Triticum aestivum
  Clone ID: PAT_TA_54351
atataatcagaactatgtatgttatgcgttcaaatctattgtcatatgtcgcatctatctccaagtaaaatccaatggtgtaggagttagatgcgacataggagtagttatttctcatgtagatgagagctagccacacccatatataatcagaactatgtatgttatgcgttcaaatctattgtcatatgtc

SEQ ID NO: 54352 - DNA, 601 bp, Triticum aestivum
  Clone ID: PAT_TA_54352
atcgccgccaccttctcggactgccccaagatcctcaacatggcgccggactccaaggagacggagatcttcaaacagtatgcacgtgagcacgagggcaagaacgccgccaccacttcgcccaccgccgccgccgccaccgccaccggtactgccgccgggaagagcgtggacgcgacatccggtgcagggaggcacacggtggtcttcgccaccgtcgtctcggcgctgctcgcctccgcctttgttctcgcgtgatgataggcttgtctgcggctgtaggaaagagaccaagacactttcatgattgtgctgggctgggctgtgtagtttccagccttcggccttcagttcggctttgtgtttgctgtgtgtagcgagtgaatcctcatcacagaaaaaataaattgttgtgtagtgcgtgagttgcaagtctttcttttccccctccccaaccactcctctccctctctttctctctttgttgcgaatagtgagttgcctccctgattaattagttcatgttgcaacttgcaactaccctaccaaaatttcatgtcccggtttgattatgatatcaagagtttctcccttcgttttc

SEQ ID NO: 54353 - DNA, 624 bp, Triticum aestivum
  unsure (1)..(624): unsure at all n locations
  Clone ID: PAT_TA_54353
aaaagaaagcaaaaacacgaacaaaatcacggcgcgatggcaaacgagcgcagcgccggcgaggagcgtggagcggcggacagcgtcgtgtggagggaggaggcggggaagttcgagacgcccgacggcgaggccttcctccagtaccgcctcgtcgttcagccacgcgcctcctccggcggcggcggcgcgtccccggcggcgatggacatggtgcacacgtacgtgcccgggagcaagcgcgggcaggggctcgccgcgcgcctctgcgacgccgccttcgcccacgcgcggcgccacggcatgcgcgtcatccccacctgctcctacatctcggacacgtacctccctcgcaatccggcgtggaacgatcttgtctacaaggctgacgagcccaaacacagcagcaccagcagtagcatgtagaacaagtaaatcgtgtgcttacctcaaaagctgtggcaactgctatgttagtgtatcacttaataatcagttgcccaattgatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnggggggggcgggttttaa

SEQ ID NO: 54354 - DNA, 625 bp, Triticum aestivum
  Clone ID: PAT_TA_54354
actgtgtcgacgggagacgatgcacggcagtgtgtcttgctacgagaagcttccgtcgtccgggcgcgctccgatgctgccgaaggaggcgctgtcgtgctcacctgcgcgcgcaagctgcgggttttttgcaaggcaggggctcgctgctgctagcccgcacgagctggctccaagggccaggcgctacaacttgaggagctcgaagccgactacctgttgtggctctccggagttactcatgcgacgtgggaaggaagtcgccatggaacaaccccgccgccttggagctcgccccgcctccggcccaccacctctccgtcggcctcgtgctcctccgcctcgatccgcccgccccgccgctggatccacgtcggagccaccgtatccgccgcccagaccaccaaccaagagttgcatcttgcgtgtcctgcggccgggaggaggacgaccgagaggagtgcccattcatccgccgccttggagctcgccctcccttcgggccgccacctctccgtcggcctcgatccgtccgccctgccgcccagaccaccaaccaagcggcgcctcttgcctgtcctgtggtcgcaggtcgaataataaaaactgcagggtcctttatgtt

SEQ ID NO: 54355 - DNA, 687 bp, Triticum aestivum
  Clone ID: PAT_TA_54355
gtcgccacggcgccgtgctcaacttcacctgcgtcgagatgcgcaaccacgagcagccgcaggacgcgcagtgcatgcccgaggcgctcgtgagccaggtggccagcgccgccaaggaggccggagtgggcctcgccggggagaacgccctacccaggtacgacgagacggcgcacgaccaggtgctggccaccgcggcggagaaggctgaggaggaccgcatggtcgccttcacctaccttcgcatgggccccgacctcttccagcccgacaactggcgccgcttcgccgcgttcgtcaagcgcatgacggagaccggcgtcagggacgtgagccgggagcaggtggagcgcgaggctcagggcgtcgcccacgccacccagggcgtcatccaggaggccgccgtcgccctctgcaactaatcaactatgcattacatacatacgtaccgtgatgatcgaaggtgtgtaccgaatgaaggtgggaaggaaacgtagggggatcgatcgatcgatcgggtgacttgggagtagttgccgcgcctgaagcttcgatggcatggcgatgccggtttcggcgtcgctacctcaaagcttgcagaggactgatgtactactacgtactaagctgccgcagtagcatgttgcacttgtagatcgatactcgaaaatgttgtaacgccttgct

SEQ ID NO: 54356 - DNA, 530 bp, Triticum aestivum
  Clone ID: PAT_TA_54356
cgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatctgatggagtcgagcaagggtgcgtgtgcgtgtgcgtgtggtttacttgctcgctctccgcctatgctctgcccttggtgtccttgtgtgtatgtgtgtgcacgtgtccctgtaattgcttcatctatctccactatggatggagtgatgaatatgtaagaatgaatgatttacctaattaact

SEQ ID NO: 54357 - DNA, 368 bp, Triticum aestivum
  Clone ID: PAT_TA_54357
tacgaggcacaggcatgcagctagcaccgaccctgcctgcttccgtcagatgagacctgactctcaagccggacgctcaaaggggaccagctgcgctcccatcgagcagcagcagaaacaggaggaggccatcgccgccatgaacctacagataacttatgagcagacgatccgactgaaggccgccgaagagccagatgctagtgcatgcaaggcggatcctgcatgcacctggcaggaaagccctcagtctcgacttcctgctgagcctgatttacagtgcactagagcaacctgacatcacgaggggctgactctacatctggcatagatgttcacacccccaggcatgagaggcctataccaag

SEQ ID NO: 54358 - DNA, 238 bp, Triticum aestivum
  Clone ID: PAT_TA_54358
ttcccggccgacccatcttcctgggtgatcggatggatctgagtatcctcctgtacatcggcatgggcggaatccgcctgttcacctgccgctttctgagccaggtagtggctcgcatcaccgcttgtactagctctctgagcgtccaaatgatcgccgggctgcatcagtcctacagatctcctctccgacttcccaggcttccgaaattgaggtctcgaagagctagagagagctg

SEQ ID NO: 54359 - DNA, 286 bp, Triticum aestivum
  Clone ID: PAT_TA_54359
acgcgttcgggcaggttcgcaccggcactgccgctcccctatcccgggccttttttgccggccgggggatcgaccagcgccgatcgatgggaggaggaggaggaggaggacgaggtgatgcggcgccgcgacatggatgctccgttttagggcccgtgccgtctgtgttccggtctggtgtctgtgtagctgtcttatgccgttatggcgtgtttcatcctgtctccattgtttctacgcgattctccgatcagggtgctgggctgacttcgccgtcttttatctg

SEQ ID NO: 54360 - DNA, 472 bp, Triticum aestivum
  Clone ID: PAT_TA_54360
aataaaactcgaactactcctgggagcagcggcactgccgcggtggtggtatcaatcaatcgaacccatgccagcggagaggaagacaagaagaaggctctctcttctcctttaaccttcgaatcatggcttccttcccccctgccggtggctgcctctcccttaatctctccgcgacgaggcgccacacgacccccacatggatcccgctgtctgcgcctcctgcctacgggccgaccaagctgtcaacaacgactgaccagcggctgcgttccggtgatccaaggagcggtgccagctgttaaagggcatatgggccaggaacttctatctcccgcggctgatgcgcagcacgcggacctatgagctccgcacactgtgctgcctcccacagggccatcaagatagactagaaccggcacgagggctagcataggaccaccggtgcgctgcgagccccaacatagtccga

SEQ ID NO: 54361 - DNA, 810 bp, Triticum aestivum
  unsure (1)..(810): unsure at all n locations
  Clone ID: PAT_TA_54361
cccacgcgtccgtccaggttggcacaactattcagcgagcacggcaccgtggtcttcgctaagatcatgcgtgacttccaaaccgggcgctcaaagggattcggctttgtagcaatggcatcacaggaggaacgcgaggaggccatcgcggccctcaacggccagatattggaggggcttgccctacgagtgagtgccgcggaggagccagacgtgactgtaagcaaggcggctccaggaggcgcccgggtggaaagccctccgccccgtcatgttgctgagccttcatttcggttgcacgtgagcaacctgtcatcgagagtggatgactctaggctggcacaaatgttcagccagcacggcaaagtggcctatactaaggtcatccgtgatttccgtagcgggcgctcgaagggattcggtttcgtagagatgtcttcgcggggggaaatggacaacgccatcacagccctccatggacagagcttggaggggcgtgccatacgagtgagtgccgcggaggtgccaggcatggccgtaagcaaggcggctccaggggtagaaagtcctccccgtcatgttgttggaccttcgttccggttgcacgtgaacaacctgtcgttgaacatggacgactctaggcttgctcagatgttcagccagcacggcaaagtggcctatgctaaggttattcgtgatatccatagcgagcgctcaaagggattncgnttcgtagagatggcatcgcangaggatatggacaatgccatcacagcccttcacggacagagcttggaggggcatgtcata

SEQ ID NO: 54362 - DNA, 162 bp, Triticum aestivum
  unsure (1)..(162): unsure at all n locations
  Clone ID: PAT_TA_54362
gggggggggggggggggnnnnnnnnnnnnnggcaagagcgacgacgctncaannnanncacgaaacaacanancacaacccagancgaagagagggcacgcccgggcannanncaggaccacgacccacnaacccncgcaaaaagaaacccgacnnaggggg

SEQ ID NO: 54363 - DNA, 271 bp, Triticum aestivum
  unsure (1)..(271): unsure at all n locations
  Clone ID: PAT_TA_54363
ggggggggggggcggggnnnnnnnnnnngcgagaacggggaccaacacnnncanncccaccgcggagggcaacaagaaggcaccancagannaggcagaccacanccacccaccacgagaggaacaggggcccaacacgacgcacanncngaaacacgacggggggggggccgangaacccagcccaacagggancnacgnnccngacacggcgcacggacacggagggcagcagcagcccaggcccncgcgccacgggngcggcgggcga

SEQ ID NO: 54364 - DNA, 510 bp, Triticum aestivum
  Clone ID: PAT_TA_54364
ggacttccaagttccaacattttattgcgactgtgtatgctctagagacatatgcaattgcaccagcacttatagatccagcttatttcaatatgaaagggggtgtccatgcttagtttaccacagatgacagtggccacagcgggtgggggacacatgaatgcttgctacaccatatacaatcctggcctcaggcgtatcgtgccaaggcgggggcgcctaatgagcgacttgagtgacataactggtgtagagctaagtgatggcttgtcaatcagcagatctgccttgcccgatgcgtcggtgggtcggacaacgttctgcaagtggctgacggcgtgtggtgcgctattgcggtttctggttcactgactagctgctcgcgtgggcaatggttggggcgagcgtgatctgctggactcaatggaggtgatacggctatccagaaacccaggggataaagcctgccaatcaacatgttgaacatgatgacattgcactgccaataac

SEQ ID NO: 54365 - DNA, 499 bp, Triticum aestivum
  Clone ID: PAT_TA_54365
aaatgggaaaagagtccattaatcgggtcactggaaaaacgtgcgggggcgcaaaaacgataaaacagtggggggcaagggaaaccacaacgggaggcggctcagtgaccggggttctcaggaaaaaaccccctccatccgggaataaaaaatacccttcccacccgaacaaaaagatggggggcccggggaaacaaccagccatcgaaagagcccccaattttagacccttaggggaaggggcggcccaaaaaagtgcctgcgcggttggggttatttccgaacgaaaagaaggtaaccgttccacaggaaattccgtttgaccgcaaagaactccaatttgggggtttccaccgcctgccccaggttgaaccctgggattggacaggggacttgaaaacccaccaacaaaccctttacgcccaaaaattccgggaaacgcgcggagtcctggttttaccgcgggtgctggcacaaatttaaacaagacttattccta

SEQ ID NO: 54366 - DNA, 559 bp, Triticum aestivum
  Clone ID: PAT_TA_54366
tttgttttttttttttgttctcctttgttacatttgtttttgtttttaaatgttatctttgtgctttgatgcttttttaggttaaaacacaaagggaataccacctttaagaatgggagcactttgtttgctggacaacaaagtgagctggcctgatggggtacccaatttctaggtgatcattaaatagtctgacgtctatcgggttgaacccaaggaagcgtgggatgacagttttaaaaaaggtttgaaccccaacaacgcacgaagaaaggtaattgctaaagaattacacgtgcttactaaggcactatctgctatttttagcgggcggggaggcaagcaggacaactctggggacatctttcttttcaggcttataccctgtggcaccccttatgaaacacggaatctttttgactccacccttaatgaaagggatgacggcctttatcgttggggcttgcggttggcaggaagacccgttcttttggatccataagaagctttgatgaggctggcgcctttttgaaaattgcccacgcgctgatacttgttg

SEQ ID NO: 54367 - DNA, 583 bp, Triticum aestivum
  unsure (1)..(583): unsure at all n locations
  Clone ID: PAT_TA_54367
ggggggggggggggggggagnccaaancacagcaagcggaggcgcaaccgggacaacagagcggggaaaacanagganccgcacaggagggaccagagccacagagcagaagagaaaaaagcgcacganacggggggcgggaaaagacaaaaaggagacagggggggccaaagcagaanncactctgcccaaccagcaaaagcaggaggggggagcccacactagtcctcagataagcggcaggggcaggagagatgtaggttacaaaataaacagggatgtactatggaccgcataattaactgtctgccgctttgacgaaacttgtaggaacatttttcaagaaggatagggcagttggagtggagaaggtgggtctaggactatgagcgtgcccccgagatccgggggcgccaggggaacaagagagtggagaacatgtgttatgaagggggctgtgagctggatggggctggacgcggagaacggacaccggcgcaactgggggtaagtgctggggggccatagaggacttgaacactgggtcgaggatgcgggggagcttggagctggcgggtactga

SEQ ID NO: 54368 - DNA, 470 bp, Triticum aestivum
  unsure (1)..(470): unsure at all n locations
  Clone ID: PAT_TA_54368
ggggagnacaggacccaaaggaacgggccggggagcccganccnncncacaacccgccacgccangggcgcggccanccccacgacgcagggggggaagagcgagnccaaggccggaagccagacccgggacggggagccacacaanncccgccaccacaaaggggacgggggcacacaacncgggggcccaggcacaacacggaccggacaggacacgcnaacaaacnaacagacccgaaaccggaacagagcngggggancaggagcaacaagcgagggancgaacgcagaacacgannaaaggggacacagaggcgggaaaagccaggaaaaaaagggacacggacgggcaggncannccccacaccgggggccggagcaaaccccggggggagaaaaacaaccgcagnnaccggagcaanccagaggacgaaacaggcaaaaaccgcccgcggggaggcaagccag

SEQ ID NO: 54369 - DNA, 622 bp, Triticum aestivum
  unsure (1)..(622): unsure at all n locations
  Clone ID: PAT_TA_54369
gacccacgcgnccgggggatcgccggagaggaancgcgacgagggcggccgccgancagnnaaancaaagccagggagcacaaggagaccggcngccagncncgggagggncccancctnngcgncaanaacngcgganncnnnggcagngcggcgaccangaacangngcnccaagngccacaaggaganggcgangaagcaggagcaggccaagcnggcngccncccctttcgacagcancgncaacggnggcgangccgcgaaagaacaccnngcngcnggcagcacggcggnggcagnngcncacgnngaggcgaagacgcnnannaccgcacagccngcnganancgccggncccagcgaggcggcganggagaaccccaaaggcccaagccggngcagcaccngcagaaagagggnngggcngaccgganncaacngccggngcgggaacccgnaccgcgcgacgcaccgnnacncggacaagcacgagngcaagnnngacnaccgcgccgcggccanggacgccancgccaaggccaacccggnggngaaggcggagaagcncgacaagaacnaggaaggggccccccnacggncggcagaacanaagggcccaa

SEQ ID NO: 54370 - DNA, 649 bp, Triticum aestivum
  unsure (1)..(649): unsure at all n locations
  Clone ID: PAT_TA_54370
ccccgcgtccggnctgnncgncgncatcatacaggacaccagaagtaaaacgaagaagaggcgncgggctcgtgcgtgcgtgcagatcagccacgcctttgcatccgagaggagtgacaagggggagcatacatatatggcggcggccatggagcagagcaacgggggcggcggcgtgaaggtcaagttcatcgagacgcagttcgtcagctccgacgccgccaacttcaagtccgtcgtgcagcggctcaccggcaagtactccaagatgccgccgccggcgtcctcggtacacaggcctcgcccaaggccctgcggcagacccgaccaacaagggcggccttgcgtctccggcagcgacgagctgatgatggctgcgccggcgaagccagcggcggcagctttcgagccgctgcgcgtggaggaggtgaacgagctctgcgacttcggcgatctgctctacgccgccccaagcgcgcggcgccacggcgggagcgtnggaaatggctgtccttactgatgcatgcgtggcccggagaagaatcgggggacccttctcattgaggatcatgttttttgttggtggattgacattgccgtgctggtggatggggtcctttcgctggaatgctgcctgggngcgcccgat

SEQ ID NO: 54371 - DNA, 593 bp, Triticum aestivum
  Clone ID: PAT_TA_54371
gctgccgcagtttcctcctctcctttcctcgatgttgccctcgagtcccgtgtacccctctagctcccgtccgcatctctcctcctcccatgcgctcccctgtcccatccatgcccagcgggacggtcgcagcagtggcgagcggcggcgggagtaggggccgggtcaaggcaggtgttgacggcatggatgaagatgacggtcgtcatcgacgggggcctagcgtgcgtagcggtggatggaagggcagcagcggcctgtggggcgtcgactagaatggcagcgacctccatggaagagaagggcccggcaggctcgtgcacgggggagaagctgggggcgctcgtcgatcgggcagatggcggccatccaagtttcttcaatcgatctggacagggtcatggcagctacccgatgaagaagaacatgatgagttcactctctctcttgagtacaatcatgtttgttcctggattttgatgtttgattttttttctgtgtaatagagcacatggcatgattttgtactcctatttactaacaaaatctagatttgtaaatgaagatcttgaatacaatcatgtttgttcctg

SEQ ID NO: 54372 - DNA, 355 bp, Triticum aestivum
  unsure (1)..(355): unsure at all n locations
  Clone ID: PAT_TA_54372
agatcgatgcgttcattccccaacgttggccaatcttttccgcgattgaccttacaagtcattgtttctctcatttctgagcgcgtctactccattcaattaatccagtagtatgtacacaaagctagctatagctgtgttggattgtgatggtgatcgaactcgcaatgtcaatgacgacgtgcatacccatgttcacgtcaatgcgcatacataaacagcaaattggacatttttaaccaaaacaagtacctactggccgngccgatccgtaagaggcgggagcaaagtcattggttggtgttacgttttcgtgcgcctagccgataaatgtgtgtgctgcaaggttggttgg

SEQ ID NO: 54373 - DNA, 428 bp, Triticum aestivum
  unsure (1)..(428): unsure at all n locations
  Clone ID: PAT_TA_54373
gggggggggggggggagaggagnaccgggcaggggggggacaagnnnacaaccnacgaggggggaaacaaanagggancaaggggagaagagcnnggagnagaggagnncgnnccacgggnccgggagccccgggaggcaccagnggacgcagngggggggggggggggggncnnnnnccngcnccggcgncngcgggnnnccggggggggggggggggggggngnncgcggcccgggggggcggggggggggggggggggggggggggggggggggggngggggnggggngggggggggggggngcgnggggggggggggggggggggggggggggggggngngggggggnggggggggggggggggggncggggnggggggcggggnggggggggggggggggggggggggggcgggggggggggg

SEQ ID NO: 54374 - DNA, 263 bp, Triticum aestivum
  unsure (1)..(263): unsure at all n locations
  Clone ID: PAT_TA_54374
gggcgccggcaaaatgcttcgctttacttgccttttcttattattggtaattaaaacaagggcgggaggcaacgtttgcattaaatttggtcctggggggaggggggggggtttagcgttaggatgggngggtaacaaaacacaacaacaattttttctttgatcttaatggtcaccggttgtactggggggttggggaccgggggggggcgtgggggctgggggtgttgtgggtggggggggggcgcggggggtgggggggg

SEQ ID NO: 54375 - DNA, 593 bp, Triticum aestivum
  unsure (1)..(593): unsure at all n locations
  Clone ID: PAT_TA_54375
gggggggggggggggggnnnncgaaaaggaggaagacgcccggccccggcancgggacgaggcanacggccacnnnanggannannaacacaagaccnnacaaaggcgnacaacagnaagaccaaagccaccancnncgcaacancgggcgcnacggggggggggggangaaggggcgcngagggncngggccnnnnccnngcgggccgcgcggccaaaccgaacaggggagaccggagggcccaaccaggacnccnnccggggaggggcgcccaccgggccggggggcgggcggccaggcccccggccggggggggggggcggggagngcggggccccgnngngcgggnggggggcggggcggnggggggggccgggcgngggccgcgcggggggggggggngcgccgggggggcgggggggcgcggggggcgggggggggggnggcggggggcgcggnggggggggggggggggggcgggggcgcggggggggggggggggggcggcggggggngcggggcggcgccgcgcggggggcgggngcgcncgcgggcggcgggcggggggcgggggggggggggggcgcggggg

SEQ ID NO: 54376 - DNA, 228 bp, Triticum aestivum
  unsure (1)..(228): unsure at all n locations
  Clone ID: PAT_TA_54376
gaaaaaaaaatgggtcacgcgacccaaaaactggattaaccataaatggggagcactagcacaccgttttttacaacaggacacacaagggggggggagggacaaaccatttctttttttttgcttgggggaccctggacgggaaacaaaaaatgcattggggtccaaatnatttcccaaccggggccaattcggtgttgttggggggggtttgtttttgtgtggggg

SEQ ID NO: 54377 - DNA, 384 bp, Triticum aestivum
  Clone ID: PAT_TA_54377
ggaggaaacataaggggggtcgattcaatttttcaatagtccaccatactagttcacttgattcacgatcttgttggacaggcgacccattgcccccgccacatgcttggaccgggagctccattccacgcccacccccacacaaaaaccctgaaaaaacctccaacaggcgggggtacacaacaacagaaccggccggggggccaatggcatttgggccatccattaatcccaagaaacccccccacccacaaaacccttttacaaaacaattatcgacggtttacaccggaccaaaatccccttggcgttggcgttggcgttccccttgcgccggccgttccccttggccttaccgttggccacccccccctttccctttcc

SEQ ID NO: 54378 - DNA, 506 bp, Triticum aestivum
  unsure (1)..(506): unsure at all n locations
  Clone ID: PAT_TA_54378
atagttacataagctagtgcaattctttcagctggtaaacatgattacacctctcgactggccgcctagccgtgaaaaaactgccggcaggtcaaccaggagatcaattacaccacgtagtagcatactaaacaccactggctaattactactagtagtagttaattactgctactcgcagcagccatggccgacgtctaaaatgccgtcgggccagagcagccgccgattcgatcgaaggagagattacatcatagctacggagcttaacgaagactgtactagtagtagcagcagctgcttgctgctcacgacaggatggagtcccagtcgatctccacggacgggtacttgcgcaggtggaaggtctccgactcgtcccacggcgcctncgtgaagtccagcttctccatctccgggaccggcggcgtggacccggcggacgccgagtcctcgccctccgtcgacgccgagcacttgggggactccggcttccaattcttgga

SEQ ID NO: 54379 - DNA, 537 bp, Triticum aestivum
  Clone ID: PAT_TA_54379
actaaagaatgtgaattgtatttattctccgacagacaaatacaacaaataaatcgcacagtagtacactgaaccctgatagcactgtaggaaggaaggaacatgcagggaaggcaatgtgcatgccactgccagccaagaataacaagaacaaatccgcaaatgtatcgacatgattaagacttaaacactccaaaactaagccttggtacccatggatcggtcagatccctttcacatgcccaacaccacagccatgcccatggcgagcgccaccgcagcgctcgcattaatgctggcggcgcccgagccggacggtgaactgggcgtcggtgtccccgtaggcgacgacactgtcggcagctgctcgtcggtggacgaccgctccggtgccggcgccggggcggcgacaggggcgacgctcctctggcccctgggcttcgtgggggcggcggttgcggcggcaacgttcacctggagcttcatgccggcgtcgcagtggccggggatgctgcaaataagtaacgcttcccggca

SEQ ID NO: 54380 - DNA, 425 bp, Triticum aestivum
  unsure (1)..(425): unsure at all n locations
  Clone ID: PAT_TA_54380
ggtcttacattatgggatggagggagtactttttaacaaattcaatacataaaaaaaatcacattttctatccatgaagtataaatgaagagaagcatcatgtttcacacgcaccataaagcatccaggagtgaaacaaaattaacatgaaccagggacttgctattattacagcagcttggcgcacaaagatttaatgcaggttggcatgtacgtgtgatgatttcatcgttattggcacgctagctacaaaggaaatggaaacgatattcaacacctcattctgatgaagcagctttgcttcaatccatccatgttctgccactgctctaatttgcggacttccctcacgcccttagctcaacataggacccagagatccctgnggttcctatcagggtgatctttccctcctcggttttctt

SEQ ID NO: 54381 - DNA, 299 bp, Triticum aestivum
  Clone ID: PAT_TA_54381
gtattggtctttatttttgtttacttgctgtttcatatatgctttttcttttttaattaatggacggggcccacacaaaccgctcttggggggggtctcgaggggggggttattaggtaccctataccacgatactccaaataatttcccaaaagaacgcgttccggctacaccaaaccacggcctgttgacagaaagcaggggatcggatgccgatggggggtcaaaccatggggtacattataccagggggctaacatggccccgccaaaaaatcgctaaaatttatggctggaacc

SEQ ID NO: 54382 - DNA, 651 bp, Triticum aestivum
  unsure (1)..(651): unsure at all n locations
  Clone ID: PAT_TA_54382
ggcagccaagacctcgtccccgacggtggcgccggaggccgcggccgtgacccggcccgcgagctggtccgtcgacagctggaggaagaagaaggcgctgcagctgcccgagtaccccaacaaggaggagctcgacgcggtcctcaagacgatcgagaccttcccgcccatcgtgttcgccggggaggcgcgccacctcgaggaccgcctcgccgaggccgccatgggccgcgccttcgtcctccagggcggcgactgcgccgagagcttcaaggagttcaacgccaacaacatccgtgacaccttccgcgtgctcctccagatgggcgccgtcctcatgttcggcggccaggtccccgtcgtcaaggtgggacggatggctggccagttcgccaagcccaggtctgacaacttcgaagagaaggacggcgtcaagctgccgagttacaggggcgacaacgtcaacggcgacgccttcgacctcaagagccgcacgcctgaccccgacaggatgatcagggcctactcccagtcggnggcgaccctcaacctgctccgcgcgttcgcgaccggaggctacgcagctatgcagcgggtcatccagtggaaccttggattttatggatcacaacgaggcagggagacaggtac

SEQ ID NO: 54383 - DNA, 359 bp, Triticum aestivum
  unsure (1)..(359): unsure at all n locations
  Clone ID: PAT_TA_54383
ttnngaataagaaagccgacatgggatagatnnaaagcatnnnnactgatnnnatacgnacaccanaatnnaagcacgcatnnnactacagnagnatncgatnaaatatncaggaaacatgatactnaaggtttcagtttaaaagacaaacgggacacatnnnaatgagnnngatnctnnataggtaggnaaaaagagcagagnanacgcgagccacctnatagccttctggttgnagacgnnngngaggccgcacttgccgnagnnntggcggncgaagtnnttnnccatgaaggtgccggcgccgnagncggggttggcgcacttcttcctgagcctgggnacccttcgccgggggc

SEQ ID NO: 54384 - DNA, 282 bp, Triticum aestivum
  unsure (1)..(282): unsure at all n locations
  Clone ID: PAT_TA_54384
ggggggggggnggacgggaaaaggannnaangaacggaaccnggccgncganaanacagannacaagccnagggagacaagcnnaagctacananaggaggncagncnnggccaagggaaaaggccagganncnangaaanggccaaaggggggaggggggggccnnncnncaccnggaacncagggcagggggcggcaggaagcnncnnngggnncaggagggcagcagncnnngggagggaccaagggggggcaannnnacacagggcncggggacaccc

SEQ ID NO: 54385 - DNA, 337 bp, Triticum aestivum
  unsure (1)..(337): unsure at all n locations
  Clone ID: PAT_TA_54385
aaagggccaactgaaaaaggactataaatcgtttttttcaaacgtttaaacatagcactgaaaacaacaaaaatttggatggttattggggttcttccaacaaggccatgactggaactgtcctcttaaacaagcaagacgggccaactgaatatggggataacattttacatcaaaagattatattattttatcaaaccacgggggaaaacaactttggcatatgaagtccatgggtgccggacctaaaaactctcctccttttggaacagttttgatccaaccatgacggggattccaggtaccgcaatctnaaaaaaaagttgcctgtgttggg

SEQ ID NO: 54386 - DNA, 136 bp, Triticum aestivum
  unsure (1)..(136): unsure at all n locations
  Clone ID: PAT_TA_54386
aaaggtacacaccactttcctcacaaacttctttacacaccattcacacaccaggcccacaccagtagtgactcacatntgcataattacattggtggaaattctcacaagcactatggatggnnnatatatattt

SEQ ID NO: 54387 - DNA, 169 bp, Triticum aestivum
  unsure (1)..(169): unsure at all n locations
  Clone ID: PAT_TA_54387
gccaccccaaaatacaacgacaatattttctttaggtaaagctgggggagagcagttacccatttaacaacagggccgcccgtggttnaacaccatcgcccgaccatgggggggggagagggggatggatctgaagaagaagaattgcccgaccgaattaagcggtttt

SEQ ID NO: 54388 - DNA, 352 bp, Triticum aestivum
  unsure (1)..(352): unsure at all n locations
  Clone ID: PAT_TA_54388
catccttccagacaaagtcaaacaaacagctatcttagaattttacaaacaaaatcttccaagacaagctttggttcatatgataaactggacgaacaagtctctctagttatcatgtgatacaccggtaagacagtgccacagaggaactaacaaatacaccgcaagacatcagctaaagcatgctgccccaccaaccgtgaaacccaagcagccaaaatctattacttgaatcgaacctagataagatgaaacagagaccgtcttctgcacgaaaatcccacggcttgattcacaggaaacaggagtgcacagaaaactagtttttatccttgccaccttgntggggggg

SEQ ID NO: 54389 - DNA, 631 bp, Triticum aestivum
  unsure (1)..(631): unsure at all n locations
  Clone ID: PAT_TA_54389
gcgcgccgccacacgaaactcccccacccaacccgagcgagcaccggccgaggaggaagaggaaggtgagatggctcgcggcacggcggcgacggcggcggcggctgccaagggcaagaagaaggggtccgtctccttcgtgatcgactgcaccaagcccgtggaggacaagatcatggagatcgcgtcgctggagaagttcctccaggagcgcatcaaggtcgccggcggcaaggccgggaatctcggcgactccgtcaccgtcacgcgcgacaagagcaaggtcaccgtcacctccgacggcgccttctccaagaggtacctcaagtacttgacaaagaagtacttgaagaagcacaacgtgcgggactggcttcgtgtgatcgcagccaacaaggagcgcaacgtgtacgagctccggtacttcaacatcgctgagaacgagggcgaggaggaggattagagtgcattgttatattgtagtgcttgttgagttttgatacttgatctgagtacctcctagttatccacctatcttatgttgtgctctgttgaacatgaatggtttaatttgaagaatccttatattttgccaaaaaaaaaaaaaaaaaaaanaannaannnnnnaaan

SEQ ID NO: 54390 - DNA, 651 bp, Triticum aestivum
  Clone ID: PAT_TA_54390
actattagttgtaccctgtccctccctcccacacaacctgacacccacttgcttcttcttcctccccctcctcccgatttctcgaattgggctcgcaattttggttccttgtattagcctcttcctgcacatagagagagcatcgatagcaagctgattaggctaggtagatagattagctagcctctgctgcggctctgaccagagaagtatacaagcttgattgggaggagatcgaagccaagatgatgcgcgggaaggaccagcggcccgcggcattctccccgatgagggagtcggtggcggcggcggtgcaggaggaggtgtgggaggtccggcccagcggcatgctggtgcagaagcgcaccccggactcggacccgccccccggcggcgcgcccgtccccaccatccgcgtcaaggtcaagtacgccggcgtgtaccacgaggtgtacatcaactcccaggcctccttcggggagctcaagaagctcatgtcagagaagacggggctgcacccggacgaccagaaggtggtgtacaaggacagggagcgcgactccaaggccttcctcgacatggtcggcgtcaaggaccgctccaagatgacgctgctcgaggaccccaccggccaggccaagcgcctcatcg

SEQ ID NO: 54391 - DNA, 465 bp, Triticum aestivum
  Clone ID: PAT_TA_54391
cccacgcgtccgcccacgcgtccgggacaactgagcgaagggcacgacacttcgggtggccaaacacctatgtcttcaccaaggcaatgggggagatgattatggggaacctgccaatagactttccggttgtcatcatccgcccgagcattataaccagcaccctcaaagagccattgcctggatggatggaaggaatcaagacaatcgactcggtggtcatcggatacgccaagcagaccttgcccttcttcctagtcaacctagatttaataatggatgtgattccaggggacatggtggtcaatgctatgatggttgccatggcagcacactcagatgatcagcaggtgcaagtcatctaccatgtaacatcatgtgtgcggaacccggcaccttattccatgctttggaagagtgtgtttgaatgcttgaatgacaaccggagatgcagctaaaggaatg

SEQ ID NO: 54392 - DNA, 571 bp, Triticum aestivum
  Clone ID: PAT_TA_54392
gatacacctgcaaagaactacatttcatttcactgaatatacatgtccacaccgagaaaacaaatgatttcttttggcctatttacataccactaatcgaaacctgttacaggttgaagttacaagggaaataataggtttgaaaaaaccattctctcttccttatagcattatcatggagaaagtggctacaaagagaaacaaaaggtatgattcatctcaggcttctccctttctcattcttccctcaagaaaaagagtctctgatcgaggccagatgattcaggctcctgattcaacttgcccactgcttgtgaaatacctgaaagcttagcatagctagattgcaaacaagtgctcatgtgcaaacaattactataatcctcatgagcttccgacagagacaattcccacaaacttatcaaagtagcaagctagcgattgagcacgcacttaaataactacccttattcattgccattagggaatatatttctttttttgagagtgaacatcatcaacaatatagctataaaagtttttgaacaccaagggactaggaggtgtaact

SEQ ID NO: 54393 - DNA, 299 bp, Triticum aestivum
  Clone ID: PAT_TA_54393
ggaagttatttcaaatttcctcggctcacgggtattttgctagttgcataaaatcttggtgtgaatacattcgacatggataattacacatatgtagctaacagacataaattagtagctagtgttggtcttggccttcagtagtccctcaaaatgctgttattcgatccttcgtagtatgccctactgcctcaggaattaaatttgtttattgaatcatactatatttgagactggtgctttgtagaaaaggaggataacccagggctttgcgtcaagcgatgcgcgtaggcgtattg

SEQ ID NO: 54394 - DNA, 265 bp, Triticum aestivum
  Clone ID: PAT_TA_54394
acaacagatatgaaatgaattgacttttggctgaacttacaaaatgaaactcatcatttagctatacccccactccactccactgaagcctatggaaacggtaccacacaaaccaagtaaccaaacaatccagaaaaacgctctaatcctgcagctggtcgagcgccttgaggaggaagggcttgaatctggtgacgttgaccatgacgtcctgcttcatgatgatctagaagagcgccagacaaccctgcgcgtgggtctgcgt

SEQ ID NO: 54395 - DNA, 507 bp, Triticum aestivum
  unsure (1)..(507): unsure at all n locations
  Clone ID: PAT_TA_54395
cagaagattattcccgtcccacggtgatcgaaatctcaaccgggtgatgattattagcactaacagtgcttgatctaatgatcttgttacaagcaccagcagccggatcgagcggggacgagagagacgacgtcaaaaaagctctctatctacacgtagggtgaacatccatggcgccgatgcatatcttctctgctactactactacagtcttatcggagagggcgctgcagctggatgacgagcacgctgatgtcgtcggaggagcccctggacacggccatgtcgacgagccggcggcacgcggcgggcaggtcgccggaggaggcggcggcggcgtcgacggcctcctggttgcccaccttgtcccacagcccgtcggaggcgaggatgagcagctcgcagtcggcgcccaagtcgacggttctagtctccggctccgccaccacccacggnttgaggtgcgcgatatcaatgccccgagaaaccatcagcaagccctagacc

SEQ ID NO: 54396 - DNA, 425 bp, Triticum aestivum
  Clone ID: PAT_TA_54396
ggaaggaggaaccagcggggccgtttcagctaaggacaaaaccccagcttcccgggggccaaatcacagaaaagataggggggttttacccacaaacgggggggctccgttcattacagggacaagtttctttccccccggccaggatctaccccagggacaaaatacccctttacatttaagcccccaaatcccaaaacaactcaacccggggggcctaagggaaacctgccatttttcacccaactttgggggaccccggcgggaaaaaaaatttgagcggagtattccacttggcgaggggttgaaatttccgcattccctttgacctggcaccgaattttagcagtttgttcccctgatctatggggccttggacacgggtgcccaaaaacaaggaccccaaaagctggtcaacatccttt

SEQ ID NO: 54397 - DNA, 260 bp, Triticum aestivum
  Clone ID: PAT_TA_54397
ggtgtcagtacttaatttacaggattttattgcgtgaccaaatcacaagtgcagcgtaaattacaatcacagatgtaaagcgaacccagtctcacagcgagagtggaccagttaacacatgggggacacaaacatacgagaatcgaccttcggttacaaagtgcgtgaacccagctgcaagaatctgaacgcaggtgaagaccacattgcttgggggccaagggcctgtgcttgcgcgggagaacccggtcctggttact

SEQ ID NO: 54398 - DNA, 351 bp, Triticum aestivum
  Clone ID: PAT_TA_54398
ggctaccacacccggcgcgtcggatactccgtcagggtaccaaggtgcggctcgtccggctagcctgggcctcggctggagcttcggtggcctgatcttcgtgctcgcctactgcaccgctcgcctcttcggcggccacatcaaccccgcggtctccttctgcctgttcctggcccggatgctgtcgctcaccagggcggtgttctccatcgtgatgcattgcctggggcccatctgcggcgctgggggtgtcttcggggtttcccgaccacgctgcacctgggcatcggcggcggcgcccactcccgcgggccggggtccacccggggggacgcgcttggggctgctatt

SEQ ID NO: 54399 - DNA, 214 bp, Triticum aestivum
  unsure (1)..(214): unsure at all n locations
  Clone ID: PAT_TA_54399
gctaagcgagtctcgctcgtcacagtacaagttcaggaatacaatacgtacgtacacattatcttatcttacagatccgggtgcccggccagtgacgccatggacgcgatgatccggaagcagagcagcttctgttattaagaataaataaagaggtttgttgcatggttggactntttttggggggggggggttttttgaaaaggtattgtat

SEQ ID NO: 54400 - DNA, 621 bp, Triticum aestivum
  unsure (1)..(621): unsure at all n locations
  Clone ID: PAT_TA_54400
cggtcgcgtgggaacaaatccacacccaatctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaggacagggggggcattcccccggaccagcagcgcctgatctttgctggcaagcagctggaggacggccgcaccctggccgactacaacatccagaaagagtccacccttcacctggtgctccgcctccgtggtggtatgcagatttttgtgaagaccctcaccggcaagaccatcactctggaggttgagagctctgacaccattgacaatgttaaggctaagatccaggacaaggagggcattcccccggaccagcagcgcctgatctttgctggcaagcagctggaggacggccgnaccctggccgactacaacatccagaaagagtccacccttcacctggtgctccgnctccgtggtggtatgcagatttttgtgaagacccttaccgggaagaccatcactcttggaggttgagagctccgacaccattggacaatgtt

SEQ ID NO: 54401 - DNA, 586 bp, Triticum aestivum
  Clone ID: PAT_TA_54401
accgccaccgccacggccgccagcgcccggtacaccctgccgctgtgccgccgcagcccggggcagccgtcggccaccacggcctcgaacgtctgccgcacgaacgtgcagtccgccagctccgccagcgccggcccgtagtccaccagccccgcgctggcgttcgccacggccagcgcctgcgcgtacatcgacggcgtgagccgcccgggcgtcgcgcacgtctcctgtgattgtcccggcgcgccggacacctggcacacgtggccccgccacgcctgcggcgcgaaggcggccggcacctcgccggcggcgcaggggcggtcggagaggtcggcgcggtaggggctgcagaggagcggcaccggcgggcccgactggttgtagttgaggggcgggccggcgcccggcgggaaggcgttggcgttggagacgttggcgagcacgtcgttgagggtggccaccagctggtggttcacctccttgctccggcgcagcgccttcgaggtcgccgccgcgtcggcgcacgggaggatgtcgtccagcgcggtgctgttgctgctgtccggcgggcggagcacccatt

SEQ ID NO: 54402 - DNA, 695 bp, Triticum aestivum
  unsure (1)..(695): unsure at all n locations
  Clone ID: PAT_TA_54402
aaaaagaaaaattaattatacaaaactaacaaagttcaactcggggatacacgcgagcatgctagctaattactcaaagtacaagccaactgtaataaaaccttacatagatcggagtagtacttttttttctgacagtaactaagtgcatatctcattcgtcttcctgtcatactccaaccaccggcacttacatattttaagtctctcagccacttcattcatggtgggcctgtcgttcacatcctccttgagacactgcaccgcgatcttgcccacctcctcaaggcactcctcattttccttcccgcgagacgcaacctctggatcaaacatctccctcaccgccccacccatggaagccttgacataatccagtggcaggctatggttcccgtcataccttgctttcttccgggtcacgagctccagtagtacgatgccgaagctgtacacgtcacttttctcggtcagcagcccggtcttcatgtacacggggtcgatgtagctgctgtccccgaccacccagtttgtgtggtccttgtcgatcgacatgagcctcgacgtcccgaagtccgacaccttgggcgtgaatccgtcattcaggaggatgttgcccgacttcacatctccgtgggagatgattgatgtctgactcgcctccgagtgcatgtnaacaagcgcaaccgctgaat

SEQ ID NO: 54403 - DNA, 159 bp, Triticum aestivum
  Clone ID: PAT_TA_54403
cacaacaacatgcatagcctgaacaaggaaaccgtttgattctttttgcaggggagatattagtagtagattaacagtaagccctacagaagatagtcgtgtcgcatggtgctgcatgcctgcgtgttacaaaaaaccctagcctgttgcgctggcttt

SEQ ID NO: 54404 - DNA, 228 bp, Triticum aestivum
  Clone ID: PAT_TA_54404
accgacacgcatatgattaattacaacagtagctggaacttttacgggtgcttggaacaacagtagctaaaaggactggcggaacattaaaggaatacaaaaagatgcctcatgactatctggctagccggttactgcggcccttattctttaatctaaaaccagcacaccgtggactctggacggggggccaccccctccttcaggtgccttatgggagcatcacat

SEQ ID NO: 54405 - DNA, 229 bp, Triticum aestivum
  Clone ID: PAT_TA_54405
accacaggcacagcaccagattctttattgaaaatgtattattactttactgttcattatataaaaaatctccactaacacgaacacaacaccaaacatggcgtatctcatcttacaccgatgtcatgcaacaagcgtatcacatctcaggatgatatcagtctacagttcagtttatcttcagtaacatggaaacggcaaccagggtagagcactctgatcttacgcc

SEQ ID NO: 54406 - DNA, 399 bp, Triticum aestivum
  Clone ID: PAT_TA_54406
ccgttaaatctagctggctccaattgagaatatgcatttgcattgtgaatgtaacaataaaacatatcacctttgaatcctctcgggtgccctatcagctaccgtatttccaacataagaaggtaaaaaaggtactggtaaattacatcttagtaatgaaatcgtgctaaacaaacaaacaatccctaaagttcatccaacttggcgcctgaaaaataacaggactgattctcctccaggaactgccagtagaggcgcaatgacaaaaagtcgcagccatcacttttgtggcgggttggagaggcccatgtttctgttcactgtacagaagaacacaacttctaccagcattgggatcatccgcaagggcttagccaggcgcaaaggctactaaggaga

SEQ ID NO: 54407 - DNA, 140 bp, Triticum aestivum
  Clone ID: PAT_TA_54407
catgccaaccaatgtttgtaaccaacaaacgcatattactaagcattcccttcccagccagaaactgtattataacccattgtgtcgcaacaggtgggtattctaaaagaagagctgttggcaccagcatttccaactgg

SEQ ID NO: 54408 - DNA, 378 bp, Triticum aestivum
  Clone ID: PAT_TA_54408
gtatacaattggcatgacacgggcttagctacaaagaaaaaagtgcacgctttttaggcctccgactgggacttggaggacaagcggcgcttcttcaagatggccgtgcgcttgtcgcgctgctccttgaggcgcgacgcgagcagcttcttgtactgcgtctcggcctccttgttggcctcggcgcggtgcagcttggcggcgcgcagggcgcgcttgtgctgaaggcggcggggggtgatgaggcgctggatcttgggcgccttggacttgggcttcttgccctccttcttggacggcacctcgcggcggatgacgtgcttgcgcacatcgtacttgtgcgacaggttgaagaacttgaagatgttaaaggggcgc

SEQ ID NO: 54409 - DNA, 263 bp, Triticum aestivum
  unsure (1)..(263): unsure at all n locations
  Clone ID: PAT_TA_54409
acacanccacaccttcttaacaacaaacacacaccagagctcacacccaacgacgacactcccctgctcccttcctttcgcctctgaaaaactttgaaacgagagaagaagatggacaccatcaccgtcgncgagaatgtgttcggggaggtggagcgcaaggtgcagaagagctactgggaggagcactccaaggacctnaccgnggagnnnatgatgctcgactnncgnnnnnaggacnnnnnnnaggaggagaggnnaga

SEQ ID NO: 54410 - DNA, 672 bp, Triticum aestivum
  Clone ID: PAT_TA_54410
gcaacaggtaacaaatttagcatatacggagcaacatgaaaaaatatgtgttgctatttacaaattattcatatctacaacaaatgtttagtcacactgaatactttactatggtagaggacggccagttgcagttgcttcgtggtttaatcagtggtcgccgccatcatgttcataaccgtaaaattggctgtcggaatttggcagttcgatgttagcttgcacgaagtcctgctctgtcagatgtgcttgtagttctagcaattcctctgattcaaatggacttaacccactgaagatgtcagcctgcacattgttaactgacgaggttcccagactaactccatctgaggaagtcccagcgacacctgctacaggataagaagtaacaggagcaacagttgtcgagaagctgaagtgtccattctgttggccagttagacttgcagctgtgaatgtgattgggtcatcctctggaactggtacaggaatgtgggacggaatagttggctctgctgaaaatgatccctgtccctgatcatttatgaaatttccctgggccagatagtaaggagttccttgatgcacagtctgtccataagtgggctgtgaaaacggcagtgtttcttggtttgaaggaccggcatcatttgtttgacaagactgcggccc

SEQ ID NO: 54411 - DNA, 345 bp, Triticum aestivum
  Clone ID: PAT_TA_54411
caaaaatactcttatattatgatgagacggaaggagtatctccgacgataacaaaaagaaacaaagtttcagctaagcaatgtggcaagtcttcatcactttagtacataaccaatactgaactgccggctcggtctctcggagctgctcatacggatagggttttgcgtgcgtatattcatagatgtgagtgtgcatgcgcgttgtgagcctctgacctaaaaagaaatactgcaattttacacacacacacacacacatggagctcaaaagtacagcgcatatactacaacacacgccaaggctaccgccatggacttccctacttgcgtgaccgaggctaga

SEQ ID NO: 54412 - DNA, 187 bp, Triticum aestivum
  unsure (1)..(187): unsure at all n locations
  Clone ID: PAT_TA_54412
caatgtcttgcactaaactcatatcggttaccctggttgtcctctttagcattggattagcaagcgctggtagggtatctagatactctagttcccagggaacaggcaccggcgggggagagggtggaggagcggtgaacggnggnggnggttgatgcgggaatggccagggaactggtgggggggg

SEQ ID NO: 54413 - DNA, 345 bp, Triticum aestivum
  unsure (1)..(345): unsure at all n locations
  Clone ID: PAT_TA_54413
atgaatttaggagtcgaagctgatgtactgtagtcagcttcaagtgatggtagaagctgatgcagtcaattctttggagtattttctttgatcatcttcaaagtgatggtacaagctgatgttaggaagctgatgtagccagcttcaagtgatggtcatctttgatcctttgacagggattcagatggtgttgattggagtggagaggagcagagacgagaggagcagcagaagtggacagcgcagcggctaacctcgagctcttgattggagtggggggaggcggncggcgaaggatctatggncagcatcaaggatccgaagctgtggttgttctggttgtcg

SEQ ID NO: 54414 - DNA, 456 bp, Triticum aestivum
  unsure (1)..(456): unsure at all n locations
  Clone ID: PAT_TA_54414
cagagttggaaatcccctctctctctccctcgtcgctgctcctctccaaatcccctgaacccgcctctccccggaggaaccgcggcggaggagagatgtcgtacgcctacctcttcaagtacatcatcatcggcgacacaggtgtcggcaagtcgtgcctgctgctgcagttcaccgacaagcgctgccagcccgtccatgacctcaccatcggcgtcgagttcggcgcccggatgatcaccatcgacaacaagcccatcaagctccagatttgggacacggcaggccaagaatcattcagatcgataactagatcgtactacaggggagctgctggcgctcttttggtttatgacatcaccaggagggaaacctttaatcatnttgcaagctggctggaagatgcaaggcaacatgcaaatgctaacatgacantgntggtgggtgggaacgggg

SEQ ID NO: 54415 - DNA, 721 bp, Triticum aestivum
  Clone ID: PAT_TA_54415
ggacgagaatttaggctgcttgattggctgctcgccgctgcgtgatttggcgcgtcgatcgaagatccattctagggggccatggccatggaggagtcgccccagctgttcctgtgcccgatctccatggagctgatggaggaccccgtcacggtgtccaccggcgtcacctacgaccgccgcagcatcgagcggtggttcttcaagtacggcaagaccacgtgcccggccaccatgcagcgcgtcgcctccctcgacctcacgcccaaccacaccctcaagcgcgtaatcgcctcctggcaggaccgcgcctccacctcctccggccccgcggacgcgctcaagccgatggcgcgggagcggctgccgtcggtgctcgccggcattgaggggacgccgttcaaggtcacggcgctcaagggcctgaggctctgcatggccggggaccaggcggcgcgggacgacttcgtggcctgcgacggcatccaggtgctcggccgcgtcatggcgcaggcgctggcggagagcggcgccggcggggacttctcggccttccggacgtgcgaggaggccgccgcggtcctcgccacgctcccgttgtcagatgaggagtcggtggacctggtgctgaggcccgagtgcatgaggcccatggtcgcgctcgtgcagcgcggcagcgccgaggcgaggctgcacgccatgtccatcctcaccaaggtct

SEQ ID NO: 54416 - DNA, 289 bp, Triticum aestivum
  unsure (1)..(289): unsure at all n locations
  Clone ID: PAT_TA_54416
cactcagcagtcttcttcttcctcctctgccattaattgatcaagaagagcttcagctatcagcaatggagcccatccctctcctgacgccgtacaagatgggccagttcgacctcgcccacagggtggtgttggcgccgttgacgaggcagcgctcctatggcaacgtgccacagccgcacgccggcgtggactactcccagcgcgccaccgncggcgggctgntcatcgccgaggccacaggggtntnngacacggngcagngctacanngatngngnngggatggg

SEQ ID NO: 54417 - DNA, 504 bp, Triticum aestivum
  Clone ID: PAT_TA_54417
aaaattaaaaaaaaaaaaaaaaaaaaaaaaaaaaaaaaaaaaaaaaaaaaaaaaaaaaaaaggaaaaaaaatataaaaaaaaaaaaataaaaaaaaaaaaaatgggggggctcaattttaaaataccaaatttggggcgcttccttgggggtcctttttttttttcccgctcttcaaactttgggggtccctttttttttccccttgtttatttgccgcccccctgtttgccctattttcctgggtgaccccccggtcccccttcccaagtggggttgagcctgatcggcttttggccggtgcccttttccggcgattgccccgccggggtggtgtttgttaccctctctgtgccctttttttttgcgggggccctccttttccccccttttgtttgccggttttgcttggtttcccgttagggggcttttttttttttgccttccctttgtgcccccctttttggtttttttttctttgtttttcggcaccggggcccctttt

SEQ ID NO: 54418 - DNA, 264 bp, Triticum aestivum
  Clone ID: PAT_TA_54418
gatgaaggtactctgtatatcacactccaaactttttctgtacaacacagaacgtcacacggcaaaattgagatacagatagtccttcgacattgcatcagttttaactctagtctgtgcttaaattactgggggatatgtttctggttgtctgtccccgtatacgaactagctgcagaagtaacattgggatcccacgcccgacgagtttgcatttgtaggaagagcaagccagaaggttcggtgtggcgacggctactgcct

SEQ ID NO: 54419 - DNA, 112 bp, Triticum aestivum
  Clone ID: PAT_TA_54419
gatcaatacatgtccagctgatcaatgaaaaatttaccaagcacctttaaatgggacatcaacatttttttaagacagattcatccacggaaaggatcagccccaaaattca

SEQ ID NO: 54420 - DNA, 593 bp, Triticum aestivum
  unsure (1)..(593): unsure at all n locations
  Clone ID: PAT_TA_54420
gcaagagatgattgcataattatgcaaatgttcaaaacaaatctaaaaaaagtatggacaactttctttatacatattctaaatttagtccttgaattgaggcttaactattaaaagcatgtcaggtggggttgaaaataccagacattatctggaattatcatcagcatcgcaaagtggaggtttgaccctaggatcacgactcatgtaccatgagttatttataaaaggcttcctctacatagaaacatatttccctcacaatctcccaacatggtccgtttgagagctaggtcctccatctctacaaataatttaatctgtgaacaatcatttcggaacagagcaacaaaacaatgcagtgtttcattatgaggcttctcggcctgatataagtaatgttatagaaaactattattagaaatgaagagattactccggctaaatccaacaactatagattcatcatgcggaaaataagtaaatttaacacattgagtatattatatagccctaagggaacanatttacatgatagtattaaggagcatatctttccctgcctcatgttgggcctcttcatgcttataaac

SEQ ID NO: 54421 - DNA, 419 bp, Triticum aestivum
  Clone ID: PAT_TA_54421
gcacggcgcgcacacgcagaggtgccggcacggcagcagcagcaccacggccgcgtcctcgcggcatcccttgcaccttcctactgctgtcgcgggacgctcctccactgccggcgtgcccacctcctcctccgcgcacaaaggcacctggttctctccccagcagcacgactcggcgtcgtcctcctgaccgtcgccgcttccaccgtcacggaccgcctgggagtcgagcgcccgctgcaggtcgccgcggagcacgttggccgtggcctcgttggactgcgcgatgtcgcgccacatctgggcctgcatgaagaggttccgaaggcgcttctcgagcgcccagttcatgatcctgatccgctgaatctggaagaacctggacttgagccgctagggcgtcgtgggctggacggggg

SEQ ID NO: 54422 - DNA, 658 bp, Triticum aestivum
  Clone ID: PAT_TA_54422
ggaacatagatatcaaatgatgcatccttataacatgagaggatcatctttagtacatgtccgcaagacttagtattaaggactgatagccaacaagcatcttgatggtacatgatagaaaagctctagcatttggcagttgttatccttcttgctcatctagcttcatgtgttgggagagaccacgacctccatggactctatataagattcatcggtaaccaaccaagataacttttaaggtcaatgcaggcttttcaacttgtacaggggtgaaaacagaacaactacaatataaaacatggggtgaagacatggtctggcataaaatgatttgaggggagaacaaacacaatgctaataccactcaaatgtgtttacaaattacaaggcagtaatgagagaatgggagttcctgattatagtactacattaaacatcaccttaatttgcccacaaaaaatagaccttaactagtgcctgacagatcttgccatgtgaagaattttgatgcagggccaaaccatgtatggagtccaacgaaaaaaaggaggtatcggctgagtattgaagtgaacatatgttttttagagagagacgaagatcacttggatctgattggatgcagtacaaacagattccaactgaccaaaccact

SEQ ID NO: 54423 - DNA, 593 bp, Triticum aestivum
  unsure (1)..(593): unsure at all n locations
  Clone ID: PAT_TA_54423
gatgagggtggcggcgaggccctcggccgcgacgctgcttgggctcgggcctagggtttgaggcggcggcctctgctggtgagggcggcgtcgtcctggctgtgtcggctggtggtacttggcagcatggtgctgaggtgtatcagtggcgaccgtgagggggggagttttttgcgcgcagggaggaggtgccgntgggcgccgnggtggcgtnnacnatngctagaccgagcanggggnntgcttgagngcagggngnaagatggaggggggggnggnggnggggggggggggggggggggggggggggcccggggagacggntgcgnggggnggggnnnggggttggggnnnngggngggggggggggggggggggngngnggngggggggggggnngggggggggggggggggggggggggggggggggggggggtgggggggggggggggggggggggggggggggggggggggggggggggggggggggggggggggggggggggggggnnnggnggggngggggnngnngggggtgggggggggggggggggggggggggtnngggngnggnggggggggggggggg

SEQ ID NO: 54424 - DNA, 216 bp, Triticum aestivum
  Clone ID: PAT_TA_54424
aaggaaatcggctattgtataatatcgttagtaatagaaccgtatagatacagatccgagtactatgaccagcactgtcaccccaagttaaccataaaaacaactgcgaatgtaagaagatatattcatccaagttacacaatttcaaaaggcaggtacactagaaagaaaagaataaagataacaagtaaaaaccaaataagaaaacatgttaaa

SEQ ID NO: 54425 - DNA, 272 bp, Triticum aestivum
  Clone ID: PAT_TA_54425
ccaagacaaaagagttgaaaaataacgattttttttctcgcagagtgagatgcggaatccaacctcgcacttcattcgacgccgtaccgggaccggtacgtgctggggggtgccagtagatgtgccagccctactgtccctggaggagagcaaggaagcccgagacgccaccacccgcctggaacggtccgtagatggcagtgaccagcagtaccagcggacccagatccatggggatgatgcccatgaggcgacgggtgtcgccgtcggtt

SEQ ID NO: 54426 - DNA, 839 bp, Triticum aestivum
  unsure (1)..(839): unsure at all n locations
  Clone ID: PAT_TA_54426
ggggtttgtggttttttttttttttttttttggggggaaaaaatcaagcatcacaaaccctggcacaaggtcacaatcggttcattcaatgatacatactatacaaactgaccatgctacaaaaaaaaatcatcacattcaatcatatgatgcatgggggggggggggccatggaacaacnacnnctccaacacatnatatataccgggggggtgggggggtgctgggggngggggggggggggggggggggcggggggggggggggggggggggggnnngggggggggggggggggggggggggggggggggggggggggggggggggggggggggggggggggggggggggggggggggggggggggggggggggggggggggggggggggggggggggggggggggggggggggggggggggggggggggggggggggggggggggnggggggggggggggggggggggggggggggggngggggggggnggngggggngggggggggggggggggggggggnggnggggggggggggggggggggggggggggggggggnggnggggggggggggggggggggggggggggggnggggggggggggggggnggggggggcgggggngggggnnnggggggggggggggggggggggggggnggnggggggggggggggggngggggngggggggggggggggggggggggggggggggggngngnggggggggngggggggggggnggggggggngnggcggnggcggggggggnggggggggggggggngnnggnggggggggggggggggggggnggggggggggcggggggg

SEQ ID NO: 54427 - DNA, 288 bp, Triticum aestivum
  Clone ID: PAT_TA_54427
gattacaaccatcttctggcaatactttatcatagatcatggagctcatcaatagtcacaattcagaaacaaacttagttttatgcttagtacaattttcttaaccaattaaaaggcatatgctcacagaagatcacatgccacttctgacataaacagctgaaggaactagacaacagaaatggacagagtgagaagcctctacgtcagcatgcggacatgctatgttcccagctttggctgtgaactgcggcctttttggtattcttgcaggatgggttggtgctg

SEQ ID NO: 54428 - DNA, 414 bp, Triticum aestivum
  Clone ID: PAT_TA_54428
ctttctctctcttctttctctctctctttcttgctctggaagcaggggaggaaaggggttctgatttgggcgcgccgtggttcggtccggctgatttgggaggtctgctcgcttgattcgggttcgctgattgacgggccggttcatctccggcggctccattcgagggccggtccggcgagcgagccagtcgccatggggaactgctggggcgccaagatcagctccgacagctcctcctcctccccttcagggacaaattccaagtatgctagtaggaatggggcggtcttgagcagctccagcagctatgcctccgcggcgttagtgccacggagcgagggtgagattctggagtcagcgaattgtaaggccttctctttcaatgagctgaggaccgtctctagaaacttt

SEQ ID NO: 54429 - DNA, 619 bp, Triticum aestivum
  unsure (1)..(619): unsure at all n locations
  Clone ID: PAT_TA_54429
cggacgcgtgggttctgttcgggttcacatgcttgcagagagaaacagcgagaaaaaacatttgcggttgagatggaagagaattgataactttctcagccgcacaggtagctctgaagacattttctcagagctttttggtcatcaaaatgctgaagatacattttggctggatagctcatcagttgatcagaacagggcacgcttttcatttatgggtggtaagggtggacctctgtggaagcaaatgacatttcacctctccaatcaaagagccaactgtcgaggaaccattactattcgagatgctcatggatctgctgtgaaaaactctctcaaagatggcttcttggaattccttcacaaggagattcagnccattaaatacgatgaagaggattttgaagggctgccattngacttccatggnggatnngntggatatctagggtatggncttaagggggaatgggatgcatnatctaacaaagctaaatnaagnactnctgatgcgngctnnntnnntgctgataacctngnggngatcgatnacaacaatggngatcggtatatgngtgngatgatatgacgaatatggngggagtnatggnaatgggat

SEQ ID NO: 54430 - DNA, 645 bp, Triticum aestivum
  unsure (1)..(645): unsure at all n locations
  Clone ID: PAT_TA_54430
gacaggcgncgcccaggcgcgccaccgccnaggcgccacnccaggggggcaggcgggagnncnccgggcngaggagcncgncgncgcngccgcnccggcggaaggccaccnccgacgacnncangnccgcggncnccnncaggacanacgcggngagcaccagcggcgggncggggggggcgccgacggaggccaagcncaagggggcgancaacgggnncgggcgcancgggcgcaacnnccngcggngcnggcacgggcgcggcgacagcncgccgcnggaggggancgccancaacgacaccggaggcgngaagcaggcgncccaccnccncaaggacgacnccacgcggggcancngcgacgcggacgncaagcccgngggcgacaacgccancngcgnggacggcgaggggancaagggggngggcgaccgcaacccgcgcaaccggccgaggggcgagaagggcangggccggggggnggagggcaccgggcggggcggcgaccgcgccggcgcgggcgggggncgcagggccggggccggaaaggggcgggnggccgggcccggggggggcggcgggggggcgcgcggggggggggggggcgggggcgcgnngcgccgccgggcgccccggcgggggc

SEQ ID NO: 54431 - DNA, 707 bp, Triticum aestivum
  Clone ID: PAT_TA_54431
cccacgcgtccgcacgaggcctctgccggcggcggcgagggcgcgcgctgcactcctccgcgccccgcgctctcgctgcccccgcgctccgccgtcgaatccttcttcgcctctggcgccaccgccgcctccttcgccgagaccagccccggcccgtttaccctcgccgccgcgctcttcccggatatgccctcctcggccttccacggctccttcacccagctccttgccggcgccatgggctccccagccgcacccccttcccctccctcaccgttcgccgtgccaccggggctcagccccaccgctctcctcggccccccttcgctcttctcccctacggatgtgatggattgctctagacccttagcaattgtgttgtggaaaatgtgttatgaagtctaatttttcttcgaaaagagggggactcccttgaccttgcgcccagagagcctcatatgcacttggttaagcgcattctccggtacatcaagggcacccccgacctcaactttcacctctcgagctcctcctccgcagcacttacaacatactctgacgtcgattgtgctgggtgccctgacacctaacgatctacgtctggctactgcatctatcttggtggcaaccttgtctcttggtcgtctaaagacaaatcactgtgtctcgctccagtgccggagcggagtatcgcgcggatgctcatg

SEQ ID NO: 54432 - DNA, 498 bp, Triticum aestivum
  unsure (1)..(498): unsure at all n locations
  Clone ID: PAT_TA_54432
gacccacgcgnccgcgcgcccgacggcgacgccangcagcgcggcgccgccgcccccgcggaggcgcnggcccggcgcgcgcnccgngcgnggcccggccncngccgggcgcngcnccngccccgcgcgggccccacgccggccgaggncgccgncgcgcgncgccacnnccncgaccccngccccnnccnccgccgcggcggggcagcngccaaccaggcgaaccncgaggcganggagncggagaagaacgnccacgncancgaccccggcggcgccgaccccacgcagnggcncgagcngcnccaccnncncgccgcgcgccccgagggcccgccccacnnccgncnnaccgncgngcacgagcacaaggaccngcncncgcagacggncanggcgcnnaccaaggaggcggagcggcnggacgngccgnnnnagnnnaacccgnnggngnnccgncgggacgcgcnggacgnggagcgcccgcgggngaagacc

SEQ ID NO: 54433 - DNA, 204 bp, Triticum aestivum
  unsure (1)..(204): unsure at all n locations
  Clone ID: PAT_TA_54433
gacgcgcccngnagcggcgcannaagcgcggcgggggggggggnnacgcgcagcgngaccgcnacacnngccagcgcccaagcgcccgcnccnnncgcnnacnacccnaccccccncgccacgnacgccggcnnnccccgacaagcncnaaaacgggggccccccnnnaggggccganngagggcnngacggcaccncggcccc

SEQ ID NO: 54434 - DNA, 373 bp, Triticum aestivum
  unsure (1)..(373): unsure at all n locations
  Clone ID: PAT_TA_54434
gacccacgcgnccgcccacgcgnccgcccacgcgnccgcccacgcggccgcccacgcgnccggcagcgggggcagcagagccngcagagcaacangcggcggancgngcggcgggcgcggcncccgcaggaccgggcgccgccggacggccccaaggcgcncaccnccnccnccaccnccaaaagccngccgnncnaagccgggccgcaggaggagaggcgacnnngnngcangacagngggcangggnggcgcaagcgnnggaggccgggaaacncacncgggngccgggggacggagngangggcgangcnngnnnangcncngccangacggagcncacgngcncggangcancggcagacgggcgccga

SEQ ID NO: 54435 - DNA, 379 bp, Triticum aestivum
  unsure (1)..(379): unsure at all n locations
  Clone ID: PAT_TA_54435
ccccccgncgcncccgcgaggcgaccggggggcaacccnaaancccgccgggcgccgcccccncnccccnccccccccctcgccgccgcccgngggcgcggcngggcaaagcccagccgncgccggcggcggcggggccccaacgncccccngcncgggcggngcnggcgcgggggggcgccncgggncggagcgnggagcngngccgggcgacacggcggngcagcgggcagaggcggagcaccggngccacngcncccccncgacgggcggccaggngnnggngcgagcacggcncngcgagaacggngacggcgcggccagaacngacgggcgcggaaggancaggggccgggcgacgcggaccgagggcggaacg

SEQ ID NO: 54436 - DNA, 247 bp, Triticum aestivum
  unsure (1)..(247): unsure at all n locations
  Clone ID: PAT_TA_54436
ctgcttttgncttctcgcctgtcgccggcgcggacgtgagatctcgctctcgcctccttgcgcggccgtcgtcgtgaggtgcntgattntggcggcgtggctcctcgtgggtgtgctcctggggatgggctgcccccttctcgtcgtgtccgccgtcggcgtcgtggccttccttgctgtgtgtgttggggggccgctcggtgccgttctcgccggggtcgtgcgcttgcccttggtcggtgtgttg

SEQ ID NO: 54437 - DNA, 300 bp, Triticum aestivum
  unsure (1)..(300): unsure at all n locations
  Clone ID: PAT_TA_54437
ggacagacggaagaacgggcgcaaaacngccaanaaccngggcccaaccgancaggccaacgaacnacgcnngganggccnggaggangagancgccncgcnggagaaggaanncncaggggannaccaccacnggannggnnnncngccacaangancnacaggggggcggcagcanganggangaagagaccaacangcngaccancanngacnacgagnangcaagcnncgaacccagggcanangacancgcaaaccangacggggagaaggcggcagacnaccangcggaaaagc

SEQ ID NO: 54438 - DNA, 492 bp, Triticum aestivum
  Clone ID: PAT_TA_54438
cggtagtgctccttggagttgtcgctcgcaatcctcggtttctcttccgtgatggcagttgtccacaaccggacctcccctgggtcacgccgcccctgccgcctacacccactgccgcgccgcacgccgctggatctccacccccaccctccccgctccactagatccccgcacgccgcaccacccccggccatgggcgctggctacccgcctccccctccaccagctcccccggatccccgcaccacccggccatggcgatggctgctccccccgctgggaatccccgctcctccggccatgaagggctcctctagctccggtcgtgcactccagcaccgacagccacggtcgtactcgtgtaattcaacagcgaccccaccatcggatgggcggccatggcatgccgacatgccgtcccagcgcaagtccttttctttgtatcttgaccccggaccatttttcctgtatcttcaatttggctctctcccc

SEQ ID NO: 54439 - DNA, 806 bp, Triticum aestivum
  Clone ID: PAT_TA_54439
ccccgcgtccggaacttgacaagagcttcaaagccactggaaaattgaaggggccattgcatggagttcctgttgctttaaaggacttccactttgtcgctggtcgacctaccactacaggttatgtttcaagacgggacttccgccctgagcatgattccgcactggtcaaaacccttcgtgatgctggtgctgtcttttactgcaaaacaaccatgcctcagtcaggaatggctattgagaccgtgagtaatctttggggacgaactctcaacccgtacaacactgccttgtcagctggtggcagttccggtggcgatgccgtcctggtagctctaaaaggcactcccatcactccatccactgacctcggaggttcaatccgtgttccagcagcctttaacgggctgtatgccatccgtcctacctctgaccgcattcccaagggcggcatggataatatcaacagtggtcaaatttccatcaagctatcctgtggaccgatctgtcattccatggaggatcttgaatcttttacgaaacttatcaatgcttaccctgagaatcagaatgatcccacttctgtccctgtcccatggaagaccgtcaagccgattgagggtaaactcaccattggattgatgaagtgggacaaggtcgtgatgcctcatccgcctgttattcgagcccttgagcataccaagcgaacattggagaaagctgggcatgaagttgtcgagtttgacgtaccatttgactgctgggacgccatccagacaacgttcgacacctactaccagtctggg

SEQ ID NO: 54440 - DNA, 537 bp, Triticum aestivum
  unsure (1)..(537): unsure at all n locations
  Clone ID: PAT_TA_54440
atcacatttccccaagtcataaacccaaggcggactcgccttcctcctccccaactactcctctcctccgcgcatcgcatcgcaccgggggtncacctgagatcacatacacaatggtgaaggctgtggctgtgcttaccggcagtgagggtgtcaagggcaccatcttcttcacccaggagggagagggggcgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccagaagatgaaatccgccatgctggtgatcttggaaatgtgacagctggagcggatggtgttgctaacatcaatgatactgactgccatatgccccttactggaccaaatggaatggatggccgtgcctgggacgaacacggagaccctgatgatctgggaaagggtggacatgagctgaggaagagcactggaaacgctggngcgc

SEQ ID NO: 54441 - DNA, 538 bp, Triticum aestivum
  unsure (1)..(538): unsure at all n locations
  Clone ID: PAT_TA_54441
gacccagcgnccgcccacgcgnccgccaacncgngcgaggggggcgcacgcgcncgcccgggcgccccgcgcgcggcggcgccagagcccgaccaaangncccngcgccgccgnggcngccgcnnccncgnccggccnccgcagcgccgnnccgcgcgcccccnacgccgccngccccaggagcanccccccgacggggggcgggggggccgnaccngcggcgcagacgcgcccccnggcgagnacagcgggcccnggcccaggcgacgagggcncgggggaggaggaggaggaggagncnanggcggagngggaagaggangaagacganggggccgangcngagaacggaganggcggcaacggcggcggcggcgccccgcgggacggcaaggggggcgcgcgcgcacgggcggcggacgaggaggagcaaggcgagcacgggggggangacaggggcanggacagcgggaagggggagaccaaggggggcgagggcggacggaggggcgngcgggccggcgggggggggggcccg

SEQ ID NO: 54442 - DNA, 745 bp, Triticum aestivum
  unsure (1)..(745): unsure at all n locations
  Clone ID: PAT_TA_54442
accaatcgacctccaagtcgaccattgtggcactcgccatggccgccgagctcccgttctacctgctcctccttcccctcctagccatagtcccgctcctctacctggcggtgtcccgcgggaggcccggctccggccggcggctgcccccgtcgccctgggcgctgccggtgatcggccacctgcaccacctcgccggcgcgctcccgcaccgcgccatgcgggacctcgcgcggcgccacggcccgctcatgctgctccgcttcggcgaggtccccgtggtggtcgcctcctccccggacgcggcgcgggagatcatgaagacccacgacgtcaccttcgccacgcggcccatcgggcccatgcagcgccgcatcatggagggcgccgagggcctcctcttctcgccctacggcgacgcgtggcgccagctccgtaagatctgcaccgtcgagctcctcagcacccgccgcgtccactccttccgccccatccgcgaggacgagatcggccacctcctccgctccgtcgcgtcggaggcgtcgccggcgaggccggtgaacctgtccgagcggatagcgacgttcgtcgcggactcctcggtgcgtgccatcatcggcagccggacgccgaaccgcgacacgttcctgangctgctggaggaggggctcaaggtcatncctgggatgagtctgccggacattttcccgtcgtcgcgtctcgcgatgcgcctcagccgcgtgcc

SEQ ID NO: 54443 - DNA, 323 bp, Triticum aestivum
  Clone ID: PAT_TA_54443
cggacgcgtgggcgacgccaagggacaggcaagatgatgcgtcaaagtattagacccttgcgggctttctcatccgaagtgtcatggatcgcccgtcgaacacaggcctgattggctaagccaggagatcttgttccgaacaagccagagcctagcatgaacgaacaagaaccccgggttcctcgatccattcaggccctgcacctgttgcctctatagcgagaggtcgttcacggggttccctcatgcgacctccagcttcggtcctttacgggtcaacctttgtaattcttcttttcttttgttttttgagtgggttacta

SEQ ID NO: 54444 - DNA, 557 bp, Triticum aestivum
  unsure (1)..(557): unsure at all n locations
  Clone ID: PAT_TA_54444
gcagaagcncggcgaagcccggccggagacccgcnacagccaccaccacgccgncgngcggnnggagcgccagcaaccgcncccccccccgggcgggancaagaaggaggagacgngcngcaccgnacgngngnngaacgcggaggggccgggggggcggcacncgggcagcggcgacncggaacacggcgagnacgacnccggcacccacgnncaacggaacgccnccgcncgcgaacaacaaggancaaanggcccacagcgnccccaannncaacgcgnnccnagagaaaaccaagcggaaagagganggcagcaacnanacggacggggnccggaaccngaggcncanccncanagnngccaagaaagannangncnnagaagcaccgcnaggngaagcaccaancccngagaaccaagacgggangaacgcnnggcagcagcgggcggangaaaacacccacggacagggcggcgggccccacagcnnagaaccgggccnacaaaagcgaggngagaaacanggggcanacgagaggggcgaggagcngaaa

SEQ ID NO: 54445 - DNA, 523 bp, Triticum aestivum
  unsure (1)..(523): unsure at all n locations
  Clone ID: PAT_TA_54445
gacccagcgnccgccctctgnnggnatcaacantcaagagctcaaacaccaagaaaaagcctgcctgngnggcacggccacgaccgngggnnctnnggnncttcctcgccaccatcacaaggttgccgcgtagctcaagaatgtatctggtatatgcctcctnttttgccctccatcaccaagtggcggtttggcatggggaggcagtggacggctccaaacactgctgtgccgtattcagttaagccgaactcgcacctgacaagttggtcgctcaatcccaggaggcaatagagatggccattggagaaggtgatgtcaaagactgtatcctcgccgaatctttgcctcgggcatccacgctccaggtgggcaagtgcggagatcgcgacgagatgctcggtattgatggcatttaggatgcaattgttctaggtggacggtccgtagaagatcatggtgcgtcggaaataactggttggtcgtggctttngcgngtggggggggcgggggcaggcgggct

SEQ ID NO: 54446 - DNA, 438 bp, Triticum aestivum
  unsure (1)..(438): unsure at all n locations
  Clone ID: PAT_TA_54446
gcgccanggnggagggangacgcgagggggancngnancggaancacgaggggcacaaacaaggggcacanngcncgagcagggcgggagagnangngcnnncaggngaangangnncncagcnccangcanaaggangcnggggaggcaggagaagncaagagngcagaaggggaanncnngcngcgngncganggnggngcnacngnnaacaaccnncncangcagaaccaggccgannngcngggcagcccngnngncagaccagccgacaccgagacgacagcccnnggagccgcanacgcagcaggannagcngccggagncnggacgaaggaggagaaanncgcaggcccgcacaaggagaacacaacggnnnnccgccccaagnnagangacgcacacaggaagaagagaggagagnccnggaacaaggcg

SEQ ID NO: 54447 - DNA, 308 bp, Triticum aestivum
  unsure (1)..(308): unsure at all n locations
  Clone ID: PAT_TA_54447
gagaagcagaggaaaaagcagcnncanngganacaaggccggaccgacgganncgaccnncgggagaacacgcngcncganggcgagaaggaagacgacggnggnnccagcgagccgcgnagacagagcgcggggcggagaaaacaccagaaaggaggcaagaggaagcgggagnaanncagaccngacaangacagnccncngaaannnngccgngnncncaanccaaacaagagannnnggnaccacnagaaacngaaccaanngngcaccgnaggaacagagangaanngngccnagaagcagca

SEQ ID NO: 54448 - DNA, 329 bp, Triticum aestivum
  Clone ID: PAT_TA_54448
gcacatggaaccacgggaagctaacatggggggtgatctacttctcctagagttcaatggcgtaggatctgaagtcaagcagatcttacctggattaatccggcggcatcggcattctgatagcactggcagcaccacttcctctagaagcaatccgatgcgagaagacatgttgaaccgatcaaacacacaccggagtagaagtcaatttctagaaaatcatctagcaaaattattcgaacagaaaatggaaatattcaccaaacttgaatacacacaggaatctgtaatctctactgtcctcaagctttgcctgaaaagtttgcaag

SEQ ID NO: 54449 - DNA, 468 bp, Triticum aestivum
  unsure (1)..(468): unsure at all n locations
  Clone ID: PAT_TA_54449
gacccacgcgnnccgcggnccgcgnngggcgagggcngaaaagaagaggggaaaagaagaggcacagcaacccgcgcgaggcggcgaaaccancggggcgnncaaggggccacgnaaagggggcaaaggaaagcagancnncgggagcgncacggcgcaggaacncgncgacancancaagncgcagcnaaacagggacgncgacgggcggcnggnggagggcccggagaaccgcgaggncggggagnangnngcggagaacaagcnccaccccgangncacagccaaggggaggcngacngngnangccaagngagccggncgcaaggagggcanncagngganggngaggncngancncgccaaaaacncngaacanccngcaacngnngngccngggagcnagcgaggangggcncaacaaaaangnnnggcanggccccgngnacangaggagaagcagggaga

SEQ ID NO: 54450 - DNA, 647 bp, Triticum aestivum
  Clone ID: PAT_TA_54450
aacctaaatatggctgaactttttaagcacattatacaatggtcaaaatataaatatttctgatcaccatgaacatttacaccttattaattttgtattcgaaatacctgagttaatttgaacttgtttacgaaaccgattatgaccgcaccaaatgcctctggctatcgttcattaataaaatgccccacatgtttcattgtcaccacgtgatgtaataatggaacaaactgcttgagaccaccttaggtaatgaaaacttttgcccatgcaataatgcttgctagaactaatttgccaactgtgaacttacgtgtcaccattatttaaggtcccttacatggtgaagctaactgccatgtattattaagggcacggtagtagaatgaatccccccacgaaaccagacttggaaaactgagtcttgtagagcttgaggctcttctctgagatccacaccagaaaagtcacctaatgatctggtgagccccacccgctcttctgcatgaacagagcaccaggagttcaatcactgaaaaactttcttaacaccaaatgtgaaacaacgctattgaatgatactccaatagccccaggctcctggaagctgcacatgtaaaagtcgtcgccgaagacagccctgtcag

SEQ ID NO: 54451 - DNA, 453 bp, Triticum aestivum
  Clone ID: PAT_TA_54451
aagtcggagttctgcaagtgcttcgatgactgctaccccgggtgcgtgagcggcaacgtgccgggctacgcctgcgatgtgttctgcgccaacaagtgcagccccaacaccaaccaccccggctatggcgtcggcgtcggcacctgcaggatggcctgcaagatacagatctgcggccactcagcggcggcgccgaccgatgcagctgacgccgacgtctgcatgcagaactgcaacaggaagctgagccagatggcccagactgattaaccgccaaaccgctccgttttaggagaagagaagaagatttgaagagctaccttgccgatcatgggatcactacatatatatgaatatgatgttgaatggctgtgattgtagcagcaaccaataaattgagtatgtcgatatgtaaggcataatatacatgcataatatgaagttaaattggct

SEQ ID NO: 54452 - DNA, 693 bp, Triticum aestivum
  Clone ID: PAT_TA_54452
cttgaaaatatacacaacaaaagaaaaaaaaatacaagtggcaacccaatcaagttatagggtcgtggcattataacatcaacaccagaacataatatagatagaactaagcattattccaaaaactaattaaaataacaagttcagtgagcagagtgcctgcaacgttggccagagctggttctccaagaaagaatatgaacacttcatgtttgttcatacccgccgaaaagcaacaaaggaaaccgcaatactgtcgtcatgaccaaacatcaaccaaaacccacacgcagagacagagagggagagaccgctccggtccagagctcaaatcagatcggcgacattcatcggcatctcgtcaatctgcgtgctgtagtactgctcaatgtccctcaggatgcggatgtcgtccttgcgcacaaagttgatcgccacacccttgcgcccaaaacgcccagagcgaccgatgcgatggatgtaaagctcacgattattcgggagatcataattaatgacaagagagacctgctgaacatccagccctcgagcccaaacatctgttgtgatcagaacacgggtcgtgccactcctgaactcactcataatcgcatccctttccttttgaggcatgtcaccatgcatagctgatatggtaaagttgttggtgcgcatcctttcagtaagccaatc

SEQ ID NO: 54453 - DNA, 228 bp, Triticum aestivum
  Clone ID: PAT_TA_54453
caatcttaccaggcagaaaaatttacaagataaccggaaaacaaacggggcgggtatggtctttttttctggaaagggggggggggggtctcaaataattcactggaaagaggtagttcctggaggaatcgggaaaattcccggggtcctagcggggcctaagtatgaaaaaaaaaccatctacgggttttcggggggatacccctaagggggtcggatatttggggg

SEQ ID NO: 54454 - DNA, 640 bp, Triticum aestivum
  Clone ID: PAT_TA_54454
ggacgcacttgcaagttgtaaagaagtggaacaaacaattcacgatttttctcactgaactagtgcataccacacgtttatgatggcagttttgccgtggcgactgtaccatacacatacaggactttttcaacatgaagaatttttcacgccctaaattaaatttcccctaccatttaagtataccggacttgctccaatgccaaaaacgacaagcaatccaccatgaaaccctaacttacctatgcacaacatattaaccggaccagcacacacacaacacaacacacacagggcgtacgtgcttttttgatcaatcaatggggtcagaggtgcgactccgcgatggcctgctcgaggtgctgcagggacccctggtagctgacgaagcccatgaaccaaaactcgaagccgtcgtcggtcaccagctggacgtacttctgctccggccggtgctggttctcgctcggcttggccgccttcaccctgctcagcgggacggccaccttgtacggcacccgcaccgtgtcgcccttgggcgaggtcagcgccagcgaccggtcgctgcggaaggccaccctctccgacgatacgaagagcatcccggcgatcgggccggcggtggtggacaggtagcact

SEQ ID NO: 54455 - DNA, 598 bp, Triticum aestivum
  Clone ID: PAT_TA_54455
cccgaggcattaataacccctaaatatgcatttccagcgaaaacaggacggttccagggacttatacgcaaaagattacagacggaatataggcgcgtaaatcgacggtactgcgggggctaaacgtagaaatacccgcgctagagccggagcacccctttcttctaagagccacggccgcggcccatccggcccaatagccagcggcaccggcccatgtgcctgttcggtcacacgcagggacgctagggaaaccctaacacccaggtggtccatacgcagtggggggtcggccacatgactgccgcgtggcccagaacgggcgagaccacagaacctgaaaaaggatgctgccaaggccatcggggaagcggacatctgtgcgacggcgggaggacacccccgggctcaccaccccaacgagaaagatggccgccgatatccaccgagcgcagacaaaaaggcctgaccgcctcctcctcctctggacagcaggaccgttaaccccgtcaagcctatgcatacgccatcagctgcgaaggccgcacctaggagcccgcatggccgaaaccctacttcaaaagctccaaatccagcg

SEQ ID NO: 54456 - DNA, 417 bp, Triticum aestivum
  Clone ID: PAT_TA_54456
tcgcgatctagaactagtccggcggtcgcgccgccagtgacatgtacaattcgacagccgaggacgtgctgtacgtgctcaaggagagcagcgacgacgaccggcgcgactattacgcgctcgggaggttcgacgcggcggccaacacatggacgccgatcgacagcgagcgggaactcggcgtcgcgctgcggtacgactatggaaggtacgacgcgtccaagtccttctacgaccccgtgaagcagcggcggatcgtgtgggggtacgtcgtcgagaccgactcctggagcgccgacgccgccaaggggtgggccaacctccagtcgattccgagaacggtggtgttgatgcggagggtatcgagctcctccaccggccattggatgaggtttgtccgggtcttctcgtcaagct

SEQ ID NO: 54457 - DNA, 179 bp, Triticum aestivum
  unsure (1)..(179): unsure at all n locations
  Clone ID: PAT_TA_54457
aaaaatgagagtggcgcttattatttcaactgcaattgtggaattgcgcgcaccaacccatttgggggagtgaaacagcaaatcacgatttcatgtgggtggagctggtnggtnaccaaaacgacacgggggggggctaagcggtggngcccagttggttggcggtgacgtggttgacg

SEQ ID NO: 54458 - DNA, 152 bp, Triticum aestivum
  Clone ID: PAT_TA_54458
attgaatcgcataaggaaactcaactgaagaatcttgaaaccccaacaacttgacaacatgcatgacagtgcagattcagaaacatgcatgatgcaagtgccacagactttcgggcttttgatcggaaccaaacagcatgacgttcctcaca

SEQ ID NO: 54459 - DNA, 359 bp, Triticum aestivum
  unsure (1)..(359): unsure at all n locations
  Clone ID: PAT_TA_54459
ggcaatcaaacattccaaatggcgtaccaatcatgccgttgagaagccacttgggcattgccatcacgtaacacaaagattgcgaagcaccgtcttagccaaaaccagccccccaccttttggcataagccaaaagcagtctgggggggggtgctgaaaaccacggttacgaatagccagagttgcccgagactggcaagataatcacgcaatgcataacatggcaaatgcagcacaggcgtcaagtcaacaggaatgccacagatggatggatgcgcagtggacaggccatgacatccgccggggcagctgggccagcctccccngtcgcgtgccctcgcgtgcggggctggggcaga

SEQ ID NO: 54460 - DNA, 518 bp, Triticum aestivum
  unsure (1)..(518): unsure at all n locations
  Clone ID: PAT_TA_54460
gggcccaaccaggggggggagnnagggcgaccaacgaacaaagggcccagccccacgaacaaaggagggcacaaaggacgggggggggggaanaccacacacgaccagganaaggaggccacgacacaagacaagggggcagcagcaaaagcagacgcagaggcccaccagagccaaccccacagggaaaggaaggacccaaagcccccccgccacgggcccccccaaccaggggaaaggcccggggcaagaagggcaccccccgggcagggagggggcacagggggggggccccgaaaagacccaccaaggaggccccgggagcccccggaaggggcaacaccgcaggggcccggaagcggggggcagcccngaagnccgggggaanccccccaaaagccccgggaaaggaagccccccnaagagcagcncaaggcncnncggggaccggggggccccacgaaaagcaacaggagcaggggggagacgggggggccagcccacccccccaggggggg

SEQ ID NO: 54461 - DNA, 213 bp, Triticum aestivum
  Clone ID: PAT_TA_54461
atcatggcagcaccctatctttgatgattgacattgactgaaagaaacaaactttacacgcgccgagcaaccgtatgcaactatgagcatgcacggcggacaacggcggactcacacacatctaggcacccggtttgcgcaccaaaagcctaacattaaatactactcgctaagataccacaccgtgtgcttgcatataatctttgtaggaaa

SEQ ID NO: 54462 - DNA, 188 bp, Triticum aestivum
  Clone ID: PAT_TA_54462
gaagtgaaagacattcgggagatggatgcaaacgggggccaaatgcggcagtgcttcatgcaaatgcagtgctgcgttaaaagtgcaggggagctgctttgcaggcgggtgcagaggagctgggggggtgcaatgtcccaactatggtttgtgcaggtgccgggtgtgcgggttatgcacgggggggc

SEQ ID NO: 54463 - DNA, 680 bp, Triticum aestivum
  Clone ID: PAT_TA_54463
attaactcaaatatagtatctaacagatgtacaacataataagtaacatcatgcctgtgtatcgttaagatgcacacagccaaacacagacagagtgacaagagaaaataaaagccgtcatattattgggcaccagtaaagtcggaaaggaccgacactatgcctatgtctaaggaggtggttgaccgatccggagattatgttgccatccgtgttggagaaaaacctcccttactacccagtcaaccgcgtgcaccccattttgaacaaccgttgtgactctgttcggtgtagtatggaccacatacgaagcccgtgtataccacaaaaaatcaccttggagacaatctaaatgacatcttcgaataagaccttggagatatggcaatcaattgtgtcatgtgggcaaagggtgacgtagttgaagctcttcaccacgtgcataaaagtctgcctggtcagtccgctgacaccgttgcagctctgaagaacatgttgagtgagttctcgcatatccaaatccacttgtcggtctatatcctctatgttttccattttttgtccaccctgtgaaagaaccctagatgaaagtttgcggcatatggaagaggtgagcccctcgagctgggtatactccgaaatgttcagttgctgttgggtcgagccatgccttcctgagc

SEQ ID NO: 54464 - DNA, 498 bp, Triticum aestivum
  Clone ID: PAT_TA_54464
tcgcgatctagaactaggtgtagtactggtcagtatatcggcatagtgtctgacaaaaaaaagaataccctgatcttcagattccctttgctaggggcaataaggagatgagaagaaacccacagacatgatgagtatccgcccgatgatcagaataaaagatgcaaaagagtatgtgccagatgatccagcaatatcctagccaattgtactccaacagtcatctgctgcctggtagcccaccccatactggtgcaggtgccgagagtaaaatgagtcattgtacatgctttttggcagctctgatgcgccaacgatggacaacgtcagctctgagtttgtacatttcacctttccatagacatcattgatgacatatttcatgaaatcttccttcagagagctagaatcaagaagagtatctgattgagggatgaggccccagtgatatacaatgttgggtttgatgactgtatgatcaacttcctgtgatgaatt

SEQ ID NO: 54465 - DNA, 718 bp, Triticum aestivum
  unsure (1)..(718): unsure at all n locations
  Clone ID: PAT_TA_54465
cccacgcgtccgcgcggctccgtgacagatgtagaaaccgtggatttatcaagcaaaatgcagtcttggaggagtcgtaattcagttccaagttcgtcatacgtatctgtcaatgccatctcacaaatgagccattcaactgtcccagtggaacaagttctggaaattcctcctgagttcgatccggattctactgagtttgtctcggatataagtgattatgcaacagaattcaaacagagagatgttgtggaaattcctcttgagtttgatccagatgctactcagctggtttcagtcgaaaggcacaatgcgaccaagctgcaatgggagggaatagaaatccctcttgagtttgatccagattctgttgagctggctcctgacatcactgagtacacatcaaaactgaaacagtcacatgagcgtgctcgaaagctgcgggcagatttggctgttgaagagcagcgcgaacaagaactgagtagaatgctaaagggcatagtgactgttccaagtttgtccgaaacgcataaaaggcgaccaaggagaaagagtagtatagagcgattgagagtgtcaaggcatttggctgaagaggcaatcagttacttcgaggagtgtgtttcaatttcacattagatagcactgatttctcctcactcgaggaacctcatcaaaattcangtgggactgtcccgcgaaagagcacagtaga

SEQ ID NO: 54466 - DNA, 521 bp, Triticum aestivum
  Clone ID: PAT_TA_54466
cactcgcgcgctcacacacgcaaatatctcatctaagacatacgttgccgaagcagtagagggcgttagaatcattactgccggaaatggcggcccaaattcatagccagtgtctcgcgggatcagacgggagccactagccgtctacgtacctctgctgaggatagagataacaggctcaaaagagaaggcgctcgcgcagcaacgcaagaagctcggaatggagctccactgctgcctgccaacgacctggtgcacgttgtgactcacacaaacatagcaccccaacacgcgtgctttgaccgagcgcctcgtggtcagcttaatgatacttgcccactagtctcagggcgagcctgggacccctgctagacgggcgcccgtggagcactgctgagcgagcgacccaaaggccgcactgttgatgatcggccttggaccacccagcgccgacgcagacacctattctgaccatgacgacgactgacccgagccgatgacggaccagagacacatgacgc

SEQ ID NO: 54467 - DNA, 122 bp, Triticum aestivum
  Clone ID: PAT_TA_54467
aataaagagcatattgtgactgggacgctcaatcgaaatgcgtcgatgagaattaactacggtggaccatgcactacccaggtgcctaacgtctatgattaacctaagtgttcattacgctg

SEQ ID NO: 54468 - DNA, 662 bp, Triticum aestivum
  unsure (1)..(662): unsure at all n locations
  Clone ID: PAT_TA_54468
ggcgacacgcgggtagccgcagtggccaggagcatagcggagcgcgacgagctactcggggacgtccgctatcgtctacaacaggcacaggcggtctacaagtcctactatgacagacgccatcgggacattcggcatgacgtgggcgattgggtctggcttcgccttcgccagcgcaccgcgtcctctctcaacttgccaaccaggggcaagctcaagccacgcttctatgggccgtaccgcatttcagaggtcgtcaatgacgtggtttaccgccttgagcttccggcacgctcgcgcctccatgacgtgttccacgtgggcctcctcaagaagttcttcggcacgcctccaactgcaccgccgggtttgcctccgatccacaacagggcggctgttccagaaccggagcgcgtgactcgtgcgcgcctagcacgcggcgtttgccagctactcgtccactggaagggtgaagcagcatcatcagctacatgggaggatcttgacagtttcgtcgagcgctaccccgcttttcagctcgaggacgagctgctcgtcgaggggggagagatgtcatgtggggcacttnctacaggcgtgggccacgcgaccaggagcaacagncgcctgccgcaataggcaaggcgtagtccgggcaggag

SEQ ID NO: 54469 - DNA, 330 bp, Triticum aestivum
  Clone ID: PAT_TA_54469
agccccccaaaaaacaaagggacccacgcgcaaaatgctcgcgctcctgctctccccgccggcggcgcctccgccgcgcctcgcgacgctacggcggcggcctcccgcgccccgcgcctcctccgcccccggccgcgcggcgcccgccctccgcgccgcggccgtccggccccgcctcgccgccgcggggccgggtcccgccgagccggagcccgcgccgctgtccgccgaggaggaggccgagcgcgccaagctcgcccaggttagcaaaaggctagagaaaacagcgcggtatttcaaggatttgggtaccctggcattctggtctca

SEQ ID NO: 54470 - DNA, 473 bp, Triticum aestivum
  unsure (1)..(473): unsure at all n locations
  Clone ID: PAT_TA_54470
cccacgcgtccgcccacgcgtccgcggacgcgtgggttctgtcatcgtcgtcggcgtatcacataatccgatggcctcgcctgttcccccatgggcacgacaagcctggcgtcgcactcgcggctgcgcgcgatgcagtgcaacaaccagcgggcgcgcagggtgaggttgatctgcgtgccgtggtgtacctctggaaagtgcttttcaggagatgtgaggcaccagacagcaatcttgagcatccttgcaaactggctgctgctgtactgcttcatgtcctccaacaacagcagcagcaacaagaacaagcgcttcagttcaccagttggttcgtgaatcggatacttgacagatatactatatattgctactattagttagacacaaaaagaattgataattgaaagttgtgttataagtttggctttcaaaaaaaaaaaaaaaaaaaaaaaaaaaaaaaaaaaanaaaa

SEQ ID NO: 54471 - DNA, 625 bp, Triticum aestivum
  unsure (1)..(625): unsure at all n locations
  Clone ID: PAT_TA_54471
ctttccccaacccagaccaggagcgccctctctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctncggcggacaagtcgggagctgctgtgcgagaacggacctgagctgtgtg

SEQ ID NO: 54472 - DNA, 518 bp, Triticum aestivum
  Clone ID: PAT_TA_54472
gggaccggaagcaaagttttattcctccattggacaaacaaaaagccgtacgtgccaacgcgcccacccccacacacgggttaaatcagatcaaatcaaaatggcccttgcccaggaaagaaaaacaaggaaaatgcaataagcccaagcccgacgaggccccaacggaaaacaacccccgcccccgcaaggatcaaaagggggggtcctcccaggggggggcccaattgggggcccttcccacccggggcatggagttgatcttggggaaagcgtccaccttgaaattggggccccacaaaacccccttgttgtccaccctggggagccccttgagggggttcatggggggctcaaaacttttgagcccccccttgctggggaacaagcacccgggggggaacggggcgtaccaacccccccacccgggcttggccaacccggggtcgttgaaaaaaacaccgacccgttcgccggcacgccccaagggaggggcaccccgccgtccgtgctttggg

SEQ ID NO: 54473 - DNA, 342 bp, Triticum aestivum
  Clone ID: PAT_TA_54473
aagaacagatgtagtattatattttgtaagcaagttagttaccgttttgttgacaagttaatgaatgaatacatatattaagatgtgttggttacaattaaacagaatttatttctaatatcataataaatgggtaagggcaggaaccatgcataaagtagagggggatactgacagaatgaagaaggcagtgaaggaagagggagagagcgaggggaggtgagagattaaccggaccagtaaggatattagccagaaggaaggtgttagggataaggtaattaaaagcattttcaagaaccaaggtgttttaatatgaggcagaggcagctaaacccggga

SEQ ID NO: 54474 - DNA, 591 bp, Triticum aestivum
  unsure (1)..(591): unsure at all n locations
  Clone ID: PAT_TA_54474
ctgttaagtctgtactcttctagaacagatactagtcgtcccccatcatataagaatggcttatttcttgcattttcccaagcgaaggtacggtttatcaggttgtccatcatagctggaattttagtgaccaaaattcgtgccttttccgcccttctaaggtttacatgagcaccccttccagaactatacctcttcgagtcctggttatattcttcaagccaagcctcttcatcgcaggcagcaatccatttatttatcctgtccataatatcttttcgacttagtgactcttcttttgctttcaatatttgtgactcgatattcgccaggagctcagaagggtcaatagtaccagaatcaatcagggcgttagtttgctcaggggctgtgctgagatcaggttgtatgtgtgcattcttgcatatatcttctaattcggcccttctctttgtgacaatttctttcaatctgttggttttaagttctgtcaacctctcaacctcagcttccatcttctcgattgttncctggaaaagaacaccagcgnatgtaattccctcttctggngatatgagaatgctgattact

SEQ ID NO: 54475 - DNA, 341 bp, Triticum aestivum
  Clone ID: PAT_TA_54475
acaaaacgctgtaaataattaatcccaaacctgcggaaagaagatgagatttgttgctacacgtgtaggggggaacatgaaaactgggtgaatgttgatgcacgatccagcttgggtaatataaaataaggatagcacaagaggtgagttagagcacagggtactatcaatgagcttgatcgtgaacctaattgatgctttggatgagctcattgatgtgagtctcgcggttaccggcatgaccgggctgcacataggggagggtgttgttgttgagggctggcaagggggcgttgaactagaatggacgcgggaagttggggggggtggcttgtaagggg

SEQ ID NO: 54476 - DNA, 425 bp, Triticum aestivum
  Clone ID: PAT_TA_54476
gggcccaaacaagggaacattcctgaaaaaaaccctggatttaggggcaaaactttttaaaccccagggcttgcccctctgcttataagggtaaagaccccaaaaagcccccccggcccgacaactttccaaaaaacctttagctggaaacttggcccgaccccaatccaacccgtttgaaaggggaaaaataaaaccaaggggaaggcccccgagcccataaaaattcgcagctcccccccaaacaaaaacaagggggccctcataggcataaccttcacaaacttgacccaaggaaccgtcccccaaaaaaacaccctttttaattttcccaccaaaaaagctctggggaaccagtgaaaaaagccgcacccttccgggtacctccaggcacaagccattttttccgagttttttgctttgtt

SEQ ID NO: 54477 - DNA, 303 bp, Triticum aestivum
  Clone ID: PAT_TA_54477
aaggaaaactgggcccctcgatttccaaaagggcgggggttgggtgtttccggggaaacatgaaaataaaaaggcccccccccttcgcgggctttttcctgttcaggttcaaggggcctttttcagcccatttcgcaccaatccaggccagggggccttaaaatcggggggaatccaagccccccgggggcaactttcatcactggcaatcccataagggtttgcaaagccaattttaacataagtaacccaacatagggttcccttttattccaccccataatccataatgcccggccccgg

SEQ ID NO: 54478 - DNA, 556 bp, Triticum aestivum
  Clone ID: PAT_TA_54478
ggggcctagcaaccttcatttttatgggactgggacaacaaaccaatgctttcaaacaaaaaaacagcgggaccggaccggacaaacacaaacgggacctgggcaaacatttggcacctgggagaacgcgataaccgggatgggacccaacacaaagacccggttcaaataacttaaggcaccccatgcccacattgactctggtgcaccccctttctcgctggggggcccaaccctatttatttttcatgggtgtcacattcgggaacttgggctgggggcacccacccttcggaggctgcattaagggccaaggggcaccccggtagcgggaacatcgggtcgcccctcaaatattgggctctgaataagggggagagcaacaaggtttggacaaacaatggttttacgctgggttggtccctttttttccttgggagcgaccagtcaatacttgacccccaccggccaacaactgtctcttttaacactgggacctcactctgagcaagagtagaccaatttgatggttcctcaacatctaatggtgggaaac

SEQ ID NO: 54479 - DNA, 122 bp, Triticum aestivum
  Clone ID: PAT_TA_54479
ccgggaactagtgaaaatatatgtaaaagggtgaaagccacacataattctttcctacttcgcccacttggctaaatctttctaattccaaaaaccagaactcttttttcaaacaggtatac

SEQ ID NO: 54480 - DNA, 523 bp, Triticum aestivum
  Clone ID: PAT_TA_54480
aaccacccccattttacgattaccctttccaaggaaattccacaatttttaaaaaggttttaagacacttaacatttggttggttccggcacaacattggggaggtggctggcaacccttgagccaagcaaaaattctggccaccggattaattttaacatacagggggattaggacttggccttttttaacccatgggccaaggacagggaaggtgggtcaacagcttccttcttggaggaggggaacaccacgccggccttattatggatggttttggcaacaaaaaactggagggccttgggcttggttaaaaaataatttgggggaaacttaacattttttttggaaacatttagggcattccctttaaacttgggaaaaagggttttgatgttacgctttatgggagaaataaactggtttttggcaaaagcaaggtggttcttaagaacggagggggtaacaatggtaaccacctttacgggctggtgattgacacccttattattaccaccaccct

SEQ ID NO: 54481 - DNA, 668 bp, Triticum aestivum
  unsure (1)..(668): unsure at all n locations
  Clone ID: PAT_TA_54481
ctcgccgccgccgccactccgccgctgccgccgccgagatgggtcgcgtgatccgcgctcagcgtaagggtgcgggctccgtcttcaagtcccacacccaccaccgcaagggccccgcccgcttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccaccctctccgttggtaacgtcctcccgctccgctccgtgcctgagggaggcgtcatctgcaacgtcgagcaccacgtcggcgaccgtggtgtcttcgccagggcctccggtgactacgccatcgtcatcagccacaaccctgacaacggcacctcaaggatcaagctcccctctggtgccaagaagattgtcccaagcagctgccgtgccatgattggtcaggttgctgggtggtggcaggactgagaagccaatgctcaaggctggtaacgcctaccacaagtaccgcgtgaagaggaactcctggcctaggtgcngtggtgtggccatgaaccctgtggagcatcc

SEQ ID NO: 54482 - DNA, 528 bp, Triticum aestivum
  Clone ID: PAT_TA_54482
aaagaataactaattgtttaagaccgcgagcacagctggcgccgtcaagtgcttcaaaaagattcttatcgtgaaaaatagttttctaaataattaaaaaaagtgatttcaatcattgatgatgcaccaaaaagattcttgcactcatacctccataatacgtgcaaattggtaagtgaaatacacacgaagtgcaacccatattaagtggcagtaaatctttcgagcaggagaaggaacgacggcgacgatcgtggtgaagacagctaccggcgaggagttccacggcggcaagtgcatcatcaccgtcggcgcgtggacgagcaagctggtcaagtcggtcaccggcgccgacctgcccgtgcagccgctgcacaccctcatctgctactggaaggtgaagcccgggcacgagcgcgagctcacgacagaggccggcttcccgacgttcgcgagctacggggtcccctacatctatagtacgcccgtgatggagtaccccgggctgatcaagatcggcatgcacgg

SEQ ID NO: 54483 - DNA, 656 bp, Triticum aestivum
  Clone ID: PAT_TA_54483
cggcaatggaggtggggacgtgggcggtggtggcgtcggcggtggccgcgtacatggcgtggttctggcggatgtcgcgcgggctgcgcgggccgcgggtgtggcccgtgctcggcagcctgcccggcctggtgcagcacgccgaggacatgcacgagtggatcgccggcaacctgcgccgcgcgggcggcacctaccagacctgcatcttcgcggtgcccggggtggcgcgccgcggcgggctggtcaccgtcacctgcgacccgcgcaacctggagcacgtcctcaaggcgcgcttcgacaactaccccaagggccccttctggcacggcgtcttccgggacctgctcggcgacggcatcttcaactccgacggcgacacctggctcgcgcagcgcaagacggccgcgctcgagttcaccacccgcacgctccggaccgccatgtcccgctgggtctcgcgctccatccacggccgcctcctgcccatcctggccgacgcggccaagggcaaggcgcaggtggatctccaggacctcctcctccgcctcaccttcgacaacatctgcggcctggcgttcggcaaggacccggagacgctcgcccagggcctgccggagaacgagttcgccttcgcgttcgaccgcgccaccgag

SEQ ID NO: 54484 - DNA, 440 bp, Triticum aestivum
  Clone ID: PAT_TA_54484
gtgtcaacttgacagaatgcaagctatactagccttttcatcaagactaaaacgcaacaagaatatacttggatcatgaccatgagccgatcaatccgtcaatgatatgattatgatcacacacacacactacgcatgcatgatgcatcctcatccatgcatgagacacgaaagtgcattgtgatgtgattcctagagaattcagaggtgtttaggaattaggagtagttcgcctgcggtgcaggcagcttgtggccttaatggcgcaggtgccgcattctttggccggcgacgtgaagccagagtgccagacgcggcggaacgcggcaaggacggcgcggtggtgctcggcggcgttgagagcgaggtagcacgccagcagctcctcgaggtcctctgatgacccgatgtggttggcccgcaccatctccgccatgctc

SEQ ID NO: 54485 - DNA, 794 bp, Triticum aestivum
  unsure (1)..(794): unsure at all n locations
  Clone ID: PAT_TA_54485
atttcgcagaagtttgcttaattatttttcttgtaattcagaagcagaagttctttcagctcctccaaggctggtgtacaacaattttgtgttacgattggcccgggacatgttagtggcagttgccggtggatgggatcagcatgttgaagtcatcaacaaaataattccccaacattggaaggttgataattgtttcacaatttgaatattggcccatcaaatccctccaagtgtgcctcaagttgctcatatgtttataagttcagtccaaaggcatgtattatcaggcgtccaagttcaaacgtgttttactagtttgtgatatcaaatatctttggctcagtgcatgaaaaaatcacaacacaaataccagaagtgagtgaaactggatggttatttaggatcatttgtttgcctttacctattcagtgtgctggagtagggtctctcaattttgtcttacaaaattgggcatgatgtgtttttatttcagtcccaagaatgggcgagtgattcagtaatcaataggaagctgacgtgtgtggcatgagttttggcgctactacgttcttgaaatatctgaactgttgccagcaaaagaaaatttgactcgctcctaaagctcaccagctcacttactttatgtgaaataatggcttgcttgctgaacttctgcctgtgatttatcaccagctcagttactaatttacccattcgtattttgcagtctggtttgcttactaagntgcatcaatattcttttgctcattcatttaacattttcattggca

SEQ ID NO: 54486 - DNA, 812 bp, Triticum aestivum
  unsure (1)..(812): unsure at all n locations
  Clone ID: PAT_TA_54486
gaggacatcactaatagaaacaaaaggacgacatgcatgtccttaaacgagacggctgacaactgcgttgctttgaaaaaaagggcaaggatgtttcagaacacagatgagctgtcgagcaacattcatcatgagatgccacacactttaggaactgtaagcgcatcatcacacgagaaagatcagtcatcaagcgacgctaatcttggtcagatccaacaaacaccggtccatggcacctcttcagctaccaacaaagacttcccatgggacgaccctgatatggtagcgcagttgatcgagtctaccgataggattgaggaagagtggttttcacaacaaagacaaactcagtataccacatcagttacacaagacatccacatatcagagatcaagcccaatgagatttgttgcaacttcacctcaaatccagtcgaaagtgctgttttcagcgacattgtgtcacgaataccaccccattcaaggcaaaagagcccaagaatagtacaaatgggctcgacatgggttgaacatagggtttttggcctgagcatgcaagtgtatggccgggtcaataagtacttgatcaatatgttgggaaaagcagtaatggccgagcaaaccgaaaaggagaggctcaatcttctcccgcgaagttactggtcaagatactatgttgaatgcaacactgctaaattattccaaaatgcatttgaaactncatttggcgttatctgttcacctgagggagacaatgataggattccatcttgaccgattcacatggtgtttttacctttagctcatac

SEQ ID NO: 54487 - DNA, 740 bp, Triticum aestivum
  Clone ID: PAT_TA_54487
gccggttttaccaaagtgcaatcgcttctctccaaccctgcctcccgaaggctgcagccatgcggcggcactacgccgagctcctccgccgcgccgcctcgctgccgtctctctcgctggtggcctccctccacgccgccgcgctccgccgaggcgcggtcctcgtcccctcgctcatccacgcctattccgcctgcggcgacccagcctccgcgctcagcgtgttcgacggattgcccgcacaggagcggacgctctctgcgcgcaccgcgctggccagcgccatgtccgcgcacggcaggtgccgggatgtgctcggcctgttccgcggacgggagggggagatggacgacaaggcggtgacggtggtcctcgccgcgtgcgctagggccgggatggtcagtgaggggagggaagtcttcgcgagggtcaggaggccagcattgcagcactacacgtgcatggtggagatgctcggacgtgccggggaggtcgaggaggcagaggggctgctggcgcggatggaggcacgcccggacagggtcatctgcatggtgctgctcgcctcgtgccgggcgcatggccgtgtcgatgtggctgagagagtggctaggttgatgagcgagtatggcattgtatgaattttggcatattgatcagttgacaaactggccattgtgttaggctgttagcccaaaatcagtgatcaaaaccattgtgttatggagctgataacacat

SEQ ID NO: 54488 - DNA, 251 bp, Triticum aestivum
  Clone ID: PAT_TA_54488
gcgccagtgtgcttgacggagctcggggcggcgggtgggtgcatgactacgagtgagagagagaccaggaaggaggacgacgcgatgcgctgtgccgtggtgctgctgctcgtcttcgcggcggctcgcgccgtcgcggtcgttaccgacgggcttcttccttatggctacttccagtctgttccggcggggggggtgcttgtgatcggcgcggtggtcaatggtttgtttgctatttgtatgtaggagac

SEQ ID NO: 54489 - DNA, 690 bp, Triticum aestivum
  Clone ID: PAT_TA_54489
acattggattctatgctgggtttgtaggcgcctcctatatgcttggtagaactttaacctccactgcttgggggatggtagcagaccgcattgggagaaagccagttattgtgcttggacttttctccgtgattttattcagtgctttgttcggactaagtgtgcattactggatggcagtatctacacgatttcttcttggttctttgaacggcataattggacctataagagcttatgctattgaagtttgtcgaccagagcaccacgctattgcattatcacttgttagcacagcatgggcaataggtctcattttaggaccaacgattggcggatatcttgcacagaaaaatatccaaagttatttcccgtcgactcattattcggaaggttcccatatttattaccttgtctgtgtatatcagtcttcagttttcctgttctaataagctgcgtttggctcccgggtccaaataatgcgaagtatccgatggttgtgcactgatccgatggtatgctaggatcagtagtccgatgtctagtcatgtcaaagattttattgtaatcaagctcattgttttaccatttcaacttttatcaccaacttctgggttaagtaaatgtaaggttatacaacttatgacttatttttattttcctatgtagtactagtacaagtattctgcg

SEQ ID NO: 54490 - DNA, 441 bp, Triticum aestivum
  Clone ID: PAT_TA_54490
gggccggtgccgccaaagattattacataccaatcttcaacttgactggaatgctgggaaaacttttccaagggcaaaaatgcgagaattattcaggggccctaaatgggggcttaacacccaaggaaaacgaggggcctgccacttaacccactcaagctaaagctcctgggttgcaacaaaattaggggggggggaaataatccaaaaaaaaagcagctggggctcaaatatgaacgcaaaccggttttggggagtctgatggtgaagacctcccaccaaaaacaaggggtctgtactttcccttgggaattgtctggaggaagggattggggaacccggctgcttgggcattgaattgcaaggggggcaacattataacagcactcaacataaaaacaattgggtttgcaagggttttgccagaaatattaggggcaa

SEQ ID NO: 54491 - DNA, 351 bp, Triticum aestivum
  Clone ID: PAT_TA_54491
gggggcaaacaggaacaacacttttttttaaaggggacgaggccggaaacacgacccggccaataaagggtgggggcgcgaagccggccgaaggggcaagtagggcggggccccccgggggggggaccggcccccccggcccaagggccaactacaagctttttaacggcaacaacttaaaaaaacgctatgggagcgggaattaccgggggggggggcaccaaacttgccctccaagggggccccgcgaggggagttaaaatggaccctttgcaattaccaaacactaagggggcccggatgggggatttatggggccccaccccccccgggcaagggagggggggaatt

SEQ ID NO: 54492 - DNA, 465 bp, Triticum aestivum
  unsure (1)..(465): unsure at all n locations
  Clone ID: PAT_TA_54492
tttttttttttttttttttttttnttttttttttttttttttttttttttttttttttttttttttttttttttttttttttttttttttttttttttaggccaaaagggggaacactgaacaaaatattatgcaaacaagacccaggtataaaaacccccccggggtctttttttccagccccaaaaaaaaaataaaaaaaaggccccgaggaaaacattcactagcgggaaaaaaaaaaaaaaaaactaaaaacttttttttttccttctctgcctgggggggtttttttatgggggccccgagctggcactggttaaacctttcaaaacggagcttgccgaaggccttaaaccccttaatttcccgggggacctttaaaagccaaaccgaacgcttttaaccacaagaaaaaggcatgtagcccccctggacccgggggggtggggaaagttcctcaggggg

SEQ ID NO: 54493 - DNA, 526 bp, Triticum aestivum
  Clone ID: PAT_TA_54493
ggccggcaaccaaactatgggttatcagccccaaaacacaaggggtttgatcactggtttggggctaacagcctaacacaaggggcaggttggcaactggtcaatatgccaaaattcatacaaggccatactcgctcataaacctagccacttttttagccacattgacacggccatgcccccgggacggggggagcagccccatgcaaatgaccctggccgggggggcctccatccgggccagaagcccctttggcttcttgacctccccgggacgtccgagcatttccaccatgcacgtgtagggctgcaatgctggcctcctgacccttgggaaaacttccctccccttactgaccatcccgggcctagggcacgcggggaggaccaccggcaccgccttggggtccatttccccctcccgtccggggaacaggccgagcacatcccgggacctgccgggcgcggacatggggctggccagcgcggggcccgcaaaaagcgtcccctcctgtgcgggcaatcc

SEQ ID NO: 54494 - DNA, 618 bp, Triticum aestivum
  Clone ID: PAT_TA_54494
cccacgcgtccgcccatggtgtcgctcgctgccccggcattccactcgctggtcgcgaaaacctccagggcctgcaccacgagggcgtcttcgcaacgcgagagcgcgcccggccgccctggagcgaaggcgcggcctcgggcggcggggactgcgcaggcggcggcggtggaggcggaggagaccccgaggttcaggtgggatgagctcgggtccgacctgtccgagccccaggagcaggcgatgcgcggcctgtcccccaagctgcccaaccgctgcagggcgctgatgccgcgcgtcgtgtcgctgtcccccggcgatgagaatctcggcgtggtccttgcgttctgggtgaaggccatgaagcccaagagggcggactggctgctggtcctcaaggagctcaaggctatggagagcccgcttctcgctgaggtactagaatatgcacttctggaggattctttcgaagcgaatgtgcgtgactacaccaaactgatgcaaatctacggcaagcaaaatctgttgccggaagccgaggaagcattccaggccatgaaagccagaggcctcccatgtgatcaggtcatgctgactgcactggtggacatgtacagc

SEQ ID NO: 54495 - DNA, 669 bp, Triticum aestivum
  Clone ID: PAT_TA_54495
cttcgcctaggctagctatatactaggtcttctcctgctcagccatggctatgatgggcatcatcaagaccgacatagcgccggagacggcgtacgagacggagcccatgtctcaggctacagccagctccgccgcggcgggcgcgcggtaccgcaggggtttgctctcgaggatgatgccgcgggggcactactcgtccgtcggcgccgagaacggaagggcgcccgaggcggcaccgatgcccccggccgctgccgatggctcggaggtcgcggagaagccgcggcgcggctggctgcggcggctgataccgcagcagcggcggcgctggaagaatctgggcggcgccagcgcgtcgaggctggccggactgtcgcgatcgctgcggtggaagcggctgtccgtgaacctgaggggcagctgggcgtcggcgctgctggacaccgtcgcgttccgcgtgatgtacgtggtggaagccatcgtgcttggcctcgcgctctcctgcttcttctgctgctgcggctgccagatatagctggccatggcctgccccttgctgtgattcgtgcaagcccccttctgcttgccattgggcgtgtaatcttgtacccccgtgccccgtcctttaattttcttatgtcaattataagatgcttagttctgcgatc

SEQ ID NO: 54496 - DNA, 484 bp, Triticum aestivum
  Clone ID: PAT_TA_54496
gggcggaggcggtggtgcttgctccggcggagggggcggtggctgtggcggtggcggagggtgtggtggcggttgcggtggaggccgcggtggctagcctgcagcgcaggaaggcatggcttgaaccggaatccggagctgctacgggactctctatagtatagatccctccctgcagttactacttagtagtcgatcactagatttgggtttgatgatgtattgcaagaaacatttggtactgctatgtatgagattgcgagctcgatctgtcaataatggctccgcgagagcttagcttggttatcaaggttgcagagcatgcatgttactaccttgatttcactgtttttcccccttctgtttgtggtgatgatatcactactctttatcagtgtgatgttagaactaggaatgcatctgttattggctgtatcaagtgtgcaatgaactttattaattatattctgttcctaatgatttg

SEQ ID NO: 54497 - DNA, 632 bp, Triticum aestivum
  Clone ID: PAT_TA_54497
cccacgcgtccgggtcaatctatgccttacaaatcaaacagagaaacagttggcccttttgaagtatttctagctccaagcgtatctggtgaacaaaaaactgttctggtcaatggattacagaagttggttttgccattagtggaggcttttgagtccatcaactttgacctgagcatggtagctacccaacttggcgtgcaaaagatctctggaattacattgtatgctgtgcaggaaaggaagcactacgaacctttgccagacatagaggtaaaatgtagcaacttcggtgtcaagttcgtctcttcatttgccgaagtgaatggcagaattttagtttgttgaacgttgatcgctttgcagatttttgtcgacgcggaatagaacaccgcatccacattgggagacccgttggacgatttttgtcgacgcggaatagaacaccgcatccacatcgggagacccgttggacgtgctagattagaccttcagggtgagccatattcttgttgatgtacttctgtttattgtactactgatatcatcatgttgtaattaaccacaccttttatatcaaaagtaatgcatccgtgcatgttcgttgtgtaaaaaaaaaaaaaaagggcggg

SEQ ID NO: 54498 - DNA, 798 bp, Triticum aestivum
  Clone ID: PAT_TA_54498
gagagcctcttctgcctcctcgcgtctctctccattccgctgccgccatccagattcaccatcactagcagcagtagagcacaaatccaatgcatccaccatccaatcaaccaccgaatccaagctgacgatcgatttcagcggcgcggcggaaggagaatcgaggaggagtcggatcgagctggctgcgcggcggaggcggcgcttcccgtcccttccagatcgacggccgcaggcgggggctggggagcggagcgccggaggagccgcgacctcgaaacaggaggcagccgcccggggtgcatatctctcgattggtcctagctagggtttcagtcagtcggccgggaccatggagtcgccgccgcccaagcgtgacgtcagccacggcggcgaggacggaatcagcgcgctccccgactccctcctactcgacatcctcgagcgcctcgacctgcgcgaggcggtccgcgccggcgcgctctccacgcgctggcggcacctccccggccacctctcgcgcgtgcgcctcgacgtcgctcacttccgcggcgcacgccgcttcgaggtcatggacgcgttcacgggcgcggtgcgggccttgctaacccgggttcctcccgccgagggcgtgtgcgggagtagtgccctcaaggtccttttcctcagcttctacacgtcttcccctcacctgagctccataggccgcctcatcgaggacattgtgagcttgggccacacccaatgccttgagttttgcatatccccgccgggcactaacccgctgggcagcaacat

SEQ ID NO: 54499 - DNA, 434 bp, Triticum aestivum
  unsure (1)..(434): unsure at all n locations
  Clone ID: PAT_TA_54499
gggttgtttttttgtttttttttttttttttttttttgttttttttttttttttttttttttttttttaggagcccactgaacatattttgacccaacaaattaatccgggaatacagtcaaaagaattttttttttttcaaacatagtagcttagggggggggggcttgggaaaagaacaggcagaatagattcagaagagggagggaactcgcaacttaaaaggacttccggggggcaattggtgggcctggcttattatactcaccctttgggatccacatttggggggaggtgctaagggggggaagaattgacccttcaatccagacactggactttcttttagggggggccaccaccttgatctttatgctggttgggggaaggggagggntcttcttggttatacgggcaggagtgcccgggggaca

SEQ ID NO: 54500 - DNA, 584 bp, Triticum aestivum
  Clone ID: PAT_TA_54500
cagcgctaaacattcaccctattttttcaaacatatccgcgaaactcagtaattttccgcatgaaagtccggtttacacgcgggtaaaactgaaaggcaccaacatgcagatgcgtacagaaattcaaatgtacatatacatactttgtactccatccgaggcctcgtttacttctccaccgtgtgctccaggtaggctcctcctgccatggacaacgctatgcacagctccatcgcctccgtcccagcgctcatccagccggatcgttcactcaaggtcttggggccgggttttcgccgtctggaatcctcctgatatggacatcgatcatcacagcagaagacagcgtactatcacctgaattccttgatgatttggcatctccatcggaggggacacaaaaataggtgaagccatctcttgatgctccatgcccgtgctacagccagccaggaagcagcagcagcacaagtttgatgtgatggcgctggaaccagcaaaatatattgtcctgcagaggcattgccagagtaggagtcaagttatgcaggaaagaatggtagataattaaaagcattaattg

SEQ ID NO: 54501 - DNA, 346 bp, Triticum aestivum
  Clone ID: PAT_TA_54501
gggacaaccaaatatccaaacataatcttttttttgggggccgaaaaatccagaccccgacagggaaaactggtaacaaacattaccaggttaccaaaggcccgggcaaaaacgacatccatactggaaaacatggccttggcagggaatctagaggccgcacccctagataaacagcaatgatagctctaaagggccttggcggccttggcagaaaaggggggaacctggcctttgaaacaaccaggcctcctagcagggaagaaaccaaccttttggccagggggggcattacggggggcaggggaaacgcgaccaatatgctggggggtaccccccccggggg

SEQ ID NO: 54502 - DNA, 417 bp, Triticum aestivum
  Clone ID: PAT_TA_54502
aaaaaccggcctctgaacgaggaatcaattggtagtaaacacgcagctaacaccttaatttctcgacaggggccctaggaatattccatcggccagcaacgaattaaccattttcaacagggggtaaactaaacaagaaccaccgaagcgataggactggactactgggcgaatttgactactgggtgggggagatggactttgtctcaggcccttcggggcacgaggggggggcccagcggttttttcatgacgacggggaactcgtttttttcggggaagtccacctccttggcggggacctcctgccactcgaactcccttaccatgttggccacgaagtactccagggggagcatggggatgcccaacccggggcaaatcctccggcccacgccgaacgggattattttgatc

SEQ ID NO: 54503 - DNA, 539 bp, Triticum aestivum
  Clone ID: PAT_TA_54503
ggaaaaaaaaaaacaggcctccaaattaaagaccccacatttaaagttacccccagggggaaaaagggttcccaggcccccaaaaaccaaaaattaaaatggggggggccaccccgggcaagttttttaagggtcccaaaaactaaaaattaaaattacaacgggggggcccttttggaaaaattggtaaagctggggaaagcctgggagcattaaaaaaccactagcattccctgaccaaatccggaaaaaaaaaattccccccaaaaaggaggaagacccatgggggagtggctccttaaaccgaccccggccaaccttttccgccggggatttttaaagggggccggcatccaaaaatgggcaggggttttcaccaaacaaccgaattataaaaagccccacagtttgttccaagaaaagccttataaagttgggaaccttggtttcatccccccccccaaaaaactggaacaccttaaaggtggggggcttaaaatcctgggagggcccccacaccatgtgggttttttgggggc

SEQ ID NO: 54504 - DNA, 133 bp, Triticum aestivum
  Clone ID: PAT_TA_54504
aattccgggggcccaccctcctcacattttacatccatactttgaagaggctagagtcctgctcagatatggagacacagatgaatagatcctgggcggaccagggagaacaggtctaagctgatgcagagag

SEQ ID NO: 54505 - DNA, 585 bp, Triticum aestivum
  unsure (1)..(585): unsure at all n locations
  Clone ID: PAT_TA_54505
caggagagcagagcagagcagccaagcaaagtaaagagatcaagagagatggcgtccagggcattcccagctctggtccttctcgtgctcatctgcggccagctcgtggtcggcggccatgcccagccctacatcggcggcaccaggggaggaggaggatctgccgccggactgcggccaccgacttccaccgccacccatggccactcctccaccattggaggatacgacgggactggaaggccttcagccatgggagaagacaagtccttcatgatcaacaccctgccggcgcacgaccacccgcttcctgtcccgccgtccggtcagtagaccatgaagtgcagccgagcttgagaccaacgaccgtgtagccagcactaagaataaatttgtgtgaagttgctgtgtttgcaggatgactctgtttctgtcatcaggggtataaaattaagcagaatacaacaaactactactaatgtactgttgagaaagttgggaattcacagtgctttcaagggaacatatataagtaagtttatcccaaaaaaaaaaaaaaaaaaaaaaaaaaaaaaaanngggggc

SEQ ID NO: 54506 - DNA, 525 bp, Triticum aestivum
  Clone ID: PAT_TA_54506
ccgggggcgacccacgacgtctcgcccacgcgtatcgcccacacatgcggtagagaagccagttcgtgaacttgttcaatatgatgaatggctaaatggggagatgattgacactgtccagctctgtggggctgagatagtcaagccaggaagctctgcagtgctttgtctagtggcaggtcagctagcgatcacattcgtgactggggtctgggaaccgctcaggaaacattagatatcatgcgagagagctctcatgggagatacagagcgactggtgcagttatgtacttcatgctagcaacgggaactgccctggaacgcacagcatcgacatagactgctcgctaccctatgatatttatgtataaatttaatgaagacgaactttacagacttcttcataatgtcagtctaccttgtcaaacacctgatctatgccgactgtttgcgctgcacagaagatgccaggcgtactagtagttatggtggatagcgcaagagcaattgatacaattaacttgg

SEQ ID NO: 54507 - DNA, 501 bp, Triticum aestivum
  Clone ID: PAT_TA_54507
ttttttttttttttttttttttttttgggttttttttttttttttttttttttttttttttttttttttttttttttttttttttaaaaatggggtcccccccaatttttacaaaccccatctttattttgccccaatcaaattccagggggggcccttttttcacccccttaaatcgacaagcgaactaattttcctacataccttttactttaccacttccagtcaaactttaacgagggcttttttcttactaaactgggcaagccattaaaacaacacctagcataaagtctcaacggttcccaaaaggtgtgaacattcacaaattccaaattccaggttttttggggcgggaaacggggagcattttattatacttggaaacattgacaaagccccacaactcaaaatggttgacttcaaaatccttggaaagggacacgcatgggttgttaaacctttcttgggggaaactttaaccattaaagaagttttccc

SEQ ID NO: 54508 - DNA, 556 bp, Triticum aestivum
  Clone ID: PAT_TA_54508
ggtttctgtttttttttttttttttttttttttgggggtttttttttttttgatgtctaagtacatcagcatctcgaaagataagatactcaagcagtacataaaattatattctacatcacatattttttttttttccaagtatcttggagggggggggggggggacagaagctcaacttgctctcccactctttgcacaggcaaagatgccggcagggcagcaagagcatgcaccccttgcttgatttacagaccctgcaggccggcaaatccttggggtgattgttctccttgggcatcagctgcagattgacagcgcccccgttgcagcaggatgctgtatcgtctacctcactggcgccacagccttttttgaagtccttgctttgatgggcacatacctgctccaggttgtacttgagtgcgctgatcatgctctcgttggacttagcctcgttggtgccacccaccaactttccctggcatttgtttaatctggtccctgaggttccaggttccttttgttggtgttctgcacttctgactcttttttc

SEQ ID NO: 54509 - DNA, 510 bp, Triticum aestivum
  Clone ID: PAT_TA_54509
ccggaaaaaaaagtccgggggggccaaggcccaaatatcggaaacgggtttaccataaaaggcccccccgcaaccccaggggtggcatcacccttaacaaacccttccccaggggggggaccaaaaccctcaggggggccccaaaccccgccaacaaggggcccggggaagacccccccctaaaacggggggacgaaggcccccctcccgggggctaaaaaagcttccctgggggcgacgacgttatcagccccctttttcacaggctcttccttttttgacaagaacagctcaagggggcaggggttggccctgtaaggattgatgccccccggaccccggtatgtcccgcccccctgctttggggcttggtccccccggatgggggaaagggaaagggtgtcaacccccaagcctttaaccccagggttcctctcagcattcttcagaaaatccaacacaaacggggccgactttgcaggccagcgcccccgcccattgggcgggggg

SEQ ID NO: 54510 - DNA, 480 bp, Triticum aestivum
  Clone ID: PAT_TA_54510
gagcatcgaccattcatgtagcttcattaacatattgggcatgcatgttatatagaaattccaaaataatccttgtcaacaaaacatgttatttgatcctcttacagactgcaaaggtatgtctcatgctctacagattggcaaccatcttatgcttgcactcatcatcgactgctatatatgttataaggcacgataacaaattgtgcttcatcaccttttgcaaatctcacgacctccaatccttgatgcactaaatcgactttcaccacgaccatttatgttccctcgccacccctgctcggatgaagaggtgacattgcctatgtaacgtattagtgtaacattcatcagtattatataccgggaaatgtacaagtccacattgcagaccacccaaacatgtcacaatccctatattgagcaaagaaagcctccaaaatcaaatcgagcatgacaccatcatggacatcaggttga

SEQ ID NO: 54511 - DNA, 616 bp, Triticum aestivum
  unsure (1)..(616): unsure at all n locations
  Clone ID: PAT_TA_54511
cccacgcgtccgtgcgagtgtgatccatgagcgccatgtacgatcttgccctcaggaccaccgccaattcaagcagcgctacttcgagttcctggactaccacgacgaccctaacggcccggtgttcctgcgcatctgcggcgagtcctcctgcgacggcctccccaacgactacctggccgtcatcgccaagaagttcggcgcggcggtggtgacgccggagcaccggtactacggcaagagctccccgttcgacagcctcaccaccgacaacctcaggttcctctcgtccaagcaggcgctcttcgacctcgccgtcttccgccagtattaccaggaaaaactgaattctcagtacaaccggagcgcggggttcgacaatccgtggttcgtcttcggggtctcctactccggggctctcagcgcatggttcaggctcaagttccctcacctgacatgcggaagcctcgccagctacggggtggttcttgctgtgtacaacttnactgatttcgacaagcaggtcggagagttcgctggccctgagtgccaagcccgcctttaggaaataactagacttgtgtacgaacaacttcggttcgatagccactcggtg

SEQ ID NO: 54512 - DNA, 344 bp, Triticum aestivum
  Clone ID: PAT_TA_54512
gaacaagggcagggtccaaaaggaccccaaactttatttggtgttacaatacgggttttttttttagagcaaccgggcccacagggggggggaaattacaacgcactccctgaaatttgccaaaagggccccaaggattttaaaaggaacccaatcaggtccaagccactcccgatcgattccaaacttgccggggccggggacatcaccacttggtccgacgagtttttcaccggagcaagccgggaacattgggctagagtagcactgcctcccatattgcttcaaggcttggaggaagaggtttggcccccctttggccaaaggatttgggggcgcggggg

SEQ ID NO: 54513 - DNA, 426 bp, Triticum aestivum
  Clone ID: PAT_TA_54513
attactacaactcttatttttcttcacctttgccctcactgaaaactttaattatgttgccttttttttttacacacctccatggactaggggggggggtttccacatcccacggggttgagtccatttcatttctggaagaatcccgtcatcctgaggaccaggttcctgatttttcaaaagtccccccctttgaacgtcctccctttgcccgtgcacatggagtaggcccccctcgacctttcggcgagcctccccccccgttcaaccaaaacgtgcgggggcaccttcctttttgcgttggcggtgcatcggacatcgccctcgcttcaatctttgttgccccttcccctcccgtcggacgtcgaccaagaacgaaacccccctttccggggaggcacgaggaccggggcaaacaactcccgc

SEQ ID NO: 54514 - DNA, 478 bp, Triticum aestivum
  Clone ID: PAT_TA_54514
atgggcccaccaaaactaaaaaaaaaaagggggtcattcatccaacatccagagggggggtcataaaacagggcattcctgggttatttgccatcacatcaagcccaagggccaaattaacacgaaccagtggtcgtcactgggcgagggggccgtccgccttgggcaccttgacgctgagcaccgggtcgtcgccggcggggtcctgccccagctggaaaaagcaaatgtcccccacgcgggggccgttgtcgacgcggaaccggttccacccgtacctcagggccgggggggtccccgcgttgcccttgcgccgggtggtgggcttgggggaaacgggccactggggcccgcgccaccggaggaccaccctggccttttccgggaacccgggcgatggggtggaccccccaggccccgtcagggcctggttttctttggggcccagtggggcctggcccacggggccgggggaacc

SEQ ID NO: 54515 - DNA, 498 bp, Triticum aestivum
  Clone ID: PAT_TA_54515
ccatcagtaaccactgggcgttccagtatgtcctttgactacagaaacaatggtgcaacccatgcatgccatttcgcaccggtgtgcagtacagcaatatgccgcgtaccactataccaccaaactggtcacaagtacacagtgcccaggatatcgcggctttgccgcaccaccacgccacggcacgcctaccacattatttcctaagtacgctccgggtccaggccaggccagatggctactgcccgatgtcgcgcttgtgaaggatcttccctgcgagcacggccgcctcgatgacaccctttatgacgaacgccgtctcgccgacgctgcacttgttccccgggaacgtcggccccgccgggttcaccccgtcgaggcagcccagcaggttctcgttgcacctggtgttcaggtagtcattgttgttggcggcgacgcagtggtcgtggaccatgcagcaggcgtccagggcgttgcagggcttctcgcccgggc

SEQ ID NO: 54516 - DNA, 306 bp, Triticum aestivum
  Clone ID: PAT_TA_54516
gggggggtctaccaaaacaaaaccaggtttggtctcaaaggggcttacccaaatggtcaggggggacaaacaaaggtttaaaaaaaaaaaattatttccaaaaaaaaaggctgccaataaatttgattaagggacaaactgaaaactggggtttaaccaaactttaaaaaaaactaaagggaattcaccggggttaccaaattacaggggcatacatgaaccgaaacacccccggggtggttaaaaacattaaggggacacaaaaagggtgggaaaaccaaaacactactggtaccgggatgggtg

SEQ ID NO: 54517 - DNA, 665 bp, Triticum aestivum
  Clone ID: PAT_TA_54517
cccactcgtccgctttccccaacccaaaccaggagcgccctccctccctcccccagccgcccgccccctccccacccagggaaacccaccagccatgaagggggccaaatccaagggcgccgccaaggccgacaccaagttggcggtgaagagcaagggggcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaacaagggcgagagcgctgctgctgctgccccaaagaaggcggtggccaaggaggtggaggaggaagatgaggaggagtccgacaagtccaagtcggtgatcaatgacgacgacgatgatgagggtagcgatgaggacgaggacgacgacgagtgaagaaaacgcatgttgacaaggctgctggctccgggggacaaaggcggtagcggctgctgcgcgagaaccggcgtgagctgtgtgc

SEQ ID NO: 54518 - DNA, 626 bp, Triticum aestivum
  unsure (1)..(626): unsure at all n locations
  Clone ID: PAT_TA_54518
gaacagcaaacactcaataattctcttgattaaatgattaaattcagaaatcattccgccaaacacacacaacagcacatacaagtccgcacgtccaacatcaactaaaacaagcaaaaacagatagacaagcacatacaagtgtggttacaagcaaaaacaaatacacaagcaccaaaacatggtgcaacatcaactaaaattgtgctgcacatcgccatgcctcttctgctcttccgtcacaacagcagcagcctaaacaacattagatcctgatgatgatagtgtcgacgatgatcggatcgggttagcatcgttgaggaggtggatgatctacaaacatttgtcatccaaagtaaactcatgtgattattagtgttactattaagagcctgttcggactctctccccactccaactccacgctggagcggagcagcgtccagttaaaattttcagagtcgcccaagggccactccgcgcgctccactccgcgctgaaggagcggaggcttgccgaacagggcctaacttgaagaggacgacgatctggtcgttgcccacgtnccccgccagcggccgactctgcttctccacggtctggagggtcaggcagaaatcatactg

SEQ ID NO: 54519 - DNA, 447 bp, Triticum aestivum
  unsure (1)..(447): unsure at all n locations
  Clone ID: PAT_TA_54519
ccaattccaaagggttttttattggagatagatggttggttaacaaagtcctagcagcacctcgagctttcggggtgaaaaacacacaattctggatcaaacttgtttcacccaacagttttcttgctgcctttgtttgtgtttctcaaccacccagaggcccttgttcccaagtttggcaggtgggcaaccccgcacagctgcttacttgccnccaccgttttccttgacagggcagatctgtttttggcccttggggggcttgccggacgggatcaggggcttgccttgggggnttccggggttgatctgggcnggcgggacttggtggggggggagcgtggggggctgcttgggggggcgcctggtgggggggaagggtggcttgtgcttggtgggggggtgggggtggggggggggggtggtgggggggggggcgtggggggg

SEQ ID NO: 54520 - DNA, 345 bp, Triticum aestivum
  Clone ID: PAT_TA_54520
cggacgcgtgggcggacgcgtgggcggacgcgtgggcggacgcgtgggcggacgcgtgggcggacgcgtgggcgcaattcctctattaaaagacgtcaagatgttatcctaaatcgcaatgatgactctgtgtaccgaaccttggttgttacctcctgttttgcccatcttttttcccaggaactcatgcgtcgctgttgtctgaactgactctgtgtctatggttcaatttagcaacttgtctgccctgatggtagaacatggcaaatgtctgccctgaatttgagttgctgtaagctacttattgttgttgtcatgcgggaaaggttgaattgggattcattc

SEQ ID NO: 54521 - DNA, 677 bp, Triticum aestivum
  Clone ID: PAT_TA_54521
cccactcttccgcccacgcgtccgcccacgcgtccgcccacgcgtccgctcgggactgctcttatgcaggatcctactatgtccagtatgctggaaaatttgactagtccaacacataaggaggagcttgaagagcgcatgtctcggattaaggaagatccagccttgaagccaattcttgatgagttagagaatggtggtcctgctgcaatgataaagtactggaatgaccctgaaactcttcaaaagattggccaggcaatgggaactaccatgccgtttagcactgtctctactgctgaaccttctggtactgaagaaactgaagaagaaggtgaagatgaagacgaatccattgtccaccacactgccagtgttggtgacggtgagggtctgaagaaggctctagatggtggagcagacaaggatgaagaagactctgagggaagaagggccttgcactttgcatgtggatatggtgagttcaagtgtgcggaaatcctccttgaggcgggtgctgctgtagatgccatggataagaacaagaacaccccactgcattacgctgctggctatggccggaaagagtgtgtggatcttctgttgaagcacggtgctgctgtcactcttcaaacatggatgggaagacgcccatcgacgtcgccaaactcaacaac

SEQ ID NO: 54522 - DNA, 480 bp, Triticum aestivum
  Clone ID: PAT_TA_54522
gagctttttgacatgtctcactaactgagccctgcccgcacggccaaacatccgtaaaacaaacgggttaacgaagtcaaatcagaggggcttacttaacagggcgtcagaggagtctgctgaagaacagagctattcatctgctgtgctgacgccaaacttgtttacatttactgctgctgatgcatacggatcaatacatgagttctgatagcccgttgatcaacatgatgaaagctgcatgttgagatcttgctgctgctgctaactcgattgaacctgatgtacatgacacaaggcgagctcacatagatgtatgcgtgagagtcctatatgtgccagacaatcttcgcaggattacatgatgagaacttatcactcgatgctgctaatgccactgtttccaatgaggctttcttgcatcaattcctgtgcttatgagccatgcatcctttggatggattagagccataacccaca

SEQ ID NO: 54523 - DNA, 357 bp, Triticum aestivum
  unsure (1)..(357): unsure at all n locations
  Clone ID: PAT_TA_54523
cccgccgccggtcgccgcgccagggccgctgccgccnccgccaacccgccgcccccgcagcaancgccccccaaggcggngcgggncgnggngaagggccgcgngcagggcgncnncnnccgcgacgggacggnggagacggcccgcgcgcacgggcacgccggctgggggcgcaaccgccacgacggnaccgaggaggcccnccngaccggcgaacccgccaggggcgacgaganggacacccggcgcccccccgaagggccagccgccgccgccggcaccgcggagcngccgagcccagccgaaccgcacgacccnagcgagggcnaccaccgcaagccgaccgccggacgacgg

SEQ ID NO: 54524 - DNA, 589 bp, Triticum aestivum
  Clone ID: PAT_TA_54524
aaaatcaaaactgggtttaagcacttgagagtttgatatggcagtatagcacatgcaattacctagtgaatattaacaagtactgtacgtaggtagcatatctatctggtttcaagattacaacacggtttcatccaagtgtatgtatatgtccatgggtgtttataaaacatagctgaggaatcacaaacaaacttcagtgtgctgccaaagcaagaccggcattgtcgtccatgagccttttgacatactcttgccgcaccggatggtcctcctgaggccggttgtgcgccgtccacactggttctcccaagaagagcctcatgagctgtgcacgacgaggcatcaaaatatgttaagtttgataaggacccattttatatctgatgcaagataaaacttctacatatatacactatgtggtcctcaccaagtagcattacatgaagaactagttgtcaaacatcttgttgatcaacagatctattttgcgacttgcgcttcttttttggtggttctacagatgccctcaatatcttttagagcttaaatcatgtttgcattgagcttggttgaaaaacaggccctt

SEQ ID NO: 54525 - DNA, 456 bp, Triticum aestivum
  Clone ID: PAT_TA_54525
aagaaaaacatttctttcgttttcatgggtagacgagacccagtcacccaggcttgcagagaaacgttcgggcattactaacttaaaggaaataagtttaaaaaaactatccaaaattataggggggtactaggggtacccctgaaaccatcatggctagaagcctataatacaagggtcttctgcccgggaacaacgaggatcccggggtgccctccctcccccccaaaaagggggtggaccggtaccttctttcggggttcaaatcagcgggaacactgggggaccgggtgtgccaacacaaatattgaaaggggggccacacaatggggtagatgttgcatccaaatatacttgcgctggctgcactgccaacattcaaaataaaaggcccacccgggatctctctaatgacgctgattcctcaccaaaagcgcttaacatactcgctagggc

SEQ ID NO: 54526 - DNA, 264 bp, Triticum aestivum
  Clone ID: PAT_TA_54526
cccacgctgccgcccacgcgtccgcggacgcgtgggcggacgcgtgggctcacgcggagggagacccctccactccaatggcggcgatcaacgcgccgctgcatcctcccctcgccgtattcgccgccgcgccctgccacggagtgcgcttccgccgcgctccactcatccgcacggcggcctcctgcggatcgtcttcgccttcgttctcctcgtcctcctcttcctcctacggaggtggtgggggcggggccgggggagggg

SEQ ID NO: 54527 - DNA, 435 bp, Triticum aestivum
  Clone ID: PAT_TA_54527
atcgtctttcacaaattaaagagaaatggactacaagatatgatggcagccaagcgaaaggctagcgttgtcaggtccctgctcctcccacttgcctcagcgagtactccaagctctgtggcacgggcgagaagaaggacgccgcgtgcgccaccatggtcgacaaggcctgcgggggcaccgagaaggaggccagcagcgtcacccacatcgagcacttggttgccgagctctcctcggacggtcagaaggtgcttcaattcaatgtgctgtgcacgtatggcgggcaggatgccctgaaggaatgcgtggacaagcatggttgttgacccgagaacaggacggggtatctatatgactggccaatgcagaggcgggctggagcgagggatgctctaacgcctgagagtgtggggctgggcgtgcgtgggcggg

SEQ ID NO: 54528 - DNA, 792 bp, Triticum aestivum
  Clone ID: PAT_TA_54528
cccacgcgtccggtcggccacgcaaccgtctctccttctccacccgtccctttgagagtcgctccaggcacccgggagatgcttgtatatactggtttagttcaggtcgtcttgtggtttggcgctatgccgttggggtttctaccgccggtgcttgcgagcaactgccggtggttgccgttcttgtcttcttcttcgtctccatggtggaggaagggaggaggcgctggatctggcgaaatccctctcaataagctcgcgggtcactcagatctggagctcaagctccttcttccttacttctcctcgagctgccatggaggtggattggaagaagaggaagaaaggggatttggctgctctatcctctctgcgtgtccttggagcccaagttctgcagcaaatggttggggatcttggtgcagagagcaccaggagtttctcgccactgcgccgctgtatctgctggtcgaaaggcgaccactcggagttctggcgacgacgtccggctcctgtatttcctcctggccgccgagccatatgggaggcagtttatctggttctttgtcctggtatttccatggtctacctccggttgtttgccggcggtgttgtagccattccttcaccccaagtggtttcgtccccggtggtggtgggatcgggccaggatcgaagacggcgaagaggactcgattgcttttcatttttgttggctggggtcctatctgcaaatgtccggcttggggtgtattttttcttctgttgggccttctgtatatgttgcatgct

SEQ ID NO: 54529 - DNA, 739 bp, Triticum aestivum
  unsure (1)..(739): unsure at all n locations
  Clone ID: PAT_TA_54529
tcgacccaacgcgtccgatggttttccaaattgcaggagtttgttgtggcaggtgctacacttactgccgaaaatgatttggcaatcagcatttgcccagcgttagtgccttctgctgaaagctccaatgagtatatttgttattttaattcgcactggaatccaagtagagaagcgcctgcgacatctcgtgcagctgattctccattaacatcctccgagtttctcagtagatgttatcgagtcacctctgatggggacggggttctccacattgctgcatggcatggaaatgtgaaactagtggttgacatctggaagaaccatggagccctctcaagagtgctcttatcagcagtgaacaacagaggagatacaacactgcattatgcggcacacagagggcatgatgatatggtcaaacttttattcggtataatgagtgacatgggtattgccaagtttcagagggcccaaaatctcaaaggagacacgtgcttacacgaggcagtgcgccatggacatgcaaaggttgtagagatactgatttcagaggacgaaaatgttcagggcttagaaagcccctcactggtgcagatagtggacaatgatggtatatctccactctacttggctaccactttacgaaggattgatattgtccgggccctcacacaaaggccatacaagtatgtggcatcctttgcagggcctgcanggaaaacagcattgcatgctg

SEQ ID NO: 54530 - DNA, 775 bp, Triticum aestivum
  Clone ID: PAT_TA_54530
atgacccgatcgatcaccgatggcgttcggcgaggtcatgccctaggcctcatcctcggccgccctgacagcggatcgaatcagcgtagttggcgcatgggacggctccctggaggtgtacctgggcgcttggacggggctgatgctgcgcgtcgaggtggcgcggtgggccggggtcccggcgcatgccgtggcgagctaatctcaacctgacgctggtcaccagcgcggcatcatgccacctggccggcgctgcagcgacgtggttaagagggaggtggatgaggcagagtctgcgctcggcgtcgcggagatctggaggatacatgattgtgtggacacagcggcggcgtggccgggtggggcggcatgttgattttcttgggggtaggtttttgctgctggtgaccttttaagaaatttaagagatccagtgcacggaaagatgctattgagttgggagaccaggtggatttgaagctcattggtcaacgttcagtcaaatttcatattgaacagttagtctgcatatgagaacacacgtatgtcaatggataagcaattgacctctaatcaatcaagttttctgcaggttgttgggaatgttaattcaatcagtgctctacttgacaggcaaaagagagagtacaactttatcacgtgcgagtgtgatgaaatgatagccccaaatttcaatacagcgttgaggagaagtactacatcattgatgctattaaaccttcgatatgctggagggcgatgaggtggcatggag

SEQ ID NO: 54531 - DNA, 404 bp, Triticum aestivum
  Clone ID: PAT_TA_54531
aaagggaaacattttggggggcggatcccaaacagtccagtacaaagcaaaagcttccgggggggcttttttacaaggaaaagctctcctaaaggcccccaggcttatttttggggatacaaacggaaaacactttaacagactataggatcggcctgctactaaaaggcccggggacacacatttttacagatccacaagtcccgggcagggactccggcatttttaaaacttaagcagggcctccaacgcgcaaaaaacgtcatggggggaaactatacctataactggatggcccgggttaactatcggaaatcgggggatctttttcctgagcataaaagctggggaatgggccactgttttatcgcatgatagcgtgattgctggaaatgtcataacat

SEQ ID NO: 54532 - DNA, 380 bp, Triticum aestivum
  unsure (1)..(380): unsure at all n locations
  Clone ID: PAT_TA_54532
ggaccagattctatcatgtttgacatcttttccaatgtgtggcccaattcctacaaaccagacagatgtaaagttcctgttgaccaacacctggacgggggaacattttcttgggtaaaaaaaaactgggggcttcacccgccgcccggtttcccagtgggcattgacttacggggttcgttgccctctcccaccccaggaaatcgccggcgggttcgccaaacctgggggcggggtttctngagaggttgtgcttgggaaacagggcgtggccaagctgcttctgcggcggcggcccttaggcttgcgctgggccttgcggggcctggggggcccgggacctgggctggccggcggggcctttgccggggccctggggg

SEQ ID NO: 54533 - DNA, 557 bp, Triticum aestivum
  Clone ID: PAT_TA_54533
atcattttcgacaccaaagctcatcttcttctccttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggagtcgagcaagggtgcgtgtgcatgtgcgtgtggtttacttcgctcgctctccgcctatgctctgcccttggtgtccttgtgtgtatgtgtgtgcatgtgtccctgtaattgcttcatctatctccactatggatggagtgatgaatatgtaagaatgaatgatttacctaattaactactcct

SEQ ID NO: 54534 - DNA, 700 bp, Triticum aestivum
  unsure (1)..(700): unsure at all n locations
  Clone ID: PAT_TA_54534
ccaccatctcacgttctcacgcatgcgcgcaggtgcatgctggacgatgtgcccattgcacctagattcgccgcttgcaatttcatgggcatagatgatagatcgtcccagcaacgaccatcggctttgaggcaatagttcagtgatagcctggtaggtgaggacgcgcggtaagcacgcacgacagcggcaatggcgagcggcggcgtgctgccattggcatcgctgaaccacatcagcatcgtttgcagttcggtggaggagtcgctacgcttctacatgaatgtcctgggcttcatccccatccgccgccccggatctttcaacttcaacggcgcatggttatttaactatgggatcggcatccacctgttgcaatgtgaagagccccagagtttgcccgggaagacggagatcaaccccaaggataaccacatctcgttccagtgcgagagcatgatggcggtggagcggcggctcaaggagctgggcatcccgtacatccagcggtgcgtggaggagggcggcatctacgtggaccagatcttcttncacgaccctgacggcttcatgatcgagatctgcaactgcgacaacctcccggtcgtnccgcttgccgaccataccttcnaccatggccgcctgcaagagggtcgtcgccgtcaagcaacagcagaagccggtggcggtacaagctcct

SEQ ID NO: 54535 - DNA, 701 bp, Triticum aestivum
  unsure (1)..(701): unsure at all n locations
  Clone ID: PAT_TA_54535
cccactcttccgcggagagcctgatgttcctggcgcacttcgtgggcgacgtgcaccagccgctgcacgtcggctacgaggaggacgagggcggcaacaccatcatggtgcgctggtaccgcaggaaggccaacctccaccacgtgtgggacgttagcatcatcgacacggtgatgaaggacttctacaacaagagcctggacaccatggtgggcgccctccagacgaacctcacggaaggatggtccgacgatgtcggccactgggagaactgcgccaacaaaagggcgacctgcgcaaatgactacgcgatcgagagcatacacttgtcctgcaactacgcctacaaggatgtggtgcagaacattaccctcggagatgattattacttcacccgctacccggtcgtggagaagagactagcacaggccggcgtcagactcgcgctgatactcaaccgtatatttgacaagaagaaagcagataccatgccgttatacgtacagtaaaagagctatactttgtacatgaagtgtatacatacggggctgcaaggtattgtagctgccgttgccacgccagtttctcataaattaccgcttcaataagtttgccattctgtaataagagtcacaaagccttggcacagcactcagaaattcaattgttgtgaagttgtaatataattcaaccgtcttnna

SEQ ID NO: 54536 - DNA, 503 bp, Triticum aestivum
  Clone ID: PAT_TA_54536
agaacaaaccatttccccaaagatccttggaatttacaccggggtggtccaatttgaaccacccattttgggggcagttcaccggagttgccttggtttttgggtacaacacgcagttagggagcgccaacgccttacttggcggggacaaagtttggggcaaacccccatgcgttgttgttgacagggtcggagagggggtcaacgaggtttttgagggggcccttgccggggacgatggcctgccccaaaaacccaaacatagaaaacatggggaggggaccggtcttgacttccttcaccttgagctccgcgaatgcctttggatcgtcagccaagcccagggggtcgaagctgcccccggggtagagggggtcgactatttcaccgagggggccgccagcaatgggggaccccttaacagggcccatgagcacgacttggcatgcccaaatagcaaggatgctttgtgcgtgcacgaggctggggttgcccaggtagtc

SEQ ID NO: 54537 - DNA, 320 bp, Triticum aestivum
  Clone ID: PAT_TA_54537
aattaacgagtgcagggccaaaatttatagcgaggatcatggaacattacatttgcggggcgggatcgctgcctgccgtttacatgtatgctaacactaggtgcgctaaggtacgtaactggctagcaaacaaggctaatgggacctgttcgctaaaacccaggccagagctggatctggtgacgacagattgatgcgtgcgacgtgcgactactggagctcacaagtacatgctacgtgaagaaacgaagacgagctcacatagacgtgatccatgcggctctgcgtttgtcatcagcgtgaacatgctgggagctgcg

SEQ ID NO: 54538 - DNA, 726 bp, Triticum aestivum
  Clone ID: PAT_TA_54538
ttcttcttctgactaggtaacgagcacaggtgaaagctgtcatgataatgatatatgttagtgcttcctgctcatcattcttgtaactttctaccttgctcagattatatctggaattctagacgaataatctgtccacatttctaatgtggtgtgcacccatcagaagcagttagatccgttttcgcacaacccccactcacacaagagccattcaactagggcagcttaagtagggaattggcttcatacacatgggtgcagttgcgttctatactggacaaaaaatcaaacttgtaccacatgtgcatttgcaaaaattcgtgcaaaaatataactacatgtctactgtcctaataagaccagatgatttcaaacctagcagttataggtgtacacatttgtggtacaatttacaaatgatcatactttttcataatgtttttgcaagtgtacatgtcatagcatgttgtacatctatgtttttctccacagatttttgaaatgtaaaaattgcagttttgaaatgatgcagatgcacccaggtgtggaatccgcattcaacttcagtgttttacccggttaaaaaacttcagtgctgattgctgctttagctaacaactgtctagtaattggtcaaaccttgatggtaccactaatttagaacaacatgaaggaattccaattgtctgttcacttttcttgcctctccattctcaatgtatg

SEQ ID NO: 54539 - DNA, 596 bp, Triticum aestivum
  unsure (1)..(596): unsure at all n locations
  Clone ID: PAT_TA_54539
gaaacgacaggccatcacaggaaactaagaacaccaccacaattttagcaagtagcagcagccaacatcaacaatctgagtttcagggttctagttccttcagcatcagtcatttaaacgacatctcaaaaactctcagcactacacaaaactcttttggctcgagagaagagcagccaagcacaacccagcagtaaaaacatcttgaaatctgacttgggaagctcaaactccctgggttggctattcttaggagcttagctagactaaaagccacggtaaaaaaattcagataacatataaacaccgctgaccacattgatgtgatgtgacaaagtgacaactaactcctgcagcagccctttcttcacctgttgaaccatttcagcacattaaaatatcgaaccaggcagtcatcctaacatttcagcttctttacatccactagtaatggttgtgcctggtgggaagaaacccgtgaaaggataacaacactccctatactccctggaacgggttccattaaatttcctgaattgcattgacttgngttggaccatatagacactttggtgtgtttgtgaaaagattacatg

SEQ ID NO: 54540 - DNA, 321 bp, Triticum aestivum
  Clone ID: PAT_TA_54540
caaagcaagcattgctgctttccccacccttgttcaggcggggccaaatacccaacaaatccaacccagttggggttaacttagggggttccaaaatcacggggggcatccaccctcccaaacttttttttttttaaccccttggggaagagtcccccgcctccccaaaagaaatcagatgggcaaatttctcctttctttgcatttgtccagttcagtcgtttttttggcccaaaccattgtcctttttgctgggcttccaggggaggaatgacctggggacctgctgctcccgccgctgcgctttacccccccctcccc

SEQ ID NO: 54541 - DNA, 495 bp, Triticum aestivum
  unsure (1)..(495): unsure at all n locations
  Clone ID: PAT_TA_54541
atccagggccgggacgggcgccccttttttctggcaggcccccggggggggcgattaacaggggggggggggggatttacacaggcccaagcccattaaggggctagaggggttggccagggggggagcatgcaaggggatgcatgggggggggccggggctcaggcccagttcttgggggagctgggggaggggtccggggcgttcaccacggtgtagtcccggtcccagagcatgacgccgncgtagtgggncgccttntgcccgatggggcgggngatctgncagagcgcttgggggtgcggntngtgtgttttcgttggtgggggggcggggggtgcggggggggggggcgtgggggggcgggggggtgggggggggggggggggggggggggggggggggtggtgggggggggggggggggtggtggggggggggggggggtggcggtgggtggggtggggggggggggggggggggggggggggggggg

SEQ ID NO: 54542 - DNA, 732 bp, Triticum aestivum
  unsure (1)..(732): unsure at all n locations
  Clone ID: PAT_TA_54542
attcgccctttctctctggatcccctcttctctcccatgatcctctctctctctctcttccccaactgccaccgccaccatcgtcgcctggttccggccagctccgacgaagtccgtcaccatccagcacatccacgaggtcatctcgtgaagctgctccttctccaccgtgttgatccatcgcgccgctcctctacgcgcggcccgggctaaccctagcaccgcggtcatcggtgcactacacggcatcgccatggacgccggtgttgcgcctgcggctccgatcggtcctccccgacgcggcctcggctaaccctagcaccgcggtcatcggtgcactacacggcgtcaccatggacgctggcgctgcgcctgcggctccgatcagtcctcctcgaccccgcctaagtccttgcgcactacatcgcctcctggtcgttgttccaggcgcctccatcgactggaggagcgatgggcccttgtcctcgtgccagtgcgcgtccgtgaaggaaatgaaccgagatgtgccgcctcagatccactgtgtgaagggggacggatcacaaagggagaggtgcagtcctccagagctgttggatcccaaaattggaagagtcacttggttgtttgatgccgtcgtgctcgtcggcgggatggtgcaacacgcaactncgatgcggttcctcgccggttggacggtgttcangcgcacccccgtgctcactgagtact

SEQ ID NO: 54543 - DNA, 314 bp, Triticum aestivum
  Clone ID: PAT_TA_54543
aaacattcccatcaagggggggggggacaaaaacccgggggggggataaaaaattgggggggggggtaggccggggctttatttttaaaaggcccccccctggccctaggggggggggggcttacatccattggcccggggtttcccatccgggggggccgggaggtaaacccggaaaaggggagctgcccccaatggggacctaacgggggggggtttggggtttcttcaactgggcttttggggcttgcccgtttcccgcgccccggggggcctgggggcgttgagggtgcccccctgccccgggggcttgt

SEQ ID NO: 54544 - DNA, 387 bp, Triticum aestivum
  Clone ID: PAT_TA_54544
gggcaagggatgggttccatttttttagccccaaaagggggggggcctttaaaaaaaaaaaaaaaataaattcccctaaaaaagggcccgggggcgaatcaaatttaaaatttaaagggaaaaaaaaaattggaaaaaaagggcccccccccccctgaaaacgaaaaatatttaaccggggaaaacaattagaccactggctttgcttagggggggtcggcaactgggggaaaaggggggggtaacccttctggggggggtcctgatcccccccttggggcccggggtgggggaaatgtggcccattttctccctgggcggggggaaggggtggaaaaaaaatttttggttgggggggttttgtttggcgggttcccgggggggtgg

SEQ ID NO: 54545 - DNA, 309 bp, Triticum aestivum
  unsure (1)..(309): unsure at all n locations
  Clone ID: PAT_TA_54545
gggggggggggggggggngnnnnnggnnnngnggggcggaaaagggcanaancanccgggannagcccaacggggcaaaanncaagggccaacaggccccaaacanaacnaaggacaacaggaaccgggacaaaancgcccgaaccaaaagcaaacccggggggggggcaaggcanngannnggggannannagcggagaagccggaggangggggncaagcnangccacacancannncaccccacggacaaaggaacggaggcagcggcagcccnnagaanccanancaagcgggacgaaacgggga

SEQ ID NO: 54546 - DNA, 626 bp, Triticum aestivum
  Clone ID: PAT_TA_54546
ggataactgtggaggatcgatatattacggctgagtgtgtatacagttactctacagcactagtttgatgctaactagctcatgggagccctgcttggaacgatgcgtagccagtcacttgggatgaaatgatgcaatgattacgattgacggtgtcaagactaactccattctactctgagacactgtgccatgcacacggttagagaaattcgaatgaccctatggccagtctctgagggctagtgctaaggaatactggaccctcatgagagactgcactttgtaggaagaagtcagatgaaccaagattaaagctctgacccagtcctggaaaatacaattgaccaacataaaaccatatacgaaatgctataaaaaaaaatgatgctcacctggttaactcgaccatgaggccatgtgatggactaggttgctctagaacatgcacacttatgaccaataatacatggctgatcggcctcgatgtttcaaacgatgatccatacatgaaaacacacctggctaagcagaagaatgacgttcatgctcctaatctcttatgaacgacgaacctgtcgcccctaaggacatgtactactgctcttgctaaacggctcacaaac

SEQ ID NO: 54547 - DNA, 724 bp, Triticum aestivum
  unsure (1)..(724): unsure at all n locations
  Clone ID: PAT_TA_54547
ccttaatatggagaagcattctgacgaagaaaatataagcggaggtggtaaaatagctggcttagaaccaatgaacttcattgcgtcagctacaccacacctgggctcaaggtggaataaacaactgcccttcctttttggtgttccgcttttggaacaaaccgctgcagaaactgcgcatcttatagttgggagaacgggtaaacacttgttcctctcggacagggacgatgggaagcctccacttcttgtgcggatggttgaagactgcgatgatgggaaattcatgtcagctttgcgctcttttaagcgccgtgttgcgtatgcaaatataacatatgaccttggttggagcacatcatcgattcggcgtcaacatgagttaccgaaactcgagttagaagcaaataatgaaaagtacccgcatgttatccatgttgatactgctaactcagagggctctcagcaagaggattctgtagacacttcactcacggatagccttgaagaggagatgatccgtggccttatacaggtgacctgngaacgggtcgatgtatgctttcatgagagccggctaaaatacaatgcgcattacaatatccaggtcaggaccccaatgaacctggagggagaagatgtcatctaccatatgatagacaattntctagtctaagctgtggccagtctcacctattctttccaattgattctactggaaaac

SEQ ID NO: 54548 - DNA, 286 bp, Triticum aestivum
  unsure (1)..(286): unsure at all n locations
  Clone ID: PAT_TA_54548
attggaaacggacgcctttccgggggcgtcccaaatccttgtttaaatagggctttgcccagaatcaataaacacaagttttcttacaaatttttacggggtttcagccctgctttccggggagagcgattccgccgggaaacccggggcccgaaccggccgagagagatggtttgatggcngggttgaacctgcccaacttggcctttgcgcttgtttgtgtggtccggcggggtctccgttgttctgtgtgtcggctgtgagctggtgtgtgtccccgttgggg

SEQ ID NO: 54549 - DNA, 403 bp, Triticum aestivum
  unsure (1)..(403): unsure at all n locations
  Clone ID: PAT_TA_54549
acggaaccgaccggaggggggggggtttttttggtggaaacctcaaggggggggggaaacggggagagtttggggtttacaaacattaaaataggctgggccaaaaatactttttaggggggggtggtttggcaaatttaagggccaaaggggaaacctcaggggggggggtgggtaaaattttggtggggaactggggggcgggggccttgagcttgtggggggtggggggaggcanttgggccctcgggagcttggggatgggggggtttttgtccggggacccccccttcaggaacgcgcccacgcatttgggggctttaacccagttccaccccaatttgggtttggccgggccggggtgtggtttgccgaacggggggggggtgcccagtttggcccc

SEQ ID NO: 54550 - DNA, 307 bp, Triticum aestivum
  Clone ID: PAT_TA_54550
atccctccctcaggggtgtaaacctccagagggtgcatgattcaaatgtttgggggtgaaccatgaactaaatgccgtcctccgactgccgccggcggggggggatcaacaatgcctgccgatctacaaaattggctcacacgagtgggggggtccaattttgcgattcgggccatcttttctgggccggggggggagaagaaggccgtgaaacaaatcttgcttttgggctttaggcgtttgccgccctgggtgatgctctggggcgtgctcgctttggtgcgcggtcgttgggcgtggcctgggg

SEQ ID NO: 54551 - DNA, 723 bp, Triticum aestivum
  Clone ID: PAT_TA_54551
ataacggtaacattatatacgccatgaaacttcgtttattgctgacctaaacatggctagtttacctttttagggaatatgcttctgtttcgaccaaaatccttttgcatctttgcattaccagaggggtatacttgattcaagatcactctagcaaacgttgttgattcctaccgctaccaaatttcatatactgaataaacagcttgtagatacatggagccgagatacaaaaataacatcctcaaccctagaatgccactcagaatataacttgaccatcctttaattgctatctgtgaagtccgcgtcgataacatctccatcatttggtccctttcctgagcttgttgatccagcaccaggctcagtttcagcatcagtagagccagcaccaccggcactagtttggttgtacatagcctgtccgatctgcattacctcctggttcaaagcctccatggcagttttcatgctctgtgtcgatccaccagcaatggcatctttcagttcctggagctttacatcaaccttctctttcacaggagcagggaccttgtccccaagctccttcagttgcttctccgtctggtacaccacagagtctgcttggttcttggtgtcaatagcatctcttttctctttgtcctcctgggcaaacttgtcggcttcttctaccattctctcgacctcgtcctttggtagtgtactagcaccagtgat

SEQ ID NO: 54552 - DNA, 726 bp, Triticum aestivum
  unsure (1)..(726): unsure at all n locations
  Clone ID: PAT_TA_54552
cccacgcgtccgatatgctgctggtcttcatttacttgcatgcttggctgaatttagctgtgtgctagtgcatgctgtcagactcaagtgctgaatgacattatgcgttacattgtttgccaattgattgattgcacgcctcttggaatctttttgagtgctactgctgtcataaagcatatatacctgctctacttctgagataaacttcgatattgatctgttcctgatttgggttaatgcggcttctccctgtcttgctctgtcaataacaatgcataaggcggccacaactcattcagctgagatccagcaggtcaaagaggagctctaccacatgatgtccgaaaacagggacaagataggaaaccacaagggcctgatcaagcacctctcatcccatgtggagcctaaacccgaggaccctgtctggcgcttctatcgcagggcaaagtggtaccatttagtcatgatgtatagcccaacattcctttatggctacatgtctatgtgtgatgtgcctgatggcaagaaggagatgacgccagctgacaaggatgattttaacaagaggatggccgcgttgatgcccaatgtacaactttgaggacagctagttgcatagcgactaaccccaacactctatgtagatgccattgctctgattggacactgcggctttgttagactaaattatatgttaagactgangtatcagtgagaatg

SEQ ID NO: 54553 - DNA, 219 bp, Triticum aestivum
  unsure (1)..(219): unsure at all n locations
  Clone ID: PAT_TA_54553
gccgcctctcgctcggatccttcgacgacctcgacttcgacgccgccacgccgcacagcgtcgacgccacgccggagacctcgcgcggcgggcccctggtgagcccgttcgacgaccacgcgttcgaccccgtgcgccccgaggccgtcgacgacctgcgggccatcgccgaccggatggcgcgtgcggngtacgcgcgcgagctggccgacgcctact

SEQ ID NO: 54554 - DNA, 383 bp, Triticum aestivum
  Clone ID: PAT_TA_54554
ggcccttaaggttggctttcttgcctcactaaatttgccggggaaaacattcgaagttgtcatgtgtttgtggcccacatggggcccttatcttggttctgaattatttccctgttgggggtgatgcatactgggaaatttccagacctttcaagtcaaagggaggggggaacggagaaagggtccccaggcatttgtgggaacattcttgggggttcttttttttgagtgggcgtgggagaatcattggcggaagctggaatgtgggccggcgccgtggggggggattgctaggtgcgcacacgggcacacattggtgcctgggtggtgtgctgtggcccggtcaaccggcggtccgtttgcgcgcgggatgagggtggggg

SEQ ID NO: 54555 - DNA, 762 bp, Triticum aestivum
  unsure (1)..(762): unsure at all n locations
  Clone ID: PAT_TA_54555
gagctccgccgatcttgcagtggcagcaatggccgctactccgcctccccttcttcctctagatccgcggctgcagcccatggcggaagggtcagcggcgagggtggagcaccaccacccgcgccggcgccagcgacgagccatccttccggatggaggaccttcccgcgacattgccttcagacacttgtaatagcaactgggagtacatgcaagatcgttacaaaaagacgagattctacctgttataatgtcactgctcttaaagaggctgtcaggaccagcattgtttcaacaagttgcaaaatgctctggacattccactgtaatctgtgtttttatgatcccaatgaactggatgatgacccttcaatgctccctttggaatctgatgaggaggccaccgttgatgaatatgtcaaaacatcacaagctaagatgaaaacgaaatgagataagttcatcgaggctgtgaattgtgttattcaacggcatagcggggtaggagtcagtaagttcagcatctggtgtggcctgcacaaggaggaatttgaacatcttgacagatggattagctttgccgctntgtccaaggagaagattgtagattttgacctgaagaaaattgattcgccatccaaagaagtccaccagttccctcttgaggccttagttgttcaaggcagctcttgtgtgcagtccttgtatctcgctgatgcttctataaagccacacnccagcatatgtggctttcaactactc

SEQ ID NO: 54556 - DNA, 640 bp, Triticum aestivum
  Clone ID: PAT_TA_54556
ccccgcgtccggcaagcgcagacagacagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccagtttgttgacaagtacggcgccaacgtcgacggctacagcccaatctacacgccggaggaatggtctgaatctggtgaccgctacgccggcggaacgaccgggcttcttatctgggccgtcaccctcgccggcctcctcggcggcggcgtcctcctcgtctacaacaccagcgctctcgccggctaagagagcatctacgtgtaacacagggccgggtctctgcttgcatgcacgtctctgtaatctacgtagctacctcctgtgaatgtatgtcatcaacgatgcaaagtaattgattcgaacagatggtttatgtatgtacgtaacgcagttaccatatactcctacttcctactttggaaactgtaaaagggtggattcttggagccca

SEQ ID NO: 54557 - DNA, 403 bp, Triticum aestivum
  Clone ID: PAT_TA_54557
cccacgtcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcgcgttttaggggaccaaagtttacgtccccgggctggcaacgtaaaagtttttttatggggcccccaaaataaaattaaggggccggggtttaaaaacgtggggaggggaaaaacccgggggttcccaaattaaatggcttggaaaaaaatccccttttcgccagtgggggtaatagcaaaaaggcccgaaccgatggcccttccaaaaagttgcccaccctgaaggggaaagggaaccccccctgaacgggccctta

SEQ ID NO: 54558 - DNA, 813 bp, Triticum aestivum
  unsure (1)..(813): unsure at all n locations
  Clone ID: PAT_TA_54558
aaccgcattacgccagatgccgccccgtctccttgatgctagccccaccgccgagcgccgcctcctccatgccggcgcctcgccatggcgtcgcgcctagactcctacgctgcccgaaagggtcatctacagcagccccggcgcccatgttcgaccttcgccacctcgaccttgccatggcgcccgcgagcccctgctcctgtgagccctagctccgccgccaccggaggtccacccgtcgcccgaccttctccgtgtcggctcccctctgcctcctcgctgccatgtcgtgggagcactggccctacattcttggctgccctgccgatgctccttcggccacgctcaaccccgccggagctccgtcacctcaagccccaccaggaccccgcgagatccaacaagtccggcgccttcccaagcccagcggccgtccttctccttcctccgcgccgccccacttcctccactcccagcctccctgcccttgctggactctcgcatccaagctatgctgtcgccgctgctgcacctccggcctccccgtcctctgcttcgtctctgcaccaccggccttcaacatcgacgcccgccccggccatcttctcccgttgcctctgcaaccccttcacggccaacctccacgagagctccacccnctgctgacccgtcgtccttgttgcccctcttatggctgccaagacnntcgcactagggacgccaagaacgccttncgtgggttcgggcagtacctacaccnggcagactacacggatgttcattccactacagcacttaaacgtcaaggtcgac

SEQ ID NO: 54559 - DNA, 99 bp, Triticum aestivum
  Clone ID: PAT_TA_54559
atctatcgtgcccacctggtctcgcttacgtagcttgacgctctgggagcgccgactgagcacagtcgaggggcaggcctctgcgaagcagatcgctcg

SEQ ID NO: 54560 - DNA, 568 bp, Triticum aestivum
  Clone ID: PAT_TA_54560
ggttagctaacattgcccccaattccgtggatgctcgtccgccggtggccggtggttctaatccgagtcgattcccaattccaaccgatgttggaagacccagcagcttcatgacagcgcgggcagacatggtgcccgcactacctgcgccggcagcggtggcagatcctgccaccttatgccgcatatgtctcccggcccggaatgccttccgatactctccctgtcaaaagacttcgtaggtttgcagccacaaacactggaggatgtggccgtactgagcccaaagctgtgatgaccaaagcaaggccggccttgacgccttctttctcgggaaggccttggcggaagcactaactgagagggccaagatggctgtggtcgaggtatctaatgcatctttgcacaaggcaagcagagcagcagaagcaggttcaggaatttcaagacgaagtacttcagagagcccaaaaggctaacgaaagagctgctgaggatgtcattcatgataagggaccagagactctcataggaccttcaacatcaatcaggactcctgcacctatgt

SEQ ID NO: 54561 - DNA, 541 bp, Triticum aestivum
  Clone ID: PAT_TA_54561
cccacgcgtccgcggacgcgtggggttgtatggctattttaatacaaaaggtatattttgtcctaagacacttgtatatatagtcactccatgttaatttgctatatcgatcatattaattttgaccttactgagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaggggggggccgttttttggggccccattttttctcccgggggtgggcggggttaatttttttttttggggcccccaattttaattcccggggccggtttttaaaaacgcggggtggggaaaacccgggggttcccccatttttttcccttgggagcacttccccttttcccagggggggtttttccgaaaggggccccccccgtgcccctttccccccttgggcccccccttttggggattgggacccccccctttcccggccttttaacgcgggggg

SEQ ID NO: 54562 - DNA, 760 bp, Triticum aestivum
  unsure (1)..(760): unsure at all n locations
  Clone ID: PAT_TA_54562
cccacgcgtccgcgcccaccacatcaacaagcacaacttccgcgtccccttcgtgtgcggctgccgcgacctgggcgaggcgctccgccgcatccgcgagggcgccgccatgatccgcaccaagggggaggccggcaccggcaacgtggtggaggccgtccgccacgtccgctccgtgatgggcgccgtccgggccctgcgcaacatggacgaggacgaggtcttcagctacgcgaagcagatcgccgcgccgtacgacctggtgatgcagaccaagcagctgggccgcctcccggtcgtgcagttcgccgccggcggcgtggccacccccgcggacgccgccctgatgatgcagctcgggtgcgacggggtgttcgtcggctccggcatcttcaagagcggggacccggcgcgtcgcgcccgcgccatcgtgcaggccgtgacgcactacagcgacccggagatcctggccaacgtcagcgccgggctcggggaggccatggttgggatcaacctgtccgaccccaacgtggagcgcttcgccgcccgatcccagtagcttcataccttgttgccaagttggtgccatggatcgtcgtcgtaataactcgaatctggcttgcatcatgtgtcgttttgctcctctactctaggtgcatcgtgtattatccagcagtactatcttggngtgttggttgccagtcgagatcaggtgagggattntgctcttcagtgctatgctcgnagttgatgttggttg

SEQ ID NO: 54563 - DNA, 684 bp, Triticum aestivum
  Clone ID: PAT_TA_54563
atgaccgtcgcactgcaccgccgtaccgtaagcccttggatcccctctagaagccggcaccgcccctcttttttcttcttttcttttcttttcttttctttttcttttctttctttttcttttttttttctttttttttctttttttttttttttttttttttttttttttttcttttttttttttttttttttaaaaccaaaggggaacctttttccacaagcaacccccccggggactttttaacccccaaaatcttttcggccaaattttccccaagtcccgcgggcccttttattcataattagccccccgccaaggggaccaaaccctaaaacctccttcccgggggggtccccccccttttaaataaccccccccccaaaaggggaaaaacccccggccgaagaggtttttttcccttttttggtccccggcaaacagggcagggttttccccccccggggctaaacccccacccctgttcaacttaaaagctcttcctttcttttccccggatcaaaaaattttcttatcctccggcgcccgagttccccctttgccccccctggtcctgaagttttcttgaaaaaaccccttgccccgcccctccttaaaaaaccccctcccaaggaaaccttggaagaattcccccgcgatcatttccccccctgaccccccccc

SEQ ID NO: 54564 - DNA, 755 bp, Triticum aestivum
  unsure (1)..(755): unsure at all n locations
  Clone ID: PAT_TA_54564
gtcggtggcgccgcaaaccctctcgcctcgaagggtttcttcctccgcctcgccgtccgcgcgctgttccccactaccgtccgcgcgaagcgagacaaggcggcggcgaagagagccacccctcctcagaggaaacagagcgacgcacagggaagaggaggaaacagcggtggtggcggcggcggcggcggcggtgcagatggcgggggtggaggtagagggaagaagcggaagaacaagggaggtgccttcatctacggaaactacaggaactactacggctaccgaattgatcgtaacggcggtgaagatccccgccttgagatattcaagaaggagtggtttgcaggcaaggattgtctcgatattggatgcaaccaaggtttggtcacaatcggtatagcgatgaagtttgaatgtcaaagcatccttggagttgacattgataaaggtttgattgaccttgctaactggaatttaagaaggatatctcgaacaggcaacatggctccagaaagtgccaaggttcataactcgtcagactccacaactaagagctgtcctgaagaagtggtatctgaaatgccaaatggaaatatttctaagtacgaacaacctgatctttttgaaatcgtctcttttcggtctgaaaattttgtacagagcanacacaaatatgcagaacagtatgacaccatcatgtgtttgagcgtgacaaaatggatccacctgaactggggtgatgatggcataat

SEQ ID NO: 54565 - DNA, 499 bp, Triticum aestivum
  Clone ID: PAT_TA_54565
aacaaaaattaaaatcaaaaacatgtttaaaaaaaaaggggggaagggaaataaaattttattttccataggagcaactgaaaccaaccagaaacatccaaaaacttgggtaacatgggaaggaaaaaagttccagggaaaaatactaaaaaccggccccattgagggcgaggggcccttctttcccggggcccccgtggaaaaaaaacaggtccacccccatttgggggggtttttttccccccccaaaaaaattttgggccgggtaaaaaacctcccggaggaattagggggcccccagtccaatttccccaaatgggaaaaagtcccctcccaaattggaaccctgccacgggaaaaccaaaaggggagggcttgggttgaatttgaaaaaaagggacatgcttataacctttttcaaaggaaagcaatggaaaaaaatataattgctgggggttaggaaaataaaaaggtttcgggggaagttttaaaagctaaa

SEQ ID NO: 54566 - DNA, 761 bp, Triticum aestivum
  Clone ID: PAT_TA_54566
ccattctccagggccaccttcatgctccctgctctctccagcgtccgactccggcctccaaatgcagtcgctaagtggtcactcgaggatgggtcaaaagttgctgacccttacaccacatggatgcatatcaatacggaaaagctgcacataagtaagctactcctgtgctcgccaaaccttgttgctgcactggttggcattggacacaccagccagattctaatgtgccagccaggggcctcgtcgtggtcagtgcgtgcttatgatcagtgtaaggggttcgaagacatggcattctaccagggaaagctctacgccattgccaatgacgagaacctccttgtggtgaacatcagccaggaccatagcaccggcgatccacaggtttctcggattggacaaatcatcaagggtgagccatggtatccagctgtgtttgaggacgacactatgtgctgcaagaagctttacctggttgaatcgcatggggtgttgctgatggcacgaaggacaatcatgtgccaggtacctggacctggagcggtgcctattgaagttgctggactgactgggtttgaggtttacaaggccgactttgagcattcacggtgggtcaaggtatcgaccgtgggggatgaccaactgctgtttctagggcgaaggtgctccagggccatgtctgtgtctcagtacaggttgcctggtgattatatcctcttcttggatgatgatgaggagaatcgtatggactactgcta

SEQ ID NO: 54567 - DNA, 590 bp, Triticum aestivum
  Clone ID: PAT_TA_54567
aacttcagacaagcgctgattaacaaacaacactaaacagagtaacaaagttcagatagatagatagtagcaatactactaacgcatttcacgtcttgtaggtaaaccagtgaacactataccaaccaccatacatatataccaccgtcagatatatagataacctatgagcaggttgcaaaataaccccggaacaacaacatttatagcatggccagataacctgggagcagcttgcatatatatagcattacgactcattctcatcggtcccgagggaagagccatgcagccagacgcatctcatcgcaaagcttccaggagatatagggatgagggaaaaggacaccgtcggatcccattttataggcgccgaaagaagtgttctccctgtcgtagcagtagtccatacgattctcctcatcatcatccaagaagaggatataatcaccaggcaacctgtactgagacacagacatggccctggagcaccttcgccctagaacagcagttggtcatcccccacggtcgataccttgacccaccgtgaatgctcaaagtcggccttgtaaaccctcaacccagtcagt

SEQ ID NO: 54568 - DNA, 211 bp, Triticum aestivum
  Clone ID: PAT_TA_54568
ccccgcgtccgcccacgcgtccgcccacgcgtccgcccacgcgtccgcttcgttgcccccctgccgcttcctaaagctcgatgattatctgacttgtctagttcgctatttcccctgtagttccaagtgaatcatgaaacaaagctattcgcatctggagtttggacatcgagcttgtctttgtgcaaatacagtgtttgtgattttgtct

SEQ ID NO: 54569 - DNA, 769 bp, Triticum aestivum
  Clone ID: PAT_TA_54569
ctttcgttggtctcatatgaaatccatcgtcaagcagtatgtgcagcattgcactgtttgtcagcaagctaaacccaagcgagttccgtatcctggccttttgcaacccttaccaataccaagtctatcatgggaaatggtcataatggattttatagaaggcttgccatcttcagggcgtttcaattgcatcctagtggtcattgataagctatcaaaatatggtcacttcatacccttagtgcaggtcgtggcagaggcttttctgaattttgtctacaagctgcatggtatgcccttgtccattgtctctgaccgtgaccgcattttcaccagtttgttttggaaagagctgttccaacgaacacaagggacacaactgcgaatgagctcagcccgccacccacaatcagatggtcaaaccgaacgtgtaaatcagcaagtggagtgctaccttaggtgctttgtcagtgcacatccctccaaatgggcaaaatggctacctttgtgtgaatactggtataatacaaactggcattcagctacatcgaagactccgtttgagatcatctacgggcatctgcctcgtcactttgggataacccctgactgcacagtggcttctcctgatttagctctttggcttgaccaacggcaagttatttttgaatcagtgaaacagcaattgcttcgcactcaacaacgcatgaaggctcaagctgataaacatagaacagagagaacattttgagtgggtgaccaagttttt

SEQ ID NO: 54570 - DNA, 481 bp, Triticum aestivum
  Clone ID: PAT_TA_54570
agggcttttgcctacccgcaatagagagcacaaggtcggagcgcgttgaactaatgaaacgagtaggttcttgccaagttcgccggtgccaccctggaaacggaacgactacaatcctgtggggtcgctggaggatggcggccgtgttaccagctctcgcccatctacttctgcaccggatagcacaagagccccgaccacttcggcagcaacaccttcggccacgcgccaggtatgcactacggtagagtggacgctcttgcaccctgtgctgtttgctagaatgcgggcaggacgatcaaccccaaggtgttcaacgagggcgaccatgaaggcagtcatgcatgtggcttgagaccttcgagggggaggccctacaatgcaccaccgctctgacatccattctctatgagtgccttatccattctatgctaggaggagccactgaccatgaagaatctacataaccttgttacgatca

SEQ ID NO: 54571 - DNA, 522 bp, Triticum aestivum
  Clone ID: PAT_TA_54571
aacagaccatccattggaattgcatgaaaagacaataggcccaaaggggggggttttttggttcaacattcatgcaaattacacggggggacaattaaaagcggagcacacaaactacgatttttatagaggatacaaaagaggggcacttgaaaaacatgcataccaaaggggcatttccgctggtttgacccaaggatggcaatgagctcgtacaaaaaaaagggggatgtcgttgctatatgcccccatccatcagttgccattagggcccgcaaacccgagggaaataggacttggataaacttaaagcacgccgccttcaatccatggcaggggggctgctcggctaaagcaaaagtggaccccaccgagctcacacctacatgctcacacaattggttttcacaaaaaaacttgagccgctggaaattgtatttgtctgccgccacaaacaaatcctggaggctttggagaaaaatttcatcctttaccgcctttttttggggttgttccacaact

SEQ ID NO: 54572 - DNA, 619 bp, Triticum aestivum
  Clone ID: PAT_TA_54572
tgaaggtggtgttcgcgtcgccggcggagcacttcacggactcggcgccgatcgggaacggcagcctcggcgccatggtttggggcggcgtcgcctccgagaagctccagctcaaccttgacactctctggagcggtgtgccgggagattacaccgacccgaaagcacctgccgcccttgccgccgtcaggaagctcgtcgatgaaggacggtttgtggatgccaccagcgcggcttcgggccttttcggtggtctaacagaggtctacaaacctcttggagatatgaatctagagtttgacacatccaatcaggagtatagttcctacaaaagggagcttgatctgcatactgctaccacaattatcacgtacaacattggagaagttcagtacacaagggagcacttctgctcaaatccacaccaggtcattgttaccaaaatttcagcaaacaaaccagaacatgtatcattgactttatcgttaaatagtaagttaaaccacagagttcgtgtaatgaatgcaaatgagatgatcatggatggcacctgtccagtacaaggacacaagctacaagaaaatgaagcccacgatgctactggtatcgggtttgcagc

SEQ ID NO: 54573 - DNA, 602 bp, Triticum aestivum
  unsure (1)..(602): unsure at all n locations
  Clone ID: PAT_TA_54573
nctatggactcctnctagnaacanggccgcacctcttttcttattttatttctttattttattcttttcttttctttttatttttatttttctttttttttttttttttttttttttttttttttttttttttttttttttttttttttccaaacccaaccaaaaaaatgggcaggattggggggcaaaaaattggggaaaaaaaaccaggggggcccgctcaggagcaggttaattaattttaatgaccaggcaagctttaaaaggggacccattcccggttggtttataaaaaacacttttaatcttgccaaaaaatattacaaaagggggatcgacttgatcttaacaaacccctacttttataaaaacgaacaggaaaacaaaacaggtggaaagcttccacttccaggaggggttttttaaaaaaaaaatggggtttaaaaataaaaataaaaacagctctcattaaccaaaatttgggggtttctttgagaagttatggaagggtttcaaaaaggggccgtttttcattgatttcagaggccccatttgcataaattcaaaaaaccccaacttccatgtaggaaaacctaaaaggc

SEQ ID NO: 54574 - DNA, 300 bp, Triticum aestivum
  Clone ID: PAT_TA_54574
gcataaaatgggctataatggtgtattcactgacacaggtgtgactgactatagaagaagcgatgatccaatagcacccaagggagcgatagatggccaactctacttagcggatcctaatgataaacaagctaagctggacacttgcctaatagccaagactaacatgggtcggctctagcatccacgcctagcccatgttgaaatgaagaatcttgacaaacttctaaagggagaacatagctcaggactaacacacgcgcatgctgagacagacctgggctcgtagccgcatgccaa

SEQ ID NO: 54575 - DNA, 452 bp, Triticum aestivum
  Clone ID: PAT_TA_54575
ccactcccaacttcatctatggctagacaacaaccatttacattttttagggggtttatataagatatgggaaggataacatagccgcacagacccataaggcaggcgctccttttatatcatccacttatgcacaaactacctaaaacttgccctaaatgaaaccagccaggccgttgattttgaaaaacttttttatcacaagagccatgatagcaagagtcagcccaaatgcagccaacgtaaacaatctgtcatgctttggcttctggattgggacaacagggttctgcggggctgaaacaacttttggaccgctatccctggggattacatcggactgagctcccacaatgttttctgcaacttctgactccaaataaggctttggaagggcagtattcgcaaaaccaaagctggagccaaaagggttgacaccttctgctgccttg

SEQ ID NO: 54576 - DNA, 333 bp, Triticum aestivum
  Clone ID: PAT_TA_54576
gaagggggcccccctaaaaaaaaaaggggggaaaaagggggggaaaaaatccccggggggggggccccacccggggaaaaaggggtgaaaaaaaacccccccccccaaccaggggaacacacaaagggggggcccccctgggaaaggaaccgacccaccacgggttttaaagtttccacgggggggcccccaaaaaagggacccctttttaacctcccggtaagggcccggttaattcgggggggggattccccgccgggggaccttttaagccccccgggaaattttccggggggggccctttaagccccgccgggggctttgggggctggg

SEQ ID NO: 54577 - DNA, 572 bp, Triticum aestivum
  Clone ID: PAT_TA_54577
actgcacaaatgaaccagcttcttgagtagtatcacccaatacatatgccactgaagagctctatctatttttctagagcagacctctcagaggctcacatgcattattatctcaggttctagggctgaattaaaaaaaaactaacacttcgccctgtacatatacaggaaccaaatgaagaaagggaatgaaccaacctttgccagatgcgagccaactcaaattgactgaaaccatacatgtttaacaaaataaacatgtcaactctagacacttaaaccaaattctccaagatggttgaagctttgaagtcgtaatcaagtgacctatccatttcatctctcaagggtgcccttgctgaaccacacgacacgttggtccaactacagccggatggccaactgcttttccgccgctcgcaagtgcgttatgaacgggttcaccgaccccaacgcgatcctatccgtccgcccgctgcccgacataccgactttggtcgccattttcctttgaacaagagcatcaaaaaaggaaaaatgagatccagtttgtcaacgaggctagctcaccc

SEQ ID NO: 54578 - DNA, 662 bp, Triticum aestivum
  Clone ID: PAT_TA_54578
cgtagcaccatgcggcaaaacttcgcaaacaccaactgttatgtacaggagccattacattttacataccatcccagatgcggaggaagcacgacgcatttacagttgtttcttcgcatcagctttaatgggcacaccgtagacgacataaacagcagttcagtctatcatcagatcaatccctcgcgtgactcacaagactatgtatgtacagacgcgcaggcacgttctgcccgctctactcgtagtggctatctacagatggacggaggtgccgattaccggactactccggccgcacgcttaccaggttggggagggcggccagctgaagcttcttgatctcgcaggccgtcaccttgcacgagtcgagcgacagcgagcgcaggttctgcagcggcctcagatggtggaggccggcgttggatacccgggagctcgacaggttcagcgagaccaaagcgggcaggcccgagattatctgcaaggtcttgactgtaaggttgccgttttgggataggttaagcaacaggaggacttagaggagcttggtgttgttgactcgcgggggggggggttggggccacccgggagctggcggagaccggggggccctggggacatggggggggggggggggggcgcgggtgggggggtgccgg

SEQ ID NO: 54579 - DNA, 751 bp, Triticum aestivum
  unsure (1)..(751): unsure at all n locations
  Clone ID: PAT_TA_54579
ccccgcgtccgcccacgcgtccgcatcaatccgagatagctctacaaccagcaaagccatccaaagccatgaggttgcagtgctccctggtcctcctgatcgccctgagcgtcggctgcgcggcagcgcaggagagcgggaaacaggcgggctacgatttcttctacctcgtgctgcagtggccggggtcgtactgcgacacgaagcagagctgctgctacccgcggtccggcaaaccggcggcggacttcgggatccacgggctgtggcccaaccgcgacgacgggtcctacccgcagaactgcaaccccgacagcgccttcgatccctccaaggtgagcgacatcctgagcagcctgcgcagcagctggccgacgctggcgtgcccgaccaacgacggcctccgcttctgggcgcacgagtgggagaagcacggcacctgcgcgcagaacctcttcaacgagcacggctacttccaggccgccctccgcctgcgcggccagctccgcgtcctcgacgccctcgccaccgcgggcatctcccccgacggcgggtactacacgatgggggccatcaagggcgccatccaggaggggaccgggttcgcgcctcacgtcgactgcaaccgcgacgagtcccgcaacagccagctcttccagctctacttctgcgtncacgccgacgcctnccgcttngtcgagtgccccgtccagccccggcgcaggccctgtggcacaggatcgagttcccg

SEQ ID NO: 54580 - DNA, 759 bp, Triticum aestivum
  unsure (1)..(759): unsure at all n locations
  Clone ID: PAT_TA_54580
ccccgcgtccgcccacgcgtccgtgcttgcctctcgcagctttgtccatggaagactgccctacgacaacatcaagcccgaccccgtcctcaagcagattctcaagaacatgcgcatgcgcaagctcgtacgtccccttcccatgccgatgaaacttcatactcggagcaaatggctaactaatgggctcctgacacgtgcgtttgtttcagattttcaccaacggtgacatgatccatgccgtgagggccctcaagaggctgggcctggaggactgcttcgaggggatcatctgcttcgagaccctgaacccgccgtgcctgctgacgccgtgcgaccaggcgccggagatcttcgacatcgccggccacttcgccgggttaggcagcgccgatgacctgcccaggacccccgtcctgtgcaagcccaacgtcggcgccatggaggcggccctcaggatcgccaacgtcaacccttacaaggcggtaagtcatcacagtttcagttatcagaacattcgaatatttacctgcagcatttcagttttgtgtttgaccgtacgtcagctaacgaagtcgaactcgcttgcttaccgcagattttcttcgacgacagcgtgcgcaacattcaggcgggcaagcgaatcggcctccacnacggtgctggttggcacgtcgcagcgggtgaagggcgcggatcacgcgctggagagcatccacaacatccgggaggcgctgccggagctgtgggaggaggccg

SEQ ID NO: 54581 - DNA, 729 bp, Triticum aestivum
  unsure (1)..(729): unsure at all n locations
  Clone ID: PAT_TA_54581
cccacgcttccgccacgcgtccgggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtagcggaggctacggcggcggcggcggtggctacggcggccagggcggtggcggctacggccagggaggcggtggcggctacggccagggcggtggtggctacggcggccagcgcggtggcggcggctacggcggcggcggcggcggctacggcggcggcggtggtggctacggcggccagcgtggtggcggtgactccggcggccagtggaggaactgagcggcggngccctccagttatcgatctatctaccatctcgtcgtcttcgtcagcaagttatcttcagttcctgtgtcagtcagtctgagtcgtcgtgtgtgtcgttgag

SEQ ID NO: 54582 - DNA, 698 bp, Triticum aestivum
  unsure (1)..(698): unsure at all n locations
  Clone ID: PAT_TA_54582
cggacgcgtgggcgaggacaacctgcacgggaagaggtcgaagccggcgctgccgtgggagaagaggtaccgggcggcggtcggggtcgccgaggcgctgagctacgtgcactccggctgctcgcggccggtgatccaccgcgacgtcaagtcctccaacatcctcctcaccgacgacttcgagccccagttgtccgatttcgggctcgcgatctgggcgccgtccaggccgtcgtccctcacgcacagcgacgtcgtcggcacgttcgggtaccttgcgccggagtacttcatgtacgggaaggtgacggacaaggtggacgtgtacgcgttcggcgtggtgctgctggagctcctcaccgggcggaggcccatcaccggcgacggctcaccaaaaggccaccaccaaagtctcgtcatgtgggcgactccgatcctcaacggcggcgacatctccgacctgctggacccgagcctggacgtgaagcacgacgaggtggaggtgaggcggatggccgtcgcggcgtcgctctgcctcgggaggtcggcgcgcctcaggccnccgatatcgcagatactgagcatactacggggggaagaggacgcgacgagcttggcggcctcagagccggactgcgtggtggacgacgagacctacccggcggcaacgtgaggtcgcccctaggcctggcgctgct

SEQ ID NO: 54583 - DNA, 713 bp, Triticum aestivum
  unsure (1)..(713): unsure at all n locations
  Clone ID: PAT_TA_54583
gactcaaactcgatctctcttaacattggctattaagttgacaatttgaccatgagtttctactcaatatgacccaacaccgaaggctactcatgcctcgacccagaaattcatgcaattgtcttcacacaaacatcgtttgagttgaactcttaaaagccaagactgtcaaaagatgatgttaccatcgatcagtcagagaaaaggtacacattattagtcttgtcagtaaatgaatactaatgtaaagaacctaagtaacttcatgtctggcgtctgacatatccagaacacaatcagaaggatagctcttcaaaatgcctagccgtcagaaccaaaatccatatcagaagagctatactcattcttaagttccacaacaagacacccggaaaacagctccaagtcaggcacccgaatacaacactcaagctcaacgatgcttatccctcgcacccttgacctcatgggtgagcatcctgggagcaatcgccatcgccatgagctcctggaagaggagcttacatgcgtacggtatatgaacctggacaatgtcagttntgttcttgcagcctctgcattcgaaggaattcttcttgagattggcaatggcaatgagtccacacttctcacaaacatgcactctgtaagcatcgctctggtaaataacctttccttcaagaaaaagcagctccatgagcaatcatgcaatc

SEQ ID NO: 54584 - DNA, 585 bp, Triticum aestivum
  Clone ID: PAT_TA_54584
cacacaaatcttattccattgccatgtttgatctgacacaaaaaaaacactaagcctgaaatctcagggcatggacatcgttcatggtgatggagcggaagcatgacctcccactccgtggatggcgacaatgggactacgcacaacatgcttcttcgacacccagctcaagcttccctccacaaagatttccgatgcacccacgccttggcagctcaccgtcacgctgaacgtcttcttttctccagccttggagaacaccagtgtctttggggagacatgcaatgtcatagagcttggcgagtttaccttagcagcgtatgtagaatctgccggcccaacgttcgtcaccgtccgggtcacggtgaacggcgttgatgctagcggcacagttagagtagggtagttgagctgaacgtccttgaccttgggcagcttcgcgcaggtcaggctcgagttgcgtacgatggtcaccaagccttcctcgccaaggagccagcagatgtaacctgcatagtcggttacaccgaggtcatacaccaaacctgggtcagcagccctcgccgggttcacatggccggcgcc

SEQ ID NO: 54585 - DNA, 491 bp, Triticum aestivum
  unsure (1)..(491): unsure at all n locations
  Clone ID: PAT_TA_54585
agctgaaaaataaaccagtccaactatatatattagcataactgaagatttatcacggctcacagggccttatcctgacttatcagggggattgcatattatccatccatgcaatgcaccaccacataaatgctagagaaaaattacaaaaggaattattaatgcaatggcactgtgtcgatcgcgccgctaaatgcatgaaggaagggaaagggaaaagctagctagcgccagcagctcacagattgtagccgcctgcggcagcaggcttggtcgcggcatcggcggaggccttgtagccggctttgccatctgcgggcttggtagccgcttccgcagcgggctcgggagcggcatcggctgcgggcttggcagcggacttggtggcggattctgctgcgggctcggaagcggcttcggacttggacttgtaaccggattcagcagacgtggtcttggaagcggtatctgtagnaggcgcggttgcggct

SEQ ID NO: 54586 - DNA, 642 bp, Triticum aestivum
  unsure (1)..(642): unsure at all n locations
  Clone ID: PAT_TA_54586
gtaatataataatctcatagactcgcagaaacaactcgtcgggaagaatctttaatgagaagactaccacagtgactcaccaggaaggtactcatgtacagcacgaatatacgacagacaatacggtacgacgacgaccatgctccacgctgaccaccttaaacaaaagaactcgggcagcatccgttgcccaaccactgctatcaatcctacaacctgtctgatataatcaaaagatattattttctctccgctcgcacatagcacatacgatcaccatccttcaactcatcatgcttgtctagattcgcgtttctcctctgctacagagatccaggttctttgtaacttggtctatgctgattgctgcgactgctgctgctgctggtgttgttgctgagcctgctgcgtctgtgatgactgctgctgttgctgctgctgtatttgcagctgctgcatttgaatcagctgggagttcatctgctgctgtaggcccgccttcgacatacgagcatncgtaatctcaccggttgcaagtttcagccgctggacctcacccgttagtgcttgattcagagcatctctcagctgcgcctgttgctacattgcttgcaggcttatttgaactgattggtctgagtt

SEQ ID NO: 54587 - DNA, 490 bp, Triticum aestivum
  Clone ID: PAT_TA_54587
ccggacgcagcacatgaactacctcaccggagtggaccattcgcttgattattacaagcatatttatatgtatagcactctcagcgctctcaccatctttacagtagctcgattcaggggctggatcaggttcaggtagtagtggtatatcgtagtagatacagctcggagccgcccgccgtcgaccttcgaccgtcagtcagacggcgcaggggccagggcccgtcttctgccgcccctcgtcgtctagggccaggctgtggacgaaggtcggcaggcagcagcggccagcataccaggcccgctctttccggctcctggcctccctcaccggcgtcggctccgtgctgcagccggagctgcgctccgacacagacttcccagctgctggggcaacggcttgctgaccgctcttgctgccgaccgactctgcgggggcggcgtgggcactctccccagtgtcgatacaggatatctgttgcaggagatc

SEQ ID NO: 54588 - DNA, 557 bp, Triticum aestivum
  Clone ID: PAT_TA_54588
attaaagaggattgattttattcgcaaaaaggagggttaaattttgttaggattaattaatgattgttaattatgggataatccctgctttcactaaccgcaggcagttgcatctgccgcgtcggttccctgccgaataggcaccctccctgaacagacgccttcctattggtgtctcttccctttgtataaatagcagatctcatctaatatagcacgctcgccgttgagcgagtcgatcgattccggcgatcgccggaacaagaagatccacaagccagaggtgagaaagaaaatgccacggtgcaggaacgcatcgcggcttccgcgttcttcgttgccaccatcggaacggcgcggggccgtcgaaccaaccatgccgcaacctgcgccagcgccgccacagcccgatgtgccggcctggcctcccgccggtccggctgcaccaaggctcgaggccgatgagaacatcaacccggcgctggcggctccgcgccgcctccgttctggtgctcggcgcatggctgagtagtatgcccctgtgtcaccacgacttt

SEQ ID NO: 54589 - DNA, 554 bp, Triticum aestivum
  unsure (1)..(554): unsure at all n locations
  Clone ID: PAT_TA_54589
gcgttcggnctagttctaagcgacgcgagcctggaaatacatttaactactaattgctgagtgagaagaaaaatgatgttgctgctaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggctttttttaagggcccacttttttacaccgttgtggctggaaaaaaatttttttttttgggccccaaaattttaaaaaaccgcccccttttttcaaaccggggttgggaaaaaaaccccgggccccccccttttttccctttggggaaaaccctttttttccagtggggcgttttctgaagggggggcccaagctcgccttttttaaaatgtttcccccccttttggggttaatttcccccccttttttaggctttttatctccgggggtggggtgggtttcccccccttttccctttttttt

SEQ ID NO: 54590 - DNA, 410 bp, Triticum aestivum
  Clone ID: PAT_TA_54590
gcgatctagaactagttccacccaacccctaaccctagcagctccgccgccgccgtctacttcacccagcccgccggaccgccgctgccgtctacttcgcccagcccgccggaccgccgactggatccagacttccacggggacgatgtgtcaggggtcccgccgctgccgccgcgcctgctcggtgctgtgccacccgttttcgctgccgtcgacgagcttctcgggctcttcaagcattcctgcaaggagctcgtcgacctgcatcgtcaggtcggttgccgctgttgctggtggtagcagcctgcgtgattgggtgtgtggatgtttgtttggtgatcgcatatggtgatgctggtgttttcttttcttcctaatgtggataaattgatacgggcctccaaaatctg

SEQ ID NO: 54591 - DNA, 552 bp, Triticum aestivum
  unsure (1)..(552): unsure at all n locations
  Clone ID: PAT_TA_54591
tgacggcaggtactcgagggcgcaacatcaccgtcaacgaggcccattcccgccgctccggcggtgggggcggcggcggcggctacggcggccagcgcggcggtggcggaggctacggcggcggcggtggcggctacggcggccagggcggcggcggctacggccagggcggcggtggcggctacggccagggcggcggtggctacggcggccagcgtggtggcggcggctacggcggcggcggcggtggctacggcggccagcgcggcggcgactccggcggccagtggaggaactgagcggcggggccctcncgttctcgatctatctaccatctcgtcgtcttcgtcntcaagttttcttcactgtccccgccgtcgngctcctgtgtccgccagtcttgggtcgngcgcgncgctcggtcctgtggcgttttgggtcgcgggccctggcgtcgctctgtccggcgctgtttggggccggtcgcgcctggggggnccctcctgcgccgtcctcttccncccccccccgccccccccccnccggtccttt

SEQ ID NO: 54592 - DNA, 250 bp, Triticum aestivum
  Clone ID: PAT_TA_54592
cggcagccgtacacagatggagcctagtccagcaccgcctactctactagctaggtagcgaatggttagcaccacaccgcatgaacccaccatggagacctgcgcggaccacttgtgcgacccaagcgtggagacccttggcgcgctctctgctttctctctggcggacagcaccttccctggggggggggtgtatcgccttcttcgtctcctcgcgccttttccctccctccccccccgtcttcttttt

SEQ ID NO: 54593 - DNA, 568 bp, Triticum aestivum
  Clone ID: PAT_TA_54593
gcttccagtaaacatatcccagcgagggaaaggaaaacccacccggcgaggagataaaaccaagcaaaaaacccccggcatccgacgatggctgcggggcgatcgaggagcaccggtcgggcgcgtgtgcgcacacggagctgcgcgaggccagggcccgaaagttcctggcgtaactgggcctgaaggaccgtctcctccctatgccgaacctggtggaaggtgggctacaaccgacccaccgggtacacgagggtccgacagggccagctcggtggtctcacccacaccttcaaagccatcggtgatgatgtgtgggacgccctctcagagacgagccgaggtggtgcgcaggacggatgcacaggatgaccggtgacaagagcatggagctgcttatctgggtcacacatctacaagatcgagatgatcccattcggctccaagatcgggttcctaaccccaggccggctatgctaagacttccccaggttcaacttagagctaaggccgacggcgaacgagggcgatggcaaggtactgctcagagcgccaagtgcaactgatc

SEQ ID NO: 54594 - DNA, 532 bp, Triticum aestivum
  unsure (1)..(532): unsure at all n locations
  Clone ID: PAT_TA_54594
cggccgcgtgggcggtagcgtgggcgcggctccagctagggtttctcgcccccgccctcccgccccaccgccggccccgtccgccatgtcgaagcaaggaggaaaggccaagccgctcaagcaggccaaggtcgccgagaaggactacgacgagaatgacctggcatacctccagaagagagaggatgagcaaaaggccctgaaggagctgaaggccaaggcaggccaaaagggtgcgctgggaggatctggcctcaagaagagtgggaagaaatgagtctgcccacccattcggnntacccagaaaatgataatctatctatctacctatctgngncgcgctgcactntctgnggncgggacagactaccttnagncgcgnngggcattgnccatcgcncgcgggtgggggcgcgaacctatggnatcgccacgcgccccctgcggcggtgctggtggtgcaggaggccccgcgccccgatnncgcacctncacccgcccccgccgctctcaaaaaaacccnccccccccc

SEQ ID NO: 54595 - DNA, 318 bp, Triticum aestivum
  Clone ID: PAT_TA_54595
catgcgccaggcgcagagcagtgagactgaagtccccttataagtccacgcagacctgctgaggcagtcgcgcgctaggcgctgatacagcatcactcatcacgggccacatgtaatgcgccattggggatgtgtcaactatgacattgttccgggttttcctttacacatcaatactttcttgttcgctactaagataagaattgagcatgctcatgctaccaacatgactcaagaaagcatgctcggatgtgatatggtaccgcatggatatgcttatgcacatgcacataatattataaggacaatccgactact

SEQ ID NO: 54596 - DNA, 145 bp, Triticum aestivum
  unsure (1)..(145): unsure at all n locations
  Clone ID: PAT_TA_54596
tttacttcgcatattagtattgactgaagtcaaacttcctaaagtctgaccaagtttattagaagaaaatataaatatttaccataacaaatttatactatgtngaaagtatatttgataatgaatctaatggtgttgatttctt

SEQ ID NO: 54597 - DNA, 582 bp, Triticum aestivum
  Clone ID: PAT_TA_54597
gatcgatcctcccgcgtaccaagccaccgaccaactggcagcgtctctccaagccgcggccacgctgatgccggccaagatcggcggccgggcctcctccgcgcggccgtcgtcgcacgtcgcccgggcgttcggcgttgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaaaaccaagctcatgacccgtctcacctacacccttgacgagatggaaggcccgctcgaggtcggcgccgacggcaccctcaagttcga

SEQ ID NO: 54598 - DNA, 526 bp, Triticum aestivum
  unsure (1)..(526): unsure at all n locations
  Clone ID: PAT_TA_54598
cccacgccgtctcgcccacgccgtccgctttctcctccccactcagtgcctcggtgtcccgngcccggnttcnnggttcgttagggggtttatgtagtggggggataaagggaggnaagnatatggcggnnacgtcgnagttacccgctttgcttttcgtcgnngcggcctttcgcctttgggccatccgnacgnnatccatgtcccttccagnaaccgccnnttctccatagtggcggcggagcggtgcatcgnactttccaagaattcattcatctgnacatgggnagaatcgggcncngnnttcccngnncgggttncnngggttnncgtcatccttnnncgcgtcggnacgatgggcgatgncnngccatggcgatcgtagggccatgnataccggccatggatcctggnaccggccgcatacattcacccgttcaatcgatggccccatgtcccccgccgcntttccggcggnagggcgggggcggcggccttttcagcggccggggggccggnntggcgg

SEQ ID NO: 54599 - DNA, 512 bp, Triticum aestivum
  Clone ID: PAT_TA_54599
ggaccgtcgtggctaactggtgctacgcaaccgtagcgccccgtgcccgctcctacagcatcgtcggcagcctcggtacctccgtgccctggaactacttctacttccggcctaacctcatgacgaacacccaagtgcagtccgcgcccgtgggacccgaattgatggacgccgacgtggatcgcctcaaggaccggtttcggagcaagttaaagaccgaagactacgacatgatagccaatgttttcgagcccgtcaaggccggacaggcgcccatagctacatggcgttcgagtgcgccgactcgcgtgtgtgcccatcggtcaccctgagcctggagcccggcgaggccttcaccatgcgcaacatcggcaacatggtgcactactactgaaagaacaattacgccggggtcggatcggacatagaatacccacgatgtgctctaagagatgaggtaataccgtggattggacacagccgttgcggtggaatcaacgctctgctctcac

SEQ ID NO: 54600 - DNA, 312 bp, Triticum aestivum
  Clone ID: PAT_TA_54600
aaatatagggggctacacaggttcatcccgacttcccaagcggggagataatgcacctatggcttacatcgaacttgtctaggtgaagtgaatcccttttatagtatcaccaaattgtcattatttttcattcttgaaatagactgtttcattatcttgactctgtacatgttagtttttctcaagtgttatttattaaggacatgatttagagaatcgctatatgtgtttgataggcagtaaaagaacacggaactgtatttagaaacactaattgcgaaaatacatggtctgctaaaagtctgtttgctt

SEQ ID NO: 54601 - DNA, 559 bp, Triticum aestivum
  Clone ID: PAT_TA_54601
ataagcagtcgagcgagcgagcaggcagcaggaaggaaggaaggaaggaaggaagcaaggaagggaggtggagatggcgcccatcaagctgtacgggatgatgctgtcgcccaacgtgacccgcgtggccacgctgctcaacgagctcggcctcgacttcgacttcgtcgacgtcgacctccgcaccggcgcccacaagcagcccgacttcctcaagctcaaccctttcgggcagatcccggcgctccaggacggggacgaagttgtcttcgagctcgagcttaacccccccaaatcatcaacgaatttggttgcagagtcgcgcgccatcaaccggtacatcgcgaccaagtacggggcggccctgcttccgacgccgtcggccaagctggaggcgtggctggaggtggagtcgcaccacttctacccgccggcgcggacgctggtgtacgagctgctcatcaagcccatgctgggcgccccaaccgacgcggccgatgtggacaagaacgccgccgacctcgccaagctgctcgacgtctacgaggcccacctcgcc

SEQ ID NO: 54602 - DNA, 477 bp, Triticum aestivum
  Clone ID: PAT_TA_54602
ggtagagtagaccgcgcagctcgcatccctgactgacctgtacacgtgcttgaataggagcccagggaggctgaaccatgaacggtatcggttggttcgggctagaagggccctacatagtacgcgaactgaaacgccacaaggagaaggggtgcatctacacaaggcgtgcacacacatgattgcttgttgtgacggtgctatacacgaccatgactgcactgactgtctttgctgactggtgaatctaaacgggcacatgtcatcgtggacattaggtgcgctggaacacaggaaatacaccgggcagaaacggctttgctaataagcatatgtgtctagtgggttagctctataaaaactgcatgacaactttcctataataccaactgcacttgtaatcattcatgatagctagagtagttgatggtgctctaccatacaaatttaattactgatgaaatcatggctctcacc

SEQ ID NO: 54603 - DNA, 474 bp, Triticum aestivum
  Clone ID: PAT_TA_54603
tccgataggttcggaatagtcaaactgtgccactgacttataggtgctctcaggctgagctgatgccccgatgcatagtgatagcgtgtgggctggtcgatatgaaccacggcccgtgtatccgctagtggcatgaaaacctacgcattatcgctattgtatcacgcgactgatgctctagcaagcaacattccttcatccatcaattactttcttgcaaggaagggcctggatcataatgtgcacaaatggagatgcctctgctcataatacctgctgatcttgacctagcgtttgcattgccaacagtctatgactgactgcaatcagagatcaacatattaccattacagttactcgcataccatcatgaccgttgcttactggattctgatcttaaccaaccaacgaatctgctcgaacagcgtgaccaccctacaagcttgaggaaaaacatgcagatcaatagcttac

SEQ ID NO: 54604 - DNA, 564 bp, Triticum aestivum
  Clone ID: PAT_TA_54604
ccccgcgtccgccccgcgtccgccccgcgtccgcccacgcgtccggcctcctcctggctctcgccagtgccagccgccacctcgtccgatcctactttggtcacagttaaatagttaatcaatggaagagctcgacgagttcgaggtgctctggccggagtactacgccggccacgcccacgccgacgatgaccacaagccactgccgagcgtgcagagcccggccacgtcgtggcagcggcgcgcggcagggtctcggccggtggacgttccccccagcagggccgccgtgctgttgctacggtggaaagacggtactgatcatcaagacgacttgatggagaaggacggcggcggcggcaagatcatggtgccgccgcacctgctggtctccggcaggcggctgtccgacggggaggccgccgcggcgtacacgctgctgcggtcgggggcggcaaggcacggcaagcgggcgcgcgacctgcgccacctgcgcaactccgtgctgcggatgaccggcttcatcgaaggatgacacgtactaggtcgtcctatggtttgggg

SEQ ID NO: 54605 - DNA, 561 bp, Triticum aestivum
  unsure (1)..(561): unsure at all n locations
  Clone ID: PAT_TA_54605
ccatctcacatnaagttcctcttcctctgtttcctcctctgctttggcctcgagcttgcgtttttcactgcagcaagcgatgaccaactcttgtaccatggcttcacagccggtaccaacctcaccgtcgacgaggctgcttcagtcacgttgaacggactccttgagctaaccaacggctcgcttggttgcaaaggccatgcgttctacccaactccgctgcacttccgcaaatcgcatgatgataccgtgcaatctttctcagtcgccttcgtgtttgccatccactctacctaccccatcatgagccgacagggcttggctttcgtcgtcgccccaagcatgaacttctcaactgcattggccaatcaatacttgggcctcatgaactcccagaacaacggcaacttgagcaaccacatcttcgccatcgagctagacaccgtcctaaacatcgagttcaaagacatcaacaccaaccatgtaggtattgacatcaacagcctccagtctatagagtccaaccctgcaggatactatgatgataggaatggtaccttc

SEQ ID NO: 54606 - DNA, 523 bp, Triticum aestivum
  unsure (1)..(523): unsure at all n locations
  Clone ID: PAT_TA_54606
agcgtcccctncnncctctcccgccgggggtnntcctccttcgccnnngtcgtctgggcagcggtgggcaagaaagaatcaaaggtcnngacaagcactccttggnnacttggnaggggcggctttgacatgtgcgacattcgnacnngccaacccggcaggaaagnggtgggcatagaaagggnnncgtgtacccaatgttnncgttgnaccaatgtaccgngcgccccaaaacgtcgnaacggctttaccatgcccatattctnanncacgnnccagaaggnaaaatggtncnntgaattctgnnngtgacnncgcttacgnnnccggcggnataccgaaaccgggcntnntcttattcnntgggccnnngtcacccttcgnnccggcctcnnnctcggcggnncggcgtcccctccctcgtcctacaaacaaaccagcgctnnnctcgccggcctaagaaggaagcactctacnngtgtaacaacagggncnncgggtctttctgccttgcatttgcacg

SEQ ID NO: 54607 - DNA, 496 bp, Triticum aestivum
  Clone ID: PAT_TA_54607
gccattgcagttttgtcaactctggcattgctttggcactttatatactggtctgtgcggcgagtgacgcgtgtgctagggccttgcacgcatctcacccgacaggccgcacgctcgcaagcgggcgctcagctctctggtagtgcgcacaccgcgcgcggaaggagcaagctcctgcaggtggggacaatcgagggcataacggaggctgaggactgtgcccatagtaggcgcggtacacaactgaggctgttcctgctgaagctgattacaccgatcatctaccatatgcatgctccgcgccgggcgagcatgatcgatcatatcgatctactactaccataccatgtagccgaatactgatcgagggcctgtatctatgcacctgacctgcatcagcagtgacgtgccatgccatgattgaaaacaggcccccctaaataaaatttcccctgattagctgcgtatgaacaaataatcggattcgacaacatgc

SEQ ID NO: 54608 - DNA, 494 bp, Triticum aestivum
  Clone ID: PAT_TA_54608
ggatcaaaaatcccctcctggatatttctaatcctccattcatcaagacctgcaactccacgaggatgagggcatccatacatatacactgggaaggacctatttatccttagcatcttaacaaggtggcgaaggaccacggattcatccattcctgcctttgcccttgcctaaagctgggaaaaaggcacccctatttgcttgccattaactatacttggacacccaaggggcggaacccgccttttcgtccaggaagggctccaccggatttgggttcccccacaccggttaccccttgatcttaccaaacacgtttaaaacacgcagcctggccatcccttgacgcggccacttccatgcaaatcccatgtaacgcacgaccaccgcttttttcatttaagccacccctgggtttatgtaaggctcatcctcaaaaacatttaggccacacacggaaatgggattcgccctcaggtgctccaccaaagcaa

SEQ ID NO: 54609 - DNA, 520 bp, Triticum aestivum
  Clone ID: PAT_TA_54609
ggtgagaaccataaactgatgctcattaattataactggtttaccgggcacgactgcccacactatgatgggcgcttacaaggtccgatagtgttatagtaagatggagatacatggctcatatacctacgacactacacacatttgcttattttgaaaggctgtgagatgccgcctgatctcctctgcacccttgaggtctcctatcatggaggccattttctgtttagatgcagcagatgccgaggcaggttaagcatcactcacatgtctcttatcacctgaagcagcacaccgctgtgaacacagcatgcctagatgcattccttctcactcgggcgcttactccacgtgctccgtgtcggacatttcctgcccaccaggttcgcctttcatgtttccaataggaggtttgggttactatggtaataagaagaatacgtgtgcaaagtgtgtatctcttctctgttctactctacatacacacccgggtacatccagtgaatacccaccggtgcct

SEQ ID NO: 54610 - DNA, 520 bp, Triticum aestivum
  Clone ID: PAT_TA_54610
agtcgacatattgtataatattatgcgtccgttcatatacatagccaccgatagcattctcatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcaacccggtggcttgaaggcgatgaaactgacgcactgcacctggcgcatgttgtcgaatccgatgatgcggacatacccgtcagggtactccttcttgacctcctccacctcgttgatcacttgtgtggcgtcggtgcacccgaacataggcagcttccacattgtccagtaccggccatcatagtacccaggggatgcgttgtgctcacggaagatgaacccaaccttgctgaactcgaggcaaggcacccacttggagcggatcaagtagt

SEQ ID NO: 54611 - DNA, 531 bp, Triticum aestivum
  unsure (1)..(531): unsure at all n locations
  Clone ID: PAT_TA_54611
acacacaanaacatccagaaattattgttctcttgtttcacagaatcctggtgccgccagagcagcaactattggacttcaaccagagcttgtaattattacaaagttcgacagaaagctccggtgattgcaagccaacagccatgctacagcatgttacaccagggtgtacccagcaaaccaggttttgctcaatctttaccctcttctccaggactgtccaccttggccacagcggatgcgtagctgacgctgctgtccctcgtgctcttgcactggctcgactgctcatagcgaacaaacccgaccttaatcttcgtcgagcagtgtttcaacatatgaagaaggacgctgatgggatggcgtccacatatggtattctcgtactcctcgagatactgtttgaacgcgtcggggtcaccagtctctatgatctccatgcccaggcggtccaatgccttgattgatttatgaatggcaccatgcttcttgtcatagtatgtataactaaaccgagatccccagtggcac

SEQ ID NO: 54612 - DNA, 553 bp, Triticum aestivum
  unsure (1)..(553): unsure at all n locations
  Clone ID: PAT_TA_54612
aatcaaacttattgacctttctttctcgtcgaatgttcannccgatcgaaaacaacagatttcaatatgatccccaaacagaaaacatcttgtcgtgcttcacttcttcatatcctgatcatcatcagacaaccggagtcagcagcggcttcttcagaacatgcgcctccaggttgcccaggaccaggtccgccatggcctggcgcgtctcgtgcgtcccgctccccacgtggggcaccagcacgacgttgtcgagcgtgaacagcgcctcgggcacgttgggctcgtcctcgaacacgtcgaggcccgccccgccgaggcgcccctcgacgagcgccgagaccagctcgggctcgtcaacgtgagggccgcgcccaatgttgatgagcaggcccttgggccccagcgcctcaatgacctcacggttgacgatgtgccgggtctgctcgttcagcgggcaggccaccacaaggatgtcgctgtttgccgccagttcgaccacgctcgggtaataggtgtagctggggtagtctttctttgttctctggtagta

SEQ ID NO: 54613 - DNA, 515 bp, Triticum aestivum
  unsure (1)..(515): unsure at all n locations
  Clone ID: PAT_TA_54613
gtcaattggccatgggtgcaacttttgggctagagccccctacggaagtggttgatgtggacatagcaactcacatagagatctatgacgatggtccntgaaagaagtttacttgttgtggaatcagctgaccgtccagggttgttggttgatctagttaagatcattgctgacatcaatatcactgtccaatctggagaatttgacactgaggggctactggccaaggcaaaattccatgtcagttaccggggcaagccattaatcaaggctttgcaacaggttctcgcgaatagcttgcgttatttcttgaggaggccgacaacagaggatgccagtttctaagcagatgattacaaacccacgccttatcatagctcatgagacatgatatttgtatgaagtttgcactatcatccaaattattcctgaaatatgcataattcccaaaaaagggaggtacacgatatatcatgtactcatagtttcatttgaaggcagcttcatgctgtatg

SEQ ID NO: 54614 - DNA, 636 bp, Triticum aestivum
  unsure (1)..(636): unsure at all n locations
  Clone ID: PAT_TA_54614
ccgggttttcccacgcgtttctttnattccccctctctcacgagttgtgctgtgcccgggatccatccagaaaaaccaggtgtggtgcgcgcagccgggtacggatcaaagggcgctttccgtcccttgcccggnnagttgatgcngnncgccgccnngtctgaatcttcnntgcgtgaggggcaggccgtatcttattcttatccatccnnggccatggcgtgctggtgggggtggggttctgagtgcgtccctcaagcttcttttcaacctcgatgctcggtggggtggggggnngctggccactggcggagcttagcggcgcctaccttgctcgtgcttctggcttccagcttgcttgccttccgtnncgccgccggcgccgccttccaagcggcgaaccttagtgcggcttggggcggccgaactgcttcttcttattttacgntgtctatttctcagatgggacctcgngagaagcttcattcagcgcatgggtttattttttgcattttattaggtnngtcggtgttatacctcttccattaactttccattcnnttcggttggtgcttgggaggcatccaaccaaagggagtggggatggcttgcctttattccactttaatttcattt

SEQ ID NO: 54615 - DNA, 415 bp, Triticum aestivum
  Clone ID: PAT_TA_54615
tataaagcaggtccttaatgacgaagacacgacttgataaggccacatacctggcgcgcatgaccggactgacagaagtcgtgcgcattgcaggcccgaccgggaacctacgctcgccctgatcaactggagggctcttctgggttatgcacaagacagacttcctcacagccaaacttggtgtcatggccatcagggacagcgagagcgagatgattcatggggctgcaaccccaagccagtattgtcagccaggctcttatatctcgcgacttgttcacgtagactggtcctttggtgcacgccctgcttggctcttgactaccgccttccttttagcacacttggttgcaacactcatctgtgactatgccaactgggagttcgcaaggatcaagggaatcaggagatgctg

SEQ ID NO: 54616 - DNA, 550 bp, Triticum aestivum
  unsure (1)..(550): unsure at all n locations
  Clone ID: PAT_TA_54616
tgtggttctggggattgcaaggcttgttccatctggtttcaggagtgtgtgttgctcctgtaatttttctcagaggagcccaaacttgatctgcccttgcccaagcttgctgagaagagttcataggggcangaaaataaataggcaagggtattggtgaatgcagaattggtgggagctatggtaatgaccgcgtacattgccgcggggaggaacttgttgtctcccggacacacaaattatgttgaacaatcaagaccttgaaggttggtttctacctgaaggttggtttcaacaagtgttataaacttgagctcctttccttgagttcatgtggtttgggtcgactttgtccttaagatagaccccatggttggagctccacacgattgaactggtccactctggcaagtggtctcgatctcttggatacttggtactatgaaaaccacacactgtattttggccatttccgttggccgagtgcttaccttgtaccacaaatcaatcgattctgtatctgaattttcctactccaatggtaagtctg

SEQ ID NO: 54617 - DNA, 250 bp, Triticum aestivum
  Clone ID: PAT_TA_54617
ggggcaaaaaccctcctcgaccatgtctgggtggtggaaaagggacgagcccaacgggtccaaggcggtgagcctgctcctccgcctgtccgcgctcatcctggccctcgcgtccgcggtcatgatggccaccgccaaccactgcaccatcgccgactcagcttgtccgacagccgtcacctaccattactacggcgccttcgtgtacctggggtggaccaacatgtcacacaacctaactggaggccat

SEQ ID NO: 54618 - DNA, 598 bp, Triticum aestivum
  unsure (1)..(598): unsure at all n locations
  Clone ID: PAT_TA_54618
tcccgggtcgtacccacgccgtcctttagcaaggctatatacctacataggtacaggccatgggcccccaccgatgaatggccctcgtcggccacnnctccgtcgctccttttccaggnggctnncaagtccaccgccggccctccccgnntcagcccgccgctccnnaacggcgctagcctcggcagctgtctagcaacggtgngaaggatcaggtgtcatgcggggtggtggcccatcgnnagggcattaagaagtntcgagacccttgtcctacgctgccacnncgctcagcacggaggccctcctcaagcaggtncgactaccctgatccgctccaagtgggtgnccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgc

SEQ ID NO: 54619 - DNA, 505 bp, Triticum aestivum
  unsure (1)..(505): unsure at all n locations
  Clone ID: PAT_TA_54619
aggcgtngagcagccaaaagttgccgaactgagcatcaagtcgctggtcgatggtgtcgatttctccggctcgctgacccgggcagagtttgaggagctgaaccatgacttgttccttaaagccatggcgttggtggagagtgccatgagacaggctgggctagacaagaacaaggagctgcttgatgagattgtgctggttggtggaagcaccatgatccctgggattcggagactcgtcaccgattattttgatgggagggagctgaaaaatatcaatgcgtcggtgatgccagatcaaactgtcactctcggagctgctcttctaagccatcctatggcaaatgggtacccatgcatgggaggcgataggcgtcagtggggatactccacggactggtgttttaccgactgaacttcccgttattgattgactgcagtgagcaaaccactagcctcaagccctcaactgcnacaaattgtagcttatatatcatcttctttt

SEQ ID NO: 54620 - DNA, 191 bp, Triticum aestivum
  unsure (1)..(191): unsure at all n locations
  Clone ID: PAT_TA_54620
cngntgagccaagaccaaaccacgnagcgcggctccacatccttgcaagcaggcatgcaggcctccaggcgctgcgtctctcgcgttgcgccgtcggtcgctcgtggctaacatgcgctgtccccgtcacacatgagccaagggtgcaagtcccgtgagccgcgtcgtgcgacaaggtgtggccgtagtgc

SEQ ID NO: 54621 - DNA, 427 bp, Triticum aestivum
  unsure (1)..(427): unsure at all n locations
  Clone ID: PAT_TA_54621
gcggcccccgcgccggnngcggagccgnngnccnncaaggaagncancacnnggaagagaccgagagnacaancgcagcagaggcagaaggcatgagaangangccgggagagacagggcacgtgaaaaaagctcaggccgagggaaggatgatcaccacgataggagcagcagagaccgggaaaaggacaggagaacgggaaggtgatcggaacctgctgtgcactcatatgagctgggctgcctaaacgcgccatgcatgggctcctcgaacctgtttgtaatggggtcagctgaggaactattttttgtagtttcaggaacagaagtagtgttatcaaacatctaatgttgactttgaatgattgaaatgctgcctattgtcgtcatggactgcggcttaaaaaaaaaaaaannnnnnnnnnng

SEQ ID NO: 54622 - DNA, 515 bp, Triticum aestivum
  Clone ID: PAT_TA_54622
ccatggtcaaccagagggcttcttgattctgcatgagaaatggcacattcaattgcagggaacttaagttccccacgactagaagtaaccagagtggagttgcttcttaaggtctgaacattttgcgtcgctgtgggaacattaatcggatggatattcggcatgaacctcaaatggtccctggagaacaccacttgggcatttctgggcgacgactggcgtaataccagtgggagcagtagccgggtttttcatacatgtacatgcacctaaaggataggaagatattgcagacaccatgcaccatatgcggaatcgcctagaaatctagaactgtaaataaagcgggtttgatctcttctggaggcacgtatggattcatgacatgacattgttttggtgtgctggtggatgcttacacataccaacttggtgagaaagtgtttttcatggatactgatacacacgccataccaaggagacaagtatttttctgctactgtgctggataatgt

SEQ ID NO: 54623 - DNA, 192 bp, Triticum aestivum
  Clone ID: PAT_TA_54623
agaacccaacctttttattccctccttttggtccagaagggttcattatccatggggctggcgggggggagagcagagcagagcacatgggggggaggggggatgaacaaaatacgcttacacaagaaaactaaagataaacattggaattaaacacgggtttggcaaattacaaagacaagcccttggggg

SEQ ID NO: 54624 - DNA, 541 bp, Triticum aestivum
  Clone ID: PAT_TA_54624
atcaccatgcgccggaccgtcaagagcgcgccccagagcatctggtacggccctgaccgtcccaagtacctgggcccgttctccgagcagaccccgtcgtacctgaccggcgagttccccggcgactacgggtgggacaccgccggattgtcggctgacccagagaccttcgccaagaaccgggagctggaggtgatccactcacggtgggcgatgctcggcgccctggggtgcgtgttcccggagatcctgtccaagaacggcatcaagttcggcgaggccgtgtggttcaaggccggtgcccagatcttctccgagggcggcctcgactacctgggcaaccccaacctggtgcacgcgcagagcatcctcgccatctgggcggttcaggtggtgctcatgggcttcatcgagggttaccgcgttggtggcggccccctcggcgagggcctcgacatcatctacccaggcggcgccttcgacccacttggcctcgccgacgaccccgacaccgcagctgagctcaaggtcaaggagctca

SEQ ID NO: 54625 - DNA, 242 bp, Triticum aestivum
  Clone ID: PAT_TA_54625
aaagaaggctcaaaacggtcccccccgggggtttcaaaaagggcaaaaaccggggcgggcacacaagggccgggacccgaggaaaaacagggggggaacaaagcctagaccgagcggatatgcaaaaaaaaaacaacggaaagggggggggcacctagaagaaaaaccatacatgccagaaaggaccacaaatcccaccactatacaggcggagctgcctaaacaaacacataacaacgggg

SEQ ID NO: 54626 - DNA, 453 bp, Triticum aestivum
  Clone ID: PAT_TA_54626
agggatccaacttccaccatcctttttgcaaatctttatgtaaaaaaacacaccaaccggtggcatttttccagtcagaccaagggcgggtgaaacaagaaaccccgcgcccactttttccaggaaaaaagggggccactcactcactcactaactccaccacctttacattcacatttcactttataggcccaggaaatttacccccaaagacaagtcaccctatgaaaaacatatacttgtcgatcccggggcttgggaaaaaccaagcccgaaggagatcccatcaagcctttaactgcattgttagctgggtagggcccggaaccaacccggtcagtcaatgtgaaacccgaaaaaaaaaaaaaacccgtttcacaacactttctgagggttatgaatgataaaaaactggggtctgggcccggcccccgggaacgtttcatcgctggg

SEQ ID NO: 54627 - DNA, 462 bp, Triticum aestivum
  Clone ID: PAT_TA_54627
cagcggaaaaggcgacagtttgttcttccaaatagttcgtcattgcccatcactaggagtttattccaacaggggggcaactcacatgcgtttaatctcacatcactacagttttgactacaggcatacttttcccaatcaacccccagattcatcagatgcccctggggtttatttattcattcggttccactgggcccctgctgaatctggcgtcgcttatcaagggtgggggattgaatttcctaactactacaacagccacccttggaatctggcgtcgcttatcaaggggggggaattgaatttcctaactactacaacagccacacttggacgctttcctggcggggggcgctgttacagccttttaaggctctttttcctggcatccattttccttttttcggttgggattttgggggaaagcggcccgtcctttttgtttgccgttgatggccc

SEQ ID NO: 54628 - DNA, 469 bp, Triticum aestivum
  Clone ID: PAT_TA_54628
gaatatacgtaagtgctatgttgattaacatgaacagggtaatgtacatacccgggtgacgagattgaacgaaacgtagcaggcctgtaggcgggacggtcattactttggttcacctagcatcaccttgtcgaggacgtggaactggaacagaacttggaaatcgacgacaaccttgccgggctccgaggggctcttgatcttgtctgcatggtacaaccccgttaagggaggggaaaagcttgccatatatgtgcttgaagttcttattttggtgcttggcggactaggacgagatgacggatttattgacctagagaaatgttagagggcctgtagattacgatcttcatgacatacggacgttgttttttgtggatcaacgcctatacttctaagacggcctgggtctacttcttggtgcggaccgccagctccttgagctgcacgacgtgattcaacgaacccc

SEQ ID NO: 54629 - DNA, 465 bp, Triticum aestivum
  Clone ID: PAT_TA_54629
ccattgatacctggtttctcgttcatataatctagcgaatcgagggtcaaggacccgctctagctcggcagcagagggcctgacatactggcacagctctgagcccgttaaggacgcacaagcacaggcacctcttgtaaaaggggtcatcttaacgggggcgagagctcccaacaccacgtggttgttcagaggccgcccaaccaagaccaggggggctaaaggccaggagctcttgacaaaggccgggggatagaccaaccttcaaatggcaatcaagattcgggccccggattgtccaacacagctggcgaaacccaaagacaaccacctcctgcatgcaccggtgtaccccaaggtttacctacctggctaccgattcaaaaaaacacaggccgcttgccctttgcctgtccccccccctcacataacctaagggaggcctaagcaaacccccgaggaacc

SEQ ID NO: 54630 - DNA, 160 bp, Triticum aestivum
  Clone ID: PAT_TA_54630
ggaccaacaggggattcccagcaggcttaacgggcgggccttggtaaccccaacccccccaaaaaatatggggcctggtacaacaaaggggctgaaaaagcgaaaaggcccaaacccaaactggaaagagggaaaagcaaatcggcacccgcattttttc

SEQ ID NO: 54631 - DNA, 519 bp, Triticum aestivum
  Clone ID: PAT_TA_54631
agtctctaaccatatttattgcatttccatggggattaacacatacgtatccatacacatgagtaaaacactcgtcttctaatcaagccatcagggcatcaatcatttcttcacgtaatcatcatatagagaaccacggggaatttctttgctaaagaaccttgccaccaccctctcttccaacaccatcatcgcttcttttgaccgaatagccgttggagtcttgtactggcccgccgatgcgcctctagacacgaagaagtccatcagagcgtcgaacgcgccctgctcaagcacccttatctcaagcgcggtgatgttcgcgcgctgcctgattttgcagtacatttggtcgaagcattcttcaactgtcgagcaacaattctccatgacagtttgatcggggatgtcgccaaccacgtggttactccttgcgttggttagctcccagaacaggacgtagtggcctggcaacttggatatgtctgcaatggcggtgcttccactgagcatgtaccc

SEQ ID NO: 54632 - DNA, 448 bp, Triticum aestivum
  Clone ID: PAT_TA_54632
aaaaacacccttcccgggtcaaacaaaaaacaaaaggggggtttgggggggaaaggcacaaaccaacgggccaactacatatacatgaggaagaccaagacccggtttgatgcttaacatcaactaactcataaaggaaaaggggcatttataagggtacttgcccaaatcgcccttggaagggaggaacccccccaaaggggggaaaaaggaaaacgggacaaaaacccatttggcataccacattacattgaaagggggggggggaggaaaaaaaaaaaatgttgttgctaggaggccttaactatgggtcaacgaccatttaattttttggggggggcaacccctgcctttttgggaacggggtcaaggcccggcttctcgagggtcttgagggccttggggggagagggggacttgacgtaacgcttggcggccccccacaaaa

SEQ ID NO: 54633 - DNA, 467 bp, Triticum aestivum
  Clone ID: PAT_TA_54633
atgacctgttttttgtttggttttcatctttccattcttaccaaaccgccccggggggcgcgggcttttttgcttgaaacccgaaggcgggggtaaaacaggggggggggggggtttcaggaccggaaatttatgatgcccaactgctcctttgggcccttaagccatagcaaatacatggttgaaatgggaccccatgcggggggggctctctgatatattctgggtaaacaggagagcaccatgcactttggctcaggagagctggattagggcgatcaagcccatcctggcttgcaactagaatctgtttaacagtgatggcaggtctccaagaactatcctcattaataatcgagaggcagaccgtccctcaaggaatacatttgcggtggaaaaaaccctgccggaacttgctcttgggaggtttgttagggttggcctcactgaaggggatagtaagtggc

SEQ ID NO: 54634 - DNA, 365 bp, Triticum aestivum
  Clone ID: PAT_TA_54634
accattaaaacgcatatcggggtcaaattgattaatattatgcgtccgttcatatgcataggcaccgcaaggatacccatacgagcatgactcatcgagccatgttggaacatgatcctgggcatacacagattctgaggagcaaccaaaaaggattaatggtttaggacagccctgtgcagtgacgcaaaaaggcaaagctgcggtggtcctatatatatggggctgttggatgtgagctgcatacgccttggcggtctactaccttccagaggacttgagagtaatgaagctgggtaactgtacctttcggactttgttgaatgggggatgctgacatacgctttagtggaataggaggttga

SEQ ID NO: 54635 - DNA, 325 bp, Triticum aestivum
  Clone ID: PAT_TA_54635
gaaagaaaacctatgcgcgttgcaagcgaaaagattttgagcagtagagatactcttgattaatttaaaagattgtaaggaaacaacaagaaataatcaaacacttattttttataggtatatatccacaccaagatggggggcggaggaagctccgaacgaggtgagagaaagtgaaggcgcagggtaagaggaattattcaggcaagcgaaatcaggagatgattcgtcgtgcaataaagcggggggtgtgcagaggaagcttggagaagttggtgttgggtgtgaggcagtgtgagacggaggaagagatgacggagctatt

SEQ ID NO: 54636 - DNA, 467 bp, Triticum aestivum
  Clone ID: PAT_TA_54636
cccacaaaaaaaaaaataaaagggccgaaccagtcccccgggtcaaaaacaaaatttggaaatcaggggggcaaaaattataaagggccccatggttttagataaaggggaaaccaacattttggggaaatgggggccaaaaaaaattcccgggaccagggggaagcccaggggggtcccccccctgaaactggggggctcctaggctaaacaccaaaccggaacagagaaaccccgtcagaaagccagggggccccaaagcttcccttggacaaggcgccgaaaaaagcgccccccaaggctttttttacttaaaaaaagaaaatccagggggcgaaaaaccccggggggtaaaaaggcctaaaaataaacaggaaaaagcccacgaaaaaagcggttggcccgggcagtattgttccaggtcatcacccaaaaaaaggggggttaatgaaactaagcccccacca

SEQ ID NO: 54637 - DNA, 410 bp, Triticum aestivum
  Clone ID: PAT_TA_54637
aatgtaatgaaagccgtgtccagaagagcgtcgcatttataaatctgagagtgaagatttaagtgagataacaatacttcggctgtgaaatacaaaaaatgtttcttaatgaccccattacagaaggtacgggagcgatgcatggagcgtatggcagtctatctgataggagtgaacagacagtttagtacacttcacaggtgttgtgtctttatctcggcatctgttggttctatcggagcgaacatacttttctgggcctgagttttttttacgtgtcctgggtgtaaaggcatcattgcaatgcaatttgcctatgatgagattgaactatcggtctgtatccagtgatgacttagttgaaagactactgatcttgttcagggtgagaggctttggggacgcgtggg

SEQ ID NO: 54638 - DNA, 400 bp, Triticum aestivum
  Clone ID: PAT_TA_54638
agaaattggatgcaccatgcacgcaacatttttccaattactgatacgaaggacaacgatcaagtttcaacagaacacatagatgggggagatccatcagatcaggagagatccatgggacacaagcacgaggcgagacgagggaaaaaaaaggagggatttagatcttgccgcgaggtcccggggtgggcggaagctggggcccctttttgatggggagcaggttgggggaggcggaggcactgacttaggcaaaaagagagccgccgatcgagcagaaataccttgagaagaaacccccatttggtgaaaggcgcggcaaaggtgttaaaaaaattgctttgcaggccaatgtagggggaagccgggtttttgccgtacaggtcccactgccccgttg

SEQ ID NO: 54639 - DNA, 456 bp, Triticum aestivum
  Clone ID: PAT_TA_54639
aacgcttgaaactacatttatgttttgccatgtttaaaatagcacgcatggaagatttttcaagtacacgtctccattattaagtccgtgggtcgactccacatgtaacaaagtttacaccaccggggacatccaagatttcaacacattctttgcactgctccaccatactgccgtcacacttaggtacatagctcagacaccccaagaataatcaatttcagtaccgccctgaaaatctgtcccggtgcggagaaaatggcatggtatttattgagccgtgagatggtcatggatgatggtcgttatacccatggcgttatgacaggtgctgcgtgtacagttctctgaacggacctcctttccaacaacaccgttgatgctgccatcaggcatacccgaaacaacgctcatgcatacgcacagtgctgcccagttgggcagagtctctcttac

SEQ ID NO: 54640 - DNA, 320 bp, Triticum aestivum
  Clone ID: PAT_TA_54640
atgtacgtccattaatcttgctcgttcacacaagtgggcgtgcgtctgtacatatgcacaagggaaagccaacactgggggtgaaataaacacaatatagttagaaattcaatggactcccaggggtaaatgtgcattgggggggagcaatccaatagaacccttcttttggaagccaatgggatcatgatctgataaatacccttctgcatgcacatgcagttccacacatgtgcacatcggagagggctttcttcataagctcccaaaagtgatccttggactctgagagcctatgtataacactgtatgccccaacc

SEQ ID NO: 54641 - DNA, 508 bp, Triticum aestivum
  Clone ID: PAT_TA_54641
tttccaaacttgatcagcctggagcgacaaaaagcttcattgctgaatgtcaggcactcagaaacactcgtcatcgtaatcttgtgagggtgatcactgtatgctcgacaagtgatctgacaggacatgagttcaaagctcttttccttgaatatatggttaatggcaaccttgaaagttggctccatccaacactccatgagcatcatctgaaaaggcccttgtctttgagttcaagaatagcaataacagtggacatagcagctgctttggattacctgcataaccattgcacgcctcctatgacacactgtgatctgaagccaagcaatgtccttctggatgatgtcatgggtgcatgtgttggcgacttcgggttgactaagttcgtacacagttatacttcaacaattgatggttctacaagcttagttggaccaagaggatcagttggatacattgcaccagaatatggctttgggagcaaaatctccactgagggtgatga

SEQ ID NO: 54642 - DNA, 419 bp, Triticum aestivum
  Clone ID: PAT_TA_54642
cggacgcgtgggcggacgcgtggggtcgcgtctccaccccaccccacctcccctcctccccctccacctccccgtgtcgcgagaaaccctcgtcccttcctctcctctccttccctccctggcggagtcgcccgagaacgccgccgcggcgcccgcgcccgcgccacccgccggcgccgcccccgccccggcgccgaagccgtccccgcccgccaggtccgggatcccgccgcggtacgacctcgacgccaagtgggacgcctgcctcgacctctccatccgccgcgtcgcctactcctccctcgccggcgccttcgggggcctcatcctcttccgtagcccaacaacccgctgggcatcagttgcccttggagctggtgtggggataggggctgcgttcactgaatggctcatacata

SEQ ID NO: 54643 - DNA, 593 bp, Triticum aestivum
  unsure (1)..(593): unsure at all n locations
  Clone ID: PAT_TA_54643
ccgggtncgttacccacgcgtccgttnctcatnnctctgcagtttgtgcctgcccagtaaccactggtcacatgggnaagnaagtnnatggcatcacgccctgaacnccagctagcctcagtggtggnnagcgagggaagcccnngccgagctcnngcggggcagnaagnaacaagnngggtctnnattctgcccggnttacctactgccgacatcgtnnggtgtggaaagcccgggggtgcnnagttccacctcgacgacanncccatgccgtatacccacaaggcaccgggaacantctcggcngtacattagggagnaggagctatcgggcaagggtccnttgtcgacgttcgtgaggggggaacctggtgnttcgccgaaggggaagnncacgccggggcccgcctnggcggcgccaccatcctcgccaagtgatacactangagctacaatnngtcattgctgatnnttctagcgtatatgaaatcgtgtgcgcttgtgtagtaggtatggtatggtgtgccagaatttgtaggttgttttccctggtgtataaattgggatccggtggcatggcattccatttcccc

SEQ ID NO: 54644 - DNA, 486 bp, Triticum aestivum
  unsure (1)..(486): unsure at all n locations
  Clone ID: PAT_TA_54644
cagcgcagacgnacagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcgggggcggcttgacagtcgacatcgacgccaacggcaggaaggtcggcaagaagggcgtgtaccagtttgttgacaagtacggcgccaacgtcgacggctacagcccaatctacacgccggaggaatggtctgaatctggtgaccgctacgccggcggaacgaccgggcttcttatctgggccgtcaccctcgccggcctcctcggcggcggcgtcctcctcgtctacaacaccagcgctctcgccggctaagagagcatctacgtgtaacacagggccgggtctctgcttgcatgcacgtctctgtaatctacgt

SEQ ID NO: 54645 - DNA, 545 bp, Triticum aestivum
  unsure (1)..(545): unsure at all n locations
  Clone ID: PAT_TA_54645
ctgaataaatatatacaaatcttggactgagcttatgcacaaattcagatactagnaaattctcacatgacttggagagagagaaaaatatcatatttgtctatcaacaactgccattcttcgttggcgctcaagattcgaaatccagaagcatctattctttttggaaattcggtagtgtatttttccttcaacttctccagtgtacaccatagagagatcaagcaaaatcagcagcagttcccatcagctatcttgactacactgtaatttcggtctccgctgtacaaacaaaacttgatagcgaggtttcatcacccttgttatgtcttatgttccagcagactatcccagcggcctttgaggatctcataagcgtctggacatggaagagctattacggaggagctgctgccattagttgacagctcaaccaccagacccaaccgcagcagcgtctccatagctttgtcgataggcatttcaatcttcgcattaaatttctcatacataaactgctcgcacatatctctgacgcttgtgcg

SEQ ID NO: 54646 - DNA, 514 bp, Triticum aestivum
  Clone ID: PAT_TA_54646
acgtacatgacgaacgtagatttacttgtaaaaatggaagacgatacacgacatagcacgatttctgtcgagacaaagtaaagcattatgtaaaggaaactagtcttaggtcatcctgcagcagcaatatctcagcaatagaaaatgtttgtagttttttctcaaccctgcagtgatgaaaatgcttctttgattgcggggacttcaatataaacgtcttgcatcgagggacgatatttaggtgtctccgcagcacacatgaggccaatcttaacaagcctgatgatgcagctcattccagccatttgatgatgattttcttggtgcacagcccttcctgcttcttcatcttggtccgcataacagggaatgattctcggatctagaatctcaccaatcttttcaggaaatgatttttccacaaaattgtaaaggctcaggccatctttaaacatctcatcagttggacgctttcctgtgagcatttctaagatgataactccatagctgtata

SEQ ID NO: 54647 - DNA, 529 bp, Triticum aestivum
  Clone ID: PAT_TA_54647
agacaagagagggcctgggttttatttatttagcaccaacttcaagttcaagcctttgtacacagaagaggagcctggctctccactctcttgcaccacaccacagggaggagggccatcatattattatcactactactagtacaaacgaacgcagaaaagatagaaaatgtcacccgaaggaacggaacagatttgatggagcgactgaaatgaattccgacgggcggcgcagcgcggcacggtagccatgaccctagaagcttctagacgccaacaaagccactggcagcagcttaattccctccttgcaacaacctttgtcttccctcctcatcggcttcgcggcggcctccatgcatggccccgtctacttcctgggcttgagcatgtcgccgtcgtccatcttggcgaacctccctcgcaccctcggctggctgtcagccagagccttcctgcaagcatacttgatctttctgccaaagttcctctggatcttcttcttcctgtacctgttgagcttctgctt

SEQ ID NO: 54648 - DNA, 404 bp, Triticum aestivum
  Clone ID: PAT_TA_54648
gccaggggcatagcagcatcaggcaatcccgattataggggggggggttcatacgggggggtcgatcgcactggcagtcactggctcgggcaaggtatttttgggggatttacaaaccacaccccttttcggaagcttgggtttacaggcaagctggggggtttcgatggggtcgacattagcttgcttaccttaaaataccttaggggagaactagagatacatccgggctgggtacgaatttttttttgggatcattggttaaaacaagacgtttcccatggtttttccgaatgggaaaggggggagcctgctgccggtgagaatgggcagtttaaactcggttgggaacctttgtttagtttggttgtgggaaaaccaaatttccgttgcggtgaacttta

SEQ ID NO: 54649 - DNA, 413 bp, Triticum aestivum
  Clone ID: PAT_TA_54649
caattactgggggtaatacacgacttacatgcacgggaaggaagatatatgtataacaaaagccggcatgctagcagagacatgcatctttcttacactacattgctgagttaccacatacgtgcgctgatgtattaacatatgaggacaacgagaagttagaaggcgaaagagggagccggcaacaaatgtgactaacatgacatgtctagcgtggacttcaacttgctctttacaccttgccggattcctcatagcatggtggccttgaagcaatgaacctgacgcattgaaactggcgcacttcgcctgaatgctgtgacgcctacataggcattaggatatctgcttgtagaccctctctcacctcgctaagtacatgtggagcgtgaccttcctgcgcaacatatgca

SEQ ID NO: 54650 - DNA, 397 bp, Triticum aestivum
  Clone ID: PAT_TA_54650
gctgtactgattactgttgatatgactgaatctgaacagggagggtccttaggtgctcgctgacgtgttatacacgcagggaagctacgttgccggctctccaaattgctacaaacataacaggcctggtagcaacacggccattatgcctgcccatctagcctgacttggcccggggatccccgaaaacagctctaggtctcggcgtaggccttttaggtcttggtggggctctcggtctcgtgtgtgtggtcaacccggtagaggggggtgaaaagcttgccaccaagggccttcgagtgcttcttatgctcctttgtggaaatggaggagatgtaccgctttaggggctgccctcaggtatgagggcctaaacgctggggtcttgattacctac

SEQ ID NO: 54651 - DNA, 493 bp, Triticum aestivum
  Clone ID: PAT_TA_54651
acaaccatgtatacacttttattaattcaaccatacctttttatacactggagcaacaagcccaacataatgcatacaggccacagtagttcatacttagaagaggcaccggccgggcgggtggattacatgcctcgagctggcaacatgaccttggcacgcgatggggcacaggccatccacgtcagaaagggggggaagaggacctgctcatggcactgacagtttaggcagattgggacacccaaagaaggcctcacaattcttgccaacgaatagggacatatgtgagatatgcttattaccaatacgacctgaccttacctgtatcacaggcacccaggataccgaggactgggggaaaaaccaacgaatacccgaacgctacctgcaagcctaccatttttcactataacgagcaggattacaacttggccctataatgagcataattatatcctgggggaaataggtatccagttacaatctcaca

SEQ ID NO: 54652 - DNA, 498 bp, Triticum aestivum
  Clone ID: PAT_TA_54652
agagatgcaatggactaattgtcatagcacgatatacattttacaagcatgcacgccaaacgcgttcaaatttacattttacacccaccctcgaatgtgtacctttcgtacgctaacgtttcccacgacggcgggtgccatgcacagggacgacaatgctcggatcggatcggctcgatttcgcctagtggaacatgaggctggagaggatgttgttggtgaccgcgtccgagaggtggtctatgtaggcttctggaagggcccgacaccagcgaatatgggctggagggacatgccgaggaatgcgaccatggcgaggctggcgcacttgatcttcttgagcttgtagctccttcatcttcttttcgctcttggtgccgaacccgatcggtttgaagatgggcccgccggggtaggcggggtcacctgagccaccgaggtacttcttgaggaccaagaagaactgcttgcccatggagcccggattgtaccagtcct

SEQ ID NO: 54653 - DNA, 254 bp, Triticum aestivum
  Clone ID: PAT_TA_54653
agtaattaattattggttttattgactgtggtttctgttttttacaagcagtttcatatgcattaacctcatgggcccgttcaatacacaaattttagacgcatattcaggcacggcgtataagctataataaaccggcgcccccgggcggagaacaccaggagcaaaggccccaagaacaacaggttgagttacggcccagagaaacaaacaagcctttccccaaacaaaaggattgatatgtatcgatagca

SEQ ID NO: 54654 - DNA, 357 bp, Triticum aestivum
  Clone ID: PAT_TA_54654
ggggggttcccacgggttttatgaacaaaaatataagggtaccctgaccccgggggggggggcccgaaatagtcatcaactccccctaagtaattacattaaaaaaaaggggattaaaaccttttcctttttcccctcactggggacaattgggattcaacaaattgaaaaaacaaagcccgggaaccgcccttaacaaaaattccagccacgtccagggggatcccgtaacttggtatgaccaaacattaaattcctttaaacaagagtaaccaccagcgatgccaatgtttgcatgccgggatgtttatcacatgaaaactcattcactcgatactatttcctgacaaaattgag

SEQ ID NO: 54655 - DNA, 351 bp, Triticum aestivum
  unsure (1)..(351): unsure at all n locations
  Clone ID: PAT_TA_54655
tttggactnactaccagcgcctctccgcgatccaaacctcccgggaaattcttggttgatctcttcctcctcgaccgcctcccaggttcttggtgtagcttttgccactctcaccaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccactgtccagggtctgaagaaggagttcaactacagcaagatcctcaaagacctcaagaaaaagttttgctgcaatggtacagttg

SEQ ID NO: 54656 - DNA, 376 bp, Triticum aestivum
  Clone ID: PAT_TA_54656
accatcccagccccggggcgctcacagcgctaaatttcgactccccgcctacgccgccgcagccgcctcctgctacccgccgccgagatgacgaagcgcaccaagaaggccggaatcgtcgggaagtatggtaccaggtatggtgccagtttgcgtaagcagatcaagaagatggaggtgtctcagcactccaagtacttctgtgaattctgtgggaagtttgctgtgaagaggaaagctgttggaatttggggatgcaaggactgtggcaaggtcaaggctggcggcgcctataccatgaacactgctagtgcagtcaccgtcaggagcacgatccgtcgcttgagggagcagaccgaagcatgattgccctact

SEQ ID NO: 54657 - DNA, 541 bp, Triticum aestivum
  Clone ID: PAT_TA_54657
tgcactgcattctatatctatctgtgccaagcatacttgtctttctatatctgtagtttctcacatacatacatacatatagtctatctctagtttagatgccattcatcattgaagcattgctttatttaggcaaacagatcattaaatgtcttactgcattttttccagagcgtgcctcgtccctctgttccaaggtgcagcaaacctcgccgtgtggacctgtattactctagctggtgcatccgtccagttgaatcaagaaacggtgatggggcaatgacggcatgcgaggtgctcctgtttcatcacgaagacatgggtatcccatggagcatcgcgaagctcggcgtgcagcagggtatgtggggctgcgtcaaacggatcgagcctggcctacgggcataccagaccgcaagggcctccggtgagcccatctcgaaatgcgctgcaatggcacatgccaacacaaagtttgtcgccgacgagctcaccgcttcagagaacaacaccgaggccggttcgaccagcaacaacgccc

SEQ ID NO: 54658 - DNA, 567 bp, Triticum aestivum
  Clone ID: PAT_TA_54658
cccgggtctccatctcgaccgttgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgctactgctaccgcgtcgccgacgaggcgcagggtaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatccccgaggtgctgaccaaggccgggctgatcaacgcgccgcagtggtacgacgccggcaagtcggagtacttcgcgtcgtcgtcgacgctgttcgtgatcgagttcatcctgtttcactacctggaagatccggcggtggcaggacatcaagaacccccggcagcggtaaaccaggga

SEQ ID NO: 54659 - DNA, 495 bp, Triticum aestivum
  unsure (1)..(495): unsure at all n locations
  Clone ID: PAT_TA_54659
tctccccgcgtccgccccgcgtccggccgctctcgccatacgcggcgtacgaagatttgaagccgccatcgtccccaacacccagctttagcagcggcaccaccggtcaggcggtgaaggagtcgcctcctgcaccggcaccggctcttagctgctccggctcctcctcctccggctgctcctgctgcttctgcaaagccacggccgctctcaccttacgcggcgtacgaggggctgaagccaccgtcttccccgacacccagcaggagcagcngcaagaaaaacgatgacggngattctccatcggcgncgnccactgccgcctctccgggggcngnncccagcaccactgccgaggcggnggcaggcccgacccctctttgccggtttgttgggttttccaaacgcccaaggggggttttccgggccccccggccgggcccccccttggtgggtccccggggggggccccccttttttttccccttttccccc

SEQ ID NO: 54660 - DNA, 352 bp, Triticum aestivum
  Clone ID: PAT_TA_54660
gtcgtaatgagaactgacgctggaagatctgcaaattaacaatacgaagggacgcatgggttgctatagtactgattttaggactgagatctaggtgtagctgagcattggcacggacgggatgttcgcttctaacacggaactagaggggcatgctgctcactgggcaggatggccatccttttggtatctcataatataatatgtacataaacattggctggcaactgaagagtgtgtgataacattaattggaccaatggaatgtagatgtggtacataattgtgtattgtgtgaaatcatacagaatctgtcgggcatcacagtagattaaagctggctgaattatct

SEQ ID NO: 54661 - DNA, 525 bp, Triticum aestivum
  Clone ID: PAT_TA_54661
tgtatgatggcaatcttcctgaacaagttccctctagcacacattctactctggatgcagcattcattcttgggccggatgccgcgcttcaaccaaatgaaaaccagttgcagtacaggatcaacaatatcactgaaccatctcaccagaatgagtatattcatggtgatcagagcacagttaacacacattattaccaaggagaaagtattctaccagttggtcagcagcaacctacaattttcactggatcaggtcaagtgaacatccatagccagatgcaagctcccatgtccatggatggcggaagtgtcatgcaggcatcaacctctgttcagcacaaccttctgtcacaacaatttgctcctactcaagtccaagaaagtatgcatgggatccattactctgagaatccacctaaccatgccgttggaccatcgacatggcacgatgatattatccctgcacgggagcctagtgccaatctatttcccggaccggattatgggaacttctagcaagcga

SEQ ID NO: 54662 - DNA, 527 bp, Triticum aestivum
  Clone ID: PAT_TA_54662
ccccgcgtccgccccgcgtccgccccgcgtccgcccacgcgtccgctcaaagtacccgcacatcaagggggtaaacttcgatctcccgcatgtcatatccgaggcgccgccctaccctggcgtgcagcacatcgccggtgacatgttcaagaaggtgccctccggcgatgctatcctcctgaagtggatcctccacaactggaccgacgattactgtatgactcttctgaggaactgctacgatgcgttgcccatgaatggcaaggtggtcatcgtggagggcatcctgccggtgaaaccagatgcaatgcccagcacgcagacgatgttccaggtcgacatgatgatgctgctgcacaccgcaggcggcaaggagagggaactgagcgaatttgaagagctagcgaagggcgctgggttcagcacagtcaagaccagctacatctacagcaccgcatgggtcattgagttcgtcaaatagatcactctaatattttcttgcttctgctcctagtatcggaatatgt

SEQ ID NO: 54663 - DNA, 451 bp, Triticum aestivum
  unsure (1)..(451): unsure at all n locations
  Clone ID: PAT_TA_54663
cccgggtttttcccacgcgtctttcgtcaaaccatggcgtccattgaccggcgnctgtcgcagggcgtgcgnntctcccaggcccgaccggnncaggcgcgccagcaggttcactcgtgaggggcgtnncgtcggcggagggcggagggccgcctggccgccgcgccggtccttggntctcatggttcttttggnnagtcgtcggcaggcgcgttgtgctgcagggtggtgcnnacgccggcacnncgtcgcggccattcaagggtttggcccacgcgcgcgccgctctttccggtggacttcccnncggcacggacaacttttccgacgaggcaaggggactttcgaccttgccccttgaagaaaaccggttctacctttgcagccgcttgcccaccggccggagggcgggcgggtccccgggcccaagggagttcgggccccagggaca

SEQ ID NO: 54664 - DNA, 413 bp, Triticum aestivum
  Clone ID: PAT_TA_54664
cgctgttcgcggcgacgggcgtggccatacggcatctgcgcctttagcctacttcgcaacatcaccggcaaccacagagggagggtcaacaagatggggagggcagcgtaagtgatcgggaaccatgaggagggcaggcactacgcacgagcacggactcagaagcctatgtgcgggagcaagacccccgagatcatgccgggcaatcaacaatatatgaaccagcctaaaatgaactactttagtatgtctgagacttgcaattaggaactgtagaggtaaagagcaaacctatttcaagcattcagtaatgtggtagagcccataattcacaggacatagtcaattacctcttattgaaagaaccatgtgatgtttgatggcttgctatatatgtgatggttgatggcttc

SEQ ID NO: 54665 - DNA, 554 bp, Triticum aestivum
  unsure (1)..(554): unsure at all n locations
  Clone ID: PAT_TA_54665
ccgggtncgnacccacgccgtcccgttcacatnnctttttcccttctcctnnctctggcgtnactggggcacaggggaaccctgcttnncttttttncttcttttggtttcttcccttccgtnnctccgtgnacccagcaatgcggcccttggnagnaccactgcctcagnagggctggggggccctnnngcacgcgnnnccccaggnnctggcnnnatcagggnaaccggcttnnnagcagtggnaaggctaccgcgcccnnatcccggccaagggaccccgccgcccnnccgccgttgtnnctcgcccgtccccactaccaagtcccgctctttggtggcggcaccggcgnngccgtctcgcttttcgtctgcaagtgcccaagaacccgtcgtcgaccgaagtggacttggtggccttgacgagnaagnacacttgggatacacactggntagactcgcgtgaacagagtcnngccggtgccctggtggnagttaacatgggcgccccgtgagatgcgggccctgatgccggnatgnacttgnnccccggt

SEQ ID NO: 54666 - DNA, 161 bp, Triticum aestivum
  Clone ID: PAT_TA_54666
attaaatgtgagtaatgattatgtgccttttacggctcaggtagtgtagatatattcgagatatcaagaccagttttgtggagtgaaaattattaaataaacatgtgcctttggttggtaccagctaccagactggttttccatcagctacattgcaattc

SEQ ID NO: 54667 - DNA, 375 bp, Triticum aestivum
  Clone ID: PAT_TA_54667
ggaacggctgcacagggagggctttatttgataccggttgaccccgcccaaggggcaatgggaggggatttatacaaatgttacaaacatacattttggacaaaaaagaggcaagctttggcataaccccataaaactgcctggaaggcctgggcaaactgcaaccacacggggcttttttttaaatcctggaaccccccgggccccccgggaaacattaccctaacgggcgccggggccgtcgccgtcccaagggagtaaaggttgcaccccaaccccccctggatttttgtggcaaccggggcgaagccccgcgtgtactgggtcggggtaatccccgttgccggcaggccctccttcggggccgagggggaa

SEQ ID NO: 54668 - DNA, 530 bp, Triticum aestivum
  Clone ID: PAT_TA_54668
gactattggtcactcaagcggtccttggaccatatcaaaaaacatgccttcgggggggcaaacaaaccatgtgctatacggccatctcttaccttaaatcgggaggctaccggagacaatacagaccgaatgggtggttaaagggccctataaactgcatcaaggtactgctggcctacctttttggggaattatgcttatttgacgaataatctgcgggatagtgcatactttattcaaatataatgttttatgatctattataaggcctgggcttgtaatcattttcttacaaactggcatactctgttggccttgctcctcagaaataacgcatgctattcccgagaacctgtttcaaagccttgattaatggcctgccccggtaactgacatggaattttgccttggccaaaggcccctcagcgtgaaattctccccattggacagtgatattggatgtcaggaatgatctttactagatcaaccaacaaccctgaacggtcagcttgattcacaacgaaggaaac

SEQ ID NO: 54669 - DNA, 518 bp, Triticum aestivum
  Clone ID: PAT_TA_54669
agaagtcgtgcttaattataagcctatatatctactagcagttcttgtactaataatacatgtgcttccacaatgatgaaccgtgaaaagcacaaaacaaaacccatcgggacagatgatatatactgatgaaacaatctctacaccctttatagcctccgcttcaactaatgtacatataccagtacgtcacattccttagccctcagtcgattaagaacgcatcacacgaactgtcttcgagtctcggcctttcagctcggaccacatgacctgatggaccgtcgactcaacccgacagggtctggatgatggtgttgtgccatgggtcggacaggtgctgcagcaggttgtcgaagggccccttgccggtgacgttgtgctggatcaggaaggccaggaacgccagcatggccagcctcccgttggcgagctccttctccttggcctcgagcgtgggcgcgaagttgagcgggttgaagacgctgccggggtagccgcactcgtgcggcggcagg

SEQ ID NO: 54670 - DNA, 555 bp, Triticum aestivum
  unsure (1)..(555): unsure at all n locations
  Clone ID: PAT_TA_54670
ttgtattgcnnaaatatggtacagtgtgaaaaaaatatnnaacaaatcacaataagaagatnntgttcttgtaatcgaaacatnnaagcgatgaattgcgttatnntccgttgtacactttattnctatatacctataatatnncactatttgggaaacgcgagcgagtattatacaccaggagggtggnccactcatttgtgcccggcgcctggtagctttcaaaccttttcatagnntaattaatgggnntttacgcagactgnnttgagcagcttttgtctattggnnggtctgcgtgtnnctccgacgaaggtggggttgtaaccatcnnncagcttcttgtacatntgcaatccatttgacccgtgcaaggtttcactttacacngttgtcagcactttcaacacggccaccgtgtgtatttatgtgaaggaacctcctccgtgtgagtgctccttccacttgcgtcctctcacaagggcgggccttaatggctttccttttgctttgatccaacgggtgacacacatggcttctttggattattagcaa

SEQ ID NO: 54671 - DNA, 445 bp, Triticum aestivum
  Clone ID: PAT_TA_54671
ggaccaggcgatctttatggggaatcatttattagggggggatcaaataggaaaaaagggatccattacaggggaggctaagggcagcgggaaagggaagctcaaaagtccatattccgatcctgggggcagaagcaagaaaaattagggggatctattgggcgaactcaaggacccaggcggggctgaaaatgtagctggtcttgacggggctgaacccagggcccttcgctagcttttaaaattggctaagttccctttccttgccgcctggggggggcagcaacataataatggggaccgggaacatcgtcggggggcggggcattgcattgggtttcaccggggggaggccctccacgaggaccaccttgccattcaggggcaacgcatcgtagcagttcctcaaaagatcatacagtaatcgtcggcccagtgggggggg

SEQ ID NO: 54672 - DNA, 507 bp, Triticum aestivum
  Clone ID: PAT_TA_54672
aaacccattatccattgagacgcataaaaaatgcgcgtggcacaaaaatcctacaccgtggtgttgagttgaccaaccgaagtcgcatcatgccacgaccgagcgaggaccgcaaaaaaaagggggcaagaaacgacgcacttatactatacttattactcgcatgttggtggataaaaatctttggtagtgtcgaatataactgacacaacagtcttatgcactggagataatacaaacatgatgaacaccggggcagaaggcgactccacttactcttagtctcgattgagtaagggagcagatgaggtccaaggtgtacggcctgaccaccgagagcttggatatgctggacaactgacccttgaccgagggcacaaaccgggacacacattcagcgcacgaaacatccttatgcctaatgttgatatgtgacgtaagtggccccacagtatacaaacaagtttctaaaggaaccctttagatggtgggcattcttcctgactt

SEQ ID NO: 54673 - DNA, 526 bp, Triticum aestivum
  Clone ID: PAT_TA_54673
gcgagcaccaaggatttgaaccctgatggaccggagaatcattgtcgtcctaaatatccaagtatccaaaccataggttggttcacacaatatctcagttttgctgtcacgttgatttatgtatcgcgttcatccatgtgaatctcggtactattcttcggagatcggagtataactcagtgctgctgctacgagcactactactagtattgtgctacagagttcttataacaaaggaaaggccataatcaatcgatgcaagctatcctaacagtgtgtactgggctaatatcatgatcgaggtgttctaggagctattagttggcagtggtctgatcctccgtcttcctgttgatggtgatcccctgatccctcctcgtcggcggcaggcgttccttctcctcctccacctgctccagcagcacctgcagctccgcctccgacaggctctccagccgtttctccatgacttgcttctcgtagttcctgagctgcgtggcgtaggtcatgtccttgttggccaccc

SEQ ID NO: 54674 - DNA, 393 bp, Triticum aestivum
  Clone ID: PAT_TA_54674
acccaaaagcggggggggaaaaaaaggattctcggggtttcccccccatttgggtaaaggaaaattggggggaaaaaaagggggggggggaccctggaatttggttcatggggggttggaacacgggttcctttgaaatttatgggggggctccctggcctttccggggggggggcccgtacccccgggagggtataagggggggaaaagggaagaagattggggggttcccaccagggctttttttgtgggggggggggggggcccccaaaaagcccccgaagcattttgttggggttgaaaatataggaaaccaagggtgggggcgaccctgggtgtcccccccggatattttggggggcgggggttcttgggggtgtatccattttttct

SEQ ID NO: 54675 - DNA, 401 bp, Triticum aestivum
  unsure (1)..(401): unsure at all n locations
  Clone ID: PAT_TA_54675
ccgggnncgaacccacgcccgtccgggccggnagccacacgnaccacaagggaaggggagctaagnctagcaccgnacaaacaacacttttgctgccgnncccgannnggcaagcaccaacatgggcgnnncggccaccttccagaatncattgctggancggcggtgcattccccagtcggcaccaacggtcggctgtgtagcagctcgcgntcagacttcgtaccccttccaacgcggcttgggcttagaagcgtcgtggacccgtcgccgaggtaggagcgcgactgtccgccgcgctcggcggaagccatgcaccggccgcggtaggaagaaacctggaaggtcgccgtgngccatccaaagagcaccgtccaaagcgcaagaccgctcgccgtagg

SEQ ID NO: 54676 - DNA, 336 bp, Triticum aestivum
  Clone ID: PAT_TA_54676
cgagcgcgagcacggacccttggactgggggcgcttgctaataagcgacgaacctgagcactccctacctcattgccctatatcgcaggcaactgttgcccaagagcgcgctatacctgcgcacattgtgcactccactggtgcccacgctcatcaacaaaggctcgaattctttctggctgaacttagatgcaacggacttgacactggtgatcgcatcatgctgggagagagatgaccgtgtgccttcaggaggaggacgccattgctgcaggagctataggtgctacatgtgatggaccctccggacctgctgctgaacctaaatatgtgcag

SEQ ID NO: 54677 - DNA, 99 bp, Triticum aestivum
  Clone ID: PAT_TA_54677
cgtactgcctgcacttgtaccgtacctctttattttccttgcatttctgtggctgcacaacgcaggtttgtgtaagaaagctaaccattgtgtgtcgct

SEQ ID NO: 54678 - DNA, 354 bp, Triticum aestivum
  Clone ID: PAT_TA_54678
ccgtcgacccaaactacagtctatgcagtcaaagtggggccgcggacacgaagtactggctgcggcaggcgaaggaaatcccgacgctggaactgacgtcgcacggggagctgccacttccagcggagcccctacgtggtcatctcccccgtcaacttgcagaaggcgatgcgcggccttgcaataacagatgcagatcactatgggaggcttgcaattaccagataagcgtaaagactagaggccaaagctgaatatgagaaaaggtaagaacaacaaaacaaacagggactgcaacaagaggaaatcagccaggaacatgacctattgaaggaatcttttacaatattatca

SEQ ID NO: 54679 - DNA, 557 bp, Triticum aestivum
  unsure (1)..(557): unsure at all n locations
  Clone ID: PAT_TA_54679
tcttactagttctagnanncgcgagccggccgtccctttgttttttttttatttgtnntctggcaaactggcagatttatttcagnaattaaaannnaaccggcacnnatcgaacccatgtcctagnncaaatatttnntaatttcacaactnntaagttacagtnnnctgcgaaatggcataagttcattaaatnntattaagaaacaagacatgaggtgttacannttctaccacnagtgcctctccnnnaactgaggaacaangcggtgggagcaaagctttcacagaaaaacanccagaaaatacctcggaactacaataatacangattatanaaaaatcagttttcatatttcagcaacacccatccgcctagtgcaagtggttcgacgatgtccttccatgctgcaattcttgcacttcccaggcctccgcggttttttgggtgcatcccctctttcaggacacgtagtccgcttctttggtgatgttagcccatacagagcattcacaccgacagagttcctagtgctaatgcattttttggcaatttc

SEQ ID NO: 54680 - DNA, 541 bp, Triticum aestivum
  unsure (1)..(541): unsure at all n locations
  Clone ID: PAT_TA_54680
cataaacaagtataattccaatcagaaaactcgtacaatcatgatgcatgtaattgtctaaacataaaccggcttactgtagcaatttctgcagcaccgtttgcctatagtacaagcctagtcatcattagtttacaaaaggggaaataacaacacccattattatgagctcagcaaacatatctagcggggcaaactagcagatgacatgaactctctctccaagctatagcgttgttggctgtcttctggccgtacgtagactctcttgcccaattccgtcgcagacgattggcgagcagctctagatctttgagttaacgaacttggttgcctctgttcttcattcctggtatctacctgagatgagtccatctgttttgcccatagagtttgcagttccgtctccacctgtttcatggtgggtctttcttcaccactcagtcttaagcaccgctctgcaagagaggcgacaccgttgatctcttcctcggttgcttcctcgaggacctgngagttaacaataccttntattcttccc

SEQ ID NO: 54681 - DNA, 428 bp, Triticum aestivum
  Clone ID: PAT_TA_54681
atagaaacaacacacttacaactccggaactctatgtgtaccttgtaccaggctaaaagccactggcgcttggtacatacattgatccaggcgctgttgagggatgacacacacaatatatactaggggtaccgcgggaacaggcgcaagcacattggctgtttacttggctgacggcagcctagggattatgcttttcagagtcggttcgatggttctgcaccttttttggctgaagaacaagctccgttgctccactggattgaacagctggagctccatcggcactgttacccacaaaggtacgcacatctgatgactcatcttttccagacgcaccttgttgtgtgaaaaccctgcctttgaggtcacgcacagagaactcatgcttttcttctccatgctatagaccaactgacaccatgatg

SEQ ID NO: 54682 - DNA, 100 bp, Triticum aestivum
  Clone ID: PAT_TA_54682
agcgacacacaatggttagctttcttacacaaacctgcgttgtgcagccacagaaatgcaagggaaaataaagaggtacggtacaagtgcaggcagtacg

SEQ ID NO: 54683 - DNA, 271 bp, Triticum aestivum
  Clone ID: PAT_TA_54683
aaaacaaaggcgacaggattggataaaatattatgggcatgggcatatacatagccaccggttggattcacatacaaacaccctttttcgagccatgttgttacatgaacatgggcatacacatattcttaggaacaaggaaaaaagacaaatggggaaggaaaacccaaagcaatggcagagttgacaaaactgcaatggcactttatatgtggcccggggggagggagctgtttaggccttgccggactcctcgcaacccgggggtttg

SEQ ID NO: 54684 - DNA, 445 bp, Triticum aestivum
  Clone ID: PAT_TA_54684
cccgaaaggaacattttggggtttttataaaaaaaaaccccctccgggggggggggaataacccgccccaaaaattggggggggggggggtccaaaaatcccaattttaaaaaaaaactacaaggctcaaaaaaaaatttacccctaaaaaaagagggaaactttttggcaaaaggcccacaacagtttaataaaaattgcggggcccccccttgggggggggtaaaaaaaaaccaacccgggacaaaaatggaagggaaagggatgctttattttgggggcccccctccttttttttttttccttttccccccccgccttcacctggaaaaaaaaacctcccatttgtttggcctccccaaaaacggggccactcggggccccctttttaaccccccttttttgttcaagggcctttggtcccttttctccaaaccccctcccc

SEQ ID NO: 54685 - DNA, 385 bp, Triticum aestivum
  Clone ID: PAT_TA_54685
agcaaaaagggagacaagaaagcaaaggtacaggggagtgacgaacgacagatcagggcttattctagcatgcgtgggctcagatatggagctagcttcgtttaattgagaacctaggtggggtcgcgaatctagggggggacaaatcctgagtcccgaaggctcttttgcgcgtactaaatgagcccgtaccaccttgccgtagtgcacgtagccgtagtcgacagcgttcgggtactcgatgccgcacttgcttttgtaccccgagaagcgcgttcggatggtgcgcataaaacaccgcatctcggaggggctgatgcgggcgtcgaggtccacgttgaaccggcggagccactgtttgaactcaggccaccgttaggacacc

SEQ ID NO: 54686 - DNA, 243 bp, Triticum aestivum
  unsure (1)..(243): unsure at all n locations
  Clone ID: PAT_TA_54686
gtctcgccgccgtgtcgcgggcgccgtccgtgcgcgcgcgtcgtgcngatgcgcatctgagtgcgccgtgcgtacgtacgtgtgtgtgacatgcgnctcaacggtgttcgagnatccggcgtgtacaaggtacgcgtatgtgtgtgtctccacnncgcgcccattcgaggtacatggtggcgtgcgtcgacnngccacccgcttccggctttccttccatgctttttcaaggtacatcgcagg

SEQ ID NO: 54687 - DNA, 131 bp, Triticum aestivum
  unsure (1)..(131): unsure at all n locations
  Clone ID: PAT_TA_54687
tcgcgatctagnaactagtcacataaacgaccatctgccgtcaaagttatcattgttcttctcctctctcctcctgatgatattgaaatcacctccaactaaaattggaagctgttcagacccacaaattc

SEQ ID NO: 54688 - DNA, 562 bp, Triticum aestivum
  Clone ID: PAT_TA_54688
ccccgcgtccgttctcttcctccaacaccatggcccccactgtgatggcttcctcggccacctccgtcgcacccttccaggtctcaagtcgaccgccggcctgcccgtcagccgccgctccagcagcgccggcctcagcagcgtcagcaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctacgccaggtgcagtgcgtcagcttcattgccttcaggccaccgggttgcgaggagtctggcaaggcctaaactacg

SEQ ID NO: 54689 - DNA, 543 bp, Triticum aestivum
  Clone ID: PAT_TA_54689
caacgaccaacgaatgctgcactgcagcgcgcgacgggaacggacgggagatataaaacgtcaggcacatggggcagcatgcgctggacaaagagatcccggcgatgaagggacccaaggagcgcaccaacgtgaagactctcctgacgtagtccaactggaacaacacaccgaccacgcggtgaaccgttacatggataacaacatccagaccaggtcggttgaccctttcttccacgtgtgcttcggcggcatggccttctacaacttcgcggtgcatgacaaagagcggctgctcctttaacacatcgaggataacgtggcgcactatatatcgaatgcgtccctcacaagatagcttatgtacgattgataaaggatggctgctatacactttatttgtaatgactgtctaactatatgtaatggctatttgactgatggaccatattgtgtcctaaggcagcttaaaactatcgtattcactgttacttttctacaaaagatcggataatcatcttgaaactgggataccctgcattg

SEQ ID NO: 54690 - DNA, 386 bp, Triticum aestivum
  Clone ID: PAT_TA_54690
aacgccaccgcctggggaaaacattcaccggcacctttctgtgctgaatagcatccccacaccgagtaacggaacaggggaggcacgacatagtacttcttctagcggcttctatgagctaataacactcacgtctttgctttaccattgctgatagcataacagagtagcacgtgcgcagatctagagtaggtgacaccactcggtggccttatgattgtgcttgactgagctgtgcagcggttaccctgcctcttacttgtgccgagcgatgggtgcccttgattgttgtctactgaaccagtgaccaaccgaattctcactacaacgataagtgtactgtactgagacatttgctgggccttcctgatgctgttcaacacctt

SEQ ID NO: 54691 - DNA, 159 bp, Triticum aestivum
  Clone ID: PAT_TA_54691
gcgttcggccaagcctgctgcgcgatgcgtgtcccaatgtcacaatctgacatgccttagaggactgtgcatgctactgggtcggcacgccgcatgatcgctgaggtgtaaataacgtctttcatgctaagcacaaaactgatttcaacataccgtact

SEQ ID NO: 54692 - DNA, 444 bp, Triticum aestivum
  Clone ID: PAT_TA_54692
ggcacccacgcatgagcacgccaggccgccaccgagtacttggccgccgtctaggggcccctgatcgtcgatcccctcaagaatgccgttgctgtccggcccgtgccggggggcacagccgggagctccgccgtgaggatgacggacgaccgggcgtactgcgaatacctgcaagacaagctcacggacggactgaccgagctggccgtgcacgttgcactcgtgctgaccgaggatgtggaggccgagtccccgggcctgaccaccgcattcaataccttcctgcgcaggatatggtccggtgatgtcaaatgatacggcgtctacctatccggcgaagacaaatacaactacttatccattcgagactacctgattatattactggattgtaaactgatgttgctttattgcgaacataacagaatatttctgatgtgcgct

SEQ ID NO: 54693 - DNA, 196 bp, Triticum aestivum
  Clone ID: PAT_TA_54693
catgccacgtgtattgattttactttgctctcgaccttcttgccgatatgtggtctcacagtgttgtgtacatcactactatggcacaacagctggcttctgccactggcagttgagcctttgcttggaccctccttgcctcttttgctgcggccatctatgtcctctctgctaggggcaacctcttcatcatgtg

SEQ ID NO: 54694 - DNA, 310 bp, Triticum aestivum
  Clone ID: PAT_TA_54694
gtgctacaggaccccttccatgcagccatcccagtcccgcatccaagacagcatgctcggagaggcgggcgcttcccctgagcaggaaaacagcaaggggtgatgattgcggtgcggccgaccctgatgctgactaggggcaacatgtccatacccaagaccgacgccctaaccttgacactgatgctcaaccgctcttgcacattactgctcccatttctacattctcactaaatatgggaatcaagttccatcttcccgcaaagatccctaaaagctctaggttgagcaaatacacgacacctatacc

SEQ ID NO: 54695 - DNA, 125 bp, Triticum aestivum
  unsure (1)..(125): unsure at all n locations
  Clone ID: PAT_TA_54695
cggcttcccgggtcgcccagcgtcctgccagcttattcatgcacggcaggtgcaatagatgattcttgggtctcttcactcgacagcacagctanaagaacttatgagcactaatggaacaaact

SEQ ID NO: 54696 - DNA, 518 bp, Triticum aestivum
  unsure (1)..(518): unsure at all n locations
  Clone ID: PAT_TA_54696
ggcggggagagaaatcgtcaatccgcagcaccatgctctacggcggcatctacgggtaccccagcgaccagaagagcaagaacggcaagctgcggctgctctacgagtgcgcgcccatgagcttcatcgccgagcaggccggcggcaaaggctccgacggccaccagagggtactcgacatcatgcccacagaggtccatcagagagtgcctctgtacgtcgggagcgtggaggaagtggagaaggtggagaaattcttgtcttcagagtagaacaagaacgagggatacacatgctgtttcttccaagaaattattgtaactaatatataataatgtagcccttttcttgtaatgcggaaaatatatttgaagaattccaattggattgtgaggtcaaggcgtgtcanttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggg

SEQ ID NO: 54697 - DNA, 557 bp, Triticum aestivum
  Clone ID: PAT_TA_54697
gcgatctagaaaccgcgagcgggcgccttttttttttttttttttttttagtcgacagattgtataaatatattatgtgcatgtgcatatacatagccaccgattgcattcacatacgagcatgctttctcgagacatgttggtacatgaacatggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacgtacgcgtcagggtactccttcttgacctcttccacctcgttgatcacctgtgtggcgtcggtgcacccgaacataggcagcttccacattgtccagtaccggccatcgtagtacccaggggatgcgttgtgctcacggaagatgaacccaaccttgctgaactcgaggcaaggcacccatttgg

SEQ ID NO: 54698 - DNA, 304 bp, Triticum aestivum
  Clone ID: PAT_TA_54698
gacacaaaaacaagggtatgatactgcaaaacacttgtactgctagtccattggcaaaagtgtttaatgacaatcgtcatgcactcacaaacagaagttgtttatgacaagacgcggcgggaactcaacaatggactagcacagggcagggctgtacttgggacacaaaagaaaccagccattacatatacatgaactggcagttacacctataagtttgaagaaagagactgacaagcaccatcgctgaatcaaccaggctataaactctaactagcgcggtggcggcatcacggaactagta

SEQ ID NO: 54699 - DNA, 533 bp, Triticum aestivum
  Clone ID: PAT_TA_54699
aaaactatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagaatgcgttgtgctcacggaagatgaacccaaccttgctgaactcgaggcaaggcacccacttggagcggatcaagtagtcg

SEQ ID NO: 54700 - DNA, 465 bp, Triticum aestivum
  Clone ID: PAT_TA_54700
acgcgcaaaaaccagggggtttcctaaaaacattcgggtggggattatacgggcaggtctaaaaccaattatggggatcaccatattggggtttcgacattttggtgggggattcggggggaaacttacttttaaataggaggcagaggtcgatcaaaggggggcatgaaaaatatgacactggggagggcatctgccatggatggagggatgcttggctgttttttttatttttctcctctttggtccggggggggggctcccttggcggaggggggggactttcttatcccaaacccctgggaggggaagcacttccattttttgaagatgggggcggtctttttggtcctggctggccccttggagcctttggattccactggacccttccccctggatgttttggagcctgaagccaccagtttcgccccggacttggacgccatgggcggaagcatcctg

SEQ ID NO: 54701 - DNA, 104 bp, Triticum aestivum
  Clone ID: PAT_TA_54701
caggagaaaaaccaactttatcacaagaacaagcataagattctcccaggcgggcagataatttaaaagctcagacaattaaccattgtaccataatagcattc

SEQ ID NO: 54702 - DNA, 312 bp, Triticum aestivum
  Clone ID: PAT_TA_54702
gaaactgaatctttcgaggccatttattgtgttgaaaacacttgcatttgtgcttcaattttttcctaacatgttcgccctggctaacttgaattcctggtccgccactggttattagtcatgactagaccatgatggtgcgcattgccgcacccatcaattttggcagtagaatggttggaatttgtatatactccctatgttccataatatttatcgctggaggttctgttccgactaggtgaaatggtgtgaaagtacgaaagtaccctcgatttgaaatcgatcgggaggcgtcttcctccgtcgctc

SEQ ID NO: 54703 - DNA, 355 bp, Triticum aestivum
  Clone ID: PAT_TA_54703
aaagtcaaaaagaggattcaattatgtacatgggttgcaccagcacaggacaagtacacataccaacggggaaaaagggttggagaatttcatggagtactagcacggcttcgcacatagcgaaagagagaatatacaggtctagcagcaatattttacactgtggctttacacttcgcatattagtatatgactgcgaccatccatcttacctaggggaataggccatgaaggaacacgcccttgtcaatgctctcgatgagatcctaatagttgttcatcgggccgggtctctcaaactattcatggaaccacagcagggcataatctccagcattgcaaggcgacctaacct

SEQ ID NO: 54704 - DNA, 531 bp, Triticum aestivum
  Clone ID: PAT_TA_54704
cggcccgccctttttctttttctttttcttttatttttttttttttatttttttttttttttttttttttttttttttttttttttttttttttttaggtgaaaaatttacagggggcatttgctcaatgagtcttaaggacagccgttttttaaaggacgagcactactttggaaaaatgggatttggttaccctcctggaaatcaatctgtaaacccaaagtcggttttttgccgccggccatgccgaacgcggtcggccttaaacggaaagaacgctgctcctgagttggcgtgcgacctccttggcgacggggaggcaaaaaaaaaaccagccgaggagggccgcccgaaccgttgccgccagccgcgccttcattcttcacgggaccattggattcaaaaacaccacaaccttgtttttgaaagcagtttccttgatgagccaaaacctttttcctggctgcttttaaggagcatgaatcttcaccatccttttgatcttggagtaacggaacctcgtaggggttg

SEQ ID NO: 54705 - DNA, 183 bp, Triticum aestivum
  Clone ID: PAT_TA_54705
gtggtcactatacaacgcgcacaccttcgggcttggcgaggacgagagtactgcggccttgcgctttaatggcggcatgagagactacccccttgatgtaatccgctggctagcataggcttgatcggcgttgagtgaatgcaggaatggacattggaaacaaagcctttccattcaaaacag

SEQ ID NO: 54706 - DNA, 570 bp, Triticum aestivum
  Clone ID: PAT_TA_54706
gcgttcggtgggaagactttgacgccgcatgtcggttccaacaaccgtagctcttcggtttcatagttgtatgcggtgtacctgcaaagcagccgcccatgtgaagctagtcatggtgagcaccaccacaacagcgggggaaccgtaaggtgctgccggcgataacaaacggcgctcgttgacgaacgccggtgctgcaacgcaccaacgcgtagacggccaccagtatgcgacacaacaacttgtccacgggcatcacgatgcgttgcaacctcttccgtgatgcaatgtaacctcgtgtgccgatgcagtactcgagcaactgcggcggtgagctgctcgtgcgcacgcgacgtgagctgcaatggagcgctctacgccgacgacagagctacaatggacctgctggacgcaggcagcggagctgcaatggagctgcttgacacaggctgcggagctgcaatggagctgcttgggacagccggtggagctgcaatggggcttggtgcagcgtcgccagcgccttttggggcgagcccattgtagtgaagcactgctgccacgcctggt

SEQ ID NO: 54707 - DNA, 482 bp, Triticum aestivum
  unsure (1)..(482): unsure at all n locations
  Clone ID: PAT_TA_54707
agtccaccgctggagcttcatgtcagccggcggtcaaacggagctaggctcagcaggggtagccacgctggaaggatcatgtgcatgcaaacggggcccattgagggattaaagaagaatgagaccctggcatacttgccaccgattatcacggtggccctcgttaagacatgtagactagcgctgaaacgggtacaagtaggnggctctttggctagagcatcatgcaaggtttgtcatcgcatcattacaccgatcacaacgcataccctgagatactatgatggcacggtgctgccacaatgtggtaagctacctatgtttgggtgcgccggcgactcacaagtgatcagaatgtgaaggacgtcaagaaagactaccctgactcgtataatcacatcatacgaatacacaccatgcaccaggtgacagtacgttacattcattgtcttaaagccacctgactgctacaagcccggcaa

SEQ ID NO: 54708 - DNA, 250 bp, Triticum aestivum
  Clone ID: PAT_TA_54708
aactgcatacctctattgtcagggcacctaacgccatttcactggccgaccgtctacaccgctataactggaaaaaccctgtagcatcccaatttaatcttctagcagaacattcgcctttcttgaggttgagtattatggattatgccctgatggttcgttcttgccaacagtttctcagactgaatgctgaaggggacctactctgatgcggcgcattaaaccctgaggaagctttggatacgatcat

SEQ ID NO: 54709 - DNA, 351 bp, Triticum aestivum
  unsure (1)..(351): unsure at all n locations
  Clone ID: PAT_TA_54709
tcgcccacttccccntcgcccccggcgtctccagnntcgcagttcttggctgtggnttggtggacggtggcacctnngggtctgttcattcgcgcctcacnncttcggccagnnatcgggttcaaggggcaggnnaccgaggnacnntacttccagnnaagtagtgtaatttatactagcnntttggttcatttgcatgtgcggtcgtggctgtgaggctnngctcaagggctttgcttctgcgcatnngcgtgttcaatggtgaaaatctgtcatnngccttttnnggttttgtgcatttgcgtctggnncttcgcaaggccgtnngtgattccnntgtttgttaatnnt

SEQ ID NO: 54710 - DNA, 555 bp, Triticum aestivum
  Clone ID: PAT_TA_54710
gcgttcgcacagcccgcccattgccggcggcgttgtctccttacccttcaaggccggcacgtacgagtatgaagatttctggctggatcccaccttctttaccgggaaggtcaggggcatgcagaacacgagccggcggccttccagaaaaaccaatctcatgacccgtctcacctacacccttggggagatggaaggcccgctcggaggccagtgccgacggcaccctcaagttcacaggtagaacgactggatcgactacacgggcgtgaccgtgcaactccccggaggcgagcgagtgcccttactcttcaccgtcaagcagctcgtcgctaccggcaagccctatagcttgaacggcccctttctcgtgcccacttacagggttcgtctttcctctacccaaaggccgtggtggctctactggctacgacaacaccgtggcactacccgccggaagcacaagaaacaatgcagagttgcctaaggacaacttgaagaacgcgtcctcgtgcacgggcaacatcacgctcagcgtgaaccaatatcaagccg

SEQ ID NO: 54711 - DNA, 515 bp, Triticum aestivum
  Clone ID: PAT_TA_54711
ttcgatcatccccttatttgcagcaacaaacagctcgtgtctgtagaaacccaggctagctatggcgtccaaaacccagctcttactttacctgctcgttgcattcttcttcttcttccttgtggtttctcaggttgaagctgctagaaaaccagctgatgattacacaggacttccacctattccaccttcctacggcggcataccaccaccagcaccacgaccctaggccggagtttgcatcgtacgatggaggggtttacaattatatacatacatatacatatctgaaaaataatgtctaagtatatatatcgggtacgaccaaacatatacatataaactcctactacaaataaacaatatgtactacatgggtatgtcaacacatgtattgtacctgctatgtatgtacctacatgttaagaaaacatatgtacttctccatattcatgtgtgcctgtcataccggccattaccctggcggcctggcctacggtcatggctatgtataa

SEQ ID NO: 54712 - DNA, 505 bp, Triticum aestivum
  Clone ID: PAT_TA_54712
ggggcgcgcggcctggctctggccagggggggctcgctcgctgtcatttggcgtagctgcctgaacaaaacacaattcgggctttataaggacgcgcacgcgacaagatcttattggccgcctcaaagagctatcgcgggccacggccagcacgtagctacaacgcctgccaacacagagtctacctggtgggaagcacactatgcttctgataacggcgcatatgctgctcctaaacggccacccgaacgagatgcatcaggccgagcgggctctacacatggatcaaggaagtattaccttgctgaaggaaaagaaaattgaccggacatgacctgacagctattagacgctacaacatcggggttgaccatacaactgcagcttgcatgacatgagttgttatgatgctcgttacggataaaatagtccccactcgatctgacaaactatcatatgctcaccctgaatggcgaaatggcacgcgccctgtaacgaggcatta

SEQ ID NO: 54713 - DNA, 594 bp, Triticum aestivum
  Clone ID: PAT_TA_54713
tgtgtcgcgagctggcctgcgttaaactgggaagatccacacatccatagctcttaatattttatccacagggaaaatggcggtcactagcttgagtggcattaagctttacgtttcttcttactgggagtcaccaacggctgacaggtttttatctactccatcctgcactttctggtacagaaactcacctcgctccagtattttgggcagggatttgcattacacctcgacgctgctctgctactgtacatacgtaatcctacgcactcttaatctaatcatggtcactctttggttgctattctacaattattactttcacaaaactgattgcatctactgtaaaaacactgcagactggagtctctagcatggcacgccctgactggatatgctgctgtgattaaatctgactcgatcacaaacggctgcaaacaattaaacacaagcaaactatatgctttctagtattccgaatactggttgctatgcaaggcatacttttgaatggacgaattatacagagctctccatgcccaatatcaaaaattctccttgtcaatccgtgtgatgctatcattatgttaccat

SEQ ID NO: 54714 - DNA, 558 bp, Triticum aestivum
  Clone ID: PAT_TA_54714
gcgttcgtatccattaagtggccttttgattcgaaccttccctaatccggagtagtcgacaggaggccaaagcgccgtcatggcccgtacgaagcagaccgtccgcaagtccaccggcggcaaggcgcccctcaagcagctcgctaccatgcggcagaggaagtctgctccgactaccggtggagtgaagaagccccaccggttcagccctggaccgtggtgctccatgagatccgcatgtccaaaatatacggagctgatgatcctcaagctgactttccagcgcctgctccgtgtagatcgcgcatgacttcaagtacggacctcaggttccaaaaccacgccgttctgtccttacaggaggctaccgaggcgtactttgtgtggctgttccaggacaccaacctgtgctccatacaagccaaacgcgtcatcatcatgcccaacgacatgcagctctcccaccgtatctgttgctagaggtcttaaactgcgccctgctccaacgccgtttgtgagttagaatgacttgattttggttgtagtttgattctaatt

SEQ ID NO: 54715 - DNA, 482 bp, Triticum aestivum
  Clone ID: PAT_TA_54715
ctcgcgtgccttgcatgatatctgtagcgcagcgatacgctttaacgccaacggcgcacgatgcgcacgtcattggggaggctcaaggcggccctgggggcgctctaccttctcgaccgcgaacaccagcaccttgtgccgtaacctgctggccggcgcttctgccacgccccctgtgatgtcagacagatagtcaaacacaaatccaagaggacaaagacacaagctgtgagaacgcaagaagtgtaaagcacacagtcttgctatactagacaagagaacttaaggctcggccacacactccaggtcaaagcacaccgactgaaacgcaaagtagaacaactggtacgagaatacaaacacaaaagaactgcgatactaaaagatctgaacttacattctaatcacatcataacacagaatatgaaacctgtgaaattggtattagtgtaatgcccattcatagataccaacatatatgc

SEQ ID NO: 54716 - DNA, 483 bp, Triticum aestivum
  Clone ID: PAT_TA_54716
atctatactagtgaagcaacgctgagaccaaagtgcatctttggtattacatcacagctactattgcgacgctcgctgagcgggtgcatgaaacaacaaaggaaactagccctttgtactagcgagaggccggccagctcctattgctgccaacggccggaaggggggcacagaatggcagcgtaccagcgtgacgcgacaagtacacccccaacttccacacctacacctgaatgtacaccacatatgaatgtactgaatctggtgacagctacgcctactgatacgacctagctgcttattgggtgaaataccctcgccgtcactactccacacaagatacctgctggaataatacaccatcaatcttgccgggtctaataacatgatactaactaacacaaattccggtgtgttcactgatgcactgtccatgtaatatacatagtctacctcactgtgcaataatgcattcaacaatgc

SEQ ID NO: 54717 - DNA, 406 bp, Triticum aestivum
  Clone ID: PAT_TA_54717
aactaagggccccatctcattttaaaaaaaacaaaaacatatggggggcggtcgcacaaaaaaaaaaatggcctgcaggacacggaaaaaatcgacccaaattcgcaggggcaaaaacagggaattggagctagcttaattgagggggaccttggcgaccatgccggccccgggggggggctcccaaaaaaaaccctaggggcccggcccggggagggggacggaaaaggcctccccgggggcgtaaaggaacccccccggggaaaacttggaaacctccaccccggaggggacgggggccttgaaaaaaaacacggtgggggggaaccccgggttgtttttgaaggggaggggctccccggacttgaccctaaatttggtgggctaaaacaccaaaacccccccg

SEQ ID NO: 54718 - DNA, 416 bp, Triticum aestivum
  Clone ID: PAT_TA_54718
gggaaaaaaaaatttttttttaacccgggggaagggggccaaaattcctttttgttaaaaaccacaggccaggggggaaggaaaaaagtaaacccccaggaccggggggggacaaaaaaaaaggcccccgggggaaacttaagcccaaaaaatgggcctttcgggcccccaaaacccctttcaaaaaaagtttaggggctaaacccttttttaaaaaggttgttttggaaacaaaaaaaaaccccgcggccccccataaaaaaaaccgaaaccctttgaaaaaccaaacgggccctaataaatttttgacccacccaaaaattcccgccccggaaggtgaccagcccagttggaagaaaacccggagggacaaaggccccggggggaacaaaggggtttttgaagggttttttccc

SEQ ID NO: 54719 - DNA, 473 bp, Triticum aestivum
  Clone ID: PAT_TA_54719
aaactattgttgtgtacagccatgtttataataacacgcgtggctgatctgacacgtacaacactccataaaagagagccatggccgactccgagaagaagcaagtctttgcaccccagcttgaacatgacaacacggggtcggactgaccatctactgatccacactttgtccatccttagtaccctaaattacaatgcaaaccacctgaaacctacacggtcgctgaatatcataagtactactggcgctagatggttaagtatcaatcatgccgtgccatgggctggacatgagctgatggaagatttggaacggccccttgtcgagcacgcttttgctgcaccaactaaccccacgaacgccaggattcccagtttaccggtggccagcaactactgcttgccctcgaggggggcgacgaacatgatgaggttgaagaaggtggcggtgaacccctactccatgggagg

SEQ ID NO: 54720 - DNA, 534 bp, Triticum aestivum
  Clone ID: PAT_TA_54720
gtaatgcttaaatcttttaagtaataaagcgccccttttagaaaaaagtactagtgacacacagatccaatgcaactagtcagcctccttctcatagcaatatcatagtgtttggagcacaatggccattattttgattggcacagctttgacgccagaaatattctttggacctttcctgtcaccaacccgataatcaaatttcgggtttcctagctctactcgaaaatgggtagatcaggagccttattcttcgacccaacatctgcatcgtttgaagatgcagagagcgatagcgcagccaaggcctttgcttgagattctttgtccatgtccaagaaaaggcgatgccatctagagtctgatgttagctctgggtggaatgcggtggcaaggatgttcccttgccgtactgcaacaatcacccgatctttagagtacacttggtcctccaaaccctcgccagatgttattgtaatgctgggtctgccagcaggaacagggcaatcggctaatacttcaacatcctggcct

SEQ ID NO: 54721 - DNA, 466 bp, Triticum aestivum
  Clone ID: PAT_TA_54721
atacatagccatgaccgtaggccaggccgccagggtaatggccggtatgacaggcacacatgaatatggagaagtacatatgttttcttaacatggagggacatacatagcaggtacaatacatgtgttgacatacccatgtagtacatattgtttatttggaggaggagtttatatgtatatgtttgggcggacccgatatatatacttaaacattatttttcaaatatgtatatgtatgtatataaatggaaacccctccattgtacgaagcaaactccggcctaaggtcgtggtgctggtggtggtatgcccccctaagaagggggaataggtggaagtcctgtgtaaacatcaactggttttctagcagcttcaacctgagaaaccacaaggaagaagaagaagaatgcaacgagcaggtaaagtaagagctgggttttggacgccatagctagcctgggtt

SEQ ID NO: 54722 - DNA, 547 bp, Triticum aestivum
  Clone ID: PAT_TA_54722
aagaggacgggacaaatgtaattaatcaaataacactgcattaattcttttacaaactataacaatattacaagtggacagtctactacataatcaaaaaactagttgataagaaaggcttcactgatataccacttggatttcacgggtcgacactccaagaaaaattaggcccggagctccttgttttggaaagactaaagagcacttgaaggacttatggtgaccaggagcttattgaccataaggctcatttgctgctgctgatcatactcttactccatctacatagacaaaaccaagttaattatttgcatgggattcacttaataaaactgcatgtatatgtacaactacattacttttttagtatagtacagaacaacagatggatgggcttgagttcaaatgtttgattgcacatgtactacaaatatactcaggcagatgaaaaatcaactacaagcatgaacacgatgagccataacaagctagtaagacactaacttctagagcaaccataatatgaagcaaacaggagaatcac

SEQ ID NO: 54723 - DNA, 510 bp, Triticum aestivum
  Clone ID: PAT_TA_54723
gtcaaaaaaggttactactatcttcattacaaggtccattgcatatgtttcctcagccttcgtattttctgttcccttgtatatagatattgtcaatcatatgactacacaacaagagggggcgtgattcactatccagtcagtacatgatccattgcgtatgtttcctcagcctttgtatttgttgttcccttgaatatctatcctcagtcatgactacacaacaagaggggacgtgattcactagtcgttccattacatgatccatatgtcatacaggaatcgagccaccaataaatgcaactatcgttatgatatttttcagaagttgccgccataaatattcataatcctgaacattctgcaaagtagagctaggaaacaagagaatctttgaagcggtccacaactcaccacccacctcacaatacagcctctaatatggataagttggtgcactagtacaccagagaagatagatcgagaaccaatatatagaagctgcagtga

SEQ ID NO: 54724 - DNA, 511 bp, Triticum aestivum
  unsure (1)..(511): unsure at all n locations
  Clone ID: PAT_TA_54724
gaagtgaaacaaanattcagaactgtatcaaatccagacagatgcaaatagttacaggtggccaaatccaacaatcattcatggtacaatacttccttacgatgcagttcaactgctatacaggcaggtacagtagagagctgaataggtacaacaccagccacagcttatccagaaggggaatttggcatgcatctggtgcgtcgttgggtgatactcctgagctgatatctcggcgtaaaccacgaaggccagctgaagtaagcttcagatacaaagtatcatggcgtatatgtacaaaaagtccatgtgcaagatctaatacacattacataaatgctaccgtactcttgcagccgatgtagatgtagcggtaatcgtgatgcagaatctgttggcagtatccggtaacagtccatcagagttcagatgacaagccggtggacattgcggctctgctggtgagcgcgggcctcattgtcaccagagcggattcgtttgcacctgccct

SEQ ID NO: 54725 - DNA, 471 bp, Triticum aestivum
  unsure (1)..(471): unsure at all n locations
  Clone ID: PAT_TA_54725
gattcatcagccatggtgaagctaccagctagcagcattacttccacttcttgaacttgccgccgccgccgaacatgccgtgcttcccatgcttgccgtgcttgaacttgccgtggccgtgcttcccgtgcttgaacttaccgccgtggtggccgtacccgccgccgtagcctccgtggccgcccgtcatggctacccatctggtggccacgggtaccccccgcagcagcatggataccctcagcaaggctaccctcctcagcatggctacccaccgcagcagcatggctaccctccacagcagcatggctacccccctgctggctaccctggctcatctggtcacagtggtagccatggaggaggaggcatgggcatgggtggcatgctggctggaggagcagcagctgctgccgctgcttacggagcacacaagctttctcacggnggccacggggggagggggacaca

SEQ ID NO: 54726 - DNA, 344 bp, Triticum aestivum
  unsure (1)..(344): unsure at all n locations
  Clone ID: PAT_TA_54726
ccttaccgncggccgcgggcgccatgtttaatcaggagggaaggtcaagccgttcaagctggccaaggtcgcctttttttttttttttgagaatgacctgncatatgtggggggggggaggatnancaaaaggccctgatagagctgaagggcgggggagggcatataggttcgctgggaggatctgtttttaagaagagtgggaagaaatgagtttggccacccttacttaatgcctggaaaatgataatttatctatctatctatttgtgtcgtgcttcaatatctgtgtttgtaaaatattaccttgatttgttttgtgttttaagtattgttttaatctg

SEQ ID NO: 54727 - DNA, 559 bp, Triticum aestivum
  unsure (1)..(559): unsure at all n locations
  Clone ID: PAT_TA_54727
aagnaaactacctctcattggtctcctctgtaccgcaaaactcgatatgtaatgttagttacgctctgcatatgttatcccttgtgctccagtacttcgacttccatctaactgtgattccgtgctgactgtgacttacaatgcaccattttctcccaagttacaagttcatttttttttgtaaaactttgtcttttttcttttctttgaagtgaataattgtgattccattaccatgtttagcttctttcgatagtcaagtgctagtgttgatcagaaaggcacttatttgtaaccaatattttcatatatccaactagtttgctcatgttctcctctgtattcttatcagcaaaaaggaggcaacccaccatcccacgaggcaatgagcgatgaatggctagaaaatgggcagtgcccacttgcccgttcttaccgtgcaatgagtggcgttctgccccttgtcgccaaggctctacagccaccagctggtatgaagctgaagtgcccgcctgcgattgttgctgcacgagcagcccttgcacgcacaaccctcgtg

SEQ ID NO: 54728 - DNA, 588 bp, Triticum aestivum
  unsure (1)..(588): unsure at all n locations
  Clone ID: PAT_TA_54728
gtgagnaatcttaattcaanagttatagggagggacttatgtcaccacaaacanaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaa

SEQ ID NO: 54729 - DNA, 131 bp, Triticum aestivum
  unsure (1)..(131): unsure at all n locations
  Clone ID: PAT_TA_54729
gcgttcgtagtgatgagagctcgtccatgagaccggcaagatccagctcccagcagtgcgacgagctctgggcgatcttccccatgccattctgccagcgcggncgttccccttctagcactgcagagggt

SEQ ID NO: 54730 - DNA, 421 bp, Triticum aestivum
  unsure (1)..(421): unsure at all n locations
  Clone ID: PAT_TA_54730
gcgttctcggncgcgtgggacgggcaccatcgcggatggcgtggcggcgccaactggcccggggctccgcgagaaggccgccgcggcgccgctgcccgaggagctgaccccggaggtggtggagggagagagggagatcgtgctggggaggaacatgcacgcctcctgcttcgcggtgaaggagccggacgccgacgacgagttcaccggcgagcgcgaggccaccatggccggtgtcctcgcgcgctaccgccgctccctcgtggagcgcaccaagcaccacctcggttgtccatacaatctgtactttgagtacggtgcttttttccaggtgtagcacttgttcattaacaacctatgtgacccatttcatgggagagcaactatggtggtgcactctaggcagtttgaagtggttagt

SEQ ID NO: 54731 - DNA, 431 bp, Triticum aestivum
  Clone ID: PAT_TA_54731
ctgcacgagaagcactcaagggcccctggcctaacgaacattcagcaagcttgcactgaaaggcagaggaacggtgctgtgccctccaccaccaagggcatgcatgatgctgctgtcaataacaggggtgactccaaaaaggaaacacgctaactgacagctggacgtaccaacacaacggggtcaccgggcacccctatgactctgaaaccgccgcttcctcgaccatcctacagtggcgagcacccaaatctcgacacaaccgtgcgtgaagccaacatcttccttacatcagacgggcaggccatgaagatcaagggacactgggtcaaaccactcgccaaccccatgacactgcacatactccactgataaccaaccaggacgactttgtacagactacgtggctaaatggatttatcatgggccaa

SEQ ID NO: 54732 - DNA, 584 bp, Triticum aestivum
  unsure (1)..(584): unsure at all n locations
  Clone ID: PAT_TA_54732
ttcggggggcatcaanaattcgagaccctgtcgctacttgccaccgctcaacacggaggccctgctcaagcaggtcgactacctggtccgctccagtgggtgccttgcctcgagttcagcaaggttgggttcatcttccgtgagcacatctcatcccctgggtactatgatggccggggcgggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgaggaaaacatgcttgtatggagaatgctattcggtggctatgtgtatgaacggaccccataatatt

SEQ ID NO: 54733 - DNA, 416 bp, Triticum aestivum
  Clone ID: PAT_TA_54733
gcacaccatggaccgccaccgcgtcgcttgtgctgccggtcggggggcgcgcctgtccgtcgccgcggctcaagtaaggcctacgtggttccggcgccctgtccggtggcgcagggtttgtgtttgtcccggcggtgaggcatgaacgggtcgggggggggggtggcttccgcgtcccgtgccaggtagaatctcactggccggggctggaccgctgcgagccgtggctggctgcggctggtgcctgcccgtaggtcggggtaggccgagctccccggggtctgtccccgtggcttaagaacttcctgcttagcattgtgtgccggcggggtgcgtcttctggcggtatcgtccggggcggttctttggtcgttttcaacttcgtccccgtcaagtaggacctgatcgtctttgcc

SEQ ID NO: 54734 - DNA, 519 bp, Triticum aestivum
  Clone ID: PAT_TA_54734
acatatctatcttcgtaccggtatatatacgcatatttatcgcagtgtttcccatggacaaatctgtactcaccagcggtagagagtagtaagtaggaggatataccattgccgtagctacaacagggcgacgtttttccttttttacagaagaactggacgatgtaccgatcgagctgagcctgcctactcctccctggggatccaccggctccaccagatgctcttgcgctggctcgtaagctcgtccatgctctcgctgatcgtcctcacgatcttcctctgcacccgcagcatcgacgccagcacgttccgctgcgcgctgtccttcttcggcttgatctccctgagctcttggagctgtgcttccgtgaagccaccgccctcctccgttcccgattttgccatgaggccgatgatccatcgcgcggcctcgctgtagtccttctgggtcgcgcggaacagctgcagcctcaggttctgcatgactgagaggccgaggagcccttcgctgttgaa

SEQ ID NO: 54735 - DNA, 538 bp, Triticum aestivum
  Clone ID: PAT_TA_54735
aagcaaaagttcaacgctagcagcggttgagtaaaattactttgttttttcttaaccatctatggctaattattattccacagctcttcatgatacaatcacaaaaaacaaacaacaaaaaaggagaaaccattccctagattatcgatagaaatgttttacttcagccatgaaagttgaaggaacacaacagccgatgacatctggactttaagatcagcaatatcaacatcatggcctccttcaaccaggccccatcgatcgacctggtgatcttcttcaagtctgatcagctcaatggattcatcaactcccaaccttcctctaaatattgcgagagggattaccaaggaatgggctgctgcggccatagcatcaatagatgccagctcacaatcatttgcatccttcagaacggtttctacagccttaactagccgctcatcttgcttccctcctaaaaaacttgtgtacacaacaggcttgaacccaaactcagtcttgacccagtccagtattgggtcaattttctccttct

SEQ ID NO: 54736 - DNA, 384 bp, Triticum aestivum
  Clone ID: PAT_TA_54736
aaatgtaatatttaatttcccctattacatgtacacagaaacgtaagcttagtacatcgcaatcgtcgcaacagtcttcttacgcccacacagagggtgcacccattttacaggcggcgcccaaacccagattgcaaatttacagactaaaaccctctaaacaaaccggacatctcgactcacacttcagaacacgaaaaactgcttctggaaaactaccgtcgaaccctatgatctttactcaagattctacttcttggcctaattgaacaaagaggccttcttggttgcaactgacttctagaggttggcagccttctttacactaactgatgtatccttgggcgccttcctggatgctggtttgttgggcaccaaaccggc

SEQ ID NO: 54737 - DNA, 502 bp, Triticum aestivum
  Clone ID: PAT_TA_54737
aacatcatgaatgcacatcatgtctagccagcagagacatagtactcacagaatcgagacaacacaatcctagacacaaggaaacagtctgacatcgcacaattaaaacgtagcattacgactgacattgaacatttgtagtactacaaaaatttcagagagagagagaagagaactctctgtatgtctatagaagaaaggtatcaggggaagtggacagagataacagcaggaggtggggggcagcactagacgaactagctagaggagaagcataaagcggcgctgcgacagagagcagcgttagataggcgcaagaaaaaaaacagcagcagcgggacatgaaatgaatgagtatcagccttgatagggggaagaagaagtatgggcacaacaaggaataagcatcagcagggctcggtgaataggaagcattaacatgaggttggtagaacggagaacaagcatggtcattgatggaagagaggaggagcagacgatg

SEQ ID NO: 54738 - DNA, 497 bp, Triticum aestivum
  Clone ID: PAT_TA_54738
ctaggcgctgggtttggtgaaatttcctcttctagtcttcatcagatcttgcttggttttgagtagtaaggggtgagcacacgtaggaattattggccgataaaataaaggcggctgctacaaatcatccgacttatttccccatgaaataagtcagattgccagccgtccgatcaaaagccctcgtatgttggatcggtcaacgtaaaccgcgtcgctctcacgcaatagcacgccgcgcgtggcctcgtcttcctcgcgtcgctgccaaatcaaaaaaaatccccacgcacatgggatccctgagataggcgcggtgagctccggcgagcggccctgaacaagctcgtagtcgcagccgccatgctgcgctcgttcacagcaccaggctcggcccggcgtcattcctcgccttgcaaacgcattaccgccgccggttatggcaacaccgtagactccaggcgtggcagcagcgcttcactacaatgggctcgccc

SEQ ID NO: 54739 - DNA, 461 bp, Triticum aestivum
  unsure (1)..(461): unsure at all n locations
  Clone ID: PAT_TA_54739
ttagcctcttagcacagctgaagacgaagacataggcagagtacctgggcatatcaggcccacggatgctatcgtatcttgaacgcagccacatacctagatggtagcatatgnctgttaatgcaccaactcgcaatgagcaaggtatagtcgttccaacgctcagagcactcgcgagttaaacacatggaatcagaatgttattgagatacatggtgaggggtctggccctgagaatgcaacacaagcgatcagaccctcttgacggacgtcgaacctgaagaccgccaccactgactcggctatgacctccaagacaaccccggcggacacgatgctcgagcagggaacatgttgagcgacgaggacagtcccctggacgaggacttcgtggactctgacagaatcagagacggcggcaaggacgccctgggcagccggggcgcaagcctttactgcac

SEQ ID NO: 54740 - DNA, 275 bp, Triticum aestivum
  Clone ID: PAT_TA_54740
caggaagcgtctcacgcctcacaggatggcgcgtataatgtatttatattgcggggcttattgtgtaataacatacaagctggaaattacatccaggggttattggacttgatacacagggaatactagggattacatggaaaacggttaaggtttatctcaaccaaatcatgtacggtgataggatctagaaggttctagtctattcctgtggcatatcttaacagctccatcatagcttttattttgacatcttaaatttggttgcatggttt

SEQ ID NO: 54741 - DNA, 443 bp, Triticum aestivum
  unsure (1)..(443): unsure at all n locations
  Clone ID: PAT_TA_54741
actgaaggtaaacattctatctataataatgttaaagatagtgcacacatgatataccatgataggaaaatccaccacagggttaataccttctgatgtaacaaatgcaagacaatcacactttcatgaaaatcatgcgcatgttacactgcttattcttgaggaaacaacaaataaataggggcgtgggacacatattatcttgaaatactcaaggatactgcaattgtcatacataacaccttgttgcaggagaaccacactagtatatctacagcttacgaataccgaaccaatgagactctcggacaatatcgtttgctaaactacggttgcgccttcataccttggcttcataaatgaacatagataccaccagcatgatgcacgactagaccatgaccaccancagcgtcgagctctataccaccgtcacagggctg

SEQ ID NO: 54742 - DNA, 354 bp, Triticum aestivum
  unsure (1)..(354): unsure at all n locations
  Clone ID: PAT_TA_54742
atcaaaactgtcccttgcaaattcacgtngaaacaacgaaggaataatcattgggtacggcanaaaagggtgaaaagaaaaaacgccacatgggacaggtttattcctccccgtggcgcggattatgtacacatcagcttggatggatggactcctaactctccgactactaattaaccggcgggcggtttggctaggctactggtcgagcgggagggtgaggtggggtagctggcggcgctgccggacgagagccatgggaaggaatggagggagttgggcgggagaggtgaggcgaggtgggtgggtgggttgaaggtgaactccggacccacgcgtccgcccacgcgtccg

SEQ ID NO: 54743 - DNA, 475 bp, Triticum aestivum
  Clone ID: PAT_TA_54743
gcggtggcaaatatgttgctcattattaaaaacccataatacatagtaaacagatgggctaaaaaatgatgggcatgtgcatatacataaccaccgattgtatttacataaaagcacgctgttttgagccaagtagagacatgatacatggacatacacatattattaagaacaagtaagaaagacaagtggataaagaaaacccaacgtaatgtcatagttgacaaaactgcaatggcactaaatatgtggcccgtgtacagtaagctgaatatgccttgccggactacttgcatcccggtggattgaatgcaatgaatctgacgcactggacctgacgcatgttggctaatcacattaagaatacgtacacttaaaggtactctttgttaccagacacgatatttgaccctagaaaagctgaccggcaactgcaagtataccaaatttccctataaagagacctaatacagct

SEQ ID NO: 54744 - DNA, 279 bp, Triticum aestivum
  Clone ID: PAT_TA_54744
accccgggcgggcgccccaatttttttttttttttggcccctaaacacaattttgtggggggggggcttcaccttccccactggaaaaaccttggggttccccaccttatcccccgtgggggaaatccccttttggcccgctgggttagttgttaagaggcccgccccgttcgcctttcccaccggttgccccccttgattggcgcttgggccccccctttttggggggtttttgccccgggggctgttggggtttctttcggggtggcgcttgctttt

SEQ ID NO: 54745 - DNA, 378 bp, Triticum aestivum
  unsure (1)..(378): unsure at all n locations
  Clone ID: PAT_TA_54745
cctgncgcgtacgtccgcatcatcggattcgacaacatgcgccaggtgcagtgcgtcagcttcattgccttcaagccaccgggctgcgaggagtccggcaaggcctaaacagctcactcaccacgggccacatataaagtgccattgcagttttgtcaactctgacattgctttgggttttccttctccatttgtctttcttacttgttcctaagaatatgtgtatgtccatgttcatgtaacaacatggctcgagaaagcgtgctcgtatgtgaatgcaatcggtggctatgtatatgcacatgcacataatatattatacaatctgtcgactatgtattcgggtaattaataatgagaaacatctttgccaccgca

SEQ ID NO: 54746 - DNA, 585 bp, Triticum aestivum
  Clone ID: PAT_TA_54746
ccgggtcgacccagcgttcgcgcgctggccgtcgtgggctgccggttggggcttgtgcccaagaacgcagggcgagccgtgcgtgacggagatctacgacgacgtcgtcgtgttccccggcgcggtgagcgacaagaagcgtgtgcacaacttggtgatgaccgtggattgggccgacatcaacttcgacgactacgagtgcatggtcatgcccggaggccggacgtcggagctgctcgtgaccaacgagaaggccgtggcgctggtggagcagttcgcggacatagggaaggtggtcgccagcatcgaccaggggcacctggttctcgccgcggcggggcttcttaagggcaagcggtgcgcgagcggaatgcccatgagggtggtctccaacctctccggctcggtggtcgtggagccccaaggggcggtcgtcgacgggaagctcgtgactgatgcgagctggacggaccttgccgagttcatagttccgctactgaatctattgggcatcaccgtctcgttctaaagatgcaactgcaatgcatatatccgtgatctgtattaaatttgtgaacagaacac

SEQ ID NO: 54747 - DNA, 567 bp, Triticum aestivum
  Clone ID: PAT_TA_54747
cagcgcagcgatctcacctccctgacccgctccctcctcccgcgtcacgtgtcctcacagctcaccccgccggcggccggccgcagcggcgcgcccccgacccccgaccaggcggagcgcggccagggcaggcgagatggtcttcgtctggctcgccgccttcttcctcgtcgtcacgctcatcgtgctcgtcatcttccagttgatgtgcttggcagatctggagttcgattatatcaacccgtttgattcatcctctcgaatcaataaagtggttatgccagaatttatagtgcaagcacttctaagtgcattattcctcttatctgggcactgggcgatgtttctgctttctgccccaatggtgtactataattatacattgtacgagcggcggcagcatcttgtagatgtgacagagatatttaaccatctttcacgggagaagaagcgccgtctttttaagatagctgctcttatcgtcctcctattcttgtccttgttctggatgatttggagtgtactggaggagcacgagtagaatgagagaaaacctgtgattgtgat

SEQ ID NO: 54748 - DNA, 572 bp, Triticum aestivum
  Clone ID: PAT_TA_54748
tttctgtttgatctgctttgggtgaagagccctctacatgtggcttgttggttggacacgtttatgttcatgcatgatgctcttgcggtgtttattgattatcaatagatctgagaaattctttttttgcttaaaagtttaattatgcgtcttttcctgcagttaagttcctgaaaaaatggtgagttcaacttagagttgtagcagtccatgtttgctgacaataggagcgcccatgtattataagctaatatatgattcaggttgtgatcattgattcatatggttagttggtttctgagaaaaagatacacacgctttcttgatggtcaaggagtttcagatagatctgagaaattctttttttgcttaatagtttaattatgcgtttgttctgcatttaagttcatgaaaaaaaaggtgagttcaacttagttgtagaattccatgttttctggcaataggagtgcccatgtattatgactcaggtttgtaaacagtcatccataccataggtacgtatgttaatgcagaagcagcactattgaattaaacgtagtaactgtgtcaat

SEQ ID NO: 54749 - DNA, 133 bp, Triticum aestivum
  unsure (1)..(133): unsure at all n locations
  Clone ID: PAT_TA_54749
gcanatattgtggttttctggctgtcctgatgtgaccgggcacttctctcccccactcanaacttcctttgcagtaaccagcattggtgaggatagctccctgctgtactattcgtcgattgatcttggctgg

SEQ ID NO: 54750 - DNA, 552 bp, Triticum aestivum
  unsure (1)..(552): unsure at all n locations
  Clone ID: PAT_TA_54750
tcgcaccaccacagccccactcgtagggggcgacgcgcaccggacacacacagaatctcctcgaccagcgagcaatggcgaccaccgcgatggcgctctccccctcgtccttcgccgggaaggcggtgaaggacctgccgtcgtcggcgctcttcggggaggcgcgcgtcaccatgcgcgggggcgcggccaaggccaagccggtgtcgtccggcagcccgtggtacgggtccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatccactgccggtgggccatgctgggcgctctcggntgcgtcttccccgagctgctcgcccgcaacggcgtcaagttcggtgaggccgggtggttcaaggtcggttcccagatcttcagcgagggcgggcttgactaccttggggaccccagccttgtgcacgcgcagagcatgcttt

SEQ ID NO: 54751 - DNA, 494 bp, Triticum aestivum
  Clone ID: PAT_TA_54751
tgaaattgattttactacaacctggcactatgtaaactaaggtatactgcatgatttgtggcaagtatctccctagtttagtgcttatgcctgatggtgtccgactcacaagatacacggagctgcaattagctgccgcaatcttctaccttgtacatgtgacaactgttgtggactgatgaaatttaccaaccttgatcggtacaaaagactatgctatcacataaagcctgtgtgctggggaagacaaccaatggatctggtatgtatcttattcattatacctatttgaagagggttccgtaactaacatgttcacttgcattcaaagtaacttattagctttcaaagacctactttctttactttggtaggatctacaaattacccctacttattcaaaaactttgcaaggaccgactcatggtatccaagttgaaagagataaattgaacaagtatgggcttactttattggaatgtactattaaacca

SEQ ID NO: 54752 - DNA, 428 bp, Triticum aestivum
  Clone ID: PAT_TA_54752
cgttatccgatccatacaccgataggtgaaatctcataatgaattgcattgcagctggggctgctgaagaactactgcctttaccttactgactaatatttccgagtgatagacttactacttgtgcaatatgagatggaacataagcactgtcgcatggataagatccatgcttaccgacgcaggcggggaaacagctacctatgaaataatatatcctacaaaatatgcactccatgttcatttacttgctcgaagagaccaactaccatcatgcaacgctattcaagaccgtttactcaacaacccctacataacagctcatttaaatacaaaaactgcggcagttgtcggccttaccaaaggacagatgtcctgaattcagatgaggagaatccctgcagcagaggaaaaagctcttgaagtga

SEQ ID NO: 54753 - DNA, 529 bp, Triticum aestivum
  Clone ID: PAT_TA_54753
gccgcccccccccccccccccccccccccccccctttttttttttttttttttttttttttttttttttttttttttctctttttttttcctttttaatcggacccggggcccgacccggaaacaccggcccggaaccggagggcgaacaaacctccccaaaagaaaggccaaaaaaaccccgggggaaaaaaggtcaaaccggcacccggggagaaaaaagtaacccccgaaaaaatcaaaaaaaaaaccgggccggaaaaaaaaagggaaaaacccgggggaccaaaggagggaccaaacccacattaataggggggaacccactgcccccattcaaaaaaaaaaacccgccaacccaccggaaaaaaaaaatcgcccaacccccgggaaaagggggtttgcttataccacccaaagggggaactttttttaaccaggaaaacggggaacaggaaaaagccctaaaacgccggcccctgtaaaaaggcccaaaaaggggaaaaccctggttggccccagcaaacaaa

SEQ ID NO: 54754 - DNA, 519 bp, Triticum aestivum
  Clone ID: PAT_TA_54754
agccagcacctcaaaacaaatgtcccttttcccctgggctctggccttttggtagcagaagcaataggtatctatacacgcaaatttagtacagtacttatcaagattaacccggtaacagccttactcagtttctcctcttcactaattgcaagaagcctcctggaatggatcaaaggaaggatgatgcctagctcggtactcattgcaagaagtagccggagaggaagaaggcgaagcccacaaggaggcttccgtagatgagtagcgtcttctggccagaggtgagcgagttgccgccgagcccgaactgctggttctgcgcgaacccggcgatctcgacgctcttgctgtcaaaaaaggactgcgccgcgccgcacgttgggcaccgccagtcgtccggcagcttgttgaacggcagccccgatggcaccggataggacgggtctcccttcgcctggtcgtacaggtagccgcaggaccggcactcgtgcacccccgtgttccggacgcgtgggt

SEQ ID NO: 54755 - DNA, 443 bp, Triticum aestivum
  Clone ID: PAT_TA_54755
aaacgggaaaggggggaaccttaataaaggcccccgattttacacaaattattcaggagaagggggcatggaaagttaaaccatataaaacgacgctggacagggccgggactagggggggggggggaacttcccccatttaaaaaaaaagggcccccgcaattttaaagggccaactttgactttaaatttaaccaatgagattgactggggggggagcaaaagttataccagggaattcgtattaaaaaaaaggtttaaaaaaaaaaattttttggggaaaaatttcccttccccagcaggggaccccatgggtaaaatttaagatggaaggtgaagcccaaaaatagaaaaaacccttttttttgaaacaaaggggggagttttaattcagggggccgagaaaaaaaaacccagggggcccgcctagggagggggttacc

SEQ ID NO: 54756 - DNA, 420 bp, Triticum aestivum
  Clone ID: PAT_TA_54756
gcggaacagtaatgtttgacgctgctttgaggcgcccggctaggtcggctattttggccgatcaggggggcacttccccggtttccttcgacatcactgcaacatcatcagcttcgtcgagtcgggcacatcactgcttggcagttggcaccggaggtgtgacagtgcgtcacgcccgcggcacctccaaataaattggcggcagctccgcgcatgcgtcattcatgctcggctcggccccaacgccatggggtcccgcgttccgttcggccgccgagtttcagtctggtaatttgacactttgttttgtcgagcaggcgaccttgctgtcccggagccgggactagcaacgccacctttccttttccaatcacctccgttctgtgggggtagcgtcgatcgagcctagttctaaatcgc

SEQ ID NO: 54757 - DNA, 426 bp, Triticum aestivum
  unsure (1)..(426): unsure at all n locations
  Clone ID: PAT_TA_54757
tntttttttttttttttttttttttttttttttttttttttttttttntttttttttttttaaaaagctgaagctcaaattaatacttttttggtctgtttgcaacaaagcaaaagcagtctccactgaaggaatggcccctgggagggacaaatgataagcagttctatttgtctttaccaaaaagggatacccaatatctttatatattaacaaaacatgcccagcaatcgcttggatgcgatgcggtacttaggtccaaaggataaaaatatcagattttaaattggcatgcttaaaaggggtaaaggcagctgccgtcgtcactcctcgccgttgggtcaaagttcttggcagtctggtcggggcatcctgccggcacaggcaaagtaccttgctgggcccctttacctcctcctatgcaac

SEQ ID NO: 54758 - DNA, 444 bp, Triticum aestivum
  Clone ID: PAT_TA_54758
ggtaacaaaaatattattatttttcgaacccttcaacacacaaaaatgattctgaatgcgggttatttgctttaacagtatcagatattggtataggggtgggggcacgaaaagatactccatttttatacaggacacccaagtttcccacgaaataatcacaaattacatcacgacgcaattggtgataccatacaaactaagatcacacccaaagataaatacccaagtgatgccatgggcaggagacattgcaacggtcaaacagagagaagctgaagatgaagcgatatctatcctttgccgaagagcagctttttcggggcctcacccttggcgcggtacttggcgggggtctcctccgccgcgacgatctccttgccgtgccgcgcttccgccgggggacgcttttcctccgcctctttgtgcaccgtcgcggcgctg

SEQ ID NO: 54759 - DNA, 541 bp, Triticum aestivum
  Clone ID: PAT_TA_54759
cccttggttacccttaaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatca

SEQ ID NO: 54760 - DNA, 439 bp, Triticum aestivum
  Clone ID: PAT_TA_54760
atgaaaacacatgaaacggctgtcaataggggcaccctggaagttgtgttgacacgaaattaattgcatctgaacctgcactgagcaaagaattaaggggcatgcccattggtggatagatcatgagacaggcgtgcacacgaggttctgttggacaacaaataatatattctggatcctttagggcggagagataatttgctatggcatgcggttgagaccacgcctacttgatgatttgaccaacaattgcccaccagggccactcctaaatatacgcaatatatgtgccaatggatgccattacacttcataaccgtggaacgaacaatgatactaagtgatttgttagaccttgtgaactcccggtattacttgttcatctgtcacaccatagaaagtccttgacatttcttcagatcatgaaaaactggacaca

SEQ ID NO: 54761 - DNA, 448 bp, Triticum aestivum
  Clone ID: PAT_TA_54761
gggggtgctcacccatagatgagcgaggtgggatctcactgcttgctggcatatcgatgacttactcctggttgactactggatgaaactaccatctgttaaccttgcttcgtagccactccaataaaggatcaaatactggcggggggggggctatttcattaaccgccccactgtgcaaaatatctcctcttctatgtctagattcaaagttaatagctctgataaaccacaaactttacatactgaacactggcgcatgaggctcgtccactaccacagatgggaatgttatctaccaccaatctagatctttcaatgttcacccctatatattaactccaaaaagggatctcctcctaaaatgaaatatcatgtggctgctcccttccatgctgatgaacaaaactgactcgcatctgtaccagatgattgatgcatactacct

SEQ ID NO: 54762 - DNA, 574 bp, Triticum aestivum
  unsure (1)..(574): unsure at all n locations
  Clone ID: PAT_TA_54762
gcgttctttccagnaaaccgccatgaaggggccaaatccaaggcgccgtcaaggccgacaccaagttggcggtgaagagcagggggcggagaagccggccaccaagggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaacaagggcgagagtgctgctgctgctgccccaaagaaggcggcggccaaggaggtagaggaggaagatgaggaggaatccgacaagtccaagtcggagatcaatgatgacgatgacgatgagggtagcgacgaggacgaggacgatgacgagtgaagcggacaatgcgggagctgctgtgcgagaagcgacctgagctgtgtgcggtggtgtcataaggagcc

SEQ ID NO: 54763 - DNA, 382 bp, Triticum aestivum
  Clone ID: PAT_TA_54763
ttggccacccgctcgcatccaatacgttgatgagtgggaatgaggtataccagtcatccgtgacctgggatgcatgctggatgaaacagccggggctgacaagcggaaaaggttcgcccagacgcctgaacgaatttaaccgagccgggagttcgagagtgacgtctgaacatcatattgacttgtgttcacctattgacttgctatgcaagacgaaccaagcgatgcatcttcattcatggctgcattaagtaatgtaaaacttaaattgaaaaacttctgcggaaatcctatacattgatagacgtcaaatggatgttcaccgtttatcagataaaggctatagggtttaatggtactattacctttggttcttgccaac

SEQ ID NO: 54764 - DNA, 582 bp, Triticum aestivum
  unsure (1)..(582): unsure at all n locations
  Clone ID: PAT_TA_54764
ttctgtttcttcacgccagggnaacagcgcagcgtccagaaaacatcttgtatcatggaaaaagatgtgcttactactgatgctctgcctattcatggttatgagcactataaggcaaaggattatactctcgctcatgcacctttctcaggaagtagcaatgcgggtggacagtgggctgctggcgatgaaccgctgtattacatcgtgtctcctaaggatattgtggtagcaaagccaagagatactgaagaccatattgcgtggcttcttcaacatggttggcatgaaaaggcattggctgcagttgaagcaggacaagggaggactgagcttcttgatgaggtgggcacaagataccttgatcacttgatcattgaaagaaaatatgctgaagcagcacaactctgtccaaagttattgcgtggatctccttcagcttgggagaggtgggtctttcactttgctcatctccgccagcttcctgtgttgatcccttacatacccatagagaatccacagctgagtgatactgcttatgaggttgctcttgtagctttaactaccaatgcgtcttttcac

SEQ ID NO: 54765 - DNA, 580 bp, Triticum aestivum
  unsure (1)..(580): unsure at all n locations
  Clone ID: PAT_TA_54765
gggtcgacccagcgttttcggncgcgtggggtgcaattgatgacgctgctcggtacttcaaanatgcatatgataggggtcttacgccttatgaatttgttgagggcatngaaaaagaagggaatccgtgtccctgggattggtcacaggatcaaaagcagagacaacagggacaagagagtgcagcttttacagaaatatgctcacacacacttcccttcagtcaagtacatggagtacgctgttcaggttgagacctacaccctgtcaaaggccaacaatttggttatgaacgttgacggtgcgattggctcgcttttcttggatcttctttctgggagtggaatgttcagcaagcaagagatcgatgagattgtagagattgggtatcttaatggactctttgtgcttgcacgttcaattggcctaattggccacacctttgatcagaagaggctcaagcaaccactctaccgtcatccttgggaggatgtcctctacaccaagtgaggccgactcagcacggcatcatatggatcttccacttgtgtgtacaccataaaatcgagcataattgcat

SEQ ID NO: 54766 - DNA, 471 bp, Triticum aestivum
  Clone ID: PAT_TA_54766
ctcgagccatgttggtccatgaacatggacatacacatttttttaggaacaaataaaaaagataaagggggaaggaaaacccaaagcaatgtcagagttgacaaaactgcaagggccctttatatatggcctgtcgggagggagctgtttaggccttgccggactcctcgaagcccgggggcttgaaggcgataaagctgacccactgcacctgacgcatgttgtcaaatccgatgatgcggacatacccgtaagggtactcctttttgacctcctccacctcgttgatcacctggggggggtcagggcacccgaacataggcagcttccacattgtccaataccggccatcgtagtacccaggaaatgcgttgtgctcacggaaaatgaacccaaccttgctgaactcgaggcaaggcacccacttggagcggatcaggtagtcgacctgcttgaggagggcctccgtgc

SEQ ID NO: 54767 - DNA, 490 bp, Triticum aestivum
  Clone ID: PAT_TA_54767
gtataatattatgcgtccggtcatatacatagccaccgatagcattctcatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctggcgcatgttgtcgaatccgatgatgcggacatacgcgtcagggtactccttcttgacctcctccacctcgttgatcacttgtgtggcgtcggtgcatccgaacataggcagcttccacattgtccagtaccggccatcatagtacccaggggatgcgttgtgctcacggaagatgaacccaaccttgctgaactcgaggcaaggcacccact

SEQ ID NO: 54768 - DNA, 415 bp, Triticum aestivum
  Clone ID: PAT_TA_54768
aaaaaccaaaaggggggcataaatggacccacaacagggagcgcccgagggggaggcaaaacagttttcgacggaaagaggagaggttcaagccgaaaatcggggcggggaccccggggttttgggggccgaccacaaggccaaccccaaaaagggggccaaaggaccccaatgcaaccgggtcggaaaaaggaaacccggccgggtcccccgtttgaagcccggactcgcgcccctccagttggagccccgccggcgccttcctgttcgccgacggggccagcccaaaccgcccggaaaaaaaaataaggggcgggggggccaccaaaaaaaaatggggggaggacccaatgaatcccaaggggaaggcccggggaccttttcctaaaggacggaagggtccccagggaccggg

SEQ ID NO: 54769 - DNA, 541 bp, Triticum aestivum
  Clone ID: PAT_TA_54769
aatcatatggaatcatatcagaaaattccgtcacaagaagcttccataaacaacagtttaatctaatatttttgctcttcctatatacaacaaataattttcaaatcctatctttcgagcggggtagtcaaggcctgattctccacgcttccaggtttgtgttcggatcatgtggatttgaactgtttcttcaaagtttgccgtccgatcaggtgtgcgaggcctgtttcttcaaactttgcccctggtgccgccacggctaccagcaagccatgggtgtcggtgaggcttccagcgatccacgggtgccggcgcggcttcctttgtgcaggacaagaactctacccgctgccattttacgaaacctttcattgcctttaatcttcaagttctcctcgatctgctctctacccatgttcgcacatgatccaaatttctctttcatgctcatgagtttctgataacacgctgatttacttttatgtgttccttgcctgcggagaccgtgcatgtctagcaatgaacctcaccaggactcaat

SEQ ID NO: 54770 - DNA, 293 bp, Triticum aestivum
  Clone ID: PAT_TA_54770
gagagacaaatttgcagggctgagcctccaaaatgtgtttccggggtattcatcaatcaattgtcattgatacaaaaccaaatgtaaaaatagcatacatcacgttttatatatcacggcttacgcccaacagcctgacctgaaccgaaacggctggtcagggcaggcacacggcgttgggttgggtttcactcactcctccgactcctcgaaggccgcctcggcccggagcagcacgaagccgacggcgacgccgacgagcgtgagcgcgttcatgacgacggcgatctgga

SEQ ID NO: 54771 - DNA, 561 bp, Triticum aestivum
  unsure (1)..(561): unsure at all n locations
  Clone ID: PAT_TA_54771
cccgttgtgagcgttcttgtgtatctcattacaacatggtgttnactggagaaatgcacgcaattccctctcgtcgggggcgaatggctttatggaattcggttatagagatctggcttgcgccacgaacagattctccagagatgctcttcttggagagggtaagtttggtgcagtatataaggcgacgttcaagggccaggaagtggcggtgaagagaataaaagcagagggaaagcttgaggacttccaccgcgagctccagacagttggtaacacgaggcacgagaatctagttgacctcaaaggttggtgcggcaaagtcagagtgatcgatggcaagacttggtggaaaagggttatcaaggttgaactcttccttgtctttgaattcatacctaatggcgaccttgaacaccacctgcacaacagcgaccaagttctatcatgggacaaaaggtacaaaatagtgaaggggatagggtcagcccttcattatctccatcacgagtgcaatccatgcatcttgcatagagatatcaagcctggtaacatactcct

SEQ ID NO: 54772 - DNA, 579 bp, Triticum aestivum
  unsure (1)..(579): unsure at all n locations
  Clone ID: PAT_TA_54772
gcgttcttctacctacccactactctactcactgagcagagcagcttcatgcgcgatccaggaagccaggaacggcaagccggcgccgcggcggcggctccatcgcgacgacaagaaatggccaccgccctccgccctccccggctcccagtcccggagcaagcttcctcgcttcgaagctgcattgcaatttgcacggacggagggcatcatcccagcgccggagccgacgcacgcgatcgcggcggcgatcagggaagcgctggagtgcaagaggaccggggaggagaaggtcatcctcattgccatgtgcggccacggccacttcgacctcgccgcctacgaccggtacctgagaggcgacatgattgatctctcacactccgctgagaagctcaaggagtctctgggtgccattcccaaagtctgatgttagagattcagagatttatagaagaacggtgtgggaagtgggaatacaataagatgaacaatgtggcgctttcttggtgcatggcacanataaatttgatcaataaatggccgaagcataagaatgtttctagaaacttttggaaa

SEQ ID NO: 54773 - DNA, 589 bp, Triticum aestivum
  unsure (1)..(589): unsure at all n locations
  Clone ID: PAT_TA_54773
gcgtttttngnattcttaattcaanaattatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgca

SEQ ID NO: 54774 - DNA, 537 bp, Triticum aestivum
  unsure (1)..(537): unsure at all n locations
  Clone ID: PAT_TA_54774
cggncgcgtggggtcacgtcgtaccggcccaggtgtcctgggagggcggggacggctgccgggagctgctgcacaccggggccggcgccggcgcggtcaagggcggcgtcgggctcgtgctcaacgaggcctcctcctcgtcgtccggcggcgcgtcactcctcggcgcgtgcgagtggtccgtggcggacgtggactcggactcatacgacgccgtgcaggtggagctcgggtgcagcgccaagggggccaagctggaggtgtcgtacgtggtgacgctgtacccgctgagcatggcgacggcggtgatcgtcaagaacaacggggccaagccggtggagctgacgggcgccgtgctgagccacatcaagttcgacaagcggcggggcacggccgtggaggggctccgcggctgcccctactgctcccacccgccgccggcgtccgggttcgcgctgctcacccccgccgaggccatgaagcgggaggagtccgggtggttcggcggcggcggggaggagccccggcagggcgcct

SEQ ID NO: 54775 - DNA, 215 bp, Triticum aestivum
  unsure (1)..(215): unsure at all n locations
  Clone ID: PAT_TA_54775
tccgcccacgcgtcctgctagttctagatcggcgagcggccgcccgcngatctagaacnntagtctagtccttagatcgcggagcggcacgctctgcgatcatagaactcgcgggacgcgtgggacggacgcgtggggcgggtcgcgtggtttttctcctggaaaaaccggaccggtacggggggggggtcctgctttccctatggagagtcgtg

SEQ ID NO: 54776 - DNA, 547 bp, Triticum aestivum
  Clone ID: PAT_TA_54776
aaaacaagattagcaccacactttattgatcacgtgggggtggctatatatatagccaattacaattgaggaaacagacttggactataattggaattggattcttcggtagggtaaccttcttcgggacaaaacctttccgacttaggaaccgacctcccggcccactcatctctagatgaactcaacaagttctatactcggacatgaacttgggcgcagcatggccctatgcgtttggcctcacatgatagacacactcaatcctgtagctcaagggtaacaagaagagacatcaccatgtgtcatcataggtgcctcctcatttacagtgcaaggcgcaccatagctgccgtgtccttgtgttgtggcaggaaactcttggccgtcctctaggaatttcattgcatcctccattgaaagtcgttgtgcctcttctgagtgagaacacttgaggccaaagacaaccacacgctccatttcggtatggtcaaagaagcttaacctgtcatccacaacaccatccacatgaacttgctgctcactg

SEQ ID NO: 54777 - DNA, 403 bp, Triticum aestivum
  Clone ID: PAT_TA_54777
tttttttttttttttttttttttttttttttttttttttttttttttttttttttttttttttttttttttttttttttttttttttttttttaaaagggggccctggggcccttttatcaacgttaattaatgggaaaaaaaaggggccaaatgggaaaaaaaaaatccaggggaactaaaaggaaaaggcctaaccccaaccggggtactgggaaaaaatggaagtccaatggggaaaacacaggggggaaaaatttttttaagggggaacggaccccccaatttttggaaaagggggggaaattggcccaaatttttgggaccagctaagaaagcgccaaaagaggggccacatgtttaacccccggggccttgcaagccaaaaagagcccagggccccc

SEQ ID NO: 54778 - DNA, 543 bp, Triticum aestivum
  Clone ID: PAT_TA_54778
gattgtataatatattatgtgcatgtgcatatacatagccaccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaagctgacgcactgaacctggcgcatgttgtcgaatcctatgatgcggacgtacgcgtcagggtactccttattgacctcctccacctagttgatcacctgtgtggcgtcggtgcacccgaacataggcagcttccacattgtccagtatcggccgtcgtattacccgggagactcattgtgctcacggaagatgaacccgaccttgctgaactcaaggcaaggcacccacttggagcggatcaggtagtccacctgcttgaggagggcctccgtgctg

SEQ ID NO: 54779 - DNA, 122 bp, Triticum aestivum
  Clone ID: PAT_TA_54779
gttataacatgcatgagagttgcatgtattatatactgtgcaagaaagagaagtcttacagggtgaatacacgatcagaacagagttctggtattattgaataaacataactgtgcaatctg

SEQ ID NO: 54780 - DNA, 517 bp, Triticum aestivum
  unsure (1)..(517): unsure at all n locations
  Clone ID: PAT_TA_54780
gatcaaccgagttgcgaaaacgttcatatcttttgtgtagccaattacaaaatattcagctaaaatttgagcaggttctcatcagctcgtaatttcctatcagcaacttggtgtacaaccggcttgtttgagcactgattgcagagggggaaaggcagcaatgcaactctgtttaactattgtgcttcgctcaacaccctgaactaattatttcccctaaaaatgggagtgctctcgccacgcgaactcatgtcacagcgccagaccattcttcatcagtcgagcaaaacgctgaagaacctctgctcggcgcaggtccaggctcaaccccgccggcgtgggaatggagaggcctcacaggcacttcttgatgtctggaaataatgacttctctttgtttgctgcctcgacgtcgtcaggcgatgctacagccaccacaaccccattgtcatntgatcgtttctacagcatcggcaaactccttgaaatccttcacgctggttgcgagtatctcttc

SEQ ID NO: 54781 - DNA, 437 bp, Triticum aestivum
  Clone ID: PAT_TA_54781
cccccggaaagaaattttttttcacataaaacccgggtttcttaaaatcccatgggcaaaccccttacccggggggcataatctggacccaaccattaacattctacattctttaatccccaggggggcccccttacattaaatcccaaaatttattccaggactgggtggctggggggctaaaaagaacttggaaaaacgggcaaaaaaatttttattggggggcttcccaacagcataattgggcccgggggcccccagttttttaatagactaattcaaacattctttagttcagttttggaagatttccggccccaaaactggaccaagctttccagccaaaataaccttcccggctttggggaagcagacttgaaacccccaaattaaagttcggggctatacaaatttagggcctccaaaacccgcatggc

SEQ ID NO: 54782 - DNA, 409 bp, Triticum aestivum
  Clone ID: PAT_TA_54782
gggaaggattttgttacaggggtccggacaaacccaaaaaccatggggggggataaaatactttggatggggggtgggataccttcacaggggggggctttgtaaattacaaagacgggcatgcaagcaaaaacccggccctgggttacacggaaatgcttttttaaccggggaaagccctggggttgtaaaaaaggaggacccccccccccaggaggcccgcgagggggaccgcccaaaaaaaaaacccgggcgttcccccggggtagggggcaccaaattaaaaccattcctttggggggtaaaatgggctgtaacccccaaccttgggcccctacttggaaaaaaactgggacaccccctttttgcccacctttctgccggtggggtcgatgtcaactggaaaacc

SEQ ID NO: 54783 - DNA, 495 bp, Triticum aestivum
  Clone ID: PAT_TA_54783
gttgtgtgtttttttttttttttttttttttttttttttttttttttttttttttttcgggccaaaaacacctggccactctaacaatccatacattttttttacaacagggaaccccgggggggggggggggggcaaacccccaaaggggccgggaatcatgtcagctaaccttaacaagacgactgggcaggggcggcccgggccataaaatttggcggggggggcgttcttcccacggaaggggacgggcactccatcgaacaaaaccctaagggccctccggggggggccccagccccctttatcaaaaacggcgatggccgcaagcctcacctggacccccagggggcccccgtggccgttcttgaccccaggggcctcgtggggcccgacgtatgccccgtccacgtcaaggcggaaggcaaccgtgggggagttccgggccccctgcccaaagggcccaagggaggggaccgcaatggggaaagaggg

SEQ ID NO: 54784 - DNA, 380 bp, Triticum aestivum
  Clone ID: PAT_TA_54784
ggggcaaaaagggggttcaaaaccaatttttatcccggccagtatacatgggggggataaagggcccatctgggcccgggccgaaatataggccctttggcggggccccccacttttgggcaaccatatattggccaaaggattggccccctaacctggggggaaaaagcccccgcaagttgggccccccatcttgaggcccacccaacggtgaaaaccccccgaggggaatatatgcccccccggggcccccatgttttcacttgttctttgggaaaaaccaattgggggcactgccaattacccaaacaaggggcggattggggctatcccctaccctccggggggagcagtatttctcaggggggatctggcgggga

SEQ ID NO: 54785 - DNA, 475 bp, Triticum aestivum
  Clone ID: PAT_TA_54785
aagccatgcaaaatttgccaagtcatgcatttaacttataaagtacggttgtttttgcattagtctatgcatgcaacgctgcgaacgaaacaagtctaggagtagcagcccaaggcatcgcttcattccctgcaatgtcacttagtctaggagttgcgttgcgttgctgaatggtgtcaagtactagttcatttgtagatccactcgtcggagcgcttgccgccgccggcggagtcgacgtcgatgaaaatgctgacggccttgccgatgcgggggcggtccttggtggtctcgagcgagttgcggacgtgggcgacggcgccccaagagcggagcgtgttggccacgtcgtcgaggcggagcaggtactcctcctccgtcagcgggaaggaccgctgctcccggtacttccacatcacgttcatcgccagcaggctccgccccatgaactgcttccggatgagcgtcacgtcgt

SEQ ID NO: 54786 - DNA, 514 bp, Triticum aestivum
  Clone ID: PAT_TA_54786
tcgcgatctagaactagcgaccccctgcaagccggcaacgtggtccagctgttcatcgtgctcgggatgacggtggggaggagaaggaacgcctgccgccgacgaggagggatcaggggatcaccatcaacaggaagacggaggatcagaccactgccaactaatagctcctagaacacctcgatcatgatattagcccagtacacactgttaggatagcttgcatcgattgattatggcctttcctttgttataagaactctgtagcacaatactagtagtagtgctcgtagcagcagcactgagttatactccgatctccgaagaatagtaccgagattcacatggatgaacgcgatacataaatcaacgtgacagcaaaactgagatattgtgtgaaccaacctatggtttggatacttggatatttaggacgacaatgatatctccggtccatcagggttcaaatccttgtgctcgcatttatcctggatttattttaaaatttctggcg

SEQ ID NO: 54787 - DNA, 522 bp, Triticum aestivum
  Clone ID: PAT_TA_54787
ggcacgattacaataataataataatgacgatggttcaaatacagtaaattggcagaaaatagatagaagatgcgacttaagctacgaagttgtcattaggtttatggacaactcggcatctaacatggcagttattacagaaagaactacggtggactgcagcatccccacccagataagacatcttccaaaccagcagaaacagttcctccgcggtaaagcagtaagctaagctcggtcacttgtccagtattgtgctcgtgatcaaagacacaaccaagttccggcttcttcaattgagcagcagccatgccatgatacaaacaccattgttggaccatctacagcagggaccaacatccaagatccaccaagagcctcatcagacaatgatgggcaaccaaaccagaaacggcagcatcttccagcaccaatgaccacaaagataacagacttatacctcaaaagttgctgtctaagagaatgggtctttcatggctgggttcaagcaattggaaaca

SEQ ID NO: 54788 - DNA, 416 bp, Triticum aestivum
  Clone ID: PAT_TA_54788
ggaatgggcccggtaaaattaaacaggggccgaaaggttacataggccgaaacatgggggggggggggggtactatcacaaaaaaaacatccgtttgaaccgaaaaaaacccgaatctctaataggggaaggaaaccttgggccttgggagcaaaaaaaaacatgttatggaccccgccacaccttttggggcgaaactcggtggtcaatatgatgcccccgcccttgaaaggaaatcgagcagatttttactttggggaggaggatcaaacctctccactttgaccaaagggtttttaactctccgctcgggggtggacgttttttttttgactttcagcctgagcaaataatccttgaacaaacagctgagcatgggctctgaaaaacgaggggctccgttctctttgtatgga

SEQ ID NO: 54789 - DNA, 502 bp, Triticum aestivum
  Clone ID: PAT_TA_54789
gggtcgaccccgcgtcctgcactcatttggaactttatgacatatttggggagtcaatttctatcttgttttcatcgttcaatggctgaccatttagatgtccttggtgttacagtccttttcgggcctgccatgaggtggctcttatattgaccttggcgagctttttaatcttgccttacttgatgactgcgctgatctgcttcattcggttcttttcatgcacaacatactacggcccatgagaccagctagctgtctatcatcaggctctgtgtaccctgtgcacaactgcaatctactctggcttagaacttataggcatcaagtatggctgcatgctaacgatgcctatgcaaatcttctgggagaacgattatcccctgacaacctgtgtgagatgagggaaaccctgactatacactactctcaactagacggttatcatacccatgctggatcagctatctctatggttcgccatgccttgtgatctctatcg

SEQ ID NO: 54790 - DNA, 440 bp, Triticum aestivum
  Clone ID: PAT_TA_54790
ttccacgcgtgcggcgcggaccatcctggagctggaggcgcccatggctgcgaggtacctgctgggcgccgccaccatgatggccggggatcagctcccggtcgactgcatgatctatccaaggaagcgctcctcttgggcggctgcctcttggagtgcttcatcaccttggtggtcgcgtcctgctgcttgtgcaaccttacaaacacagggctctaacattcacctggcctcttttattaactttggcgctgttttaactgcaagcgccagctagatgctgcattacatgagaatatatgacatctgtcttccgtcctgtctctgaagcaatactggcagactcagaactgtgaacctggcatatgccatatgaatgtgtgcatatgaacagtaaaacaattataatggtgatgaaatataaggatgcgaacaactgg

SEQ ID NO: 54791 - DNA, 534 bp, Triticum aestivum
  unsure (1)..(534): unsure at all n locations
  Clone ID: PAT_TA_54791
ttggaaatgccactgctgcacgaaactggngcagagtgcacgctgatatgggagctctacatgatccctagacgattgtggcaccaccgagcgtggcgctcctctgccgccggggcctgctgcatatcgctccaggcgcagcggtggctataataccaccgagcgacatagcccatattactaggaggcgggtagacagtctacatatactccaacggaactaagagagagctggaacggcgtgtccaagcatggtgacaagtacatggcctatgctgcggctacaggccaatctacacaccatatattggtcatgagtctggtgaccgctacgcgctctgaacgaccaagcttattatactggggcgtgcgactcgatagccttcttatagggggagttctactcaattacatgaccagcgctctacaacgctaagacagcatatacctgtaacactacgcacgttaatctgcttgcatgcacttctctgtaatctgggtagctacctactgagaatgtctgcaatcaacgat

SEQ ID NO: 54792 - DNA, 173 bp, Triticum aestivum
  Clone ID: PAT_TA_54792
gcgtttctccccgcgtccggtactctttcccacttgactagctagcagccatggaccgccctctcctgtgcagccgtgtccgtcccttccttcgccgccggcgccaagtggccgctccccggaagcacaggaggtggtgcgcgcgtccctgggccaagaaagccgccagcgcg

SEQ ID NO: 54793 - DNA, 582 bp, Triticum aestivum
  unsure (1)..(582): unsure at all n locations
  Clone ID: PAT_TA_54793
accacaccacagccactcttttcttctcggcggaggcggaggcgaacgaggaaccctagatccgcaaggccggcgacgatggcggcgcttcggtattcggcgaggaggctgggtggctccctgctccatcgaacgcaggccgcggtcgaggaggagggacgccggctcatgcgcccccgccagatctcaaccgagttcttcggcgagccaacgcaggcggcgccggtagcggatgagcgatgacgcctgccaagcaggctcatgcgctcgcacaatctctccactgagcatgctcgtgcaccctctgcacgccaggtacagcagaagaaggaggagctgtatgaggcggtgtctaaggcggaacagaagaagcaggagctgctcaatttgatggctaatgagcagcatttttctgcacaatccactcaaggacaagctgcccctctgccctggaaggtgtactcgaaaagggctcggggtgtgctagatgtagcttgcaaggcgacatttttcgtctatgctggtgctnttctgctcggtatcactggcaccggcaggaatgctgggctaacaagccaagtc

SEQ ID NO: 54794 - DNA, 514 bp, Triticum aestivum
  unsure (1)..(514): unsure at all n locations
  Clone ID: PAT_TA_54794
tagcaggccagagcacacaccgcgcgggtgcgcgggttgccacaaaacaaaaacgcagcgtgtctcgcttgcggcggcgactgaacagccctggtccgggtgcacgcgcagaagcccatgatggcgggtgcaggaagacccctgaaattttttagggggcaaccacaaccaactggggcgtggggatggncctctccccctccagggcaccccatggtgcgagggcggcgccccaaccgtagcccacagcggagggtgcacgcgcgggtccaactgcccctgcgccccctgcacctgcgcttgatccatctaatgccgacatgtataccaaatgggacggatggacctatagaagagacactgagaagctgctctgcatgcacctaggcttatgatgtctcttaataactgccggctggactaagactggatctatcctatcgtatcgctatctgatcgagctagttcatgggccctcgcggctagtaccgagtggtgctgcaggcgcgcgtac

SEQ ID NO: 54795 - DNA, 488 bp, Triticum aestivum
  Clone ID: PAT_TA_54795
gcccggcctggcgcccgctacctctggtttggcgctcagctagcacccgacaaacagcccttgctgccgtcccggtggcacgcaccaacatggcccacggtcacctccagattcatgctggcggctggcattcctagcggcaccaacggttgcatgagcaggcgcgtcagcttccacccctccaaccgactggaacttgaagcttgcggaccttaccgaggaggagcccactgccgccttgcccaggtaaccagcaccggacgaggacgagaaaccggacgcttccgaagacaccaacgagcccaacaaagacaagccaccgcccctgggacccaacattaaaaccaaggtgaagattctgaagacggagtgctactggtacaacgggaccggatccatcgccacgtctgatcagtatctcaacatccgttacccgaaggtggtgcgtttctccaaggtaaactacaaatgcgtgtctacctacaact

SEQ ID NO: 54796 - DNA, 471 bp, Triticum aestivum
  Clone ID: PAT_TA_54796
cgcacgcacgctatcccagccaaccactcacacttagctagctagcagcaatggccgccctctcctctgcagcggtgtccggcaccttacttcgccgccaagtggccgccacccccatgcgcatcaacaagatggtggcgcgcgcgttcctggacaacaaggcggccagcgcgggcgtggccatgacggccagcgcgatgctgatgagcagctcggcgatggcacacgacgtgctcctgggcaccaacggcggcgtgctggggatcgagcccaacgaattcaacaacaagtccagctagaccatcaccttcaagaacaactccggcttccagcacaacgagccgttccactaggacgccgtgccggccggcgtggacgtctacaagatcttccaggaggagtacctcaacgccaccggctagaccttattcgtcaccctcaccgtgcccggcacctacggcttctactgct

SEQ ID NO: 54797 - DNA, 565 bp, Triticum aestivum
  unsure (1)..(565): unsure at all n locations
  Clone ID: PAT_TA_54797
ttcgcggnatcacgttgcaactgtaaaccggcacgacggtggcttatctgctgttcccgatgaggtcgctgggccaggatggctggaagatcgccgccgctctcatggggagctacattggcggagcggtgaatttcgtggcgatctcggaggcgctgggcacgacgccgtcggtggtggcggcgggcgtggcggcggacaacctcatctccgcgctctacttcacggccctcttcgcgctggcgtccaagataccgccggaggccaagagcgcctcgtccccggaggacggcggcgggggcgagccccggggcggcatgtccgtgctgcacggcggcgcggcgctggcgctgtcgttcgcgatctgcagggccggcacggcgatcgcggcggggctgggcgtggccgccggcggcacgctgccgtgcgtgacggcgctggtggtgctcctggcgacggcgttcccgggcgcgctggggagactcgcgccgtccggcgagaccatggcgctgatcctgatgcaggtgttcttcgcggtggtgggcgccaactgcagcgtggtgga

SEQ ID NO: 54798 - DNA, 562 bp, Triticum aestivum
  Clone ID: PAT_TA_54798
tcggtgatggcttcctcggccacctccgtcgcacccttccaggtctcaagtcgaccgccggcctgcccgtcagccgccgctccagcagcgccggcctcagcagcgtcagcaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctacgccaggtgcagtgcgtcagcttcattgccttcaggccaccgggttgcgaggagtctggcaaggcctaaactacgagttgaaacaatggcctatgtatgaaggtcttttgtga

SEQ ID NO: 54799 - DNA, 434 bp, Triticum aestivum
  Clone ID: PAT_TA_54799
tgggttgccagctccggcggtcctttcgagggggtgaagtccaccgccggtctggctgacagtggacgttccaacaggactagcctggtctgactgagcaacggaggaaggatcacgagcatgccggcgtggcccatctagggcatgtaacaagtataaaaccctgtgctacctgacacggctcagcacggaggccctcatgggtaggtctactaccatgatctcgctgcaagaggcttccttgtgttaagttgaatacggttgggcttatctttcgtgagcacagagcataccctgattactaccatgggctctgctggacaatgtcaaagctgcctatgcttgtgcgcaccgactgctcgcaggttatcaactactttgacgatgtcaagaatgagtaccttgacgcgtatgtgcgcatcatcggatgctac

SEQ ID NO: 54800 - DNA, 480 bp, Triticum aestivum
  unsure (1)..(480): unsure at all n locations
  Clone ID: PAT_TA_54800
acgccatnntcggtgcggcacacgcgccgggccgcgcgggcgcctcccgcaccgccgcccccactgcccgggcnnncgccgcgccgcgcgtgggcgggtggcggctcgcgcccgccggnacnncggcgtnnctcgtccccgcaccgcagnncggcgccctcgnagggagcgtcgtgttttttatgtaagcgccgcgnngcggcgtcgaggaggggcggggcgcgcgacgaggacccaccggcccnnggcgtgggacgggccgtggagtggggagcggggcacgccgctggtgtgttcgactngtgtcgaccggagccccactgccgtcaccctgccggnactccggnagnaagtcctcgacttttctgggnaggggggcccacacatggnaagctccctcggccttcttccgtgccagtacattgtgggccctctcggcgtcttctttctctttggttgctttgtggcgtttgcccgtgg

SEQ ID NO: 54801 - DNA, 488 bp, Triticum aestivum
  Clone ID: PAT_TA_54801
ttctgccaccctaccaaagaacgccggtatatcgctggccagacagcaactacacgcgctgctgcgagagtaccttcttgcttgcggggccctccaccattcggaccatgagcttctggccatcctccatgcccgacatctgctaccgttcctagcatacacaaggtttgacaagcctgtgggactaaacaacaagttcatcactgaacatgaagaccaagatgacagatgcttttcaatacggtcgttgaccaaaatgctgacaactactgcgctaactgctgacatcatacaaactcaatgtatactgcaggagaaggatctcagtttgagaaaagttacactactgtatcgaccttgatgaataattgcacctacaacctcacctcaatgatctgaagaaggaattttgttgtataggaaatgaagactatgatccaatactagagcatgtaattcaaatacagggccatcagtgtgaaaagatg

SEQ ID NO: 54802 - DNA, 381 bp, Triticum aestivum
  Clone ID: PAT_TA_54802
cccaacaaacaaagcggtaattattggagaaacaggcctcggacacggaaggcaggtaaagttttgctctgacgaaacaaaccggaagaggacccatccggaaggggtaaaaatgaaagtcaaaagggaaagacctcgatgaacttttggcaaagaggccctttgtttgggggaaggagttaggcaatcaaatgccacaaaaatgcactgcttgacgtttatcgcctcggtttctggccggggaagtcgttaacccaaaatttctcccaaaaaaaatgggccattgagcaaaaaataaaaagctggcatctttccaggagggttgcccataaacacctcggggcccaccacaccaaagctttccacaccacacttttttgt

SEQ ID NO: 54803 - DNA, 445 bp, Triticum aestivum
  Clone ID: PAT_TA_54803
gggcacattaaacggggataaacaggaatggcaacataagcccacacccattaaatggggcaaacaaagggggggtaataataacccaaccccaggggtggtcagaattcaacaaacatgggggcttattttttatgaggagatatttttggcttcaccacattaaaagggaacattgaatgaaaattatccacgggcagttttttcttgaagggacaaatttaaaaaatccccccaaggggaaatgatcccccccaggggggcattatctacattttattggttttaaccattttttccacggggagctttacccccaaaaccggggaatcctggaacatgggtacacgggtgttggccactgggccatgaaaaaaaaaagtttttaaaaagattataactttgccaaaaattttagttatagggaccggcccaaaaagggggg

SEQ ID NO: 54804 - DNA, 329 bp, Triticum aestivum
  unsure (1)..(329): unsure at all n locations
  Clone ID: PAT_TA_54804
agagggcattccccttccaacaaaaggctgacgcaaaattttctattacaccgtcctgtgtataacatagggcgtaccgtgtggcctcctgaggttctcttgggcgcagaacacagctgcacgcatggtaaggtaccttgaacaccccgggcgactactctgtgcaagaacaccttgacgcctaggttgttggtcccaaactgtttcatatacaccatgtaaaggttgagcnctgttggcgcctacttgcatacgaaaaacaagggatgggggggctactgcttgacctggacaggatgagtcttaaaggatctgaactagatgagacg

SEQ ID NO: 54805 - DNA, 431 bp, Triticum aestivum
  Clone ID: PAT_TA_54805
aaaatattgatgcaataaagggttacctaccttactcaaatttcccttggcgacaaacagattaggggtgagttcatatcacccctcacgacacgtgaatgggggagcaacgaaaccatccatcacatggaggggggccctgacataataaaggaccgagtaccacaatgggtgcatggaaaccatgtaccagatacactgaatatataatatggacgtacacacaggtacaacaagaatctgattacctcatctattcccgaaggagccttaaatagtaccactgccaccagcatctagttctagaggacctgaagcacccccttgaaccctaggccacggcccacgtaaaagacgatgatgtcttattagaccttccccaacacgaacatcggacctgccgagttggcccacgtgagcactatgagcaa

SEQ ID NO: 54806 - DNA, 456 bp, Triticum aestivum
  unsure (1)..(456): unsure at all n locations
  Clone ID: PAT_TA_54806
aatgttaccctattttctgtgttttgtcctgtttatttttctgtttttgtgggcagcggcacgcaaccaagggagaccgttcaaccacattgagacacaaaaaaaacagcgcgagggaaacagagacgaacggagggaccctaacacacaagtattaaagaatgcaaacgctaccgtctcgtaccacgagaaacacaacggtnggacacagcatggcaaccacatacattttggtgcggaaaactatccgagaggcccccacccaagatcgaccaaacaaaggatgggccaccccataataaaaaaacccatccttctgctgatttgagaaagaaccggaagcggcattaaacacccatggaaaaacaaacgcttgagcacgaccaggaacaccaatatcttcggaagacatgttcgacacgggaatcacgaacccggacctgaagatcgaccagc

SEQ ID NO: 54807 - DNA, 425 bp, Triticum aestivum
  Clone ID: PAT_TA_54807
cagataccaaagatggtagagtgtatcgattcagcgctacgataatgcacataaaacacactctgccgtgcaaaaactgtgcatcttcgtttgcttactttcacaggtggtagctacgcattttacagaccttgcatgcgggcagggacccggccctgcgatacacgaagatgctctgttagccggcgagagcgctggggttcaacacaaagcagacaccgtcgtcgtggaggccctctagggtagcgggtccagaacaaaagcccggccaggtccggcggatgtatcggtctaccagagtaataccattactctggggtggaccttgggatgtaggaccggtacttggcaccgtactagctaacaatctggtgcacgcccttattgcctggcttactgacggtggtagctgtgtcctgtgtgaa

SEQ ID NO: 54808 - DNA, 372 bp, Triticum aestivum
  Clone ID: PAT_TA_54808
gggaaaacaaaacgggggtgcggggggggcatacaaaccaggggggggggcaactgggtaaaacacaccggggcaaaataaaaggggtggggggtaaaggggccttaaaaaaaaatgcctcaaacgaggcctagaaattaaaagggggtaaatgggacaataccaaggttacgaaaactttcaggctttggggacagcaaacaaacatttgggggtggcctaaaaaacgagaattgggaaggttttttttttggcaaggccaacctgaactaaaaaaggggaaacatttttaccactgatcaacttgggggggggtaacctggcctaggtgtgggacctggactcaagggccaatacaggaaaatttctttt

SEQ ID NO: 54809 - DNA, 326 bp, Triticum aestivum
  Clone ID: PAT_TA_54809
cagaaaagaaattataaagtccaacaggaagccggccacatcatataaacccgagaagtttcacacagaaggctggaggggaggccaacattcacattgacacttgacgagggacgggggcaaacatagggtggaacacacgcgccaggttaaatcgttaaaccagcaaacttctgaaactataccagggcgtaggaggaggtcgaaaccccggggtagttaacgtgggagaaacccaccaccaccgggtaacggctgacggaaccctgatcaaccgggacaacggatccggccccgttgtaacagaacgaccccctcctcagaaa

SEQ ID NO: 54810 - DNA, 477 bp, Triticum aestivum
  Clone ID: PAT_TA_54810
atagaaaacatattcatatagtgtacgttcgaacaattaatgaatatgcatgcatgacacgtcaataatcgtcccaaattagaagggtcaatagcacagcgatgtggccctagcttagttgacggtgaccttgacgaccatgccggccccagcgtggggctcactgtaaaagccctgcgtgccgtgcacggagagggtgaaggaaaaggtcttgacgcttgcgaggagggactggtactgggagatcttggagacgtacaggcgctacggtaccgcttgctatcccaacacaacatgatgctaacaacccatacccagctcatgaatgttaaggaagtaacatggactagacgctcattaatatactgtctaacaccatggcgcacaacagatgatctcagcatcacttaatgtgatatacttaacacgctgagcactatgcttctgactgacattgacatggcagcgcttggcacc

SEQ ID NO: 54811 - DNA, 224 bp, Triticum aestivum
  Clone ID: PAT_TA_54811
tttttttttttttttttttttttttttttttttttttttttttttttttttttttttttttcgcacacaaaaaaacgcctttttgccctacatctcaacgaccaaatatacaacatgggcggccataatggccgcccaaaacaaggaccaactcaacccaagagaccctggataagaccatgcacacttatggtccgaaacctctggccaacgggttcctggtt

SEQ ID NO: 54812 - DNA, 510 bp, Triticum aestivum
  Clone ID: PAT_TA_54812
gactcaccactcaaaaatcttcctccgttccagtacgaatcacatacggatgtatatagatgcatttagagtgtagattcactcattttgctctcgatatactccctccgtctcataatataagaacgattttgacattagtgtaatgtaaaaaatgttcttatattatgggacatagggagtagtttatagtgaaatctctacaaaaacttatatttagcaacggagggagtagaagagttcaaacactccatatgagctccatctagcaggagaggattgcctaaaaaattctactctggcaggagaagaagaaagaaaggcactgactagaagccggacatcctccggagcgcgaacatgccgaagccgatgccgaggaacgtggcgatggagatcccgaagagccgacgaggatgccgggcacgacgagcgagctccaccctttcgccatggccatggcggcggccgtggtcggcccgccgacgttggcgttggacgcgacgagca

SEQ ID NO: 54813 - DNA, 435 bp, Triticum aestivum
  Clone ID: PAT_TA_54813
aggcagattgaactaagaaaattatgtgcatgtgcatatacataactctaggcagaatggagatacaagcatgctttacagggtcatgtgcgcgaacatggacatacacagatctcttaggtcaggaacagacaagagcgagcaagggaacaggaaacacccacgcactgtcagtggtgacaaaaccgcaatggaacttcatatgtggcacgtggagagtgagctgaacaagcctcgccggactgcttgcagcccggcggctggaaggggatgaacttgacgcactggacctggctcatgtcgtcgaatgactggatgcggacatactcgtaatggcactccttgttgacctgctccacctcgatgatcacctgcgtggcgaccgggcacccgaacataggctgcttccacattgtacagtacctgtcatcgtac

SEQ ID NO: 54814 - DNA, 515 bp, Triticum aestivum
  Clone ID: PAT_TA_54814
agttacactttccttgtccttcgtcagctctgacagatcttcctcaagtaattgctcatttctcttcaaatttggctttctccatcttcatctggggcacaggctctgcagcaacatgcgctcatgccattctggggcatttgagcttacatgtcttttcccactggctagtgcctctaaaactcttatccttgattcgaatttctcttcacgtgctttcataagggtattttgatttcttatgtgctctgcctgcgtagaaattcggcgttcaacctccaatacgaactttctcaacaagaaagcgagatgtgcattgcttttgagtagcctacataaggaatttcaccattcttcctctcaataatctcatcgaggatgccattcacaacactcagaagcgactgggtaggggcattatccaagctggtggatttcatcatcatctgaaattttagaactaggcaaatcagaataacctccttgcctcagttggaaagacttcatgaaaattg

SEQ ID NO: 54815 - DNA, 464 bp, Triticum aestivum
  unsure (1)..(464): unsure at all n locations
  Clone ID: PAT_TA_54815
acaggcccttaggtctgcgcccaggctgagggacgaggaagcgagcagggtggagggtgcgagctacctccaaggcacgccagagggaggcgaacccctgcnnncgccaccgtccgcgggggccaggcgcgtctccttgctctgccgcgtgcggggcgcgcgtgacccgctgtcctgcggggacccggcgcttcgcgtctggtgcgacgagtcgcgatgtacgacgggaggggcacacgggccctgagccctttggggctttgagcaacaacaccctgctnnnggggatggactcctcnnnctggcgcgtcnnttcggccgtcattctttggtcgcttcttacaaccgtgctaacaccantccggccttcgacgaggaacgaaggtagtccgtgcggcctcttcccttctaagacttacacatagattctctccccgtgcgtcttcattgtaatcactgctcgc

SEQ ID NO: 54816 - DNA, 580 bp, Triticum aestivum
  Clone ID: PAT_TA_54816
gttcgacgttaaatgtttccatgccaaattttccagtggaagagaaaatgatttttccttcaagctatatgatatggatggtacagggtttattgaacggaaggaggtaaagcagatgttgattgctcttctaggcgaatcagagatgagattatctgacgagattgttgagacaatcctggacaagaccttttcagatgctgatacgaatcaggatggtaaaatagacagaacagaatgggagaattttgtgtccaggaatccttccttgttgaagataatgactctttcgtacctcaaggacataacgaccacgtttcccagctttgtgtttcactcggaggttgatgatattgttacatgacggtgatcctcacaaagatgtacaggtaacagaaggaaagaacctatcatcagaatatctgcaacgctgcaacatgcttgatgctggctaatgttgctcgagagtcaagagatagtttttttctgggtggtgttcattacaccgagagttagtcttgttaaatatttatgtatgtttgtgagcttcaatttgcaagtacttggcacaacttattac

SEQ ID NO: 54817 - DNA, 597 bp, Triticum aestivum
  Clone ID: PAT_TA_54817
tccgggtcgaccccgcgtccttgcgttcttgctcgggtctcgtctcggaagaaagatccagcaccgagagctcgaggccgacgactcaccttttggaaaggcggggttcttctgaggtgacggtgtgtggccatcagcatcccggcctacgacctcatctcatctccatcgaggccctgcatgattacgctcttttgcgcatgatcttgtgatgggtatagggaatcgccgaatcgcctcaccttccgtctgtctttttgcaggaccttgcatctccagtagatcgggcgcgtccactgttcccaggaccagagcatcgcacttggcaaagcagaggagaagatggacgctcgcggcggagacgcatcggccattgccctgctgctgtgcgcttgctttctcaccgcccttgcatgtgacagcaatggtgccaagtttgcgtacagcggtcctcttggccccgatcactgggggggattggaccccaacttcacgcgctgcgccatggggacgtaccagtctccggttgatatcaagaccagcgacgtggtttacaacccgatgctggggcctcttcacagggaatacaccgctgcg

SEQ ID NO: 54818 - DNA, 535 bp, Triticum aestivum
  Clone ID: PAT_TA_54818
taccagcatcccaccgtgatggcctcgtcggccaccttcgacgctcctttgccaggggctcaagttcaccgccggcctccccgtcagccgccgttccaacggcgctagcctcggcagcgtcaggaacaggggaaggatcaggtgcatgctggtgtggcccatcaagggcatcaagatgtgtgagaccctgtcttacctgccaccggtcatcacgaaggccctcctcaagcaggtccactacctgatccggtccaagtgggtgccttgcctggagttcagcatggttgggtacatcttccgagagcacaacgcatatcctgggtactactatggacggtattggacaatgaggaagctgcctatgttcgggtgcactgacaccacacaggtgatcaacgaggtgaaggaggtcaataaggagtaccctgacacgaatgtacgcatcatcagattcgacaacatgcgtcaggtgcagagcgtcagcttcatcgccttcaagccaccgtgctgcgaggagtacggaaaggactaaaca

SEQ ID NO: 54819 - DNA, 581 bp, Triticum aestivum
  Clone ID: PAT_TA_54819
gggagctctgcatcttgatctactgtcacttagttttatctgctgcctattgaacgctagctgctgcaaatcttgaaaatgctccacagtccagatctgaatggaagctatttcttcctctccagatctctccaggagcttggttttattgggtatttgctactatgattcgaggagacttttgtattttctagagttttatttgaagccaagatttgtaaagtcttggtattttgtttttctcccaagttaatgcataaaagattcaggttgggcttatgtactttgcacgcacctttattcccttacttttcggccgtggtgtcactgttgccttgtcttcatccattccctccctgtcgtctgttctacaggactggtctccatttgtggcggggctcgtagatctcaccatggatgcatttatcctgtcctcctacttgtggccacatgatttttcatggtagatttgcaccagattcgtttctgcttggatctaggcgctgagcgcagcacatggttgccattacttttgctgtctctgccccatgcgctcatcttgtgcttctggtgatgtcacc

SEQ ID NO: 54820 - DNA, 493 bp, Triticum aestivum
  Clone ID: PAT_TA_54820
actgttactttgatttatactataaactatagtagttttattacagatatatgtacatgacatttacaccatgagttcaacataggatttacaaggtcatgcatgcatggtacgtgatgcatgtacagtgcaaggcaaccgtaccctgccgagatacacacacatcacacttacgtacacgcggcacgcgctgacgcgcatataggctagtagttgattaattaattaatccagctcgccatcaggggagccggtttatttcctgtacagatccttggtcctgcaatacgtagacagtaatagcaatctgtaaatagattcccgattctgctgcttggttttcgtggtcgtcatcgtcggtccgccgccgtcatcagaacaggaacgccgtcggcgcgaacgccggcatcgacgacgccgtctcgatgtgcctgtattcgtcactgtgcgcgcggggcaagaccctgggagccaccctgccgggcctggccgg

SEQ ID NO: 54821 - DNA, 476 bp, Triticum aestivum
  Clone ID: PAT_TA_54821
aaccgcaatcgtgatggaggaggagtaaattaggtaaaggattcattcttacatatttaccactccgtccattgtggttttagatggagcaattacaggggcacgggggggcccatccccacagggaccccaagggccgagcttaggcggggagggagcaagtaaaccacacgcacacgcacacgcacctttgttcgactgcatgaaatcaaagggacgctggggtttcacgtgtacttttacaccataacacgagtgcttgcaggattacaggggggggggttgcacttgcagttgttgccgtaagtgcagccctcgccggaactggccgggggccacctggaactgccccgctttgtttttaggcgccacgccgaggcacgaccacggcggttgacctgggccgcggcactgccctggtccgtaaaatcaggggacatcttcccgaacttgcaatctgaaccgaatttgggacc

SEQ ID NO: 54822 - DNA, 538 bp, Triticum aestivum
  Clone ID: PAT_TA_54822
tcgcgatctagaactagtaatatgcaacatagcatattttatctcagttgactaatgatctttggtaatgctctgcctggtaggagcctatgtattcaaattcaagctcaactttattctgccttttttacccagctggattttagataaatttccatatgcatattgcctggatctgttgccttggtgcttttttaaagaaagatgcatattgttaaatttgaatgcattcctagtcattctaagagttcctattactaagagttattctgctattctgtatagttaatttttgttgttgtttctgagatgtatgtgtggctctgaacactccattcttcttgtaaaaccctttaactgcttacttgcaacttagaagcaagaacttaatagtattcgcctaccttattagtttttaggacataccagaattagttattcttatagtaaatcttaagttcttaactgctctgcaaactcaaaattttccttctaaagtcggttcgaatcaatttgtatacatattttgtgctatctg

SEQ ID NO: 54823 - DNA, 382 bp, Triticum aestivum
  Clone ID: PAT_TA_54823
aaaattggggggctctgggggtccaaatttacaggggggggcaaccccgggggcgtaccaaaataagggacatatttcaacgcggggggggggaaaaaaaaagggccacgaaaaaacaaaaagggcccggggggcgaacagggggggggggcccgggcccccaaaaccgggaggggggggccgaagggccaaaggagacacaggggaggcccgcccaccccacaaaggggcacccggggccccaggcgcgcacaagggggcaaaaaccccaccttgaggagggcccagagcccactaaaacagcgggcggggagcagctctgccccccggagggccggggggcccaaccccaaccccccgggcccctggggggcccggcggg

SEQ ID NO: 54824 - DNA, 519 bp, Triticum aestivum
  Clone ID: PAT_TA_54824
gctctaaaattctactgtagctcatatcatgctgtagcataggtccatggactagtacatctaatactcaacatctctcgacaagtttcgtaccatgcttattctagctactgtacatagggggtttgcagcatgcacctgcatgtacctcgcactgccgatgcgtatatgaaggtcatattatatctcttcacacgaaatatattgagtactagtttagcgctcgctcgatgctccgctcgagttcgtcgtccttgaggccgacgaccttgcccacctgcttgcagttcttgaatagcacgaacgtcggatacgctccctccactccgcaaagccccgccaaatactcgaagttgtcgacgtccaacttgcagaagtctgccttgcctatatactgcttggcgagtttctccaacagcttctccatggccttgtacagcgtggaattcttgtcgtagaacgcatacaccaacagcttgttgtatggagcagacttgttccaatgcaatttccattcat

SEQ ID NO: 54825 - DNA, 505 bp, Triticum aestivum
  Clone ID: PAT_TA_54825
gtgagactcaaaaaatatgcccttcctctggcgatcagtcatttcatcattatccccgcatggtttacacccccgtgtcatggaccggggaagatgactccgatgggaggggggggggcgcacactacacaggcggtgcatgttcacggccatggcggccaaggactgccgctggccaaacctaacccgagtgctggaacccgtgagaaaaacaggaaaggactgaccaaaggcacggacgcactactcttgcttgaaccagtaaactttcactaccatagggcccggaatactagtcttacattagggcccaaatgccctctgctatgtaaagtactaagcatgtggactgtcggtctagggatggaattacttgggaggatcacttgtacgacttctttgtcgaccacaagcgcaggatgttggatggtagaacttgccgctgtaccagaagacccccttgcggtcctcggggctctacatagatgcactgcttggcctcgcg

SEQ ID NO: 54826 - DNA, 414 bp, Triticum aestivum
  Clone ID: PAT_TA_54826
ggggcccaaaaaaccacccttttacaggttccaaaggaggaaggaggggtttagggggacggggttacgtacaaacaaaaaccatttggtcgaaaaaaatactttggatcgggggggacaaacattcacaggggggggctccctaaattacaaaaaccggcatgcaagcaaaaacccggccctgggttacacggaaaagcttttttaacccgggaaagccctggggttgtaaacaaagaggacccccccccccaggaggcccgcgagggggaccgcccaaaaaaaaaacccgggcgttcccccggggtaacgggcaccaaaataaaaccattcctccggcgggtaaattgggctgtaaccctcgaccttggggccgtacttggaaaaaaaatgggacaccccctttttggcgac

SEQ ID NO: 54827 - DNA, 247 bp, Triticum aestivum
  Clone ID: PAT_TA_54827
ggaattcaaattcaatatcccgctgggatcttcgccgttctggaaggcccacaatgggcccatttctaagatttcggggggccgcccaacatcatatatattctgggagaaaagaacaaagtttggtggtccccccagggggggtccccattgggggccgcaaaacccaaaagccccaggggggccacaaagcagctctgggaaaaccaccgccggggggccattgaaaaccacccttccaatcaac

SEQ ID NO: 54828 - DNA, 273 bp, Triticum aestivum
  Clone ID: PAT_TA_54828
aggcgacagatgggccctaaaaaattaggggcaggggcatatacatagccatcgggggcattcacaagggggggggggttctcgaggcatggcgggaacatggacatacacatattcttatcttaggaacaaacaagaaagataaagggaaaaggaaaacccaaagcaatggcagaggtgacaaaaccgcaagggccctttatatggggcccggggggagggagctgttaaggccttgccggactcctcgaaacccggggggttgaaggcgaa

SEQ ID NO: 54829 - DNA, 567 bp, Triticum aestivum
  Clone ID: PAT_TA_54829
cctataactacagttatgatcccttgcaagaatacctatcatttataagtgatggtggcttctccgtggatggtgtgttaacagactaccctattactgcatccgaggctattggctgttttgctaacttgaatgaaagtaaggcggatcatgggaaacctttaattatttcgcataatggtgccagtggagactatccggattgtactgatcttgcctaccagaatgcaattaaggatggtgcggacgtgattgactgtgcccttcaagtcacaaaagatggagttcttatttgcatgagttccatcaacctgctcgagaccaccaatgttcagaggacacctttcagtacccttacatctgtcattcctgaaattaagagtacagcagggatttatacattcaaccttacttggaacaacattagcgatagttctttgaaacccaagatatctagcccattgagtagctactatcttgtaagaaacccgagatacacaaacaatgggaagtttgtcaagttctcagattttctggaatatggaaaggatcaggatttgtctggca

SEQ ID NO: 54830 - DNA, 579 bp, Triticum aestivum
  unsure (1)..(579): unsure at all n locations
  Clone ID: PAT_TA_54830
gnatgtgattatccagcaaagtgccatagtgtttcatcatgccttcatacgcttcatagaatttacaagcacacgcaattgaaacaccactctcggccggagggtaaacgatagaaatacaaaatttcttctacttgcatgtagggtggttgtgtcattttctgaaattaaggattatcaatgctaaagtagaagtgtaaaatgtaaaactgtaaattaaggggacatatccaacaaaagagaacctaaactatagtggaaatattgggaaaataaaacatgttttttgaaacttgttgtttcctttgatagtactggttttgacattgtttgtttggcaaaggctagcaactgacaaaacataacagtttcccttcgacctataacctaaactgtaacagaatattgggcaaatagaccatatctcctttctaataatactggttttgacattgtatgtttgtcaaaatctagcaactgataaaacataacaatttcccttcaacccataaaagctggcaaacctggcaaacataacaattgcgctaactatgcaccatctttttgtgcaccacttta

SEQ ID NO: 54831 - DNA, 576 bp, Triticum aestivum
  Clone ID: PAT_TA_54831
tccgcgccgataatacaataccatggcccccgccgtgatggcttcgtcggctaccaccgtcgcacccttccagggctcaagtccacggccggtctgcccgtcagccgccgctccagcggcagcctcggcagcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtctttcgtgagcacaacagctcccccgggtactacgacggccgatactggacaatgtggaagctgcctatgttcgggtgcaccgacgccacgcaggtgctcaacgaggtggaggaggtcaagaaggagtaccctgacgcctatgtccgcgtcatcggcttcgacaacctgcgccaggtgcagtgcgtcagcttcatcgcattcaggccaccgggttgcgaggagtctggcaagccctaaactacgagttgaagcaatggcctatgtatg

SEQ ID NO: 54832 - DNA, 585 bp, Triticum aestivum
  unsure (1)..(585): unsure at all n locations
  Clone ID: PAT_TA_54832
gtgcgacggataactttgccgctgcngataagcttggagaaggaggattcggtgcagtttataagggaaaccttcctgatggccgggagatagcggtgaagaggctctccagaagttcagcacaaggaataggagagctcaagaatgaacttattttggtcgccaagcttcaacataagaatcttgtcaggcttgttggcgtatgcgtgcaagaacacgagaaactgcttgcctacgaatacatgcccaataaaagtgttgacaccattcttttcgatccagagagaagcaaggagctagactggggaaagagattgaaggtaataagtgggattgctcgaggattacaatatcttcatgaggattcgcagctgagaataatccacagggacctcaaagcgagcaatgttctgttagactccgattacactcctaagatttcagacttcggcttggcaaggctatttggagtagatcaaacaagggaggtgacaaaccgagttgttgggacatatggatacatggccccagaatatgcggtgcgtggccagctttctgtaaaatcgnacgtgtttagctttggcg

SEQ ID NO: 54833 - DNA, 595 bp, Triticum aestivum
  Clone ID: PAT_TA_54833
tccgccatgaaggggaagtggctgtcaaaaaagcgctttcctgtagatactgccttgggtgttggtcttgcacttgtggttacaatatctagcacagccttgtgctactactggggcgtgaagagaagaaggtgagaagaaagagatccgagttattccgtaagaatggaggcttgctgttgcagcagagattttcggcattcacatctcaaagtaaggactcgtcagcaaagatattcagtgcggaagagctcaagacttcaactaacaactacagtgagactcgaatccttggccgaggtgcatatggcacagtgtataagggtgttcttccagatgagactctggttgctgtaaagaagtctagggtgtttgatgagagccaggtggagcaatttgtcaatgagatcaccatcttatcacagaccgatcacccgaatgttgtcaagcttttggggtgctgtctagagacagaagtgcctttattggtgtatgagttcatacccaatggaacgctcttccagcatatccaaaacaaaagtgcacctctctccttaacatgggaggataccttaaggatagctgcacaaatagc

SEQ ID NO: 54834 - DNA, 348 bp, Triticum aestivum
  Clone ID: PAT_TA_54834
cagctgctggcgggcaacttcgaggaggcgtgcaaggcggcgggcgctcccctgaccctgcgcatgcagccggggtacgaccattccttcttcttcatcgccaccttcatcgacgaccacattgcgcaccacgcccagttcctcaagagcggctgactggccgctagtcgcctgtagcgagtgatgcgatcggtagaactgccgtgtcagcggcctccgtataccatctgtgttgttatcacctctgtgttagtatgcgtggatcgatgatgcaccgtgtgttgggttgagactagacgaagtgtgcggaaataatgtggacggacggcttgcggccgtctctctctc

SEQ ID NO: 54835 - DNA, 598 bp, Triticum aestivum
  Clone ID: PAT_TA_54835
gcaacaggtattcttcatgttttgtatcttgccaagttcgattatttcttggcttagagcagcgccgcaagtagagagagaggccaagggtactcatgtgtcatgatagatagctgtgcaggagcagctcggggacaaagccaaggtctaaaatgctgaatcccaataaagtggtactgtatatctcagatgcaggatgacaaacttgtgaactaagcagcaaaaggacggaaagagcccgatggcgttgtagctatcgcccccttcagcgtccaggaaccaggcaaaacgccattgtcaatgtgagcggcgacgagcgaatgggcagcaacctcatgcaccatggcatgacgatcagatcggcgacgtgatcgttgtgctggacaatgccaaggatcagttcgtttttgtcaattgtcgtgtgggattctatgcccatccttttctgaaaacttctgtttttgttattcaaaatatttaagaacttgtgaaatttgttatcttttgtaagtaaatggcggtgtcaaagtgtcttgtatatttcaattaattctcaacaggttgccaacaaacttattattatggggtttgttctaaa

SEQ ID NO: 54836 - DNA, 576 bp, Triticum aestivum
  unsure (1)..(576): unsure at all n locations
  Clone ID: PAT_TA_54836
cggncgcgtgggcggacgcgtgggctggcttcttcgtcaaactcatcttcatccccatcaacaacatcatcatcgagcatagcttctctgatctcgttcgcgtctctgatctcgtccacgaccgcgaccgcgacggaagcctcctctgctcgccggtgtatggaagcacgagaagagtgatggccatgaatactatggtctccttgttagcgagtcagccaggaaatatgccatagtcaaagagcttgatagccctgttactttgaaggatgtgacagttgtcctgcagttcgaaatgaggcttcagaatggcctcgagtgtggagatggagtaggaggatgagcagcatcaacaaatgagcctgatggtgaagaagcacctgatgaccagaactcgttcaagtgctctttagtccttccaaaacaaggagctctaggcctaattttttttggagtgtgaagccgagaagccaagcgcgaatcagtgaagccctacttagcaaagcgtttttggttctgtagtagactgtaaattgtaatattgtaacagattgtaaaagactaatgtagtgttat

SEQ ID NO: 54837 - DNA, 176 bp, Triticum aestivum
  Clone ID: PAT_TA_54837
gccattttgcccgatactcgatttgtttacattctcaacaatggtggagtctctacatatttttttagctgatggagtgtctacaattgaggatggtgggaatattgctatgctattaaacaatgtcaatttcagaataaatatggacatcatacattgcagtgatgttcccacat

SEQ ID NO: 54838 - DNA, 289 bp, Triticum aestivum
  Clone ID: PAT_TA_54838
catagttaatacccaccctccgtcttaatataagtgtctcaactctaatactactttatagtaaagttagtacaaagttgagacatttattttgggatggaggaagtattagtttagagtaagagtttggatatggaaaggttcgtcccgaagaaggtttttctactatctccaaattcaactagagttttttcttttcctccaagttgtaatttgctttataagccccccagagtcgatcaatatgatcaggcaagttgaatacattttcctaccgtgtgttctctct

SEQ ID NO: 54839 - DNA, 612 bp, Triticum aestivum
  Clone ID: PAT_TA_54839
gcctactaccgcgaggcctacggcgggtacgggatggcgacgcccgggtacgcggcgccggtgccgtacggcatgtcgcaggtgaacatcgacggcaactgcggcgggcgccccatgccgccgcagccgacggtgaagatctactgccgcgccaaccccaactacgccatgtccgtgcgcaacggcaaggtggtgctggcgccggccaaccccaaggacgactaccagcactggatcaaggacatgaggtggagcaccagcatcaaggacgaggaggggtaccccgccttcgccatggtgaacaaggccaccgggcaggccatcaagcactccctcggccagtcccaccctgtgcgtctggtgccgtacaacccagactacctggacgagtcggtgctgtggacggagagcagggacgtgggcaacggcttcaggtgtgtgcgcatggtgaacaacatctacctcaacttcgacgccctcaacggcgacaagtaccacggcggcgtgcgcgacggcaccgaggtcgtgctctggaagtggtgcgagggcgacaaccaacgctggaagctccagccgtactactgagccagccagcgcgcgccgtgcatgcat

SEQ ID NO: 54840 - DNA, 497 bp, Triticum aestivum
  unsure (1)..(497): unsure at all n locations
  Clone ID: PAT_TA_54840
gcgaggccgtgtggttcaaggccggctcccanatcttcagcgagggcggcctcgactacctcggcaaccccagcctcgtccacgcgcagagcatccttgccatctgggcctgccaggtcgtgctcatgggcgccgtcgagggctaccgcgtcgccggcggcccgctcggcgagatcgtcgacccgctctaccccggcggcagcttcgaccccctgggcctcgccgatgaccccgaggcattcgcggagctcaaggtgaaggagatcaagaacggccgcctcgccatgttctccatgttcggcttcttcgtgcaggccatcgtcaccggcaagggccccctcgagaacctcgccgaccacctcgccgaccccgtcaacaacaacgcctgggccttcgccaccaactttgtgcccggcaagtaagctgctaggtcttgtagcaacgatcgagtgtctagaaactgatcgaccgtgcacgtacgtacgtacgcgatgaag

SEQ ID NO: 54841 - DNA, 552 bp, Triticum aestivum
  unsure (1)..(552): unsure at all n locations
  Clone ID: PAT_TA_54841
gttagatacagacgaagnagatgatgacacaactttcttgaagtaattctatccagtatttaccccaaccctcgtcccagaagccctgcaggtttcgctgaagttacttccatccatcgagctgcagtatataaggctaagtgaaacccggccttgttggacacgattagtcgtacactgttaactgttggatcaggaaatcctatctgcgctgatgtaggattgtcccatggagcagagagaggaggggagtgaagtgattcttcagtgctgattgatacagttccgcagtgtaatcggcgaaggatggatgcaagacttgcaatagctacgactatcagatgtgtatacttgttacatgcaagatgtaattatgttaaggtggtatccaggcgctgttaccagctgcgtgtaaccgtggccctgtgttatactgtagaaggcagatgaagcagccaggtttgtgtttcagcctagattcttcccgtggctgggcactgtttcattacctgttatactactacaatgcatgattcgcttgtcgtccttgtt

SEQ ID NO: 54842 - DNA, 474 bp, Triticum aestivum
  Clone ID: PAT_TA_54842
gggatagaaccgaaccttttcaattcaattgatagatcaaatacaccaatgtgccggaatagctacagaaacaaacacccgatgtaactgtgtgtatatattgcacaaaatagcaagataatagcttgcctgcgcaagtctaacggctcctccggtaacttaacctactggcacacagcctcatggtctgctgctcaaagcagcaaagctgcacaggccgctaccagcagaatgcaggtgcttacagccgtcgtgtgagcatcaaatggcgatgaaccgggaggtgcggcggcaccaggaggtgcattcttaggcgcgacaggggggaatggcggctgctgcacctctgttttgttcaattctggcattggtgccaccgctggcggctgggcctaaggagcggcatttctttggagtagctgcacgaggccgccgacattaacggtctccatgtaggcgggcttgtcctttcct

SEQ ID NO: 54843 - DNA, 174 bp, Triticum aestivum
  Clone ID: PAT_TA_54843
gcggtggcaaagatgtttctcattattaattacccgaatacatagtcgacagattgtataatatattatgtgcatgtgcatatacatagccaccgattgcattcacatacgagcacgctttctcgagccatgttgttcctaagaatatgtgtatgtccatgttcatgtaacaac

SEQ ID NO: 54844 - DNA, 548 bp, Triticum aestivum
  Clone ID: PAT_TA_54844
cgaatgcacatttttatacagaagcacgagcagtcgcccgatacagtttctgtcctcgagacctagtttcagtcaaatgttgctcatatcatagggacagtcatctataccacggaccgcacacacattttcttgtcgctaagaatgtacatgcactttctcatgaaaatgaactcaaagggcatctactggcggagctcacgaaagacatgcttccactggcgagcaagttcgaatgatggtttgtatcaacagcaccggcagcaaaacagatctcggcatgtgtacggggctgctctggcttccagctcctcaattgggggcacggcctcgagaacaaatccattctctctagtgaagcagaagtcatagatgttcctgcatatgcctttactgaacggatgaactctatcaggaattcccctttagtagaatatccgcttccttctggccactttataggttgtttgatttgtgagagcaatataagtgtgaaacatcaaccacaacagtaggaacataaggataaatatcaatattgccaatag

SEQ ID NO: 54845 - DNA, 539 bp, Triticum aestivum
  Clone ID: PAT_TA_54845
acttcacaaaaaaaataaattgtctcaatgaatggacaaaaatgcaaaaaatccagtagtagggctttgaagacaacaacccaattatcctttgtcatccttttgctcatcttggttcaagccccgtgattgaagcttcatttggtgatgccatacctggcatacgggtcgactcagaagaagtagggctcatgcacatgagaaatgatggcttcgatggagaccgtagagacacagtgttactgctaagcatgaaatttacagtggacatcgtaggcctatctgctgggttatcttggacacagagcaggccgatgtgaaaaagcttcactacctggtttcctggggcatggcctctcagagatgagtctatgatctctgcagttgtacccatggtccagtgttcccataccagacttgagagattgacagactcgtcgaagttccaggagcaactgcttcgtcttcctgtcaccacttctaacatcaaaacgccaaagctaaacacgtccgattttacagaaagctggccacgcacc

SEQ ID NO: 54846 - DNA, 525 bp, Triticum aestivum
  Clone ID: PAT_TA_54846
gaagtaaaattggatatgaactcacagttgtgatatcaagaatttggggtgatttgtgggatatcaagaataagtaaatagtgattgctctgagctattttatgcaattctccataactatattacacattgtcttgagatgtcaactgacactaaaatactatgagaaggttcatcttggagtctgacaagaagctttcatttcagcctccatgctcaactgtgtaattccttctgaatggtgcaggctggaagtggagcttgcttcacgtagaaggttcccttgttcattaaatggttcacctgtttttctcatagtttgctccttggtgaatgaccttcttagctcctctaaaactgatgcaacctccttcataatgggtcgttcttgtccattcatacttaagcatctcacagagagctgcgcaactgcatagagttgctcttcacttgcttcttccaaaatgtgtggctctatctccttaagtaggcgcccttcattgactacaatcaccatatgcatgg

SEQ ID NO: 54847 - DNA, 272 bp, Triticum aestivum
  Clone ID: PAT_TA_54847
attccgaggcaacgcacgggcactcaacttcaacttgtagatatatgcagttcagcaatgcaagaacaagacattgccatgtgctagggtaagcaaaaacaaggccgtgtccaaatgccgggcataaccacaaaatatgcttagaatttgaaggacacagcgttccatgaaaaactagttggaaccaacagcacgtttccctgtaacgcgtaattacaaggtggtacatgcagcacctttatgagatcaaaccagcaaaagattaacattgg

SEQ ID NO: 54848 - DNA, 283 bp, Triticum aestivum
  Clone ID: PAT_TA_54848
gaggggggcgaaccaggggatacacaggcattaaacaaaaccccatggggaggggtcttttttacggacaggggctccgaaaaaaacacagcaaaggggatttagggggaaacaaaggggggggacgggccctgaaaaaccgggggggggaaaagggccttttgagggggtcaaagggggaaaaggggaaaactgccccggggaagccgggaaaaaccaccccgccggacacgatgctgagaaggaagtttttgggggaaggggaaagccccggggacgcggc

SEQ ID NO: 54849 - DNA, 574 bp, Triticum aestivum
  Clone ID: PAT_TA_54849
gcgatctagaactagttgttattgtgagaattcttaattcaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatgggtcgtcctttatttgg

SEQ ID NO: 54850 - DNA, 421 bp, Triticum aestivum
  unsure (1)..(421): unsure at all n locations
  Clone ID: PAT_TA_54850
caggntgaccctgccaggtggcagccaacttcacctcccaggtcatcatcatgaaccaccctggtcagattggcaacggctatgccccagtgctggactgccacacctcgcacattgctgccaagattgctgagctggtgaccaagatcgacaggcgatctggtaaggagctggaggccctgcccaagttcctcaagaatggtgatgctggcatagtgaagatgatttccaccaagcccatggttgtggagacctttgctacttaccctccttttggacgttttgctgcccgttacatgaggcaaactgtggctgttggtgtcatcaacggtgtggagaagaaggacccaaccgactccaaggtaacctaagctggcatgaagaataaatgaggcgtttacctgaatccatctatgtctgc

SEQ ID NO: 54851 - DNA, 291 bp, Triticum aestivum
  Clone ID: PAT_TA_54851
gtccgaatcccggtcgccccgcgtccgatagtttaaagggagcactaaactatcgtcctggatgccaggctgctttgccgctagaagtcgccaagctactggacctaccgaatatgggtgcttaatgacaacttcaagaggttggagaacatattttcaagtttgcgagaccggtatcatgggatctcaagacattatacaaatatcctcttgcacagaaaaggcccatcattgcacttaattcaacaagatgacagactgttgttacaaaggaacagaagtgaatcatac

SEQ ID NO: 54852 - DNA, 455 bp, Triticum aestivum
  Clone ID: PAT_TA_54852
acatgcgctggaagcagactgtttgcttctatcaaaccatactaagtgaaaggctttaggccgtcttgattcacaaaccttgggggggacgaatatatatgattaatcttaacaaaatgcaagccggtgtttgaaacacaatatgctttatcaaccgattgagaacgtaacggttaatatctatactccattattgaggtagaacaataatacacgagctacataggtataattacgttgagctagtccagtacaatataacagcgtgacgtcgtttcgtacctatatattagtatgattaccaaggttaaacgtgcaacatatactttaggaactatttttatgatatggaacactcatttcatgtaatatgggctgaactatcttacctgatccttttgattaaggggcaccctgcccttttttaaccaatggcaaccagactacctatgtat

SEQ ID NO: 54853 - DNA, 413 bp, Triticum aestivum
  Clone ID: PAT_TA_54853
ccccgcgtgcggctagctatcgcctccccacctagcaattcacgtactccgtcatggccccagccgggatggcttcgtccgccaccaccgtcgcacccttgcaggggctcaagtcgaccgccggcctcccagacagccgccgttccggcagcgccggcctcagcagcgccagcaatggaggaaggatcaaatgcatgcaggtgagaccaaatgagggcatcaagaagttcgagaccctgcgttacttgccacccctctatcggaggccctcctaagaacggcgactacttgatccgctccaagcgggtaccctgcctcgagttcactaaggttggctgtgctttccgcgagcacaataactcccccgaatactagcccggtcgatactggacacgcgttacctgcctatgtta

SEQ ID NO: 54854 - DNA, 563 bp, Triticum aestivum
  unsure (1)..(563): unsure at all n locations
  Clone ID: PAT_TA_54854
gnttttcggttccctgtgggagctccattctggtatccaagcatttctaagaaccaatcaactcaaggtttatgataaggcaaggaatgcagttgctctcgccctaagcccagttgttcgagctcttcttgatccagacggtgcattgcaacaagtacgggacttggatgatcttgtgatgtcccagggatcaaaagactattaccatcggaatggagggaatgggatatgtttgacaatatatacaagttagatggtgttcctgtagtcactgttcagcttcgctacaatggatgggttactgaagtccaagacttggagaaatcaagacaactccaaaaagcagttggcttggataatctactctatactccagatgcagacttctcctgtttttcagaccttgcactgtcatctcctgctgactactacattgaaggacaaggttccctgatccaagctgtgctaactccaggtgatccgtacatgccattgccaaatgaggagattattagcaaggttgaaaaacaggtcttagatttgtttccatcagcccgaggctt

SEQ ID NO: 54855 - DNA, 463 bp, Triticum aestivum
  Clone ID: PAT_TA_54855
gtacactggtcatgtttccagggttgagcacaccgagtgctaaggccagacgacgttaagaaggggctagagctccgatggccaggactactggaaggataaatactatgccaccgtggtcgaggctggcattacactttctgagaccatgggttaactaacaacggttacgacggcagcactgctaaaacagaccacctaccagatcctctccaagaggtgccttgcctggagctcaccaagaccgggaccatgttacgccagcacaacgcctttgctgactactacaatgggacggccatgcaacaatgtgaaatctgcctattttcgggagcactgacaccacacatgtgatcaacgcgatacccgaggccaaaacaaattaccctcacacgaataggcgtatcatatcattgtacaacacgaccaacctgcagagcttgaggttcatgctgctactaag

SEQ ID NO: 54856 - DNA, 115 bp, Triticum aestivum
  Clone ID: PAT_TA_54856
gctctggcttctaacatgcttcagttctccagtttctggcttgcctgctcatggcgtctgccggctgtttaacacgggtgacctatttgtgaatctacaggatcgatgcgccttg

SEQ ID NO: 54857 - DNA, 521 bp, Triticum aestivum
  Clone ID: PAT_TA_54857
aagcaaactaggacgtcattttatagatgtaaaaaaatacaaggtattataataacatgcattattatgccaagtatggcatgcaacaatatttggaaagtggtcaatcgcatgggacttacctgcatggtgcttaggtgcctgggcacctaggtgccccaaacattttacctatataggacgacaatatgggacacctaggtctactcagctctactgcttccttagttttgtaccaccaccaccaccactccaaagctagcttctatttcaatccatttcatacacagattgactggctaccgaaacattttttgcaacagggtcctgtactcctggctccgcgaccactcgtccatctcgcgggctcgcatcacgggcagagggtgcgacagctccctcgtctgagcgttccggatgtaccacccgaccgggttcgacgaggccttgtcgtaggagcgggcttgctccaggaaggcgtccacgttgagctggtccgacagggacgggcatcctcccgc

SEQ ID NO: 54858 - DNA, 455 bp, Triticum aestivum
  Clone ID: PAT_TA_54858
gccaaagagacctgacatgcattgttttctttatttacaatctctcgaataccaagacgttacaatactcacgcacctccccatgcttatatacacaggcagccgatagaaacaacctgggcctacacagacatgacaaccggtctcagcttgctccatatgatatgcaagccaacaataatcactcggctaccttgatcactattagcttaaacattattgaatacgactagtatcactagacccacgtatgtatctatcgactcactcttgatcagctagctaaagaagcatgaacgagcattttgtacatttccggacatgactaaaggcaattatttttaacagttggtattcgccttactgatgcaaacttgtttgaaatcatcctacctaggctcgacatcagaaatcgtcacgtcattgcctgaaacgggggtaggcagttgttggct

SEQ ID NO: 54859 - DNA, 427 bp, Triticum aestivum
  Clone ID: PAT_TA_54859
agaggtcatataagctaatattatgcatatcgggcatatacattgtcaccgatagcatggagatacaagcaggcttttttgagcacatgactgtacatgaacatggacatacacatattcttaggaacagatcacatggattggtggaacaaggagaacccacggcatggtcagagttgcaagaaatgcggtggcgctttatatatggcctggcgagagtgagctgattatggcttgccggactattcgaagtccgtggggtagaaggataggaagctgaccaagtgaacctgacgcatggtgctgaatccgataatgctggcatacctcggacgagactagcttgttgatctactccgctggtttattacctttgaggttgaagatgcacccctacataggacaggttccaaattgatcaataccg

SEQ ID NO: 54860 - DNA, 458 bp, Triticum aestivum
  Clone ID: PAT_TA_54860
aagggcaaccatgccttataccaaaagataaggtcccaattattggagaacaacagacattcacggtcttaaaaaataggccggatcagatagaaagcctaaaaataatacagggggaaacaagccgaaccattaagtggttaaatgttggtttccagaccatagcaaaatttgtttaattagaagtcgggctttttagggtaagtgcaaccagactgctggatgataacgtttgttgctaaccaaccggcctttacacaggactaaaagctcttctcttgaaccaactgatagaggaagcctccaacaaaagcatgaccaggggcattggtgcaaacaagattttacttggacaataggaacacaggcaatgtttgcaccttcccatactcagacacaactactgtgtaagaaccctgggaaattacagcattccttttttgtttaccaaaagccaa

SEQ ID NO: 54861 - DNA, 556 bp, Triticum aestivum
  unsure (1)..(556): unsure at all n locations
  Clone ID: PAT_TA_54861
cgttcataatttgacataaccatttagtagttaatctctcatattgatgatcacacataatttacaataagggtagggtagtctgctaccatactgatttagaaattctctgtagaactaccacactgtaggactgtctcatagtgacaatcacacataatttacaatggtgtggtagtctgctaccacacataatattactcgataaaccaaaataacttcattttcttatgcggtcgaacttcattttcttatgtggtcgaaacatcggccgcattcaccacttaagctcagatgagtagtaaccagtaaccactattgttgtcctcatggtcagatgaatagtaagccaggaaactcatcatattcggcgtagtcagactcatcatcacacgtgtcattaccgatggtcttgatggcatcagtcgacatcatagacaaatagccaaggttgtcagcttcttcagtaagaccatagcaatcccaggtgacgtcacccttgataggagaagagcctgaaggcangtaattaactggcactttgacaatatgacct

SEQ ID NO: 54862 - DNA, 523 bp, Triticum aestivum
  unsure (1)..(523): unsure at all n locations
  Clone ID: PAT_TA_54862
gaaaaacggtaaaaatgcattggacagaaacagaaatactaaaagcagacagtaacacccaactaatatctgaaatcatgcaagcacacacgggtgatttctgcgccatccgacggcacaacaccgggcactgaaccggtagagatgcacactaagaaagccaatgacaggctcaagttggtacaatgacaccgccatgaccacagggtctggggaccaaatttaacacgttacaggtgacttgactccatagcagatagaacagttgggagaggactcctcggtggacttggccttacacttaggagccggatggctgatctggaaggcgaagacggggaagggcccaccgatgactgaggtggtgcggaagactatcttggagccggaggggctgatgaccatcttatagatagcgacccacatgagcatgtccttgatcttgacaccggtcatgctgtgcatacagccgagctccaccacggncgtaacctcgggtggcgtaccagtacctgcttgccga

SEQ ID NO: 54863 - DNA, 174 bp, Triticum aestivum
  Clone ID: PAT_TA_54863
gggggccggaagaaaagctcactggggggggttttcacacatgtcgccgcagaagtgatcttcaaagggtttggactgaagggaacattttggtcctttatttcacagggctaagggctaaacatttagctttccaaaaaaaatgctgggcgggttattcttacagtacaaaac

SEQ ID NO: 54864 - DNA, 143 bp, Triticum aestivum
  Clone ID: PAT_TA_54864
aagaaatcaacaccattagattcattatcaaatatactttcacatagtataaatttgttatggtaaatatttatattttcttctataaacttggtcagactttaggaagtttgacttcagtcaactctaatatgcgaagtaaa

SEQ ID NO: 54865 - DNA, 417 bp, Triticum aestivum
  Clone ID: PAT_TA_54865
acagaaacagccacataagctaaatgcaaggctccaactttccaacaccaaggaaaggaacagagacaccagatacactcccagaataaaccgtcctgactttggggcattcatgatgcatcacaacagtatccccacgggtttaggaggttcccctttgtcagtgggcatactgcactacatgaacataaatgtgaagaacatacgcatgacgcgtgattacaggacaaacggcaaccgacacagcacaggactcacatgatttagaaggtctactcttttcacaagccaccaggtcactttgttgggggcaaatgcaccacacaaccaacagcttagcgctttcatagaccacggacggaacacatcattgcgaaaacatattccacaacttacagggatgatatttactaaaaa

SEQ ID NO: 54866 - DNA, 473 bp, Triticum aestivum
  Clone ID: PAT_TA_54866
cccagcaggaaaataaaaaataaagcccaagcggaagcgggggcccgatccccccatcagaagagagaacgaccatgttttttcggccctggaaaattaacacggacgggaaattcgtactttaaaacttttcccgggaaaaattcacacagaaaatgatgctgcatcgggcgcatggaacgcagttgatccataaaaagccgagggggggggacgggaaataaacggccagttaaaagggggggcaccctttggggggccccggaaataacgggaagcaggttgttgccaaaggggtcgttgaggggcccccacaggttttaaaaggggccctccccggggacgtaggcctggataaaaaaccccaccagggaaaacatggccagccgcccgtttttgatctccttcaccttgagcaaccccccctggtcggggtcggtggcaaggccaaccggttcaaatgggccaccggg

SEQ ID NO: 54867 - DNA, 400 bp, Triticum aestivum
  Clone ID: PAT_TA_54867
aactaccaatttctttcatcccttatgctataaccacaagctgacattcaaccacaacaactaatacatatgtacatgttcatggatgattacacagcataagcactagcttgaccaaaccactctcccacggtcagccttgtcatggctggtgagctgatacaggcaccgcctctaattgcacccaccaccctaagatgtctgtcctccgattgttgcaccttcaaatagagcccaaattccaggtgctctgggaccggaacacctttaatctgcaatgtaacaacatatctacattatgcacaatgtgcgaatccacactgaaccatactcatacttataccggttcctgagatcatagcatacaagaacatgtttcgcaactgatacttgggtatgg

SEQ ID NO: 54868 - DNA, 632 bp, Triticum aestivum
  Clone ID: PAT_TA_54868
cccacgcgtccgtgggtgtagtgtagcacaaaagatgaagcagttaagagaaaagttacaacatgaaaaggctagtggcattataattactgcccttgatgaggttgcttggttgtacaatgttcggggaaatgatgtgcattacagcccagtggttcattcttatgctattgtaaccctgcatggtgccttcttttatgtggataagagaaaagtaacaactgaggttaagaattacatgtctgaaagtggtattgatatcagagagtatgatatggttcagctggatgtgagcttgcttgcatctggacagctaaaaggttctgcagttaatggtagcttgcacatggaaaaggatatcaacgtggcggaacattccaaaatctggattgattcaaattcgtgttgccttgcactctactcaaagcttagaccagatcaagctttgatgctgcaatcgcccattgctctaccaaaggctgtcaagaatcccatggagctgactggtttgaggaaggcacacattcgagatggtgcagctgttgtgcaatacctggcctggctggataatcagatgcaagagaactatggggcctctggttacttcagtgaggccaatggatcacagaaaa

SEQ ID NO: 54869 - DNA, 558 bp, Triticum aestivum
  Clone ID: PAT_TA_54869
cactgagtctttttttattgctcggggaacagagatgccttccgatctaaaagaatatctgaaatgtgccaccaaatcctattgtcaggcaacacgaacatatttccgtcctaaagccgaacctaaatgcatgacgtaaaccatgggatatcacaggaagattattgtcaagctaggctagaaattagcagagaagctattttgttggaggcagatctgcctcggtgagaatccggcggcatgtcttgcaacgaggccgcctgcacccttgccgccctgatcctccatgatgacgggatccccatcacttttgataagatcgcgacgggggtgaaagctgccggaatcaaggttgaggcctactggcccgcgctcttaaacaagctcctggagaataggagacgcgatgacctcatcctttcctgcgaatctggaggaggtggagctccagatgttgatgctgctaccccggctgctgttgcagctgctgcccctgaagagaacaaagaagacaaaagtgagaggcttaggaagacagccatgattacatgggcttca

SEQ ID NO: 54870 - DNA, 478 bp, Triticum aestivum
  Clone ID: PAT_TA_54870
acggtccctcccctcgtcggctcgcctccaacctgcagggcgtccgcactcggcagcattgctgcgtcctcagcggcgccagacgggcaccgccgacctaccttaacaagttagcaaggtctcgtagcctcgtgtggagggagggagaagggatagaagaggagtccggtgcatctggatccgtgccgccaagctgactttctccgctccacgcatcctcctccacctcctccccgcgaccccggtggtgctatatcacgcggtcgtcgcgaggtggtgcgccccatccctccttcgtagcagcttcagcaggaggaggaagatggcggcaaagaagaatgccggggtgctcgcactcttggtcgtcgacggcaccctcaccgtcccctgcaaggaggtgacgccggtgttgctcgtgtttatgaagcgcctgcgtgagaatgtgaccgttggcgtggtggggggatccgatctggac

SEQ ID NO: 54871 - DNA, 273 bp, Triticum aestivum
  unsure (1)..(273): unsure at all n locations
  Clone ID: PAT_TA_54871
nnctggggctgtnnncgaaaagcataccaactctattggggagaattagtgtgattcaagctccaagacctgcatgcgcgtcaacgcttggcancgtcaagcagctgctggcgtcttaaacgggaggctaagatctgcaaatcactttaaggaggtctcttataagcttttttttttagtggncgagctttttttgtgtgtggcgcagcacanggaagaaaaggatcaattgcgtgtgaaggcaaatgaattggcaggtcttttcatgtcgtg

SEQ ID NO: 54872 - DNA, 591 bp, Triticum aestivum
  Clone ID: PAT_TA_54872
tcgtccacgcgttccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggctttttttaggggttccatgttttttttccgctttgtttggcaactttttggttttttttttagggccccttaatttaatttctttggccgtttttttacaacttcgtgtttggaaaaaccttggttttccccaatttattggctttgcaacatttcccctttttgccagttggttttttagctaaagggcccctccgtttggccttttcaaacatttgcccatcttttttgtttattggaaccccccttttattggttttttaagcgggggggtttttttggtttctcgcaggttgtcttttccttttgtaggggccttagcgcccgtttttttggtttttttcctttcttttttggcccgttttgcggtttttcccggttatttttttaatgggggtcttttttttgggttcctattttttttttttagggcctttgcccccaaaaat

SEQ ID NO: 54873 - DNA, 565 bp, Triticum aestivum
  Clone ID: PAT_TA_54873
gccacgcgttcggctggcttgtaagctcgtagatgtgttagcatggtagataatgaaatactgactttagtgctatatgcgctggattagggactacagtaatgatgaatagaaacgggtaggggcatttgtattgggacgctagaggagaaatcgttggcttgaccgaggacaaactactgagaaagcatttgaccctggacgattgcattgatcaagggctaaagttaagggatcgaacacgattagataccgccacagtctataaccacatactgtgccgactagagattgatcacgtttattatgactcgctcaacatcttagcgaaagtaaaggttttgagttctggacggagggtggaacggagggagctatatggagttctgcaggcttgttcatacccttgttgattcaaagatcagcttcagtgcatccataactacattaagcataatccaaaccgtgtaccatgattgctttgctttctgcatagaaaaaggtaacaagactccggcagctctcctgggacctgccagagatggggcaagcctgagtgcaagca

SEQ ID NO: 54874 - DNA, 420 bp, Triticum aestivum
  Clone ID: PAT_TA_54874
gccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggtacctgcggtgggccctgcaagaagtactgatcggctcatgccagcatgatatgttccgcctaaaatgaaataaaagctcagacgagatgagcagcgtcatcgtgcctatgcgtgtgtgtgtggccaacaaatatgtataccagtatgccgtgtcttcgtcgctgtgttttctctctcgagaaaaagttggtgttgcttgttgttcagatatccggaatatcctccgtgaataagtaatgattgtgcgttggtggc

SEQ ID NO: 54875 - DNA, 618 bp, Triticum aestivum
  Clone ID: PAT_TA_54875
ccccgcgtccgaaaaatgtctattgcacctgaatccgaattcgttattcctaaccaatcgaccattaatctaggtgttcagttgaaagaaaaggatgatttacaactagtcgaaatccctgtcccaaaaccagaaaaggaccacgtacaagttcaacttaaatgcgtgggtatctgtggatcggacatacacttgtggaaatatggtgagattggtatctttccagtaacccaacctcaacttctaggacatgaaggtgcaggtattgtaacagcagttggagaaaatgttacatcattacgtgttggagacagagttgctattgaagcaggaataccatgttctttttgtgatcaatgtatgagtggaaggtatcatctttgcccggacgttatctttaaatcaacccctccttatgacggtattttggcaaaatatatcacacatcctgctcgttggttgcacaaaattcctgccagcattagcttcgaagagggcgctttacttgaacctttatctgttgccatagctgctgtagatcgagttcgagccaagttcggtaaatcgctactcatcactggttgtggacctgttggtttgttgatacttgcaggtgca

SEQ ID NO: 54876 - DNA, 551 bp, Triticum aestivum
  unsure (1)..(551): unsure at all n locations
  Clone ID: PAT_TA_54876
aaacaaactgctcgtaaatcaactggtggtaaagcacccagaaaacaacttgctactaaagctgctagaaagtcagcacctaccactggtggtgtgaagaagcctcatcgttataagcctggtacagttgctcttcgtgaaattcgtagatatcaaaaatcaaccgagcttttgattcgtaaacttcctttccaacgtcttgtaagagaaatcgcccaagatttcaagactgatttacgtttccaatcctctgctattggtgcattacaagaagctgcggaagcttaccttgtttcactttttgaagacactaacctcgctgctattcatgctaagcgggttactattcaacctaaggatattcaattagctcgtcgtcttcgtggtgaacgatcttaaggccctagttgcaatctattaaaataaagatcgtcttgagataaaaacattatgcaaaaataaaatttacgtcatttacaataaaaaaaaaagatgatcaatacatgatattcagtttttaaaaaaaaaaaanaaannaaaaaaanaaanna

SEQ ID NO: 54877 - DNA, 373 bp, Triticum aestivum
  unsure (1)..(373): unsure at all n locations
  Clone ID: PAT_TA_54877
tcgcgatctagaactagtctggtcaagatcgcgggggggngntncagaggngngnnggcngngtgggcgtgcgcgcggggcgagcgcggncnggnggggcgcacggncnccgcggggggggccgggttcttcncctcnnnnnnccgcggggggggggggggggggttttncngttngccttnttttgccctgctcgttttgggtgcgtttncgctcncgtcgtgtgcgtttttntgtncggggggttggctctgggcncggggtgcctgatcgtggggcccttttgtttggagtttttacgcaccaacagttccggggggggggggcctttctccctccctggttgtgtgggctcctnagaagttgagtttct

SEQ ID NO: 54878 - DNA, 478 bp, Triticum aestivum
  Clone ID: PAT_TA_54878
gcgggacatgaagatgaatatcatcataagtaaaaaaaaaaagatgaacatcgatgaatcaaacaatgcatttgcccggatccttataatttacatcatgggagtacaaaacaaatcatcccgcagcttgcaagggcaagcatagggggtgccttacttgccgggcaccaagttaggggcgaatgcccatgcgttgttgttgactggatcggcgatatggtcagcaagattctcgagtgggcccttgccggggacaatggcttgaacaaagaagcccaacatggaaaacatggcaagacgaccgttcttgatctccttcaccttgagctcaaaaaatgcctcggggtcgtcagctaagccaagtgggtcaaagctgcctccagggtaaagggggtcaacaatctcgccaagtgggccaccggcaacgcggtacccctcgacggcgcccatgagcccaacttggcaggcccaaaaggct

SEQ ID NO: 54879 - DNA, 580 bp, Triticum aestivum
  Clone ID: PAT_TA_54879
attggttatatcacgtttcttttatacaaatattacatatgaacttgtttctcttagatagaatccatacgttgaggcttaagttgttctgatagattagttaaagcgattaacttttgtacatgttgtatattcaaataatcaggaacataggaactgatagtgacattatgaggctcaggttgatcataatcactttcttcaagtgatacattatcaagtaacaagatatcctcagtatcgctactgctcacacgagatgctacagctcttaaaatatcattgtgaattggttcctcataatctgcgacaatataattttgtatcaacttttgaacttgagtaggtgccaaaaaccagcaaacatcataaataatctttatatcctctaatgtcgccttctttagttgtaataactttgtggcctgtgtcaaatgctctagttgatttgtagcttcagatgcttcatgcgatttacaccattcttccaatcttgtaatattgtattgaatttgcatagctctcttccaagaattaaagttacgtctcataacaagatcattaaaggtagttataccaa

SEQ ID NO: 54880 - DNA, 597 bp, Triticum aestivum
  unsure (1)..(597): unsure at all n locations
  Clone ID: PAT_TA_54880
gaaccaacacaacaattatttcatccaggttattgcacggtgttcaacagagaaaacaagatacaggggaaatgacagtaaaaatgctgaacccactgcggtatctatttcgtccaagtaatgctcggtgttggcaggtggcacgatgtagtcgccgcttaggactgagaagaactcatgtcccagaatccaatctccagctcgagcacaccaagaaaggcctcttcagctctcttgacaacaacaacatcatgtggcgcattcgccaagcagcgatcagcgatccgctgcagagactggcagtactgcttgaactcagggctgccccatctctgacaggtcccaggagctccgccggcgtcttgttaccttcttctatgcagaaagcaaaactatcctggtacacggtttcgattatccaaaatgtagttatggctacactgtagctgatctctggatcatcaaggctttggagaaacctgcagtactccatattactccctccgttccatactccccccagaacccaaaaactntactttcgctaagatgctgagcgagtcataataaacacgcccaatctttagtcggcatagt

SEQ ID NO: 54881 - DNA, 269 bp, Triticum aestivum
  Clone ID: PAT_TA_54881
ggtctcattaatttaacttcaggccgccctagggtttcttgccctgcccattcagctaacagtcgttggcaccaaccccctggtgattggttgttcacaccaataattggaaaacaaaaccccggaaaatgacgtgcctttcatatataaatcatcctgccctgccctcatcagggggtgtgtcccttctggaacatgcccttcttggccctccggctctgaccctggcccgttttgcttcctttcttcgcccaggagttggcacttgg

SEQ ID NO: 54882 - DNA, 198 bp, Triticum aestivum
  Clone ID: PAT_TA_54882
acaaattgccggacaaaaagacgagctgaggcttattttgacggggcgcacacacaccacgctacagatcactcacaaaaccaccaggggggggggggaacgacgcacacgcgcgggcgcgacgttgcccttattacgacgtaacgtacatacggacggacgcggggtcgcccgggaatccggccggacctgaggcgc

SEQ ID NO: 54883 - DNA, 569 bp, Triticum aestivum
  unsure (1)..(569): unsure at all n locations
  Clone ID: PAT_TA_54883
attgatacaaacggcttgaactgtttattttgattttttaataatcatattttttaaaagacaaaagaaattgaacacgccaattaatttaatttagtatttggactttgattgcaccacgagaataatcgcttgttgtttcaaatgccttgagtgcatctttgaattcatatttatgagtcaccaaatgcttaatatcttgaatagcgccactggacaataaagcaattgcacgaggataagtatgatgatatctgaataggccgcgtatatcaacttcacgcatagcgaaattatttacaggaattgtctgatcattttttcctacaccaacaagacagcaagtgcctgcttcccgggtggccatgatagccgttctgaatgacgattcaataccagtgcattcaagagagcattctgcaccctctccaaccaaacagtttcggatttcattcactgtttcagtctcggaatttcctggtacgatcttgtangtgaatgtggctcccatctttntagcatattccaagcgatgatcctgcacatccgtcatgcctattggatgtaca

SEQ ID NO: 54884 - DNA, 536 bp, Triticum aestivum
  Clone ID: PAT_TA_54884
attataaatgaagggtttctctttattaaatcttttcgtaatccaactttgtttccaatttttttgcgtcttgaagttttcttactgctttcataaaatcttcttggatacagtaatcacgctcctctctgatagcagacattcctgcttctgtacacacatttcttaaatcagctccattgaatccatctgaaagctttacaatagcttcataatctatatcgccatgctttgcaatattgccagcatggatttttaaaatttccaagcggccttgttcgttgggcaatggaatttcaatctttctatccaatctaccaggtcgaagcaatgcagggtcgagtgtatcaggtcggttggtagccataataagctttgtctgcccaaggtaatcaaaaccgtccatttgatttaacaattccattaaagtacgttgaatttctctatcagcagatgtaccttcagagaaacgacgaccaccaatggcgtcaatttcatccataaaaataatacagggttcatgctcttttgcatag

SEQ ID NO: 54885 - DNA, 284 bp, Triticum aestivum
  Clone ID: PAT_TA_54885
aaaacggaatatattgtgttgaccctctttttttttttttggaaaggaccgaaattttattttggcaaaaggtttttatcccaaggcggccttttttttaaaagatgccaactagggccttaaaaccggtccccaccaaaaccacgagccaatggaaaacccccagggggaatagcaccccgcttagcatgaacagcagcgaggttagggttctcaaaaagggaaacaagggaagcttccccaccttcttggaaggccccaatcgcggagggttggaaacgaaa

SEQ ID NO: 54886 - DNA, 514 bp, Triticum aestivum
  Clone ID: PAT_TA_54886
aggctcagaaataaccttgggattcagctaacaaaccagtttatatttgatacagacaagactacaagagtagccgctacttaataacataagctttacattacgagggtttaatttccgggcgggaagtcaccggcgtcgctcgttgtacaggcagggcctagtcgtacacaggaaacagcaaccagcagctgagctgagctcaaggggagattgatctggggatgatgatgtcgccgatgttgttgtgccacgggtcggcgaggtgggaggcgaggttctccagcgggccggtgccggggtacgccgactgctggacgcagaagccgacgaaggccagcatggcgaggcggccgttcttgatctccttgagcttgtactcctcgaacttggcggggtccttggagaagccgagcgggtcgaaggcgccgccggggtacttcttcttctcgggggccttctccatggtgcgctggtgctcggcgaaggcgatggccacgaacttgatcaccag

SEQ ID NO: 54887 - DNA, 551 bp, Triticum aestivum
  Clone ID: PAT_TA_54887
gagaccaaaagatattcgtggatttatacgccgtcttcacattttaccaaatttgtgacaaaatgaaactgcgtaactaaagatgattagcatatgacgacagttatcaaacggggctttggttcacgaacaacacgggatggtgttattaattatttgccatacaggaaagctttgacccatgtccgaacattgagttcaccaggccaagtcaatacattctttgaattcaaacggagatccaatgaatgaactagcaatattcaaccgtgtaccatccattgagaaagcactcaatactgacacaggaactttaggactcttacacaagaatcaagataccgctcttcttgagcatgttcaaataattaggccaggacttgccaacgatcttcgtagccatcatgtcagtcaatgagtcggactcagggtcaatcccttcttctttttgcctcaatacataaccattacatcctaactttatggcatgttccaccttatcagggatcacatcagaagcaatgatcttagcacccatagacttagcccat

SEQ ID NO: 54888 - DNA, 186 bp, Triticum aestivum
  Clone ID: PAT_TA_54888
ggacgcggtgccaggctctgacctcgctgatttggcggtgcatcacccgcgcccggtggctggccccggtcagcgtgacagcgttccgcggggccgcctcttccgcgggcggttccggccgcctctgccggcggcgtgcttcgtccgcgggctgtgcggcgtctgctcgcagcccgtgcgcgtgtc

SEQ ID NO: 54889 - DNA, 457 bp, Triticum aestivum
  Clone ID: PAT_TA_54889
ataatattgtactattatttatgtttattattacgctaatataaagatattatttaattctcctaaaagttatatctttaaaattattcttaaataaatttaattcggaagatattttatttagatctatttttaagttagttccatattgttttttatcatctaaaaatgtttcatcaatatttcttttaatatctttaatgtatttattaaattcttcttgtaaattatttactaattctaatgttctatctgaaataacttgattagtatttatattaattgattcaactttataaaacttattgtaattattatattctatattatctctactagacttatttttaatattttttttatttccatgattgttattaatataggtatcatcataatattcattgccattgattgctaattgtatttcaggacttgttgtttttttcatcaatta

SEQ ID NO: 54890 - DNA, 495 bp, Triticum aestivum
  Clone ID: PAT_TA_54890
acatgcagctcatcttaatttagggaagcccaatctcattcagaggttcaaaacacaagacagcgacatacaactagcctgatatgtgagtcaggggggaaggccaagatccattctcagacattatagctccatatctagcatcggtcccatctgaactaggatgatgaatcatgctagagccatatgtcaatttgaatgcaatctatgatcccgggatactaaccttatttttgatggggaaagacagatgatgcctgatcttaacaccttaacgcacaacattcatttgcgctactctgagggctccagttagcagccgggtgcaatgcaggaaccaacaaaaaatggctctgcaaccgacaatagtgtggactatgagcggtctgatccaacttatcactccaggttgccagatgtcactaccgcaggtaatgatatcgattactggttccatgcatcaccgcaacttttgcagcacagtaagccctgggg

SEQ ID NO: 54891 - DNA, 636 bp, Triticum aestivum
  Clone ID: PAT_TA_54891
tgcctactcttcaatatcaaaacgctactcaaccagatattacttatttacctgaccttaagaactacaagcaacgtaccgctcgtcgcttggctaatgaacagctggaaaacgaccttcctgaaggcttccctgctcaattagaaggtcctaaattatggaaaggctctgattatgaaggaaaggaatccgaatgggtttatcagttgactgaacaagaacttgaagaagtcgataaagctgttcatgattttgaagcaactgagaaaccattgggtgaaatcaataaagaaaccttccctcttccaaaccttggtcctaagttgaaggaattaatagagaaacatgtattggatggtagaggattcgtagttgtacgtggtttaaatcctgacaaatatacaagggtgcaaaacatcattgcttataccggtatttctgcctgggttggtaaacgcggtcttcaaggacttcatacaattgctcatattaaggatcttgttccagaaaagggacttgatgatatcgttgctcctgcttttacaaatgatcatcaagtatatcatacagatgtgggcgatataatatctctttatgctcttggagtagcagaagaaggagcaagtcacgtatcgc

SEQ ID NO: 54892 - DNA, 640 bp, Triticum aestivum
  unsure (1)..(640): unsure at all n locations
  Clone ID: PAT_TA_54892
cgaacttattgccaattgtttaaagacacaaggagtagaagtcgtatttggtattgttggcatacctgttgttgaggtagcagaggcttgtgttgcagctggtatacgctttattggctttcgtaatgagcaatctgcagcatatgctgcctctgtctatggctatttaagtggtagacctggtgtttgcttaagtgtgggtggtccaggtgtggtccatgcccttgctggtctactcaattcaaagatcaattgttggcctatggttttactctctggttcgtctgaaacggatcaagtcgaacgaggtgcttttcaagaacttgatcaagtggaagcatgtaaaccatattgcaaatacgctgctagacccacatcgcttgagcagttacccttcatagtcgaaaaggcctttagaacggctttatatggacgacctggtgctgcctacgttgatttgcctgctgattttattcaatacccgattcgtaataagcaagtgatggaagatattcaagtacccaaagtgcctaatgctccaaaagcaatggctgatgtagacgatttaaataaggcagtgagtttattgaanaacgcaaaacatcctcttattgtggttggtaaaggcgcttcctatgcc

SEQ ID NO: 54893 - DNA, 391 bp, Triticum aestivum
  Clone ID: PAT_TA_54893
gccctgctgctgaacaaagatggcccctctgaggcaagttcatctgccatgagagatcttgagtcaaagcttgacgcaaccaccaaagaatgtcttgctgagaaggaacagaaccggaagctgaccgtggagaacgagaagctccagtatcgtgtctcccatctcatccggacaatcaaagaggcggaggcaagatagagaagcctctgataagctggacctcgtaaaactagttctatttgggattcgagagaggcgttcatctcgcaaacctgtctatgtgctcgatgttgacatcattgttggagttagattaaactgttgtcctgagattgatgaaatgggcctggtacgtgttagcttatatagcagtaatgtgttgatcaggcca

SEQ ID NO: 54894 - DNA, 654 bp, Triticum aestivum
  unsure (1)..(654): unsure at all n locations
  Clone ID: PAT_TA_54894
cggacgcgtgggttcgactttgctggtactggaatgaataaaatgttgcgtgatgatctgcggcggccaggttgcttcctggctgctgctgctggtnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcggccgttttaaaagaaccaaagctaacaaacccgtgaatgcaacgtaaaaatttttttaaagggcccccaaaattaaattaacgggccggggtttaaaaacgtcggaactggaaaaaccctggggtaaccaaactaaatcgccttaaaaaaaatccccttttccccagctggcgaaaaagcaaaaaggcccccaccgatcccccttccaaaaagttgcccaccctaaatggaaaagggaaccccccctgaagcggaaaataaaccccggggggtgggggggttacccccaggggaaccgttaaattggcaagcgcccaaaccccccctcctttactttttttcccttcctttttgccaaaattcgccgggttttccccgaaaatctaaaaaaggggggccccccttaaaggttcccaaataaagggttttaacggcaccctccacccc

SEQ ID NO: 54895 - DNA, 634 bp, Triticum aestivum
  Clone ID: PAT_TA_54895
cccacgcgtccgggattattcaaagcatatcagtgaagctagtaaagctagaaatccctctgcaattcgtgctttaatgccttaccttaatagaaaggacatgatctcattaggtgctggtcaacctaatcctgctacttttccatttgctagtttaacattgacactcaaaacaggcgaaaagattgaaatagatgaccaattgtttgatagatcactgtcttatgatttgacatctggacagcctttgttgaatcaatggttgactgaacttcaaaaaatagaacatgctcccccggttgactttgatgtttctatcggttctggctctcaagatcttttgacaaaggctcttgaaatgatgatcaaccctggggatgcagtcatggtagaggaaccaacctacacgggtgcattggctttccttgaaactatgccttgcacattagcacatatcgctactgatgagtttggtattgttccggaatccctagagaatatgcttgctcattggccagaaagtaatcccagcggtaaaaaagatcaaccgagacctcacgttctttatactattccaagcggaggcaaccctacaggtatcagtgctacctatgaacgcaagcaagccgtttat

SEQ ID NO: 54896 - DNA, 377 bp, Triticum aestivum
  unsure (1)..(377): unsure at all n locations
  Clone ID: PAT_TA_54896
atgggtgttactgttgaaactatccaacctggagatggcaagaacttccccaagcaaggtgataccgtcactatacactacactggtactctccaaaatggttccgtgtttgattcctccgaaaaacgtaacgaacctttcgttactaaaattggtgtcggaagagttatcaaaggctgggatgaaggtgttcctcaattatcccttggtcaagaggcaaacttgatttgtactcctgattatgcttacggtcctcgtggtttccctcctgtcattcctcctaacgccactctcaattttagagttaagctcttgaagattaactaaatcttattatcttaaataaattataaatgtgttgctcaaattgagctant

SEQ ID NO: 54897 - DNA, 403 bp, Triticum aestivum
  Clone ID: PAT_TA_54897
gccctcgtccgggctccgtggaggaggctgtggataatagtccgttgtacggtcgtggcgggcatgatcacctactgcggcctcaaggtgctacaactaggtgaccctacttggctgtgcgcatgttccagcgtgtccaattgcgtggaagtgtggcccacgtcagccccggggggaacagggacgacggcctaatctggagtacaacgcaacgacgacgctgagagctttcctacgcgcactggttgaaccccctgaccctaacttctggctccatcggctacaggctcggtgcgccctgcgcgccgtgcccggactcggaggatggatggaaacccaacccaccaacgtggggctgaagcgccaagccgtcatagtgcagttcaatgcaagctactgttgg

SEQ ID NO: 54898 - DNA, 649 bp, Triticum aestivum
  Clone ID: PAT_TA_54898
cccacgcgtccgttttcttttttagaacttgaattatacacataatggcaacaaccgtaccaccacaacaaattacagctgctcaaaaattagcacaagtgaatgaacaaacttggttaacaatgggtaatctagcggaaatgatgacggattatgaaaaagcaatgaattgttatgaatctgctttaagacataatccttattcagtcgttgccttatctcagatcgcgtcactatacagaggacgtgaacaatttggaagagccgtagaatattttaaacgaattcttgctattcaggaaaacaacggtgagacatgggctgctttaggtcactgttatttaatgatggataacttacaagaagcttaccaagcttatcaacaagcactttatcacctttccaatcccaaagatcctaaactttggtatggcattggtatcttgtatgatcgttacggctcattagaacatgcagaagaagctttttcggctgtgatgaaaatggatcccaaatttgaaaaggccaacgaaatttactttagattgggtatcatctataagcagcagcaaaaatatgatctgtcactccaatgctttagatatattcttcataatccaccaagacctcttacagaatctgacatttg

SEQ ID NO: 54899 - DNA, 472 bp, Triticum aestivum
  unsure (1)..(472): unsure at all n locations
  Clone ID: PAT_TA_54899
taccgcccgtgacggcatggtacatgcccctgcctagcttgattcctttctcgtgcatccatccatcaatcgacctctctgctctgctctgctctgctctgctctggtcgatccgaccaatctagtgccgattgtttgctctcgtctgtttattctttcctttttctcgatggatcgtttcttgttccgcccccatttttctttcttttacatttcttccgagtgtatgtatgtatgtacatcaaacaacagaagatgaacagaccctggccggtgaaaaaaaaaaaaaaaaaaaaaaaaaaaaaaaaaaaaaaaaaaaaaaaaaaaaaaaaaaaaaaaaataaaaaaggaaaaaaattaaaaaaaaaaaaaaataaaaaaaaaataaaaaataaaaanaagggggcgggcctttttaaagaatcaaagtttatttccccgggctggcaaggaaaaaacttttttttggggc

SEQ ID NO: 54900 - DNA, 566 bp, Triticum aestivum
  Clone ID: PAT_TA_54900
gactcagggcaaggacccaaggagcctgataggcaacatgactgaccgcgcatacttacggctgaagactgtcgcgacgaggtcacaattctgtgccactgaaactgcccagctggctaagacagctgaagcactgtgcgctgttccccgcggcggcccggctggacacaacccatgaagacaccgacgaggatgaggaggccctactacggcagtgtccttacacgacgcttgtcagaaggatggcgaagcatcccgactggcatacccttcaaccagatcatgagaccggctgtatcactccattaaccagtcatgacttacatatgtacaaccataagctctgacctcctgcaaaggcagcatgtaacctcggattgcctgaagactgcttagaagcttttagttcttggtataactacctctctgtaatggcttccttgttctacctggtgtactagcataaactatatatctagatgacaccactttgcgtccatgcatgattatatacgatatgtatataagtatatatactctctggaatagagttctcgactgttgaa

SEQ ID NO: 54901 - DNA, 636 bp, Triticum aestivum
  Clone ID: PAT_TA_54901
cccacgcgtccgcctgctctcacttgctgcatcttcccccggagctcaggtcaatctacaatggcaatgatcagtcctgccgccgccactgtcgtcgccgccaggccggggcaggctctagggctgcctcagcttagggtgaccagggccgagaggctgaggtgcggctgctccaaggaccgcaaggaggcggcagcggcgagtccggcggtcgtgaagggcgtgccgctgctggccgcggcgagcgcagccgctacggcggcggccccggcgctggcgctggtggacgagcggatgtcgacggagggcacggggctgagcctggggctgagcaacaacctgctggggtggatcctgctgggcgtgttcggcctcatctggtccctctacaccgtctactcctccaccctggacgacgacgacgagtccggcggcctctccctctgaagtcccaccaccagcaccatcttcttcctcctgcctgcccgcctcatccttgaaagctttgcgtaattaccagacgaatgccgagttactgattacggtaggagaactgtaagatgcagtatgccagtgttaaaccgttgcagttattaacttgttgtttggatcacaaaatctcgttgccagtactac

SEQ ID NO: 54902 - DNA, 202 bp, Triticum aestivum
  Clone ID: PAT_TA_54902
gcggcgacaaaccgaagctggagaaggaacttcaaaagcagattagtggatttaagaagcgccccaagtttattactactactatatctcgagagtacaaataaacttggggcgctcatggacatcagaaccgagggggtgaggaagctaggtgagctgagcgatcggcgcagcgggacggggggggaggctgggggaatat

SEQ ID NO: 54903 - DNA, 373 bp, Triticum aestivum
  Clone ID: PAT_TA_54903
aacgaaaatctttttacataatgaaggaatcaaataaacgagaggtactacaactacaactactcgaccgccatagattgcttggaactttggatgaaaaccatacagtacacagtagtagctagcaaattaactactcattgtccttcttctccttctcgagcttgcatttcaccctctcgaacacaacggaggccgtcgccggcgagtcgagcttaagcttgagtttgcaggtccccgccagcttgttcttcttcagctgcagcatgtaccgcacctcgccggtgaccgccacctccagctcgaactcccccgtcttgttctgctccttgtacgcggcgacgccggcgttgcccagcgccacgtagccgct

SEQ ID NO: 54904 - DNA, 290 bp, Triticum aestivum
  Clone ID: PAT_TA_54904
ataaaagacaatagctcttttctctaccatatctattcaggtattcatagcaggattgatacataatacggcacaaacgttcgtactctgggtctcaagctagaaccttaactgcacaaaaacctgcgctccattgcataagatacatagatgacacgagaggaaaacaaactatgtaggactcaggtacatacatgcttgctgccaattgccaactagcaacaaatcttcttgctgctcatctaaaaggcaaggcaaggaaggggggatagtcaggcaggctaatcgac

SEQ ID NO: 54905 - DNA, 615 bp, Triticum aestivum
  Clone ID: PAT_TA_54905
atgcaaagttatttgctgtttattcatccacaacgagaggccccttcaggacaggacacaggacaggacagagaggatttgatcacacagtgaggtctgacagtgcccacattttacatacaaaagaatcaagggggtaagcaaaatacagttttgtccatattatccacacccgcactctctttttttgttggcgcggtccgtttacgcgcttccggtttttcttgtacgcaaccgatcggtcgatcaccagacaggagtataatacaaagtgttcccaaccccagattataagacatagaccagggccgcacttggtacaagcgctggcatgttttgctactttttcccgccggatgtaaccccgactacgacgttgctcaccaatttccccttgtcatctactgtcattgggttttcgacgaccaccgttacattctgcgattgagcggatggcgcagaagtcgatgggacactataagaaattccgtttggtgcatgcattgtaggtggcaaaggtctcacggtgttcattccaatgtttgtaataaaattgcagatagcacatttgaccgaagatgctccatatggatacattaacaccgtttggcactg

SEQ ID NO: 54906 - DNA, 463 bp, Triticum aestivum
  Clone ID: PAT_TA_54906
aaaagccaaaaaaaacggaacccccttcggggggaagcaaaacaaattatggccaaaattattcaggggttcttaagccacacccaaaaaggggggggcaaacaggccgggggtaacaaattaaacaaaggcaaaagttaaccagaaggcattttatgggaacttcccattttcgggggggaacccaaaacgacgaggggccccaccccaccaccacgaataaaagtttttttttagcgaaccacaccccgaaaccaaaatccaccccgggggggcccccgaaaaaaacaaaaaaaaccaaaacctactcttccttggaggggggagggggggaccccggggaaaccatggagcccaccccccacttgttggccacgttcaaccccctgaaaattttgaaaaaacccttgcccccccaattctccccccataagttcttgaaaacccaaaagggcttcccctt

SEQ ID NO: 54907 - DNA, 587 bp, Triticum aestivum
  Clone ID: PAT_TA_54907
agtctacactgcaaaccattgatccaagtctccagaaaagacagatcacgcaggtaaaatgcatgaaacatacgtatatagcaaagacaaattaattccacggccgtcaaaaaagtcacctacaaaatttagccttgggcgataacaaacaagattctggagctcagtgttcttacaaagacagtccatcgctcgatgtcatcatcactctggctccagtgatacttctattttttgctcatccacctccagggtatttaaaaaataaaatggatgcctacagaactaactaatctctccatgggtcattctcattctcagtcctgacttcggatggctcaacgacctccgtgacaacaccttcagaagagtcgacgtcggcattggtctcagcctcctcggtgccggatcgaccccatctcccgccaagggcgatggtcatcatctcgtagatcttgccccccaactccgctggactctcaggagtgtatccactggagatcagggcagtctcgtacagcaactcaactgccctcttggcttcggtgctctcaggctcgttcttgcaagcagcactcaagtccttg

SEQ ID NO: 54908 - DNA, 645 bp, Triticum aestivum
  Clone ID: PAT_TA_54908
gttggcttctcctccccactcagtcctcggttcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccatgaacggccaggacctggacggccgcaacatcaccgtcaacgaggcgcagtcccgtcgctccggcggaggaggcggcggcggcttcggcggcggcggtggcggctacgggggccagcgccgtgagggcggaggcggcggcggctacggcggcggcggcggcggctacggaggtggccgcagcggcggcggcggcggctacggcagccgtgacggcggcggctacggaggcggcggcggcggcggctacggcggcagccgcggcggctccggcggcggcaactggagggagtgaatggtggggcccctagctggccagttatcctagttaccgatccctttttttacctgtctaccaa

SEQ ID NO: 54909 - DNA, 176 bp, Triticum aestivum
  Clone ID: PAT_TA_54909
cccacgcgtccgagagactactgtgacacattagtctctatgacgcgatattcggacgcgtgtgtctattcgagtatggtggtcaggttcttgtagtacgtgctcagcttgacatattcagaatagtgattcattgtggtagctaagaaagaaagttcgaaccgatggatgcttct

SEQ ID NO: 54910 - DNA, 382 bp, Triticum aestivum
  Clone ID: PAT_TA_54910
cacctccctgagctatcagatggggaagctaccttgtgatcgctcacccgtcggaaacgctcctgacaccttgcttggctcgttcgaaactgggtcagactgatcgggctagaagatatccgctgatgttcgagacggatgttgaggccgacgacatagagaataaggcgatggcgtccttccagaggtcgcgtatagcgacgatcctgtccgattttcttgtccttacaacgtacgcatacgcctggatgttcagactcaacagcaagtgcaactcgcatgtgactagagcacgctcaatattctatatctgactgaatgtagtactcactgcgtactcaaaatatagagcgcccgatttgtttgaaaaaaaaaaagaaac

SEQ ID NO: 54911 - DNA, 599 bp, Triticum aestivum
  unsure (1)..(599): unsure at all n locations
  Clone ID: PAT_TA_54911
gttttacttacacatccttacagagtacacacctatagaccatgaaaatgcaccactatgtagacatacacttgcatcttgcttcggacatactccctccgtttactattatacgatcttctaacttttttctgattcggatgtatatagacgcattttagtgtgtttgttcattcatttcagtcggtatgcagtccatattgaaatatctaaaacatcttatagttgtgatcggagggggtacataatttagtgatgttcagttgaacttactatgtcatttgttgcttgtgacatactacataagttagtgatgttcagcagttgaacttaccatgtcatttgctgctatgttttgtcatgtcattctgaccaagataaactacctcccaggttgacattgttggagtgagctgctattcttcgaaggacctgtgggcatggaaaaatgaaggnagtcgtgcctccgtggcgagaaaaagaatgtgacacatgnacctccacgtatccaatgtcctggagaggccgaaggtgatctaaaacgatcggacaggncaaatacggtgatgtggatgcacatagatgatgctaactacacc

SEQ ID NO: 54912 - DNA, 530 bp, Triticum aestivum
  Clone ID: PAT_TA_54912
ccccacctaagtgttaaattaacaaaaactatatccaggagcatgctcaattcatactacagggtaataagatcgcttaaataaggggcccaattccgacgatgtcacccttcaagacaggggtttttacatcacaacatgccctcaacaccgtagatccaggtggaatatggttcttgtcaggtgaaggggcccccaacttaaagcaatcgacacccgaaatcgatggatttcttcactcccctggggcgaaacccccttgcttcaggttttccctcttgagcttcttcttggagactggcttcttcttcttaggagggagcgtatattgcccatacaggcacagcgcatagttcccaacaaataaaaacatccaggggggtcgcaaccacaagcaggactattattgcaggggtcaggcccttgggcacctctctgatgatcacattgttccctgactccgcgaacttctccaccatggcggccacgagatctggaccaggcaccccgcccttctcggcttgtgaacc

SEQ ID NO: 54913 - DNA, 561 bp, Triticum aestivum
  Clone ID: PAT_TA_54913
aaaggaaacaaataactgggtctcgatattattcatcaacaaccacaaactagcaggctgtagcaaagctcacatcataattaaatggacgaccttaccaatcgttccagtttaggcctgaccttacagaaatagggctacattattggtttctgaggcacccagagcctggcaactactacaagaaagcacacaccacactcagctccacagcccagtctccctgctgcagtaggatcaacttcatagtccaccgccagggagcagtctcataaccaaccacacttggcggtgatccaccacagcaaagcctgggcacagggctgcagcctgcagccacccctttttgcagccatagcaaccagaaatccccctgtcccggcgtgcaaaaatgtgaatagacaacagccaagttgatgtaatccatgcattgcataatgtggcatcacctgctcaaaagtatcggcgagctgtgctgaaagaggctcggagttttgcaatgttgctttcagacagtcgagacagcatagaatggcctgcacctttcaactcttgctggct

SEQ ID NO: 54914 - DNA, 437 bp, Triticum aestivum
  Clone ID: PAT_TA_54914
gaaaaaacgcggtcgcactatatttagaaacggatggagtgctacgttcagttcacatattgactgtggcagcgcttcaccaatctacacaaactgacatgatagggcgaacattggcagacctgcctacgttgccagacccaagaaaacacggacaggatcgatcaagacactacctttggacgcgtacgccattcccttattctcatactacctaacgcctgaaattccgacgtagcatggccgcggtatactgtggtatgcgcgatgcgatccggccgtagtctgccgaacgatgccaagcctgggtcgggactgagccgtttggcgcacggtctgaacctgaccacaagtgtgagcttagcgccactctcgccggaggcacgagccgagtggcggacgacgctggggtcggaccgcggctaattctcggtacc

SEQ ID NO: 54915 - DNA, 346 bp, Triticum aestivum
  Clone ID: PAT_TA_54915
gaatcttaaggcgattatacatgtggatgtattcataacatacaaatggaatcataaccgacaaccctgcattagccagtgctgctacaaactcagtttatacattggttaaatacacctggaaccatacaggacgcacctgaagagctgttgctcaacaatgacagaaagttaaatttgcacagcaaagatggtacaaataaaaatactccaactggaggggcgtgtcagcacgacagtgatatgacaaatactctattgccagctaccatactgctgctgattgcgagaaccgccttgggaatagttcgggcctcctcggtctgaaccaaacgtgccatatggc

SEQ ID NO: 54916 - DNA, 601 bp, Triticum aestivum
  Clone ID: PAT_TA_54916
agaatatagccctgacatgggacccaaaatttcaattactcataattcgtcagtagtcagtaaaccctgcggttctacagtgttatttacatccccaagcattgttggtgatcatgaacgaagtagttttgggccagaatttgaagctatccatgaaacaattacatccacaagtgcattgacatcctcaggggcctgtgttcgccgaacgccagagtcagtgccaaaagtggtacctacctccttagcaacagcctcccatggtgtgcctgttgtgagatttgccaggagttcaactccacggcttactgcatcagccattcctgttgcaatggaaggccatgatccccaggaagtgagcgaatcgacatatcaagcagtgagctaatggcagattctgagcttagcacttgtgcaatgatagaggtctcatcaatttgatcatcttcgaactttactaggagatttcgagatattccgtagtaggattttatcatgccggcgtgtctcctctggttttgggatgaagtcttctcggccctttaccaagtccatatacagtgtgaggaagttgttgaatcaaggaaagaagttgcttaac

SEQ ID NO: 54917 - DNA, 432 bp, Triticum aestivum
  unsure (1)..(432): unsure at all n locations
  Clone ID: PAT_TA_54917
ataagccctaacaacacaaaaagatctgcggtgcattccacaaaactaggggcacggtagctagagagggtctccatggaaacacaaggcctaaacaagctgattttagatgagcaggtctcttagacttgcacacctgccttgcgtaaacttggggttcttgcacctgtacttgacgtcggggccgatgccaaaaaccttgggatcggcaaacacgttctccaacaattggctccgaggggggagcgggctcacatcaacaaacttcaagggcttttcaacaacatcgacaatattattgtcaatgttcttcaactccgcttcaaacccgaggatctgatccctgatctacttcttaaaagattggatgggaaccctttcacnataccgagatttttcatcaagccccctgaggtcatttcaatcaccaag

SEQ ID NO: 54918 - DNA, 577 bp, Triticum aestivum
  unsure (1)..(577): unsure at all n locations
  Clone ID: PAT_TA_54918
atccaaagtaccaaagtctattacatatcagtagtgcattttcataggaaatgcaatatgatataccaaaagaataaaggttcaatacattataccaacaaacgtcacaactaattattactctaccatccagatgatgagtcacagaaataggaagtgtatgaacaatatatcatagcttatatgtgcacagtaagtcacgttgattatatacatgaagcgagtttacatcaccgatacaactcattcaatcaggactattgcttatggaagcatagaagtcgagtttgtaaagtgcccaattcacctgcagagagtagcaatcttgggcaagcccacatagacctttccatctacatggtagagatcaggtgcacaatgtaagaatgcctgatggtgtcggggctcgcctctataacccaacatacttgacctccctccaacagcctncttgagttcaccaatctacaaaccagccccataagagcacataatcacagcaaatggcaagggtaagtattccctggcaagtactggaccagaaaactctgactgaataactgaaccaaccatcacg

SEQ ID NO: 54919 - DNA, 571 bp, Triticum aestivum
  Clone ID: PAT_TA_54919
aaacctcaatggccaagtgcttttattcgagtaatttgtagaaattacatgactggaacgcttcaacaggaactacatactgtcggagaattcaaacacacgggaggcacgacggaaagcaggaacgtcacattatttcgcctcaaatcaaagtcttggggaaaagcttccacggaaactgtggcacgcgtctgagtttattcctcgacgatgctcgttcatttagcctcagctttctgctcctcgtcgtacttgggacggactttgaactccacgttgttgaggaccttgttcatgagaatgtccgcggagtcgatacctgcaatgcaaaggaggcagcagcgcgcagttagcgggaaaccacatctctcagatcacacacaccagctcgatcgcgtggccgggagaagataagactaagagacctgcaagataagctccgtggacgtagccgttgtagtgctcgctggtgtgctccccggtgaagtagacccgcccgccaaccggcgcccggagctggtcgtactcgtagcggttgacgccgacgggccagttggagtaggagcccttg

SEQ ID NO: 54920 - DNA, 414 bp, Triticum aestivum
  Clone ID: PAT_TA_54920
cccacgcgtccgcccacgcgtccgacttgttctccctccctctctgcctgaccagctaggatcagcggaagcagcaatggtgatggcgtcgtcgagcgggctgaggagctgcagcgccgtgggcgtgcccagcctgctggcgccgtcttcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggtgtcagaggtgtaccactgccgctgggccatgcttgccgtccccgggatcctggtgccgggagctttggacctgtgcaactg

SEQ ID NO: 54921 - DNA, 549 bp, Triticum aestivum
  Clone ID: PAT_TA_54921
ctgcacatcgtatgtgtacagcaggatccacaggttgcatggaggcacatggcgtgctgcaagtgcaacatgttctaacattcgttcagagaccgaagtgcttccacgaagggcaaggtgccaagtgatatccaggcggcgatgcgttttgtaccatccactgacaacattaactaagtcctattacttcatatgatgatttgtttgaagtggcctttgtgacactgttcaagcactggtggacatgaataaaccttagttagattgggaaagctaggatcaagtccattatttgttttttgtgtgattatagaaattgtttgattgttgttggatctgttttaacttttgctagccagatttatgggattatcccattctatggttagtggatgtatgattttattttgtgctagtcatgaatggattgtgcctgttccctcggagactaaatcaaagagcggtgcactgttgttgagatactagttttagttcatggtgatgctgattggttgttctaagtttgtgacacctagattgggtgtttct

SEQ ID NO: 54922 - DNA, 220 bp, Triticum aestivum
  Clone ID: PAT_TA_54922
ccggtccggcttcccggtcgccccgcgtccggtcgcaggttcctgatgaatctgtaagcgctttgtccttggctgcctatgttgaggctttgaagctacggaatctcactcaggcatctttgcttactagcaattagaatttgcgtttgtgtacattcttataccatcttttgatatctggacttttatgaataaaatgcaattctgtcacagtggaact

SEQ ID NO: 54923 - DNA, 609 bp, Triticum aestivum
  Clone ID: PAT_TA_54923
gataggtccaaaagatctggcgaacaagcaggtgcgtattgtccgacgagacaatggtacaaaggttgatattccttcaaccgacttggttgagcaggttagagtgttgctggatgggattcaagtaaacttgttggaaacagcaaaagcaaaaagagatgcatgcattgaaatcatcagcacctgggatgaattcatagcggctctcaacaacaaaaagttgatcttggctccatggtgtgatgaagaggaggtcgagaaggacgtgaaagctcggaccaaaggtgaacttggggctgcgaaaacattgtgtactccatttgaccagccagatcttccttccggaaccgtgtgctttgcttccggaaagcctgctcaaaagtggtcattctggggtcgcagctattgatctctgtgttatgtcacctatacattgccattttcgtggatcttttggtctggcaaagctgtttattatactacctgatttttgagtaatgcatatcgtatgatacctgtaactgcggattggttgtccatttgctgatcagttcggtgccgagaaatatacattggtaatgttgaggatattacttatcgttagcgttt

SEQ ID NO: 54924 - DNA, 690 bp, Triticum aestivum
  unsure (1)..(690): unsure at all n locations
  Clone ID: PAT_TA_54924
cccacgccgtccgaaaaattaatannaaatagataaattannattattaataataaagaaatatnntaaatattaaatatttaaagaaagaaatnngattttttagaaaatannattgtaataaaacccaangaggatatnnaattaatgnnatctagaaaaaatnagacaaatatatnagatganannattgaagatgaaaaatannagaaattagtaaaggaattnagaaaagttganaaaaagtnagaaaatgtangatttaagatgatnnaatttaataaaaaccaaaacacaattatgcaaatattataaatcctctaaaggttgtgataaaggtcctaattgtagttttgcacataacgagaatgaattaagatgtatatttgatcaatcatgtataaatgaagaatgtaaaagaattcatataaagagagatataaaaccaattacaaaaaataataaagaaattgctattattgatgaagaagaaaaaatacctgaaatacaattaacaataaatggaaataaatattatgatgataactatattaataaaaatcatgaaaataaaaaaaatattaaaaatgaatctagtagagataatatagaatataataattacaataagttttataaagttgaatcaattaatataaatactaatcaagttatttcagatagaacatt

SEQ ID NO: 54925 - DNA, 164 bp, Triticum aestivum
  Clone ID: PAT_TA_54925
gaggtgaatacaggcccaacacgctgctagggttgttggccacctggtccaggtggaggatgaggcgagtgaacaggtgctaggacgcggtcatggactgaagaagaggatgatcacattgctttacatgacgtgcttgacttgttattcgtgaggccgaccat

SEQ ID NO: 54926 - DNA, 586 bp, Triticum aestivum
  Clone ID: PAT_TA_54926
ggcaggcagtcccgccgttgtctcctccgcctccgcgcctccgccgtctttgccaagcgcagcccacacgtcgcggcggacgccacttctcccatggatgcggactggacatgggcgtgccgggcgtgggagaagtggaccgcgaagcacgtcggatcttccgttgcagggatgccggtcaaggcggcgctgctgctcaattacgacccgaccggaccatctcgcctcctccccatcgtagcagaggaagagggaacaaaatttactgctgttgatctgcaaccgttcattaacttctttaggaggaacaatctgcagacggaattcttttctattggaccaaaccaatgcaatggtggctgttgatcagtttgcatggcacttcaaccggagaacacattaacttcttgtggtgtagactcatggactgacagggtggtgtataacctgacatgctggttaatgttactgttgtattgggatccgtaggtatgtagtgcataactgagatgctgttaaatgcaggggaattgaatcatataatcgtttgcatagtgatttaaggatcaggtggtatgtatccaat

SEQ ID NO: 54927 - DNA, 154 bp, Triticum aestivum
  Clone ID: PAT_TA_54927
tcggcgaggtcatcagcaccaagaggcagccagcagggcccaagccggggttcatggttgagggcaccaccatggagacggtcacccccatgccgtatgacgtcgacaacgatcagaagggtggctactaaagcgcttgcttactgagctgaaa

SEQ ID NO: 54928 - DNA, 272 bp, Triticum aestivum
  Clone ID: PAT_TA_54928
gggggttgatgagggggatgcggttgggagtgagggggttaaggagaagaaggccgcgaagaagacaaaggtcaaggtgggaagggggaagggtgttgtggatcttgtggagaagaatgaggcggctgctgcttaggaggcgggggttgccattgctgagatttatcagcggatacggtttgggatggggaggtgacatgctccctcatcacctgctgtgagcatggggttattatccggtgagaatggatattgttggggtgttggtgttg

SEQ ID NO: 54929 - DNA, 648 bp, Triticum aestivum
  Clone ID: PAT_TA_54929
atgcacatggttcactggtacctggttattcaacgaatgctacatttatcgaagactcgaggaaattttccaaaattctcaatactgggtcggctacgactgcttcgaaagccagaaacttgccactttcaagggttctcacagcgctgtatatgatttagcacgcaagatgcccgaactgatacgcgagatgtcacaagagaaattggaaattgtatataatgaattaattgaagtctgtttgtggggaaatgcaaccgatttgagcttgctaacaaatatgtcacaagaggatatccaacgtcttcaagcaattgaaaaagataaattagcggagaggaagaagtttattgtctgtgatgatactgataagctgtggtttaaattgaaggaccttgatcaaggacgcattgattttgtattggataattcaggcttcgaggtatttgtggatatggttcttgctgactggttattacaatctaagaaggcttctaaagtcgttttccactgtaaaacaatcccttggttcgtatctgatgtgatgcctaaagatatgcccatgatgtttgaaaaagtcttgacagagacttcttgcctggagaaaaatctcaagaagatattgatgccttagaaactatggtcatc

SEQ ID NO: 54930 - DNA, 559 bp, Triticum aestivum
  Clone ID: PAT_TA_54930
cccacgcgtccggactacattcacagcaaatccctttgtcaaaagagtattggctttatgtaaaaagacacatgaggatgatttgtgaaaggtgctgtagaacttacaaaagagtattatattagtgaagagcagttgggtgttggttcctttgctgttgtaaagaagtgcataaaccaatctactggtgaacactgtgcgatcaagattattttgaaaaaggctgttgcacgaaagctgcatatgttggacagtgaaatagagattttgactaaagttcggcatgagcatattgtatctttacatgatattaatgaatttgatgatgcggtctatattgttaccgatctttgtactggaggtgaactgtttcatcgtattgttgaaagaggtacttacacggaggctatagctgctgaccttgctcggcaatagctagaaggcttagcttacttacactctcatgatattgtacactgagatattaaaccggaagaatttactgttcaagacactagattaagattttgagttgatgattactgactttggcctttct

SEQ ID NO: 54931 - DNA, 455 bp, Triticum aestivum
  Clone ID: PAT_TA_54931
cgccatcccgcccgctcgcccggccatctttagcgagttcgcgcccacctgcttcgcccctggtcttgcttcacgcgagctcccccgtcacatgggcagacagggtgcttcgttactgcaccgcggcgtcttcgccctcgccgaccgcacgcacgcccccgcgagcaccaaccccagtgggtgcacggcggctggcctccgctctcctcttcgtccacgcgggccgcgcatcctcccccgacgcgttcgttggctctcgcgccgaccggcttccgcgggctcgccgtcgcttcgagtccagccggcaggccacacccagctccgccttctagtcatgcatccgggaccgtccgggtccacttgctcctgctgcgcgcgccggccctgtgttactgcgtggggaccgtaccagttcggcgggcggatgctgcgtctgcactcgacctgcccggctt

SEQ ID NO: 54932 - DNA, 653 bp, Triticum aestivum
  unsure (1)..(653): unsure at all n locations
  Clone ID: PAT_TA_54932
cgatctctgtcttcttctgagagactcgtaccagtcggctgcccaccatcgccggtccaagaagccgcctgctcgtcggctactccgccgccccactcgcccttccatcccccctccctcccccggattcaggaccggatcggccttcccctctgtagatggaaatcacaattaattccttgacgtacaaaggttcgattccagatgcaattaatcaatcaagaaggaagaaaaaactctttgtaatttacatatcaggtcaagatgaaacctcaagtagtttggaacagtctacattggttgatgaacatgtggctgcagtgataagcagatgttgcatattcttgcaactaaaacaaggcgatgttgatgcgcttcaattttcagctatctatccacagaagtctgtcccaagtatatctgtcgttggactgagtggtgctatgctatggaatcatgaggggtatattagcccagaagatcttaaggaaagcattgataaagcttgggctgcacttcaactgcagatatggaaaccacattgtatgagctgngtattgaaacccgccaggcccttgttgtcgttccaaatcgtcaatctgttaaagtggcaaggcaccaatcgtcactgccatccagtgatctggatcgca

SEQ ID NO: 54933 - DNA, 455 bp, Triticum aestivum
  Clone ID: PAT_TA_54933
gaaagaaagagcaacccatgttacatgttacttttttagacctccatttgggatgggacccttacttttttattggggggcgggtaccccctcggtgaacccacccataacactttttttagcttattgactcacagtaacaggcaacacacaggctggcccatgggctttcaaaaaccccataacatttcctcacccccccgccctttttggggctgaaaattcaagaacccctttcatgacaagcaactggcgggggcttgtttttggtcccaactcacaagggcccagtaaaccggggggtaaactaaccggagccccctcctccaaacccagtttttgatggggagggggagacccggaaaaaaggggtacccttcccttgccgataaaacttgcctttttttttttggatcactgaagcatccctgttcacatgccagcctccggggccc

SEQ ID NO: 54934 - DNA, 597 bp, Triticum aestivum
  Clone ID: PAT_TA_54934
atgcggcaaaaaaaattcttttattgtaaataaataaaaaaaaaagtctggaaatggctcctttctttatccaacatttgatattcttcaaaatactaaataagcctgaatgttgcttctaatggaaagatttcttccctttcatcatgatagattctcttccaagtggattcaagttggggaggaagtttccaagcattttcaggatgaatccagtgacgaagaagatgacgagtgttcttagggctatctgtataaccatcacgagcatggaaaatagataaattattgatgtattgaatgtctcccttttggaaatcaacacccaaattaaatttctcagctgtataatgcaatgcatccaaagcttctgcttgtgcttcagtaatcggaggaatgtcttctcttctaggattctttccaaagcctgtaaagttacgacgagcatattgaatgatgagcttgttatcaacataatacaaaagaggacgcaagacataaggttccttttctttgttcaaatcagtttggaatggccaatcattagccaaggtgtggatcaaatcagggcgtgttttcgcaagttcattataaact

SEQ ID NO: 54935 - DNA, 433 bp, Triticum aestivum
  Clone ID: PAT_TA_54935
agacaaactggtattcaatagggtatttttgggccatttggcccctttgtttgaacataaaatcgcatgcattacgacaccctttttatgattttattgcatttccccccatctacaaaaaaataaaaaggggcacgaaatttttttccctcccttaatcaaacagggaacactcaaaactccgtacggggcaatgcctttgacccgatcaaaaaaaaaccaactgcttgaaattgatgggggcggggaaaccgagctttaccgggggggggaaaatggccttggcccccttgatgttgggggcctgggggccctgcaccttgtcccaataaacatgggcgttgcggttggcccaaaagggggggttgggtgccccgcaccatgccttggcgccgagccttccgccgcctgaaaacgccctggccactttctt

SEQ ID NO: 54936 - DNA, 599 bp, Triticum aestivum
  unsure (1)..(599): unsure at all n locations
  Clone ID: PAT_TA_54936
gtaacacacaaaaaacatttatttataatcttgctttttcagtcttttgttgccatgcaaaggccaatttctttcttccaccgggagcaataagtacattaattacacaagtttgatcctttgagtccaatgcttcctttaaagcctttcttaattcaaccttatccttgaccaaccatcctttaccaccacaagcctgtgaaatcatttcatatcttgtttcaggcaataaggcagttgtaggcaaagtaccattatttagtgaagcattgtattcagagtcatctaaaccgtgataaatgccattattattaatgacaataattaacaagggtaatttagatcgaattgcagtttctaattccatagcagagaatccaaaggccgagtcacccacaatcgacactactcgtttagcaggtccataataagattgggcagcgatcgcataacccatgcctactcccatggtggcccctgttcctgcatcaatacgatgtctcggttgatgaacatcgaaaaagatcgcccaatgtccatcgtgttggcaccttcactgatatagaccacatcttncttgggtaaaaggtgtttgatga

SEQ ID NO: 54937 - DNA, 331 bp, Triticum aestivum
  Clone ID: PAT_TA_54937
gcccgggtcacttcagttttgattttaaaacggggcccagtcctcatttagagttaaacaagggtcaacatcctgacctgggccgcaaaatggtgacccagaaacattttatgtctacaggtttatcccgacaatgaaagcggcaataacggttttacgagctctagttcttgatcttctttttgggcctcagctggttgctggggccacacttttttttgcggcagttgacagcccttggatgccgcctggcgtagcacttgcgggagatcatcttctgctggttgtccttgcgggccagggcctggagcgagggctctttgatgccccc

SEQ ID NO: 54938 - DNA, 555 bp, Triticum aestivum
  Clone ID: PAT_TA_54938
tttttttttttttttttttttttttttttttttttttttttttttttttttttttttttttttttttttttttttttttttttttttgggggcgggacaaaacaaaccgggtaaaaaaagaaaaacccccccgccccattttaaaaaaccgagggcacccggggaaacaaaccccaaaaagggggggaaaaccggccccaaaaaccgggggggaaaaaaaaaccccctttccaaccccaaaaaaaactatttttacgggggcccccttaaaaaagggctttttaactggcccccccccctttgaaggccccggggaaaagggaaaaaaaaaacggggggttttcggtccccaagggcaggttccgggtttggtccctttcaaaaaaaaaattttggggggggggggaaagctttgaccaaaaaacccctaaggggaaaaaacttgccccaaagggggccttttttttaaaaaaaaggccccgaccccgggggcccccccggaaatcccgaccgggccccggggggggccccgttttccctttaggggggggcatt

SEQ ID NO: 54939 - DNA, 590 bp, Triticum aestivum
  Clone ID: PAT_TA_54939
gggttataaaaggatcaatttattcacaaaatatttattgtatttttcttcttttgttcgaattttgaataatataaaaatattaaggagaagtggtaataaagaataaaaaagcaatactttttctttttgtaccactctgcctttaacaaacagaaagagaaatgtagaatgagaatgagtgagtttaaatctttaagttatgaatctcagcttctttatcaatcaccatggctaatctacgaagagcttcatccatttgtggcttatttacattactaaaagaaacacgaatgtattcattcttgttgcctcttggcataaatgccaaacctggaatagcaagtacattttcttttagaacctttgtcattacgagatcataagaatctgtgatgccacctaacaaacgaagccagacaaacataccagcactaggaacagtccacaccgctcgacctgtcatgtgtttatcaagacattcaacaaagtcatcgcgcttttccttataaaagtctgcaactcgctttacgtgttcgaaaaatccttgatgaccccagttagccaacagttgataggccatgacttga

SEQ ID NO: 54940 - DNA, 488 bp, Triticum aestivum
  Clone ID: PAT_TA_54940
ggggggaaaaaagtttaatttaaaattccccaaactggttttaaaaaaatgttacccggggaaaaggggcggaaaaagaaaccctttagggaaaaacaggggcccccccgggaaaaggaaaaaacccccccaccaataggggaccccccccgggggggggcccaaaagggagccctttccttttttgccggccaatgcccggaaaaagggaaaaaaacacccccaggggaaagaaaacctggaaaaattttaggggaaaaggaaagggtccttataaaacccccccaaaaaaataaagtccttttttccaaaaaaattcccaacttggcccccggagaaaccttaaaaaaaagcgtttttttcacctggaaagggccccggccctaagggggccctcatgggaatgggggttattgatcccccacttgggctgggaaaaacccccccaaatttcccccccaaacccctgggccccaaaacttttttgg

SEQ ID NO: 54941 - DNA, 466 bp, Triticum aestivum
  Clone ID: PAT_TA_54941
acagcaaccaaatgaatatattcatgcaagagagatgtgtgcatcatccactgaatcatccactgaaaatgttgcaagttgaaaacaaatgtcaagtactccctccgctctcttacgagccagtgctcgttctctagcagcggcaagtgcgtcgctactcctcttgtcgtgctcgtcgctgattggtgctggttgagtattctggagagcctgttaagcagatgtagaaatatctgcctctttctcagtagatctaacagctggtgaatcttttgatccaatagcctgaaggttctaccacactgctacttccatgagccttgtgtgatcctacactggattcccttctgcgcttacgacaacgactgtatgcttccgcttcagacttgctacctcgaatatctcctactttattttccaactttttacggtctgagactactgtgccctgatttgttcgggcacc

SEQ ID NO: 54942 - DNA, 411 bp, Triticum aestivum
  Clone ID: PAT_TA_54942
ctctttctgttttttgccgtgagaacgcccagccgtcctgggtgttggtttacaacgtcaccacctaggagtggcgccgtgagggcgctgtgcacggcttatccgatggtcgggcaatgcgcgatcgtggggagcctgctccatgtgctgggcgggttggtactcgagaccttcgagcccgccacggaccagcaccagctaaacacgttcatcatctggtggcagacattgcacaccgatgcagtggtagcacatctatttctgctgaacctatgttggctttccaatctacggtactgaatggctcaacgagatcaataactcgctgaagacggggtatgtttaccacgcgacaggacgacttctgggaccagatgatggatatgtgccacaagcacaccaagtgcagat

SEQ ID NO: 54943 - DNA, 446 bp, Triticum aestivum
  Clone ID: PAT_TA_54943
cgaaaaacttccccccattttgaacaccgggtgcccgagggatttattctcaatactactcaagtcagcacaaagatccatgtaaaagcttcaaaaaaaataaggcaagcttcggcatagcatgactttgaactttggatacgggggggccgatcaagccatttggatagtcccaatgtagggctgggcaaactgcatccacatggggcttgggggcgccatcattttcgtaagtttttggcacatggaaacaccgccggggagcatcgtaggcatcgttgtcatgatcttgccccctggggggtacaaagcccccccttcatggatttttgtggtgagggcggtaaggtccggcttttttgacccaccggatgggggtttcgaagccgtcacagtttcctttgcaaccatgatctcggccgtttgagctcccacctcgccctgcg

SEQ ID NO: 54944 - DNA, 556 bp, Triticum aestivum
  Clone ID: PAT_TA_54944
atatataaaatattccttttttttcttatgctgatcctgcagtttcatttgccaaactttcttctttactctgtgtattacttgtagcaggagcatcagccatcgtttcctttttggattcttcttcctttttcacttcttcttctacttcgccttcttctggttcatcttctttcgattcctcttttttttcttcttccttcacttcttcatctcctctgggtctcttgctctcttcatgatcatgttctagtgatctcttttgacccaattgagggtttccaatacttaaaagtgcatcagctgcactctcatcgtaatcttcatctactcctgaggtttgtctaaattttttttcatctctaaaatgttcttctcctcctcctaatttaggttcctgttttatcacttctgtattcacagctgtatccatttccatggcccttgaggcaggttggtgtagtggttcataacgatgaccttcagtacattcataagaaatggattttgatggcgttagagttggggttagggatgggggtagtgagtaagaagt

SEQ ID NO: 54945 - DNA, 433 bp, Triticum aestivum
  Clone ID: PAT_TA_54945
ggaaaacaagcccccgaacccactttttatagaaaaaagggcggggtccacaaaaacccgattttggaaaacaaggggtcagcaagcaaaagggaaaaagttggggggggggggggggcatagggaaccccgttttaaaaaaaaaaaaaacaagctacggggccggccggggcaggaaaaaagggaccccccccccgggggccaaaaaggggcccatccaacccggcgggatcccgaggaaagggaaacatccgccgggggtactagttaaacatccctgaacggaaacgggcacatgggtttattttatgggccccatcgggttataaattttttaaaacggggggccaggcatccagcctgggattattgggtggaacaagaaccactttgttttccattatacggaaacgggaggaaccggcaccggggg

SEQ ID NO: 54946 - DNA, 588 bp, Triticum aestivum
  Clone ID: PAT_TA_54946
acgctacatgatcgacctaatttagacggaaactcttatagttaactattagagctaatacatcccactataacaaacctgacaccttatatgttttgtgcagcgatctggaatcatggtgaaaaagggccccaccaccctcaacatgtttccactcattgttaccacacccctcaacacattacaccataagtccgtcttacttgattccccacctaagcttcatacccactacctattcttttactaccagagatcggggacccaaccgtatgttgaacgcgaatcaacacagaccttctggagggccaccacctggtgcatttacggctgcttggatgacatcatgactaccaacattttgcaaagcgtctgtctgagcctacaccaggaagcgactggtgggcccacaccaggccatgccggtgaattgaggcgacaatggctcgaatgacccaacccactgtcctgttaggccctgtccatgagggaataatgatccgagtgagcacaaatacctccagggcagcttttgtgagagggaccagtcccagtcctttgagtggcactggcagcatgcacagtggt

SEQ ID NO: 54947 - DNA, 431 bp, Triticum aestivum
  Clone ID: PAT_TA_54947
aaaaaagccaaattttatttccaatggggaaaaagctgaaaaaggggtccattcaaaaaaaaggggggaaaaacccaaaaagaacatggggaagaagaagaagaaaaaaataggggtggaaaagggttttaaaacaaaaggcccaccccttggggggccggaacaaggggggggtggtgaaatcaaactaaaaaaagcccaaattgggggggaagccggaaaaccaatcaaaagtggcgaggaaaaaacaaccaaaaaaaccgaggaagttggggcccccgaaaaggggctttttaaactcgccgagggaactccgggaaaaccggacccttgtagggtcccgaaaagactgggcgggggggagggcccccgggtgaaccaatcccgaaaagggaaaaaaaaaaggggggagagaaaaatttggggggggg

SEQ ID NO: 54948 - DNA, 481 bp, Triticum aestivum
  Clone ID: PAT_TA_54948
aaaaaaataaacaggttccccctttttttgtggggaaattttataaaaggcccccctccgggccaactgggggggggttcatacctgggggtcccaaaatttaagcgggggatggggtccctaaaaacgggtcttaaattcctttgcgaaggttttttggggggatccaccgggttttaaaaaaatttttgtttggccccacatccccccggggcaaaaaacaacagggaccttaaggggggggggggggtttcccctcccctggggggcccggggtcccccccccaagaaggtaatgggttccccggggggggggcccgggaaacgggtaaaaagccccctttgggtgggtttgggccaaaaaaaaaaaattccggggggagatgggtccccctaaaaaaataaggaaggggtggggacaaacagggggaaatttgggtcccttttcctttgtcacaaagggggggggggggaaaggccc

SEQ ID NO: 54949 - DNA, 573 bp, Triticum aestivum
  Clone ID: PAT_TA_54949
gaagaacttgatgcggaacggtgtccacggtttccaaactttattatgtttgactaaggaaaatcctacaacttcaattattttggaacaaggggagtacattcgcttcgaccgaaatccggttcactcaatgccgtaaaacttcttgtgtaattcgtactggaccttcccatcgggaagaacctcgcttacactctccctttccctgcacctcttctcccatcgcttgagctttgggcattccacctcgaggttaatccctccatgttgctcgtacccgtaaaacatgcttgagaatgggatgaagaccacgtccaagaatccgaaattgtcgccagaaaagaagcacttgtccccgagcacctcctctagacgtttaagatgctcgaccaactcttccttggccgcctctttctcctcacccttgctcgtgaaaaacctcgtctggctgctgaacaccttgtggtcaatgaagtcagcccagaacctggcgtcggccctgtcggccgggtcgccggggagcaaacgggcttcctggccccatacctcgtcgatgtactcgatgatgttgac

SEQ ID NO: 54950 - DNA, 600 bp, Triticum aestivum
  Clone ID: PAT_TA_54950
acagttgtacaaaaattactttattattgtgaaatgaaacaaaaagatgtcattgtcataagagaaaccttcttttttcaaattaaataaatatcttttttttttggtctctcggatttattttgcacagatttttatgctttaacaccaagaagcacattgttaccattgccgttgctaggcaaataggtgacattggaggctttagaaagtgtttgagcaatttctttactagcttcaattctacggaaagcaatgaatccatcgcctgcgtttgctaatgctgtagaaatcatttcagcagcctctgagtcaccttcggcacgaataatagctgcttgcttttcctgttctgcacgttcgacaatgaatttagcacgttcagcttcttgttgagcaatttgtttttgttcaactgcattagtaaattctctaccaaaggtcatgtgtgtaatagaaacgtcttccaaagccaagttgaaatctcttgcacgtttatataattcctcacgaatttttgcagagaccacttcacgttgggtaattaattcagaagcatcaaactgtgcaacgatcgatttcaaaacttcattaccaatg

SEQ ID NO: 54951 - DNA, 399 bp, Triticum aestivum
  Clone ID: PAT_TA_54951
accattaaaacgtatatagtcgacatattgtataatattatgcgtccgtgcatatacatagccaccgatagcattcacatacgagcatgctttctcgagccatgttcgtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacataggcgtcagggtactccttcttgacctcctccacctcgttgatcacctgcgtggcgtcgg

SEQ ID NO: 54952 - DNA, 547 bp, Triticum aestivum
  Clone ID: PAT_TA_54952
aagaaatgtaaactgtgatttgtttttagttatattctacaacggcatattttccactaaagcagagaacctccttagcaatccctctattctctatgtctttcttcatttgttcagaaacaccaaccaggacatcagccttgtttgtgcgcaaagaaacaatatttgtaaaatcattagccatatcagatccaatagcatctctaaatggtgttgtcatgggccattcacaatcaaaacataactttctataattcaagtcccctttataaataacaagatcagacttcttcatgctctcaaacaattggggtgcatgagatttcatgtaccagtaagacaaaccagagcaccaaaaatcatctgagacaatctcaagttgattattcttcacatattgctgccatcgatgaaccatagtttctaaggcatcaatatcttgttgagatttttctccagggaagaagtctctgtcaagacatttttgaaacattatgggcatatgtttaggcatgacatcagatacgaaccaagggattgttttaca

SEQ ID NO: 54953 - DNA, 184 bp, Triticum aestivum
  Clone ID: PAT_TA_54953
ggacacggggcaacagatttggtcggaacaaaaagaacgagcggggggctttattttggacgggggggggacaaacaccaaacttacaggattactacccaaaacccccagctcaggggaaaagctaacgtacccccccccccgggggggggacgttgccctttatttaccaacccggccccgg

SEQ ID NO: 54954 - DNA, 503 bp, Triticum aestivum
  Clone ID: PAT_TA_54954
cattcataaaccagagcgtacatgctatcacctgtgttattgccacaaaaagacgggaggataacccgtgagaggttaacgtcctctcaaacaagacacatgcttattacatcgtttgattcagaccggattcttgcaaatgtgccaacgggcgatggattctcaccttatatgagggctgtgacaacatggacataagactgaactgtgcgacaacttttgaaacccttacggccacgaggtgccaagccgataccatagacttccctacttggagtccatgggtgcgtttactgcttcttatgctgtaatacgttccttaggatcatgtttcagtactttatcactcaaatgctagctttcatctgaatatctcaaccaatcttcttcagcaaattcgtattgacctttcctgatcgcgtcgaataattaattttggtcctccccataaataggggcataacacctccaaaaggtttacatggatgacaccaacacttcaa

SEQ ID NO: 54955 - DNA, 351 bp, Triticum aestivum
  Clone ID: PAT_TA_54955
cttagcacccgacatatctttcttttcagccggacgcagtgttctctttttttctgccggctatagcagcctggactctttctctacccggctcttcttcttttccctttttttcttttttacactgacagccggcctctcccttctcctttttttatctccgtgtggagcagccggctgttgacttttctctcttttaccagtcggcaggggctgagcagtcggcctcttccagccgaggcgggaagcggccaacgcaggcgcgagctggcgcggggcgcatccggcggaggaggccgagaggcggggcaggcgccaaggcacgggcggaaccgacccggaggcggtgac

SEQ ID NO: 54956 - DNA, 469 bp, Triticum aestivum
  Clone ID: PAT_TA_54956
ggagaaacacatggttctttattattctttccgagcactcaggaaaaaagagcattatgggggaactccccaacaaaaaatttgaaaagggaaaggggcagagcgactaacagagcaaactgcacattactcagcggtttcagggactcaaaagggaaggggtaaatttttgaaaggacagtaagaaacttaacactgactaccaaacaacaagaccaggggagaggggcgcttaaagggctaatgcttcttttcacttcccaggagcaacatgatcccggtttgacgaacttgaaaggggggagaccaagaaaatgccacgcttttaggcagatgccttggcaaacttgaggggcttcaccacctcccaggggaggggagcattatcggggccaaagggaccataaacggcagtcttgaagaacctgtttccacctttcttaaagtccagggtggggctgaaaatccc

SEQ ID NO: 54957 - DNA, 468 bp, Triticum aestivum
  Clone ID: PAT_TA_54957
ttttttttttttttttttttttttttttttttttttttttttttttttttttttttttttttttttttttttttggggccaccatgaaaggaaacattttattggttttccttggtcaccacccctttttttaaggggggagggtttccccaaaaaaaaaaaacttttcggctggggaaaaaggaacttctagggttcagggcccctgtaattttaaaagcaaaaaacatggttaaatctggaaaaaaaaacccaaattgacttggttttggcccggaccccctaatggaagcatgaaaatgggcccaaaaagggctttttgggggaagggccgctgaagcctcaaaataaaaggaaagggctttggttgaacaaaggggttgaatttgccctttaaacccccggaaaaaaaacggattttttgaaatagctgggcagaacattgagaaaacgaaaatcccctggggg

SEQ ID NO: 54958 - DNA, 512 bp, Triticum aestivum
  Clone ID: PAT_TA_54958
ctagggttgcacgtgccatattactagttatgtataagcactgtaatttaacacctcagtttgttcccaacatatgtataagcactttagtttaactgtttaacacctcagttcgttcccaacatattttttccccgttaaacggttcaagtatcaaccaacttcgatgcagtctggtcaccccctatttcttttcatcgcctccaaactctgtagaattcccattccagaagacatttctattatcagaaggatcttgttcttcactgcttagagtgtgaatgttgccaccgaactgtcggggccgccttctcaaggtatttccagagctatgagtagttgtttgttgacttctatcaccaccaagaggttgggattcagagcttggtctgtactgctgcgagccttcatttcccagttgatcaggatgtgatggggggggatttcctctcaagtaggacaatggattcacgtatgataacgctgcccccagaaaaccccaaccacgtgac

SEQ ID NO: 54959 - DNA, 766 bp, Triticum aestivum
  Clone ID: PAT_TA_54959
cccacgcgtccgcccacgcgtccgaaccccggctttccttccggcaggcagtcccgccgttgtctcctccgcctccgcgcctccgccgtctttgccaagcgcagcccacacgtcgcggcggacgccacttctcccatggatgcggactggacatgggcgtgccgggcgtgggagaagtggaccgcgaagcacgtcggatcttccgttgcagggatgccggtcaaggcggcgctgctgctcaattacgacccgaccggaccatctcgcctcctccccatcgtagcagaggaagagggaacaaaatttactgctgttgatctgcaaccgttcattaacttctttaggaggaacaatctgcagacggaattcttttctattggaccaaaccaatatttggtcacttcaatccacgagcactggttttgtgctcgttgtgttaacacaacacagccagggggtgaaggagttatagttatgcagattggggcttacttgttagtttctatgtatgatggttctgttggttcggcttcacaggcaatggtggctgttgatcagtttgcatggcacttcaaccggagaacacattaacttcttgtggtgtagactcatggacttacagtgtagtgtataacctgacatgctgcttaatgttactgttgtattgtgatccgtaggtatgtagtgcataactaagattctcttaaatggcagttgaattcaatcatataatctttgcatagtaatttaagatcagttcctatgt

SEQ ID NO: 54960 - DNA, 420 bp, Triticum aestivum
  unsure (1)..(420): unsure at all n locations
  Clone ID: PAT_TA_54960
cgacccagcggccgcgcaaaacacacanngcaggccggcggggggggagcagggagccagggaggccgcgngggcggggagccagggaggccgcgcgggcngggagcagggaggcagcgcgngcggngagaaggcaggcgcgcgggcggggagcagggaggccgcgcgggcggcgagcanggcggacgggcaggcgggggggggggcgcgcggcggcggcncaccccaccgncgacngcncagcgcaggcgcgcggcggngacnacccncgggcgcgcggcggccncnncccacgagcagggggcgngagggccaacacaggggagcaccacccagcggagacggcngccgaaagcngcacnggcgcgcggcggggcaccacagacagagngcgcgcaggaaccagcaagaggaagggcg

SEQ ID NO: 54961 - DNA, 580 bp, Triticum aestivum
  Clone ID: PAT_TA_54961
cccacgcgtccggcgcgcggcgtcggcttcgggcgaggacggcggcggcgtggcggaggccgacggctgcaacggcctgctgctctactacgcgtcctgcccggcggcgttccacgtcgtgaacccgaccacgcgccggtgggcggcgctgcctgagccgcgcaggaagacgctgctctccgtgctctccttcgacccctgcgcctccccgcactacaaggtggtctgcttcaccgggtggctgccccggggcgcctccgtcgaggtgttcggctcggagaccggcgcgtggggcgagcacgagctcgacttcggcctggagaccgacgccatgtcggccaccatgcactgcttcgccggcgccgtgcacgtgctggcatactcgggccacgtcgttcgcatcgacctcggcaccatggtgtgcgcggtcaccgcgctcccggcgcccgtgagctaccgggcgcgcgcgggccactgccgcggccggctccggtacccgtccagcgacggctcgcgcctcacgctgtgggagctggtggacgcgggcaagtccgagtgggtggcgaagcacgagctgggg

SEQ ID NO: 54962 - DNA, 461 bp, Triticum aestivum
  unsure (1)..(461): unsure at all n locations
  Clone ID: PAT_TA_54962
gggggggggggggggaagaaaagaananagnnnancaagaaggcaagnaanngaacaaggccgnnannacagaaggcaaanaganngcccnacnaaacaagcacngcancaancaaananagaaaacgagaancggaccgggcancccacaaaaggacgggggggggagcnnnnnngngcagngnnggacgcaacnacannncngnagacgaggaaacggacccacanncnnggaggcgancacanccncagcngcngaggggggcgngcggcancgccacncaggccaagcaacnggccaaanggcgcgagaagggaaacagccagannngnangagcngcgcgncnncnnncccggacccgaacacgcacgccngcncgacgcgcancggcgccagggggaacgcgangagcnncgacggggnccacagggacaccaccncccgcnccggggggaacgc

SEQ ID NO: 54963 - DNA, 458 bp, Triticum aestivum
  unsure (1)..(458): unsure at all n locations
  Clone ID: PAT_TA_54963
ggggggggngggggggggnaacgagaaaaancancgnggaaaggaananagnannnangaccaccnnncgaagggaaaggagccggaccccanacancagaagggaccaaancgaaaggacgcngagacacngacncacnangagaananggnagcngaagggggggcggggacgacaacccngacacncnaaagagacancnccngagacagaccccagaaggccncgacgaaccaaagacganaancgagaaccacacagangaccaagncgangaagccacggcnngaaggaaccagnnacagaagcgacagcagcggaggaaccggcganggnggnggcngcggaaggaacangaagccagnccaacccccaaagacccngggaancacagcggcgagggccagccccaaccagagngggcgggcaacgancccgaccgggggaaggacggggg

SEQ ID NO: 54964 - DNA, 396 bp, Triticum aestivum
  Clone ID: PAT_TA_54964
cggtgtttaacctgttgaccgcgacatagatgagggatgttcccaccggttggcattaagtgatcacagctttattgctagttgaatgcaaaaaaaggtaatattcaggactacacactcgtaatgaccatttttctttatcaacaagtctatatggaagccggaggccgtaccgatgcacaataaataagggagcctaggtagccacaaaactctctgaaagcttccatatcaaatagggtagccgaggtaaactgatacccttcgaaaacaggaagggacacacatttgacgatcttataaaccggaaaacagccaccctagctcttgtggctaaaggctaggcctcaatccaataagaaaaagattctacttgacaccacaacatgttgaaaa

SEQ ID NO: 54965 - DNA, 308 bp, Triticum aestivum
  unsure (1)..(308): unsure at all n locations
  Clone ID: PAT_TA_54965
nggggggggggggggggggacagggagcnagccagagccgggagcananannggcgacagggaagagaacncnccnagaanagggacaacgcggccccgnnnacannggnnngggccgcgacagaanccaaggggggggaannacacacagggcaccgnggcgagggggccncccnccncccnnangcaccacaacaaccccnnccaaanngcaacacaacaacggcgnnangggnaccacacacnagggaccanccgnccaacnngncgcgcaancgccncngcaggaagncgagaaccgagcgacg

SEQ ID NO: 54966 - DNA, 431 bp, Triticum aestivum
  unsure (1)..(431): unsure at all n locations
  Clone ID: PAT_TA_54966
ggggttgggttgggtttttttttttttttttttttgttttgtttttttttggggggtgtgatttcttgggggaagccctcgcgccgcaacggattgtatgagggtttttcttggtggggccaaatggtttgagggggggattattgaggtggcgaggggggggggggtctttttgttcgccaagcgtgggcgtttaagttttcggggacaaagagcggggaccaggagctttgtggggacgggctggattcatggatggtgtggaggcagaaggggggtgggnaagattttttagtcgggacagcagctggtggtggtgggggggaagagcggtgtgggctgtggtggcccgtccggtgggaaggggacagggatggtgggccacgtggtttgtattgttattgcccaaggttgtaggggccggaggcttg

SEQ ID NO: 54967 - DNA, 323 bp, Triticum aestivum
  unsure (1)..(323): unsure at all n locations
  Clone ID: PAT_TA_54967
ggggggtgggggggttttaaaacaatattttcggggcactttgtnagtgatgcagggtgcggacccggtatggggagccgccctggggcccagcaggtgacagttggcaccccaacgcagcgggctaagtctttgcggggctttaccaactgggtggggggggggcttatncacctctcccactccccctccctcaactctcgcgggggtggcgttttcgttcgttgcgtggagccgtttcccctgggctgcgctcggccgacagccgtggggcctgctcccggccctgggggggggggatggtcacccgggctggtttgtgc

SEQ ID NO: 54968 - DNA, 484 bp, Triticum aestivum
  unsure (1)..(484): unsure at all n locations
  Clone ID: PAT_TA_54968
gggggtggggggggtttatgcataaaaatctactccgaatgcttttatttgaccaaggtagttcttcggagagaaatttggctaaggcagttgccattacacagttgcgcgcgcgcacacacacaccagtgttcttggcatcatcgtctctcactcggggtgggggcgtactacgcgtgattaacacacatacctaatcagtcactgggcgctgcncacacacnctcacactcgcacacacccacacacgcacacacgcgcaccccccngtggtggcaggcttggtagaaagagtgctccctgncngctnttgccctgggcctgccgggaaatgggctgaggtgccccgcgtgacgcgtcggtcgttctccgctttgggcgtgcctgtgcggggcccgtcttgccggcgccgaaccgggcgaaggggccggggggcccccgggggccgcntggcgcgggcctcccggggggccccgggggccgc

SEQ ID NO: 54969 - DNA, 419 bp, Triticum aestivum
  unsure (1)..(419): unsure at all n locations
  Clone ID: PAT_TA_54969
gggggggggggggggggnnnnnnnnnnnnnnnaacacaagcgcaaagccccganncaggcaccncagcagccaaggggaggaaccggcccgacagcngaaccncncagagcgcccgagcgccacgagacagnaagancagcaaacaannggccagcggggggggggggcgacnggnaannaaacaggggggcgaggccccacggccccaaggnggccgggaaaagaaancacgcgngnnccacacgacacaccacacgccncgggcgcggcngcggcggcgggcagggagagcagccgcgacggcgggancagcggcgggggggcaccgagacagcggaagccggcggcgaccaccgcagancgggcgacccnngggggggngggccgcccgggcgggcnggggggggncgcccacccc

SEQ ID NO: 54970 - DNA, 621 bp, Triticum aestivum
  Clone ID: PAT_TA_54970
ataactgcattttcttgtatccataatttacagcatttacaactattgagtcctaagttactgacttgtgagccatgtagacgcactggccaataacacgatacattcacagcttattattggtagcacgacaaggtcgaaagagtcttccatgaatagttactgttaccgggcagtataccacgccaccagaaaaaagagaaagaacaagtggactaccgttcggggggacttcacttggcgagctggtgggaggcggccattcttgaacatctgtgcgataggcccagtatcggaaccaactgcgttactctgctccgagagctgacctagcacagtgtcaacgactccctgtaaagtgggctcctggcccaaagctagggctaccaccatgcagaaccgaacgctgataagaacctgggcgaacatgcatggaagtacatgacggtgaccccgctcggacaccctcaccggctgggctataggcggcgctatccacttgatccggatcatcttaagaaggaccctcaggagctgatcaaggagttgcattttccaccccacccggatcatgcgcggctacatcctcccgggctgggcaagtgtcaacaccatccttga

SEQ ID NO: 54971 - DNA, 555 bp, Triticum aestivum
  Clone ID: PAT_TA_54971
attggggttggaacgatgaccaacattgtgtgtgcctgttgagtttcagcctcacatcgatgatggcaggctcttacttcagatcttgaggtccgagacaggcgaaccaggcccatcggatgccacatggccgggtgggctcacttgcggcggcggggggggtaagccctatgtatcccccgacgccttcaggcgagcaccgcccacgcatgcacgcatatggccatgagaggcaccttgcggcaccaaaacccccactattccaatcccactagcatcacacggctagcttcgaggctcttggggagccactgtgaataaggccatgggccgtacgcacacgtttcttcacttgttgaaacacatcttcgtgggagcgcccccatgtagccgccacacccttgggtggcacttcctttgacggggaagcgatggtactgagttctcgcaccgagcttctataaagaccagcccgaccccgaaaccgtctgacgggacttacctccggtggggctgggcggtccttgacggcccgcaccttggattcatccacct

SEQ ID NO: 54972 - DNA, 545 bp, Triticum aestivum
  unsure (1)..(545): unsure at all n locations
  Clone ID: PAT_TA_54972
gggggggggggggggggnnnnnnnnnacnacaacagagcgggagcnannnanannacaagaagagcgggcacaacancaaagggcgggnacgaannnanacagcagcggcagggcgcnaacacaaacaggncagngcnngcnggcggnggcggcgnnagagcgggggccncaccctgcgcccgcngggggcgccgccgnccgagancgggccccacacgcncnggcncnggccgccgcngcngcannccnccncgcacccggcnaccgnccggaggancnccgacggcagcgccgggcagnngncnnngagggaancgaanccgncggnccggannacagcngaaagggncncagcagcaaannnaaggcagacggacnngagcccngnagcaggangccgancagccagcgcnagagnagnngccacagannnnacagaaancnnggngcacaagnaagaaacacanaacacncnnagccngggcaacncaaanggggcggcgacagccaacaangncccagcgaaaggancaaagaagggaca

SEQ ID NO: 54973 - DNA, 433 bp, Triticum aestivum
  Clone ID: PAT_TA_54973
tcgcgatctagagccatcgggttgcctagacatacaatctgcgttactctgtaacctggaattgagtgcagaaacagtgcatcaggggcaggtggtgacttttattgatgctgcagaccgaaagtacaacataacttccagcccagggcatatgattggcgcccagcgactgaaggaggtggcgtctttgaaagcgactgacttagtcgacctcctggctcttggggccatgaccgacgttggcagtcggtgcgcaatagtacatgcctcccggcatgtcagcaccagcaccgtggtacatcttggcgatgatggggtcgcagaggcccttcatgtccttgatcatgtgctcgaactccgtaacctcaccaagatggttggcgtgcagccactggatcgcagcgtcgacagcgacctagatcttcttcttgac

SEQ ID NO: 54974 - DNA, 130 bp, Triticum aestivum
  unsure (1)..(130): unsure at all n locations
  Clone ID: PAT_TA_54974
ccgggtcgacccagcgnccgccaggggcagcgnancangacccagccgggcaaccggagcgggcggnncccccagagcaaagcgcgcanccagancnggcnncncgagcagaagggaangcggancgagg

SEQ ID NO: 54975 - DNA, 210 bp, Triticum aestivum
  Clone ID: PAT_TA_54975
tggtacttgcaaagagaacaatggttgctttattggacttaatacccagatccggctgccgtgccagatcagcttctctcacattgtttgccgatgctcgtgaacatcttctctccgcctattgttgaacgcaatgaggtgcctacttgggcagtcttgaggaagaaggaccttttttctcatctgtgccggcgtttgaaaacgcttttc

SEQ ID NO: 54976 - DNA, 326 bp, Triticum aestivum
  Clone ID: PAT_TA_54976
ctcctcccctagggttttgctgcccccctccacacccgtgccgccgccgccgtcgccgcccgcgtccccccatggcgctgccgaaccagaacaccgtcgattaccccagcttcaagctcgtcatcgtcggcgatggcgggactggcaaaaccacttttgtgaagaggcatctcactggagagtttgagaagaaatacgagcccaccattggtgttgaagttcacccattggattggaccactaactgcggaaagatccgtgtctactggtgggacactgctgggcaagtagaaggttggtgggcttagacatggacactatatcga

SEQ ID NO: 54977 - DNA, 488 bp, Triticum aestivum
  unsure (1)..(488): unsure at all n locations
  Clone ID: PAT_TA_54977
cccacgcgtccgcccaagcaccagagcctcctcaacctcccggcgccggcgcatcgacggcatggcccgcaccaagcagacggcgaggaagtccaccggcggcaaggcgccgaggaagcagctggcgaccaaggccgcccgcaagtccgccccggccaccggcggcgtgaagaagccccaccgcttccgccccggcaccgtcgcgctccgggagatccgcaagtaccagaagagcaccgagctgctcatccgcaagctgcccttccagcggctggtgagggagatcgcgcaggacttcaagaccgacctccgcttccagtcctccgccgtctccgccctgcaggaggccgccgaggcctacctcgtgggcctnttcgaggacaccaacctctgtgccatgcaccccaagcggcgtgaccatgatgtacaagggcattcagctcgcgccgcgcgatctgtgcggagagggcataggctgcttctgcaat

SEQ ID NO: 54978 - DNA, 123 bp, Triticum aestivum
  Clone ID: PAT_TA_54978
accggccaaaattgtaacctgatagcaagggcagtggattggatcgagtaaaaccagatctatgccctgtggtacaacttcaggcaatatcatctctgacaccgaacgggagcatggtgggaa

SEQ ID NO: 54979 - DNA, 527 bp, Triticum aestivum
  Clone ID: PAT_TA_54979
gctggcaaaaacctaaacacataggtgccaggcaatgagggcccagatcccaggccggcaatgcccactcacgcgaaaaagcctaccctatgcatgggacataacaaccggatacggctgccgatacctcttgggccgcctactgtaacaagaattgagggcagtgcgggacgtgcaccatggtcagctagaagatgaagctatagctgatcaacgtgactgtttccgtctgggacgccacgacgagcaatactcactgatactgatgactctgcccaaacctactacattaggtaatatgcattgattccatccctgtgggcgaaagatctctttgatctactcacatgcgtgacgctgaaacaccactgactagtgactattttcattggataagactacctaacttcatcaagtgaataagcatattgtaactgtgcatcagctgacgaggatcaacagaggaatccaacgatctcctgtatcattgtaagataagctgctgaacaaggattgttaaatcctgc

SEQ ID NO: 54980 - DNA, 718 bp, Triticum aestivum
  Clone ID: PAT_TA_54980
ctgatcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccaggcgcccactggcgacggcacccacgaggccgtcctcagctcatacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgccggagagccagccaagctcatcaggcagcggtaccgtgaggctgcagacatgatcaagaagggtaagatgtgctgcctcttcatcaacgat

SEQ ID NO: 54981 - DNA, 553 bp, Triticum aestivum
  Clone ID: PAT_TA_54981
aacgagaaaaatcatcgatgaaaataatatagtatttatgaccacctttcgaagtgaaaggagccggaccccatacatcagaatggactaaatcgaaaggacgctgagacactgactcactatgagaatatggtagctgaatctgcttgccaagacgacaaccctgacactctaaagagacatctcctgagacagaccccagaaggcctcgacgaactaaagacgataatcgagaaccacacagatgaccaagtcgatgatgccactgcttgaaggaaccagtaacagaagcgacagcagcggaggaactggcgatggtggtggcagcggaaggaacatgaagccagtccaactcccaaagaccctgagaatcacagcggcgagggccagccccaaccagagtgtgcgtgcaacgatcctgactgtgtagaggacgggtgctcagtgcgggaagcatcagtcacagaaccagcagtacccgtcgaggaagaacctgaagccgcaagcagacgcttaagtctcagaatatcttgctcggtcaaagcaatggctg

SEQ ID NO: 54982 - DNA, 368 bp, Triticum aestivum
  Clone ID: PAT_TA_54982
aagtagcgcacccaaaatagcatgatgcaaaagacagattaggcccaaactggatcaacatacgagacaaaaggagctggcaaggcagataaaccagatgcacatggttcacagaacagacaagagcctacagtctacacacaaggcaactgttaccttgaaccgaagaaaaccagggaacgtgggtctgacctgctcacctcccatgccacaacaggaacgctccttccagcaaccacagatccttggatactccctagcctaaacagcacgggtagaaggagacctacgccctcttaggcgggctacagaggatcatgacacacaaggcgataacggccccagacgaggagacccaggaagttaaa

SEQ ID NO: 54983 - DNA, 106 bp, Triticum aestivum
  Clone ID: PAT_TA_54983
aaacagccgcatgcacaatcaatttattattgacggcctataaaatttatatcagcgcaaagattctgcatttttttaatacaccggcaactgtttcacacaatat

SEQ ID NO: 54984 - DNA, 227 bp, Triticum aestivum
  Clone ID: PAT_TA_54984
gagtgtaagtccttattttccatgaatttgggtgtcttctgttcaagcaacaaaccaactaaacataaccaatcgtgccggtcatacaccaaagcaacagacagcagttcctatcgcgagatgtaagactgtctattcttagataattgatgagccacacccaaggttggataataaaaccaaagacatccatgcgcccggcagcttaatctcttgccaactccttc

SEQ ID NO: 54985 - DNA, 574 bp, Triticum aestivum
  Clone ID: PAT_TA_54985
gtataaatatgtgattctcaatcaatgaaagtattagatcattcgtacaatcacttttactttttacacgttatcagcactgctctgccaaaagtaagatagagccatcaccggaaaggacaagaaaaggtaggtcatggcagggagaaacctgtcatcagcggctttcgctttcgctcgctttatccaaagagagagccgtcatggccttggtgtaaggagcggcccacgtcgccgcttcttcgccgggaaccaccgccgtggatatgcacgccatggcaaccaccctgtgcaccaggctgggccttccgccacggccactgctgcaaatggagagatacctgcaatgcgccaggccgggctttcggctccggcagtcgccaacgagtacgtcggacacgcgactacaccaactgtcttctccatccctccgatggagtggttgcttgcagggccatcggcgccgtttctcggagaagaggagatgttcccttattttttccttctactagttcttcttccaagcgcaggataaccccaaggggttgtgggtttttttctaccaatggggagc

SEQ ID NO: 54986 - DNA, 412 bp, Triticum aestivum
  Clone ID: PAT_TA_54986
ggataaatagatgcgccataaacattcaacaccaagattcaacattcaacaacagcaggagcaccaagaattcgaagctccttctctaaaaagtagcttattccatcagcgtggacgtattccattctcgccgcggctaggcaagcaacctgctccgaggctcaccacgccgcccgggacggggctggaggctaccgtgttcgcccaagcgggcctgccagagaccttatactccctggacacgacttagggtcgggaggccaccaagaccggctcgcagtgtcgcttcgcgtgggaacaaaggcgcatgaccgccaacgaggatgactgccgcgacgaggagcccctacaagcttggaggccgccttgctactcccactggctggttgcacttcaccttccccatgttagt

SEQ ID NO: 54987 - DNA, 359 bp, Triticum aestivum
  Clone ID: PAT_TA_54987
cttattattgttttttctttttttgttctagtttactatcccacaaaaacgtgccaaacgatagtctctttcaatgatgcccaggggggagacttcttttgaggggcgatgtttattatccgggtgggcacactgacaaacccccgaaggaaacacgaagaacatcaaaaatccggaaaacaaagaccctggcggatagttaaaatctttaacttctgataacaaaagaaaaatcatcctctaaggagggctggggaaaattttcacaggagtcacttcacagggaaatgctggcagccccccggtcaataacattgctgggccacaaggccgaccaggtccccctatagtctgggagt

SEQ ID NO: 54988 - DNA, 325 bp, Triticum aestivum
  Clone ID: PAT_TA_54988
gggaagcgcaatttgtaacccaacccaccgaggggaccagccagaaaccagcccacaccgttatgattttgggttgtacacaaaaaaaacataaattaccccgcccgttttttggcacaggcacacagctaaaaaaacccccccaacaaatcccccaaagcctggcatgcataaacccgcgccccccagttttctgggtggaagctttgagggggagtaggagtccccagtttattttcaactccggggggaagccaaccccctgcatgggcccaataatgggggcccaaccccgggttttcggagaggccggaattaaattttt

SEQ ID NO: 54989 - DNA, 454 bp, Triticum aestivum
  Clone ID: PAT_TA_54989
gcaagatgttgttcaaacattattttgaattatttttaacatgacacattaacggttttgaactaaataccgttttgattacaagatagttgtatatcccggatacaattatgatgacgttttgtctaactcacaaggagagcgagccgaccaaaaccttttaagaaaacggattgtagacacacggtctctttagctgggcttaatgccccaacttgcttaatgttcgaaaaagcttttttttaaatagggcctcttttaaaccctacccatccttaccgggaagacatggagcttatcgtcccacaacaagaatatattctgttgaaaaacacccgcccctgcctgtttgaccctcatgttcaccatatgagccagcatctgggctctctcctttcggatgttacacattacctaaaggatgtccttgacaaggctacagggaaaccacatc

SEQ ID NO: 54990 - DNA, 383 bp, Triticum aestivum
  Clone ID: PAT_TA_54990
gggaacagcccaaaaaaacaaatttaaaaaaagagggaaaagtaaaaaaaaacccccgggattatgggaaaaaaaaccccccaaaaaaaggaacacaaattttaaaaatttaacaacccctcccgggaaaaaaaaacctttgactccttttaaggaaagggaaacgtaaaaagggtttaaaaatggggggaatcttcccccaaaagcattagcattatccccaaatgaaaacccgaaacaaaggggccaggaaaaaaagcaagaggggggtagttaccctcgcaaaaggaggtaaaaggctaaaccggtgggggggggggttaaaggcccccatccggggggggcgccccccccaaaaaggaggggggcctgctacggccaag

SEQ ID NO: 54991 - DNA, 602 bp, Triticum aestivum
  Clone ID: PAT_TA_54991
aatcttgcaactgcttttattttagttttcactacgttcggcaaaatattccttgggacacatagtacattacttcagtctcaggaacaacgtgcggggtcgtgcacaggttcacattgtgtcatccaaaccaaggattaaaagaaatgctactcgctgcacaggctacacatgaatgatttccctccagccaggaatcaaaaatactctgcccccctgacctataagatggggggccaagcctaacacccagctcctgaaagaaccgaccattagatacccgtttttcaacagctataactctgctctgactgtttgattctgcaaaatccccaacgagatcagggtatcttttctctatgaaactctgagcaaatgcaaagacctcggatttgggggcagggacatcatccaccacattgaatatcttccttggagatttgatgctcatgctacccaagatagcctgatagacgacagccacatggatacgtgcagtgtactggttggaccccctcaacttctgccttcgtgaacaagattttctcttaactatgggatccaaagcacttcttccaggcccatatattccacccaaacga

SEQ ID NO: 54992 - DNA, 541 bp, Triticum aestivum
  Clone ID: PAT_TA_54992
actcggactcggtaacgacgatttttccagtagtgcaatcggaaattttctatgttgaacaactagaatagagttgcccccgttgcaacgtacagatatttatagccagtagagatagcaatagggccgtatgcagcaggctagcagagctgagagcttaggatcaatgggcagatgcccaggagtcccccaccctgcagtcgtcatctctctaatggcatcataggacggccttcactgcttcagcttcctgttagatggacagccgcgtcgaagcagaactcttttccaggttcgaacgtggcctcgagctcctcgtagctttgcagaaccttcaggttctttgccgcgtcaaggttctccttttcaacatattcagcgactgcgcggttgatgattttcttgatggctgctttcttcacttttgacggtccaatcaagtgcagagcgacttcttttggtacatttggagttttccctcctttcagtcgccgaaatcctggaagtggttgtgccgcggcaatatgctttgataagactt

SEQ ID NO: 54993 - DNA, 475 bp, Triticum aestivum
  Clone ID: PAT_TA_54993
ctctttactgttatatatgcttatgccatcctttggacagtgttattgtaaatataggaaacttgtgcttgaagcttgtataggttaaaaacacagggaagaccacctttaaggatgggagcctttgttggctgaagcatatcaaagtgtgcgtggcactgatgagcgaaaccgctcttatctgcggtgactgattaagatcagtttgacgctaactcgcgtaaaagcccaaggatgcgtgtgatgacagttataaagaaggtttgaacctcaacaatgcacgatcgaagttcattgctaaagagctacacgtgcttactagggcactatctgcaatttttagctggctgggaggcaagcaggacaactctggggacatctttcttttcagattataccctgtgcaccccttaagagacacgggatctttttgtttctaccctaaatgaaagggaagagtgcctttatcgttggg

SEQ ID NO: 54994 - DNA, 327 bp, Triticum aestivum
  unsure (1)..(327): unsure at all n locations
  Clone ID: PAT_TA_54994
agaagccgaaggagacggggggcggcnangcnnnngnggaanncgaagaacggagnggcgnncacaangcanngagggcnncaccacnnngaaaaaangggcggcangaanangnngaggagcggaagccnaacagnggaacaaggggaggaagaagggggggaggcagagggggggggggcggcagnggcagaggagangcgagaggngacgagnccagcggnggccgnggaaaggcgaaggggnagcagcgnggcccncaccacgagaggggcagnnggggggcaaggaacngaggccccagggcganagaaggaagcagaagag

SEQ ID NO: 54995 - DNA, 634 bp, Triticum aestivum
  Clone ID: PAT_TA_54995
accaaaaataaaaaacacgcgaaaaggacagtgggggaaaacgaaaagaaaaaaaaaaaaaaaaaaaaaaaaataattaaaaaaggaataaaaaaaaaaaaaaaaaataaagggggggcggttttaaaggggccatattttcgtccgcgtgattgcaagtggaaggttcttgtatatggacacctaaatcaagggggggggccagaattttaaaaccctgtgttagtgaaacccctggggttaccaaccttaatcacgttggaggactacctcttttgctcaaagggggtaatttgaaaagggcccaacccggtcggctttatcaacagtgagcacaacttaattggcaaagggctacgacccctgtatcgtggaaataagcaagctggctatgttggttatcccccaacgtcacacatatatttaacaaggcctaagaggccaatatttagtatttttacccttactttctcatcatgttattcggcttcccgcgccaagttcaaaatggggggttcattgtagggaacccattaagctgttaagggcccttgaacgccaaaacatttgattagggagagggcacatataaagggccattgcacttttagacagtttttcctcctttgaggtt

SEQ ID NO: 54996 - DNA, 449 bp, Triticum aestivum
  Clone ID: PAT_TA_54996
ggtccgattcccgggcgcccacgcgtcggcgtccctttcctttctcgcggggcccatctagctcgtcggttacggcgcgggggggcttcaaggtgagcggatggcggggcggggcggagagcggggtgggcgaagcttcgagtccctttgacaaggaggccttctccacagaagctgcgtcggggggggcgcgacacccccaccccagcgccgcggaggacacaagtgatgaagaaatggcgattcttcttttaggaggtgcccaatttacgagtctaccatgaattaatcggcgactgctgaaaaagcctttctttttcagcttttctaacggctgaagagtctgcagggacaggcaccttcaatcgctgttcaagaaatgctgatggagcttttggcttttggtagggaaagtgctgcacactgaccactgatgtggtgatatcttg

SEQ ID NO: 54997 - DNA, 776 bp, Triticum aestivum
  unsure (1)..(776): unsure at all n locations
  Clone ID: PAT_TA_54997
gggggggggggggggggcnaaaagggcnnncnnaagcaagggaaaagacaaggcncnngccnggggaaaaaaacaagcaaacccncnngaaagggnncncngaanaancgncaaacaaaanaanaacccanaccacaacannananncnnnnacncggggggggggccagcaangcncnncnncaaggacnccacgncgncggccagcgcggnccggcgnnccnggaagaggagggagcggnacacgaaccanccgcngnagccgagcccaacaagcnccangancnngggaagcagaggcagagagggganggcgccgacgangaccgaggagaaccanacggngacganggcgccgncggcgnacgggagnacgggggacnggggcnngaccgggnnccacnnggcnnnnagggggnngacgagcncgnngnncggngnggnagaggggnnaccggaggagggcnnngnccggngcgganagagccgnggggcnnnnngngggcgacgaggggggaaggggcggcgggggggaagaaggggggngggggcgccgggggggaggggggcngcgggngggcncggggggggcggggggggccggggnnggggggggnggggggggnnggggggggggngnggggggngnnngggggggggggngnnnggcggggggnggggggngggcgggggccgggggggggggagggagnggggggggggggggggggggngggggnggggggnggggggggggggggggggggggggggggg

SEQ ID NO: 54998 - DNA, 543 bp, Triticum aestivum
  unsure (1)..(543): unsure at all n locations
  Clone ID: PAT_TA_54998
caagaagccacccngnnacagggnccaaaggaggaagnanagcggnacagcggnacggacanacacanaaaccagcggggcggaccaagnacgnggcancgggganggcanacanccacaggagggggggggggggagnacagagacgngcangcaagcagagacccggcccggggggacacgnagaggcccncnnagccggcgagagcgccggngcngnngacgaggaggacgccgccgccgaggaggccggcgagggngacggcccananaagaagcccgggcggnccgccggcggagcggncaccaganncagaccannccncnggcgngnnganggggcngnagccgncgacggnggcgccggccgngncaacgaacgggggcacgcccnncgggcccaccnnccngccgggggcgncggnggcggcggggcagccgcccgcaaggccaaggggccngngggccnnggncnngnngcccccggggcgggcggcggcggnggggggaccccggggggggaggggggggacgcncgggggg

SEQ ID NO: 54999 - DNA, 386 bp, Triticum aestivum
  unsure (1)..(386): unsure at all n locations
  Clone ID: PAT_TA_54999
agcnccaaagcacacactnnaannncggnggcgggannacaaggaagnnaccgcaacanaaaagaaaaggagcaccccaaaaaaaacanaaaagaaaagganaggaacnnannagnagcagcacggnnggnaaggggggggggganccacannanagcnggcanggncncnaaaagcnggnccaggaggccnanananagcacaaaaggnacacacagaacgggccagccagcaaccagccacagcacaggcngggcnncacggngagaacgggggccaccnncangccgcacgacgnggcacacngggagaggaagncganccagaagacgcggagcccgnggcngaccnnggggcgggcgagcgcgccggcgaagcggcgcacg

SEQ ID NO: 55000 - DNA, 402 bp, Triticum aestivum
  unsure (1)..(402): unsure at all n locations
  Clone ID: PAT_TA_55000
gggggggggggggggggcgaacaaacnnnngcncnggagggggannncanncanagcgaacggaacagggacggnaacaagnaacacggaacggnagcggcgncacancnaacggnagccagaacaacncggaaccnacgcganggagcgagancnagggggggggggagcgagcganaacacnnnggnagacaggnnaaaaaagggancggnnacnnaggaaacgggccagcnnggggccccaccanccacncccnccagnggccgccgccggagccgccgcggcggccgccggagccgccgccgccgccgccnccggagccgccggcggcccggccgccggagccgccgccgccggcgcggcggccccccccggggccggcggcgccagcggcgagaccg

SEQ ID NO: 55001 - DNA, 444 bp, Triticum aestivum
  Clone ID: PAT_TA_55001
gggtttgggttttttttttttttgctattgtttggggcgatgcgcccacgttgccgccagttgtatcataacaaggggggggctgcactgttgcagggtacgtgcaagtgctcaggggccgggagcggggccgggccatggccgtcccccaaatggcgggggggggcgtcaacctcctgaccaaaaacgccagctggtggggccctgacgcggcagcctcctgtccatggcactggtggcgggcttgaggccccgccgcatcacctgtgctgggacgcgtggtggccggagctggcgctggcctagccttggggctggctcgtggtcagggccgaccccgcttgcgtccgcgtcccggcctgggccatggggctgtgctctggaccgggcacgcattcgcgctggggtctgggctagcccgctaacgggctcttgcctagctgg

SEQ ID NO: 55002 - DNA, 440 bp, Triticum aestivum
  Clone ID: PAT_TA_55002
gatcacccacccacgggagggaggtttttttttttgaacggaatcttcaccggcacggcacggcttggctcggaacaaaccctcccggagtggatagaacacctatttctgcgcacctagcttaaactcggtaggaatatgcttgcaaaccctttgtaccgtcggcctccccatgagcatcttccaccaggcctttaacttggggtattcataaaacaccttgtgcatcgggggggtcattaattaaaagggaaacgggatgtgggtcaaatccgtgaatctaattgatttcccagacaagtacctggttttttccaacccggccttttaaatccccaacacacccttcaggcgttccaatttttaatccaacaaggtttggttcggcgccgccccaccccccaggtttatgaatgggattatgatacactccaacacca

SEQ ID NO: 55003 - DNA, 563 bp, Triticum aestivum
  Clone ID: PAT_TA_55003
acttacttctagtgctccacttgtccaaagggggtgtgaattagggtttgggcaattctccccattatatgtgcatgataagttaaggcatgacatctaagatgggttgcacttacttaggatcttgagttccaagtttggtgtactttcccaacttaagtcacatgtgatggtgggcttacttgtgtagcctggagtggaaaactctaagtaacacctgaggtgttacattgagcacctcccaatttttcactaaaatatgctataggttttccttgttgcattaaaactcctcctatcccaatcccactagcatcacattctacttcaaaagttttagtgaaatcaggaagaataagtacatgtgcttcagtcaaacgtttcttcaattcttgaaaagcatcttcttgtgagtttccccatttaaattcaacacctttctttgtcaattcatttaaaggggaagcgatggtactgaaatctcgcacaaatcttctataaaaaccagcaagaccctgaaaacttgttacttgacttacattcggtggggctggccaatcctt

SEQ ID NO: 55004 - DNA, 301 bp, Triticum aestivum
  unsure (1)..(301): unsure at all n locations
  Clone ID: PAT_TA_55004
gagacgcgacttagatgtngnaggtttagttcccctttattgccaccatcaagtttttgcattttaaccgggctggatatcttgccttttgtaancctaaaaactattataggggggggggggttcctacatacatatgcactgnntgccttattataggggggggggggataggcttnanaggtntttgagggtttccggacgcctggggtgcttggcctgggggtnctgcgtgctgcaggtggaggtggtggtgtggggggggggnggccgggccgagggncaggggcttgggggttct

SEQ ID NO: 55005 - DNA, 319 bp, Triticum aestivum
  unsure (1)..(319): unsure at all n locations
  Clone ID: PAT_TA_55005
ctcgggggggggggctggnggtnngcncctccggctngggngtntnnccccggcgggcggctcgctgcncngctgncgnngccgnccgnccgcttcntctgtccgcctcgnggcgcttcggcttgctctggncgnccgcctcgntcttctccnggccctccggggtcngcngcgggntgccttccngggccttcntgttctcgccgntctggctctctttggtggctccngtggtcccggccgncccgttggggttcggcgcgccccncgcggtgcccngctgggccctcgngncgcccngctccggggcggtgggctt

SEQ ID NO: 55006 - DNA, 523 bp, Triticum aestivum
  Clone ID: PAT_TA_55006
gagaattcttaattaagagttatagggagggacttatgtcaccacaaacagaaactaaagcaggtgttggatttcaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacaaccaatggatctgttatgtagcttatccattagacctatttgaagagggttccgttactaacatgtttacttacattgtaggtaacgtatttggttataaagccctacgtgctctacgtttggaggatctacgaattgctcctacttattcaaaaactttgcaaggcccgactcatgggatccaagatgaaagagatcaggtgaa

SEQ ID NO: 55007 - DNA, 401 bp, Triticum aestivum
  Clone ID: PAT_TA_55007
accaaataggtatactcaatatctttatatattaacaaaacatgcccagcaatcgcttggatgcgatgcggtacttaggcacaaaggataaaacatcagatattaaattggcatgcttaaaaggtgtaaaggcagctgacgtcgtcactcctcgccggtgggtccaagttcttgggagtctggtcggtgcatcctgacggtacaggcaaagtaccttgctgtgcccctttacctactcctatgcagcaagagatggtgggtgtgtatggagaatgttctaaccgtacaaggtaccagctcttattggattctggttagcatcacccatagctgtctggctcatgtatgtgtcaacaagctgcctacacttgagattgttctgctttttactagcatgtgcc

SEQ ID NO: 55008 - DNA, 509 bp, Triticum aestivum
  Clone ID: PAT_TA_55008
aaacaaaatttccagaccccggagcttcgattcacacaaacaaaaaggattatcaactccaagctccatccatgccatgaaggaaaaggctccatttaactaacaggccccatttttatcaaatacaaaccgaacccatgggcctgggggagggaggcagtagctagtttcaaaggtaagggggggcttgtttatgaagaacccgggggggaggagcttggggagggggcctcctccttttttttcagggcctcaaacttggcgatggggacctgcaactcggcggggctgcccaccgcccacatgggggagtagtacaccccgaaaacgaaccccgtaagcccgcccgccaccaccacgttttttgttttgggcgccagggtgccaaaccctgccattgacgaaaaatacggttgggctggtgctgaccgtcggacggaccaatctaaacgtgagggctgcggctgggggaaatgcgggggaaacggttgacgggaacaaccacgggg

SEQ ID NO: 55009 - DNA, 704 bp, Triticum aestivum
  Clone ID: PAT_TA_55009
cacaaaaggatgccgcatccatcaccaggaacacacaggaacgatacacatacacggcaacagcaacaggcccactcgacaaaatgtctcacacgctggacacaccgactacacaggacattcggtatatagttttttcacagaatcgggtactggaggtaagcacctccggctagggagaaaaaccccaccaggcggcacgctgcacagctgacgaagccgaccgaccgcttcatctgtacgactcgaggcgcttcggcttgctctggacgaccgcctcgatcttctccaggacctccggggtcagcagcgggatgacttccagggccttcatgttctccacgatctggctctctttggtggctccagtgatcacggacgacacgttggggttcgacgcgcaccacgcgatgcccagctgggccatcgagacgccgagctccgaagcgatgggcttgagcccgttcacttttctaagcgtgtcgtcaaccagagacctgttggccaggttcttgtaattatctagggcaaaccgactttcagcaggtatattccctttgctatacttcccagtgagaacccctgaagctaggggactccatgtagtcaacccaatgccataagtactgtagagaggtacaaactcagactcaaccttgtggcgggagaaagagggttgtactcgggctgctcgacgatgggcc

SEQ ID NO: 55010 - DNA, 637 bp, Triticum aestivum
  unsure (1)..(637): unsure at all n locations
  Clone ID: PAT_TA_55010
ggttcgctgctgtgcctgcgcgcgtgccaccctcgccgccgggttgccattatgagttgagttggagcccgatctccccgtccccgttgcgttagccccaccaccttctcactcataactccctcccctcccctccactcccctccccctccctcgctcctggcgcggcacccgcaggccgcagcgcagatctccttccccgaggaggaggaggagatggtgagcgcgtcaagcctgctgctgccgtcctccatgcgcgacttcgcctcctgcatcggcgacggcgccgtccgcgtcgcctgcgccagcccctcctccaccctcacctccggcggcggctccggctccggctccggcgccgcctccaccctcgccgtcacggcgtcctaccgcgccacgccgctcaactctaacgcctcctctccgccgctgctgtttcgcctgacctgggcccactccccggggggccccacactgtcgtttggtccgtccgccgccgcgccttccggtctcctttgcaggcgcaggggcacccgctccttcactctggcggatggcggcggcgatgcggatgatgcgggaggcgggctcngaggcccccatgctcgcccttttctgggacctcacggggggggcg

SEQ ID NO: 55011 - DNA, 713 bp, Triticum aestivum
  unsure (1)..(713): unsure at all n locations
  Clone ID: PAT_TA_55011
atcataaaagggtatcatttactattcgtttgtttatcttgcagaaaagtgcgagaaggcactataaacttcgtgataatgagaagagtcaagagcaggaaagaagaatattgaggaacaagactttgggcaggaagagaagagggaccaaattgtgaaggaagaagtatccaggggtgcgaactaagtgaagaatggatcttcttgtgtagaaagttgagaagaggagggccaaagtgcaacagtggcagctgagaaaaggggaacaaaatccctagcgcaaccaattttttggatcaggcctggcagctccatctccctcaaccgccttttccaccaccggccgccgccgcggccaggccggcgcggcggtgcgccaaccagcgccacccagccacccatcctcgccatctccatcacccgccgctgcaccatccgccatcatccatccacatcgccgccactagcgccgcatcaccaccaccatctncagcgccactcgcgcgacccgccagacgggcgtctggtccttcttcccttaccttgctgcaactcccttcgcctatctctctctgctgctcgctgcatccctcttctctgaacccccttcgctgttgctttcttctttccctcgaatgatgcgttcttctttcttctgtcacctgctggctgctgcttcccccaacttctcttcgttacttccttcccttcgt

SEQ ID NO: 55012 - DNA, 465 bp, Triticum aestivum
  Clone ID: PAT_TA_55012
ccccgcgtccgcccacgcgtccgcccacgcgtccgcccacgcgtccgcccacgcgtccgcgcagccgcaccacttctgcaagagctgccgccggtactggaccaagggcggcgtgctccgcaacgtccccgtcggcggcggctgccgcaaggccaagcgcagctcgtcgtcggcgtcggcaccgtcgacgcccgcggccacggacgccaagagccagcggcgcgcgtcttcgtcgtcctcctcccgctccaacagcggcagcggcagcgcgagccccacggccaacggggaggatacaccgacgacgaccaccgacccccctccgggcacgccgtcgtgcaactccaacgccaacgccggctccttcgccagccgcatgacgaactaccccttcgcggcagacgtgccaccatccgcgccgatattcgccgaccaagccatctcgctcgcgtgcctcttcgcgcc

SEQ ID NO: 55013 - DNA, 420 bp, Triticum aestivum
  Clone ID: PAT_TA_55013
aatttgagaaggagctattagagatggaagccaactttctcaaagtccaggagcaggatgataaggacacgccaaactggatctctgtctcacatcaggatgaggcagaggagatggagttggaggacaggttgtttgctagacgccgtaaaggctgggaatctgcatggggagaccgcagtgacttcgaagacttgaccttattgagtcctatgcactttacacattgcacgctgggactgatcccctacactgctagcactgtgagcgccttgcagatctactctgtcaagattgttgaaacaaagggaaagttgaagtggccactctatgtctatggggtcgtcgctgcccgagatgccgtagatcacaaccgtaacattctcttctctcggcaaagggaagactaccaagaactca

SEQ ID NO: 55014 - DNA, 619 bp, Triticum aestivum
  unsure (1)..(619): unsure at all n locations
  Clone ID: PAT_TA_55014
cccacgcgtccgaagtgggatgctcaaggtggaaagagtaaagctttatttgcgaagacattggatgacaggttcattataaagcaaatcaagaagacagaatttgaatccttcataaaatttgcccctgattacttcaagcatgtttaccattccttagacactggaagccagacttgccttgccaaaatattaggaatctatcaggttaagcaaataaggcatggcaaagagataaagatggatctgatggtgatggaaaatcttatgtttgggcacaacgtttcacggatttatgatcttaaaggtgctatgttttcacgacacatcaccaactcaaatgaccctgacactgtttacttggatcagaactttgtggaggacatgaatgtatctccaatctatattggtggaagaacaaaacatctcttgcagcgcgcaatctggaatgacacatcttttctcattgcggttaacgttatggactattctctgctcgtcggagtggacaacaaaagaatgacttgtgtttggattattgattatttgaggaatatacttgggacaagcaactggagacatggggcaaagtcttcttttggtaccaaagnaatgtttt

SEQ ID NO: 55015 - DNA, 550 bp, Triticum aestivum
  unsure (1)..(550): unsure at all n locations
  Clone ID: PAT_TA_55015
gctagggttttgggattttagcctccagcgccgccgccgccgcccagcgaattcgacaagcccccgagctcgccggatccgatgggcgtcacgttctccgacctccacaccgccgacggggtnaagggcctcgaggcgcacctcgccggcaagacctacatctccggcgatgggatcaccaaggacgacgtcaaggtgttcgcggcggtgcccgtgaagcccagcgccgagttcctgaacgctgcccgctggtacgacgccgtcgccgcggccgtttcttcaggttccctgggcaggcctctggggtgagggcatcctcggctcctgctgcagctgctcctgcgtcttccaaggatgaagatgatgacgatgacatggatctgttcggcgatgagaccgaggaggacaagagagcagcanctgaaccgtgagggctgcaagccctgcaaagaagaaaggaaaggggcaaatccttccggtcctcatggacattcaagcgcatggggacgatggagactgacaagaaagaagttgggagggaggctgtccg

SEQ ID NO: 55016 - DNA, 704 bp, Triticum aestivum
  Clone ID: PAT_TA_55016
ctcttcctcctcgctctctcgcgcacggggctcgcgtccgaaaccctaacctcccaccatggcggctgaaggcggtggcgtccgggcgctgtcccagcgcgagcaggacatccagatgatgctcgccgccgacgtccacctcggcaccaagaactgcgacttccagatggagcgctacgtctacaagcgccgcactgacggcatttacatcatcaaccttggcaagacctgggagaagcttcagatggccgcaagggtcattgttgcgattgaaaaccctcaggacatcattgtgcaatctgctaggccctatggacagagggctgtcctcaagtttgcccagtacactggtgctaacgccattgctggcaggcacactcctggtacattcaccaaccagatgcagacttcattcagtgagccacgccttcttatcctgaccgaccccaggactgatcaccagcctatcaaggagtctgcacttggaaacatccccaccattgccttctgtgacactgactctcctatgcgttacgttgatattggcattcctgctaacaacaaggggaagcagagcattggttgcctattttggctgctcgccaggatggttctgcagatgcgtggtaccattctcccaggacacaagtgggaaatcatggttgatctgttcttctacagggacccagaggaagctaaggagc

SEQ ID NO: 55017 - DNA, 529 bp, Triticum aestivum
  unsure (1)..(529): unsure at all n locations
  Clone ID: PAT_TA_55017
cccacgcgtccgcccacgcgtccgcccacgcgtccgaggtgttggatttcaagctggtgttaaagattataaattgacttactacaccccagagtatgaaactaaggatactgatatcttggcagcattccgagtaagtgctcagcctggggttccgcccgaagaagcaggggctgcagtagctgccgaatcttctactggtacatggacaactgtttggactgagggacttaccagtcttgatcgttacaaaggacgatgctatcacatcgagcctgttgctggggaagacaaccaatggatctgttatgtagcttatccattagacctatttgaagagggttccgttactaacatgtttacttccattgtaggtaacgtatttggtttcaaagccctacgtgctcttacgtttggaggatctacgaattccccctacttaatcaaaaactttccaaggccccgcttattgntatcccaagttgaaagaagataggttgaaccaagatgggtcgtccctttattgggg

SEQ ID NO: 55018 - DNA, 451 bp, Triticum aestivum
  Clone ID: PAT_TA_55018
gaccaaaacataaccacaccaatttcacgattaccattacaaagcaaatcccacaattatcagaaagttttcaagacactcaacatctgatagttaccgacacaacattggagagtcgactgacaaccatagagcagagcaaaaatactgacgaccgcatagattttagcatacagggcgattagcacttgacctttttcagcccatgtgcaaagtacaggaaagttggatcaacagctccctccttgtagtaggggaacaccacgccgccattattatgcatgcttttgccaacaaaaaactgaagggccttgagcttgctaaaaaaatactttgtggcaaactcaacattttttttgaaaacatctagggcatccccttcaagcttggcaaaaaggttcttgatgtaacgcttcatgtgagagataaactgcttcttgtcaaaagcagg

SEQ ID NO: 55019 - DNA, 422 bp, Triticum aestivum
  Clone ID: PAT_TA_55019
gggagggccccaaaactttttttttaaaaggggggggcagaaaattttaaaaacgggactccaaaaaaacggaaaattacgggcaggtccctgatacttaaaaaagggacttcaaaactggaaggaaaaagggaccgggtccaaactgttttcaaggggatccaataatggcgggggccggggacaaaccatttggtccgggaagacctttgggggtgcaccaaaaactccatttaaagcagaactgcctcctttgtgggaataaacccctggaggaaaaaaactagccgccattcagcctgaaaattaaacaaatcgttaaaaaaggccggccagccatggagggcgctgaaccttctttaaatccactggtgatggggctaaggatccccatggtttgcctccaaattcaaaccggaagc

SEQ ID NO: 55020 - DNA, 544 bp, Triticum aestivum
  Clone ID: PAT_TA_55020
gattagttcaaagttcacttattcatacttgaccgtactgctatagcagcaactgtttaaacgaaaccaacacatcacacaactgtttaaacgaaaccaacacatctcacaactgtttaaacgaaaccaacacatctcacaactgtttaaacgaaaccaacacatctcacagggactcgatggtccatgaaaccagacacggtaggacttgacacaaacgagacttaacacttcacacgagcgacaggggcacccaccagagtactcagggcatttactgaccaccgcggaggcggagcaccaggtggagagtggattccttctggatgttgtagtcagcgagggtgcgaccatcctccagctgcttgcctgcaaagatgagacgctgctggtccgggggaatgccctccttgtcctggatcttggccttgacgttgtcgatggtgtctgagctctcaacctccagagtgatggtcttgccggtgagggtcttcacaaagatctgcataccacctcggagacgcaggacaagcggacgcgtggg

SEQ ID NO: 55021 - DNA, 637 bp, Triticum aestivum
  Clone ID: PAT_TA_55021
ctgaaatgttgtataattatttgtcaactgtacgagcacacaccactaaaaatggttgggataaagagggaaaacaaacaaaggggatgatcctgcactgcacactcgcagtaaatctctctctgagtattaccacctaaaatgatccatgaattatgtttcactttcatcccaagcttattgtccctctaaaaacaagctatatatgtctagagctgtaaattaacaccaaccaaacatcgcattcgtcttggttttgctaaattcaatcaactaccttttcccaaatgggcaggtagccagagtgaggagcaagcggaaacctcatggtcatggagatcatggcggggccttgaaggcctgcacgacgagcgagaaccccggcgctgccccctcctcctccagccacagccggctctccagtgcgctcctcgcccggagcatcaccaccgcgcagcccggcgtgtcccggaaccaccacccgtggaggtcccacataacgtccaccggcgcgccgtccacgaacaccgtctggttgcccctgaagttccaccgcagccgctgcgcctgcaccgcccgcttcccgtcgacgctgacccacagctcctcccctcccccggagctcgtggcgcacccg

SEQ ID NO: 55022 - DNA, 430 bp, Triticum aestivum
  Clone ID: PAT_TA_55022
gggaccataatcctacccagccagaaatcagatgccctggatacaagcataataggatgaagcggctccacctgtagaggaccatacacataagacgccaagcataatgttactccagaaatctaagtggagtgcctagcaataccaagccctatactctggaatcctcaaaaagaaaacaagcaaacatggtgcacactaaggcttcttctaattacggctttatatgccatcactgctcctgcctatcaggaattcaaattataaactaccctattcacgcaagagaacctaattccttcagagcagctatacatgtcctggtacagcagagggaaaactcctgggattggcatgtcatagagctacagcctcagcgcagcaaacaaaattaccggtgtggctgtgatagcaatcagatactcttgga

SEQ ID NO: 55023 - DNA, 504 bp, Triticum aestivum
  Clone ID: PAT_TA_55023
gggggaaagcccactgggaacttacttagttctgatatttcaaaaaagctcttgcccgggccccgaaaaaaccaaacccaataaaattgaagacaagccccggggatcctatttatacaaaatgcaaatagctgggttttaacttaacgagctggaatctacagggccctgttaatgggggagggccatgacagccccctctgggtgatattggcgagcccatcactttcaggggttacggcatccacttgcttccaactattgagcggggagccatctttcctttgaggggggggcaaaaacttcaaatcatcactggagccacctggggtcattgacaaaaaaaaatgaccaacccctagtgtttgaaaaataaaaaaggattcccttatcgcaaacatggccccaaaaaacccggggcaggatgcaagcccaacaggtatcggtcgtagcatttcaccccatacaggaggcgaatttttgaagttttgactccactggaaa

SEQ ID NO: 55024 - DNA, 675 bp, Triticum aestivum
  unsure (1)..(675): unsure at all n locations
  Clone ID: PAT_TA_55024
aatacattacaagaacaaatcgcatagtagttgattaatagaagatctattatgcaaatgttcataacattgtatagaactaatacaaccacatccttcatgatcaagttgtactatatatctaaaatcttctaccattaatagtaatacataatgttttgcaatgaacttctctcattctatttcataaaggtacacccatacactgcaataataacatcattgacatgttctgaatgtgtaggtatgttaacccgcattgccatgtgaacatgcaagctttctgtatcacttcggcgacatagctttgaaccacacgtgtggagcagctttgagttttaggtcatgccttctgcttacggcaatcgcaaatttctcggacatgtcaagcgaagcggggctaaccccatcaggaagcatccagttgaagtgatacaaaaggtttgttaatgccatctcagtgaccgacgagctgaattgaatccctgggcattgtcgtcgcccagccccaaagggaatgaactccaagtatgtcccattgtagttcacgtttgttgttatcaaacctctctggcctaaactcttcaggattaatccaatatctanngatcttgagaaattgcgagacattaatgtgtacaacggtgcctttaggggatgttattacccataact

SEQ ID NO: 55025 - DNA, 451 bp, Triticum aestivum
  Clone ID: PAT_TA_55025
gggcaaacgaacggggtcatttagttttgcaggggcccctggtctaccccagcaaaaatcgccattaaaagagctgctactaaaaagcccaacccttgagagaatttgcttcaaaaatcaacaggccagggcaggggccatttgaaaacgggcaaacctttggtaaacaagcagttgttttttgaccccagctacaacacaacagcccctggactggagcgccccggggggcaacaattggggggaaaaaaaaatccttggggcatcccccatacccatatgacggggaaattcgaaaaaatgttcatcaaaggggcgagccccccgggaaaaaatttccgggcgaaaagggaggagggcctttttatgccggtccacaagcacgggctttggtggattttttcggacccctgggcggacccctgggcggacccctgggcggacccctggg

SEQ ID NO: 55026 - DNA, 466 bp, Triticum aestivum
  Clone ID: PAT_TA_55026
aaaacaaaaaaccacgttggggaaggggcccaaaaaaaaaaggggggcccccaaaaaaatttcccaaacattggggggggttgggcacaaacaaaagttaaaagaaattttaaaaacccactccaggggggggtcccttaaaagccccctaaaaaaaaaacccttggggggttttaaaaacgcggggccccacaaaaaaggaaaaaaaggcccaaccccaaaaaaagaaaaaacttatttttgtccaccacggggccacaagagggaaaaaagggagggcctaagggggggctgaaaaaaacaagccttgaaaaacccgaaggccttttttttataaaaaaaaaaagggtttttttttttgctaaaggccaaaaacaaggaaattcatccctccagggaaaactttgttaaaacggggttccttaaaaggtttggccaaaaaaacacccggggggggggggttttt

SEQ ID NO: 55027 - DNA, 682 bp, Triticum aestivum
  Clone ID: PAT_TA_55027
aatcaaaatagaaacattacttcacacagcataataataaattgtagtaggcacaaatagtcggataacattaggtcgatgcacaaacagttggacatactagctaatcaatacacaaatacatcgacagtttcgcaacccacatgcaagacaagaacagataaaatgggcggtgtgaatcatagtccatagcatccacgccaaaagaaccattccttcttagaggatttccatcttgctcttgataagctgggaccaagcaacagtaatctccaccttagagtcaccaatctcacatatacctcgacttatgttgcaatgtttggtcctaaacgtgagacggctttgcctagcaatggcaccagactgtgagtaagcttgtatgacaaattgcaggttatgtcccagttctacagaaacaacatgccttgacagatcaacgtaaccagctgagcccattggcatttctccatcaaaatcatgagaatcaaccaacacaacatgcctggatagggggtccttaacttcctgtgggtggtgaggagcacataatccggccgccgtattcaaaaggtgatggccacccttcaacaacacagacactcaagatagtagcctggacggtttctgtaagtcgctcaaacataactctatcgtgcaaaaagagtgctaaagagcgctg

SEQ ID NO: 55028 - DNA, 501 bp, Triticum aestivum
  Clone ID: PAT_TA_55028
aaagggccccatgaggctttatttaaaactggctgacatatggaccaaaaagggggggttaaatatacagggcaggcgggggggaattaaaattggtaaacaccacaaggccaaaaaaaaagttttccccattgccaaaaaaggggggaaaaaaacttgacaggactttgatgtcaaaccaacactaacagggaccccaaaaatttattttttggaaaaaagggctcctaaaaaaggagggattcggtttcgaaaaaaaatttcccccccttgagaaaaaaaatcccaaacgtaaatcaaccaccatgcttttggccttctttttgatggaggggaaaaacacccacaaaagggacccctttccaaaactcggaaacacaaaaaaaaaaaatttccctgcattttaaggcctctgaacaaccttgattgcaacagctgcagcaccaccaaaaaaaatcccaaccagcaatccttttttaaatgcaaaaaactttgccattt

SEQ ID NO: 55029 - DNA, 380 bp, Triticum aestivum
  Clone ID: PAT_TA_55029
aatgatgacatgctaggcaagctgcccaacgatgacatgctaagcaagctgcccaatgacgtgctgctcaacatcctcgagagggtgggcacgcttgatgctgtcaaaacctgcatcctctcgaagcaaatgcagaagctgcccggcatgctctcccagattgtcatcgatctcagccctcgcgatttggtgcgaatgaacggcgttgtggccaacgtgacggcaaacatccttagtaaaaggtctccccagatcaccgttcgcaagctgaaggtcaaattcttcttgagtcctcgcggtctccccatcggcaaagctgttgcgctcgctatggcgactcagaaactagatgctgccgagtttgaaatcttgaccctgag

SEQ ID NO: 55030 - DNA, 625 bp, Triticum aestivum
  Clone ID: PAT_TA_55030
atcgggtcctgctgcaactgttcctgccgcttacaaggatgaatatgacgatgatgacatggatctgtttggcgctgagaccgccgaggacaagaaagctgctgctgctcgtgaggctgccaagcctgccaagaagaaagaaagtggcaaatactacgtcctcatggacattaagccatgggacgatgagactgacatgaaaaagttgaaggatgctgtccgcagtgttcaaatggagggtctcacctggggtgcatctaaccttatgcctgcgggttatggcatcaagaagctccaaatcatgctgactatcatcgatgaccttgagtacttcaacactcttattgaggaacagctttgtgaggcgcccatcatcgaataatgccagtgcaggttacattggtgccttcatcaagatatacaatctttgtctccgcacctgctgctgctggattcttggtaccgagatctgtcattctggaaacattatgccgtcccatttagttacccctgttacagaaatgctaccgtgtttgattttgagtgatgcccatgtcttgaatgtctgctacctttaaactaatgaactgctgagacctctgtaatggcgaaacatctatcatgt

SEQ ID NO: 55031 - DNA, 221 bp, Triticum aestivum
  Clone ID: PAT_TA_55031
ggcttcttctccccactcagtcctcggttcccggtcacggatcccgttcgcaggcgatagggctataatgagtctcgtggaagagaaaagacatggccagcgtagagtaccgctgcttcctaggcggcctcgcctgggccaccgacaaccagggcctgcatgaactgctgctcgcagtgcggatacatcttggactaccagatcatgactgtcagggatac

SEQ ID NO: 55032 - DNA, 436 bp, Triticum aestivum
  unsure (1)..(436): unsure at all n locations
  Clone ID: PAT_TA_55032
cccacgcgtccgcggacgcgtgggataatgtatacgacagcccttcttactttcatggctattggaggattcccctcttttgtagaggacgtaaaggttgctttctctctgccatcagactaacattttcataagagcaattatatgcccatacattcactgtatactggaagtctgaaataaataaaaagtctggctgcacactttatttctaggtattcagaagggagaggctgagcggccattacggcgtggcagagtttgtgatctcaaacacgctgtcggccactccatacctggccgtcatcgccgtgatccccggcgcgatgctgtactacctctactgggctaacaaaagggcctgaccgcttcgcctacttcgttgttaacctgtgcatgggcacantgctggnggaaggcatgatgatgatcattc

SEQ ID NO: 55033 - DNA, 649 bp, Triticum aestivum
  unsure (1)..(649): unsure at all n locations
  Clone ID: PAT_TA_55033
tggtacttgcaaagagatacaatggttgctttattggacctaataaccagattggctgcagtggcagatcagtatctcagagaatgtttgcagatgctcgtgaacaacttcactccgcctattgttgaacgcaatgaggtgcctacatgggcagtctcgaggaagaaggatattttttctcatctgtgcgggagtttgaaaacgatctccgatactgtacccttagcaccaaggatgttaagggatataatagatcggagtatgccgaagttatttgataacaaagctaagatgatctcgtttgtcgagtgcatgttgggactagatactgacagaatgggggatcttatcggagctattttgctggccaaagttgttgatcttcttacaaaattggatgttaatataacctgggaagatatttcttcaagaggaacatgacaaaggtatatttgaaattgaacttgaagattttggatgccgatgatgatggngatggctttggacaagcaggaaacaagggtctgtctgggaaggaaatgcatgtgcttaaaagcttgatggtttaatggttgttgtttgcgagcaccttaagtatttagatcgtccgccgtctatataaggaatttgtcattctgaaaactatatt

SEQ ID NO: 55034 - DNA, 181 bp, Triticum aestivum
  Clone ID: PAT_TA_55034
cccacgcgtccggccactgcatccgtccacgcgccacggccacgcgttcgctcctttagccatgcttctgaacagggagcatcccgccctcttacgggtggctaatgcttttggatgataagcactggtgctctatgtcaacatccggtcctactacctggtcgaggcgacccatcgggat

SEQ ID NO: 55035 - DNA, 652 bp, Triticum aestivum
  Clone ID: PAT_TA_55035
cggacgcgtgggcggacgcgtgggcggacgcgtgggcacggcccatccgccgagatgaaccacgtcaagtcggctcttctctcaggccaccgcccgcaccgtctcgcggcggcggcgccgcagcagctggcggccaccgcgtcgttccactccacgcctcccctgcagcggaagcgcaagacccagtggcagcacaggttcaatttttatgcaaaacgcaggagaaatagagacacaaaaagaacaatgatacggaatatgtctgagtatgcggagcagctcttcaatagttggcgtgatgaagatgagaaaaaagacgcatctagtggaccttcatggtttagaggacatcgttgggtcagagattcgaggaataatggtttccgtccacatgagtttttttacgatactgtcaaaagcagggggggatttgagttttgcacaagcgatgatgatgatgaaccagagactgtttttcgcatgcttttcgtgggaaccagcacacatattattggtcttttgaatctgatgattttccaaggaggaattcaagacgttctcattcagaaagttccggacactggagttattgaacagacgatgagggcgaaatatcccccagacagaggtatctgtggcgcgtcaggctctt

SEQ ID NO: 55036 - DNA, 617 bp, Triticum aestivum
  Clone ID: PAT_TA_55036
cccacgcgtgcgcccacgcgattcggtccccttgacgctgctaatgtctataatacttagtctgtgtaagtgtgccgttttaccggtgtttggccttgtgccgaggcattgtcgtctgccctctgggagatggccaccggagcttgcatgcagcttctggtgggagacgctggagccttctgctctgactccatggcggatgcctacaggaatgagccgaatctggccaatccccccataataagcttgttactccactgtgatcaaacctttgtggatattttttctcttactaccgacaaggtggaatatcttatcgactagggtggtgtggccccctgttcgagagaatgtcttccattgatgaatctggaggcatactatggggactctgaccacaatcagatatggattcagagaatctacagcaccctccatggctgatcggtcatctataactatctggtgaatcttcacggtgaatgccgaataactttattacttcaaggattaatgccaactagggaggcacagcttctttaagtggaacatatagtacatacacactggtctcaccggaccaagtatttcgaccccggcgcctgtgatgatagcat

SEQ ID NO: 55037 - DNA, 715 bp, Triticum aestivum
  unsure (1)..(715): unsure at all n locations
  Clone ID: PAT_TA_55037
cccacgcgtccggtacagaaggaaggaggtgagctacaagatgaataataagtttcaggctaacatgcaaaagtatttggttagtggcgggtgtttgccaagggaaccgctaccattcagtgtcactggcagattgcctacactggtggaactagaaaattatgctcttgatcaatgggagtgcttcttgctgcaattgatcaactcgtctcaagttgagaaagggaccactttcagctcgtctatgatgaagacgttccagcgaggtcttctgagttcaagggatggtgaatctgcaaattcttactcttctccgcttgtctagctgatggagacaaatgcacagctttggtatataatgagagaatacatttcatccgcagaggaacgcggggtggatcccacggacttgatatcatttctcttggagcttagttttcatacacaaggagcggtaaagtaaaacattcttttttacaagattatgttaagaaccattcagaagtgaaaagttacgcaacctttgtctgcaatgatcattaaagtcctatttctgacggcacagttttctttcaataatagtagggaatattattatgagcaagaggtgtacagacgtaaatattattgatttggggtattgttgaagagagatcaattgtcgcagtaatgcgatatatgaattagagcatctanaagaactaaagtatattct

SEQ ID NO: 55038 - DNA, 528 bp, Triticum aestivum
  Clone ID: PAT_TA_55038
ttcagactaggcctaccaggctaccacgaggtcacctcagttgatttcagactaggcgagctcctggatagctttgcaattcgatgctcgaaatatcagacgacataatgtcgcatgtatatcactgctctttgtatggatgcggtggcatgtgagaggacaagcaggcattgggccatttacgaattgccagaacattgagggtgtgtaacatgaaattgtttctacatgagccttgtgctaaaggtctggtcctattgcattcgtagttggagtttaatgactgcagcctaatttatcttcattgggtgttggtctcttttgggagaattaacaaatttctcccaaattatcacaaatgggggaagtttggtctaaaccatttatgtaaaaaagattggaaatgattggtatattaaaagtcaggccgtagttgcatgaaacaagtgagcagtatacttcagaagcttgcgagcacgtgggcttcttttttattgcaaagttttcttcggaacatttggaaagaat

SEQ ID NO: 55039 - DNA, 599 bp, Triticum aestivum
  unsure (1)..(599): unsure at all n locations
  Clone ID: PAT_TA_55039
cggacgcgtggggttccgatccagcaccgccgccgccaacaccacagcatctcgtcgacggagaggtagcaagcaagatggccggaaggaagggtggcgacaggaagaaggcggtgaccaggtccgtcaaggctgggctccagttccccgtcggccgcatcgggcgctacctcaagaagggccgctacgcccagcgggtcggctccggcgcccccgtctacctcgccgccgtcctcgagtacctcgccgccgaggtcctggagcttgccggcaacgcggccaaggacaacaagaagacccgcatcatcccgcgccacctgctgctcgccgtccgcaacgaccaggagctcggcaagctgctcgccggcgtcaccatcgcccacggcggcgtgatccccaacatcaactccgtgctgctccccaagaagtcccctgccgncgccgagaaggaggccaantcgcccaagaagaagaccaccgccaagtctcccaagaagaagacggccgccaccacagagtagccggccccggagcctatctgaccctttagttccgtatcaagggagaggatgatgtgactttttggtttattggatcct

SEQ ID NO: 55040 - DNA, 734 bp, Triticum aestivum
  Clone ID: PAT_TA_55040
atccctccctccctcccccgtcccggccgtctccgacccgacctctcgcttcttcttcttcttcttcttcttcttcttcttcttcctccctcactggtgaagccagatggcggcggagagggtcaaggacgtcggcatcctcgccatggacatctacttcccgcccaactgcgtcctccaggaagaactggaaactcatgatggcgtgagcaaagggaagtacaccattgggcttgggcaggatagcatggccttttgcactgaagtggaggatgtcatttcaatgagcttgacagtggtgaagactctcctgaaaaattataacatcgatccaaagtgtattggacgtttggaagttggcagtgaaactgtaatagacaagagcaagtctataaagacatggttgatgcaaatatttgaggagtgtggcaatactgatattgaaggagttgattcctcaaacgcatgttatggtggaacagctgctttgtttaattgtgttaattgggctgagagcaactcatgggatggacgttatgggctcgttgtttgcacagacagtgcggtatatgctgaagggccagctcgtcctactggcggtgcagctgctattgcaatgctgattggaccaaatgctcctatttcattggaaagcaaatttagagggtctcatatggcacatgtttatgacttttacaagcctgatcttgcgagcgaatatccggtggtcgatg

SEQ ID NO: 55041 - DNA, 671 bp, Triticum aestivum
  Clone ID: PAT_TA_55041
gtgcacaccgagtacacacgcaacacaagttaagtaataattgtgacgctgatattgagccgcgccaacaaccacgtggagcggcctaaggcgctcgggaccgtgcccgccgtgctctgaccagcaacagaaagagtgctggaccttcagcggacgaactgacacagggttgtcccttctaattgtgaggttcgacttaaactgcaaccgtctgtatgcggtgctggaaccggagagctccggtgctaccacccgctgcagagatgcttaatcaagtagacggacaacgagaagacggctgcgacgagtgctgcaaccatcgatctcgcctactactaccaggctatgtagtgtgctggaacctactatattatttgctggcactagctacttttttatgatacatgtccttcttatcatcattcttagcttcatatgatttctgatggaatgagaagtgcctgtgaccgtccaacttcttttttttgttgggaccacgtttattttgtgacgcaacttggtaaatgctgtggtacatcaactcactattttaacgtagatggagtggcgaatctgctactacccgtgactgcagaagttacaaccggtgagctttattgttatgatggatattggaatgctaccacccttgagctattattgctggaacc

SEQ ID NO: 55042 - DNA, 521 bp, Triticum aestivum
  unsure (1)..(521): unsure at all n locations
  Clone ID: PAT_TA_55042
aaaaccaagaaaccggtttataatgccggcacaggcacagggggggggtccctcattttattcgccttctccatccggggggggggggggttcacccaacaattttaaccacctccgaccaacgaccaaagcacgcacgcacacaggcagcagccaggcgggggataaacaaccatcaagggtttacagacagacacaccttttttttttacccaacacacaaccaactgggaccaaaaatgggggcggagcacggcacgccccctaatacagggccccctccttggggggggggatgacccaacccgacttggggtaggggacccacgtaaacacgtagccctcctggtgggcgtggtccaagaacgacccgtccgactggtccaccgggcccgcctaaattttgcccgcgcagggcgagcatgcccccgcccggcacgagtaggggagttccacccccgccgtttccgncgagtccaggatgtaggtgtcgtccggcgcctaaaactcgggctcggccc

SEQ ID NO: 55043 - DNA, 379 bp, Triticum aestivum
  Clone ID: PAT_TA_55043
ccaggggcaaaatttaaaacccggcagcatttagtttcggggccgccaaagggggcgcaacagttttgccgggggggaaaccggggggccccaaaaaaaatttgcccttcagctggcaaacggggatcgggggaaaccttttactaaggaggttggccgccacgtgggccacaaccccgttcattccccccaaatcgggagggctgaaatcgatgacaatcggggaaagcatgccgggcagtttttgcatttgcttagaaaggatgcaggttttgacagaataaagcgggcccaccctttggaggatgttgagcaccacgtcattgggcagcttgctaagcatgtaatcggggggcagcttgcctagcatgtaatcatt

SEQ ID NO: 55044 - DNA, 502 bp, Triticum aestivum
  Clone ID: PAT_TA_55044
gcaggggctaaaaaaggatagatcaggctcaacaaatagatgcaccaagtcaagaagttaacgcctgcggcctgccgtttcaagaccaagttgaaaagaagagactactactagaacccaagcctttttggtactccctccataaaaaaagagtataagagtgtttatatttctttacagagggggtaactgctagacaaatttcaccacttcatttgatcccagacgcggtttcacgtcaagtttttccggtgcgtgatttccgaccgtgtcccctcgcctgctttagcaagttataagaagcagtcgccttcacgcgtgccgtcttagtaacctagaatagttcatgctgacaagtccacaactgtagctcagcccttggcctcctcctctatcttgcaggcgctgctgcaggggcatttaccacgttcctgcgcaccaccctggggcctccgccattgccattcaaattcaagccattggcactgtccccatcacccac

SEQ ID NO: 55045 - DNA, 523 bp, Triticum aestivum
  unsure (1)..(523): unsure at all n locations
  Clone ID: PAT_TA_55045
ccagcaagttcatcccagaagagaaaaatatcaagtcaagaaagaatgtgacatagcaagtattaatacaatgtatcaggggggggggggnggggggggtaaaaaaaactaaacatggcaaaagaatctgtctatgttccatttaatggagtacaacaactgaaattagccaacaagatgatacatacaacaaaagaattaatcattccacatttgctcgggcttagttcccagcaacactttccgctccagctggtcctttgctcatccagtacttgtatgcgtagagtgaggacaccactagggcaccgacgacgatgaaggcaaacattgttggggcgattttagtagggctcctcttctgcttgctctgtgccagcagtgctctcggcttgatcttcgccatggctcacttctcgatctgcagcttcgcaattctagccgagggatcccgcgccctggctggcggagacggaggtggcgtggagcgatcccnaaaggagaggaaggggtccaagcgaag

SEQ ID NO: 55046 - DNA, 533 bp, Triticum aestivum
  Clone ID: PAT_TA_55046
ggggataacagttagtactttgttcgttggaagttgcatcacagtgacaaacatgaccaagagaacagtggttcgagggggaaaaagaacaatgtattttggttcacacaacaaagaatgaaggaaaataactgaaatcgctgattacatatgcacttgttcatactattacatttattatgatcagcctgtaaaattatttatcgggttgcagtagcaaccaattattttatgagcaaacacaaactgatgcaatggtcacaccaagtaggcgggggtgaattgaagttccttggattgctaccgggagtctcccagtagtcgcagatttacaatttcatgtctcactatgtcgaaaaacgacatgcttaatctgcgtccggttgtatgtgtatgtaatatgtacgagctcatccatggtctggattaccgcaggatatgagaactccatatcctttggtgtcctctagtgtcattacctcgttccatgaatcaccgtcatccgtggagactgcaatcttaagtgtgcccct

SEQ ID NO: 55047 - DNA, 596 bp, Triticum aestivum
  unsure (1)..(596): unsure at all n locations
  Clone ID: PAT_TA_55047
atgaacatctaaggattattctaatagaacaagggccatcagatcaacgtctcgatgttttgctttcatcggcagaatttgaatttctagcagattcctcctttttttttttccaccgtactaactatgctatttagatactcgtaaaaatacatacaatttgaggctctggtgataagcacatctgaattactctatgaccacgcggtatatctttcatataacagtgccgcactgcgtgctaacctaagcgatttgtcttcatgcaactactcttatccagacttatattactgatcagtttactttgcgactccttttacccactgagcgtcagtttcccctagtgtcaaaggcgagctagaaagcttgacaatcaatagctgtcaaaggatgctttcatgtctgcgcctggcccattgtattatatcaagcactggtgcgtcttggcctcatcttcccagtcacatctcatggagagatagactaacaccaacgtttgacacagcattccctccaatcaacccagaccaaattccccgaactccgagntctagtgaccagcccattatgatccctatgggcacaccgaccag

SEQ ID NO: 55048 - DNA, 443 bp, Triticum aestivum
  Clone ID: PAT_TA_55048
aaaaaaaacatcagcttttatcttccattcagattcagtactacacatttgcatccgtatgtagtccatattggaatctctaaaaagacttgtttttatgaacgcagggggtatcagggcgatcgggggacatataaagagcttcactaattacatatttttctctcctatacatttttatatttttataggcatactggcactgaacttgggtactctaattcatgctcagctgtagttaccggatactcagtctgctcactccatcgcttgaaatgccaaaattagatacatgcactctacaagcatggggaccccttttgattgaaaaatggcacaatcatctaaaatcgctctttgctcactccattaaagaattccttctttagttggcttcacagttcagtaatcctgccctgcgttggttagctggaacaggaatt

SEQ ID NO: 55049 - DNA, 571 bp, Triticum aestivum
  unsure (1)..(571): unsure at all n locations
  Clone ID: PAT_TA_55049
acaaggcctcggaaacaccgacaacagccagccaatgaatatcaagacagattcaacaagcaccgagaatagcctgagctgagctcccaaagaaggacatgttcacaaactccatcagatgatatatattaagcctaggacggtgacattaatcataagagtctcacaggtgaatgacttatacaccgggacggaggtagtaccattttggcttggcttggctcggctcggctggcgaccaccacttatagcctcagtgtggtgtctgccggcggccctctagaggtggtgccggaggcggaggcggccgactgcttcgccttctccgacaggaacttgctgcagtccgctcccttcaccgtgaactccatcagcagctcctcaaacagcctcttgagcgaggtcttgaacctgagcgagcagctcttgtcaccctcgtccacgtcctgcaccccgttcccggcaaggcacccaaccttgggcgccgtccaggtaggccttgcangccaccaggacgttgcgcccgtgcttgcggaaatgggcagccacgaaatcctcaaaatgctttggc

SEQ ID NO: 55050 - DNA, 459 bp, Triticum aestivum
  Clone ID: PAT_TA_55050
aaaagggccccgccctaaaaaataaaagggccccccaaaattaaggggtccctttctttggcccccccctataaaggggggggctgggaaaagggcccaagaaagggtttccaaaaaccaaaactaaatcggaaaaaaaaatccttggggcaaacaaacagtcccccaatggcccccgggccccaaaaaacccaaaaaacccttaccctttttttggcccccaagttcccaaaaggcccccaattgaatcggccaaatccttccccggggaacccccaggaggggcccaacccccggaaaagtttttacccccccataatggatcccaacccaaagctggacaactggtctctcacgggggccaaaagaacccagggccggaggcccattttttttaatggacattttataaagaattttttaagctgccccgggccgggaacaacctggaacccccgg

SEQ ID NO: 55051 - DNA, 567 bp, Triticum aestivum
  Clone ID: PAT_TA_55051
ttttttttttttgttttttttttttttttctattttttgttatttatttttcatatttttttttttatcactgtcaattcatattttttttcttttttttttataaggggacaccgcttgaaaaaattaaaagtaaacatttccaaaaggggggcccacaaaacggggaaaaccctaactggggttcaaaacccaggatagggtggcttcatgccggaaaaaacattttccggaaaaacgagggggggaggctaactaggcaccaaaaaaaaaggatcaaaaaaaacctcttattccccaacaaggtttctgaagcgacgacaaggggcataaacaccggttttttgcaaaggaaacaccttcgaaaacaccctcgggggaaacgccccccagggaaccccccaaaaagggccccacccaaaaaatccaagggcacatcaagaatgggcccctgttgaaaataagggcagcacaaaagttcctagctggaaataccccatggccatggagggggagggggacaacaggaaccaaaaaaccccctaaacctctaggaggagggggccg

SEQ ID NO: 55052 - DNA, 584 bp, Triticum aestivum
  Clone ID: PAT_TA_55052
aaccataaacttatttcatttcattatggtatgcacattgctatggtgacttgcgacatacaaatttaaatataccacattcttggtacggaatggtaatcatggttactccttgaacgacgtcactccatggactcctcacacagtacaccacaagccatggccatatatatctaacagtagaaatcacatcttgcatgtccaagcgcaaaccccatgatagcatggccccgcaagagcacacctcagcaatctcttccatgtctatggagacgagggagaatctggacacgtacctccatcgcaagtgcctctctgcccctccctgtgtcacccttcattacctgtgtctgcagcgcctaaatcagacgatggtgagtctagtcttgttgtccgccctactttctatagctttactctccaccttacttctcgctcgtttgcttatgcaacccttaagctcgaaggaattctttaggctttggaatgttccaggtccataaccccttgaaatgaatatgccgtccacaggttttgcaacaagagacctataaaggagcgcagtggcggagcttcgttggggc

SEQ ID NO: 55053 - DNA, 264 bp, Triticum aestivum
  Clone ID: PAT_TA_55053
cgagaacaaagactatttcccaaaatgaattggttgcaaatacattaatacgttgtctgattacatgaatgaattaacttcagttgccgactgtagaattcatagtcctgcttgtcctgatcggacatccgccgattcataaataataacgcatgagagcatcattagaaatgcccactgacatcctactggctagctttatccctgcctatatatatgctggctctaaaccaagtccacaccctaatgcgtacaccctatcct

SEQ ID NO: 55054 - DNA, 485 bp, Triticum aestivum
  Clone ID: PAT_TA_55054
ggggaaaaacgatgggccggggggatgatagtataaaggaaaaaaccccctcttcccccagggccattattattattacctcaggggggaaacccccccatcatcttcccccttggaaaaaataagcgaacccggaattatagaaaagggggcgaccaccacaaaatgggttgaggggggaaaaaaaaggagcggggataaaggggggggggtaccccaacgaacttcatgcccatagaatggacccgtaattcaagcccccaggttgagccccggtttgcgggcggggggggggctttggttgtcccccaagacgggctcaaagggccccacaagcgccttcaccttggtcacctgccgcaactccaaaagtttgatccgcgccccctcaaccgccttgttggtgggtgccgacccccccccccgcggggttttgggattaaacgaccccttccccgtggacgtcctcacccgggagccctgga

SEQ ID NO: 55055 - DNA, 550 bp, Triticum aestivum
  Clone ID: PAT_TA_55055
gtgacaagcctggttaaattacagaacaccacatgatgagggaattacagcaacaaaaacttcccaggcgaaacactagcgcggcgtgggcaaggaactaagtacacgcggggagcgtgaaaacaccattctctccacataatgtctgggcgagcgaccggttccaccatttccagaagaaattggatccccacttacacacttatgcttacacaaacactccatctctacgccattgttgaccaaccgtactttatactgcttggccaggtcctaaaaaaaccttgaacctggcgggcaactactagctgccgaactggaccgtgtaagcccgcccaaagctggctcccttcgtcggccccctcttcttgtcggtgacctactcgccgagcttgctcttctctaggaactcggagaagacgcttgccctggccgaccctgtggaggcggcgcatacggctaagacagccgccaggccgagaagcgccggccgccggtccttgtgcggtgggacctgcacgcgctttgaccacgccggcgaggcggactg

SEQ ID NO: 55056 - DNA, 524 bp, Triticum aestivum
  Clone ID: PAT_TA_55056
aagaaagccctaggatgggatggagcagcccatatatatagcacagtacaaaccaagttcataatgagcgggggcggcaactaaaaaaaaattatgtaaatcctacatatcttccttatcaagccaaactaaattatacaacaacaacaacagggagaggcgaggcgaggcaattataacccctttgatcaaagcaagacactgaaaaaaaaagggctggtgctaagctaactttaccatttggagctagtttaacaaaaggctgaatcctttttgaaacttcctttttttccgtttttgcttgggaggctgaaaaaccaccttgatcgccgaataaaacaccgccttgatattctgctgggtttttgagctgcactcaatgaaggccggcgcgccaataacctttttaagcttttaaccctgagctgggaaaatagaaacagccccagggggacccacaaaaaactgctcgtcatcccgaaaataaagctttgtccaacaagaattatgggcacacccggagc

SEQ ID NO: 55057 - DNA, 654 bp, Triticum aestivum
  Clone ID: PAT_TA_55057
aatcaaatacgagtagtacgtacgtaccccgtgcaacttgatgttacaaaatgagatttctcggagatagtggctggataataaacccagtaaagtagtctggtaggtgcagtggagcagcgcgacacgccgctgcctgcgaatgtcttgtcacgcccgagcagatgacaagatgatcgcgtagtacgagtcaccgccggggccagttcggtacgcgtacgctcggctcggctcctagatgggagctaggtcaacttcgttatccgcgctacacgatactccatgtccatggtgataggatgggccatgcacgacgtggacaaccgaccgccacgcgttatactcatccataggagtagaccagagcggcagtaatttcttctctctcttttacttttttctggtgctagaaccgggcgagcgcgcggcggagcacctgggcgaggaggctgggggcgctgaggtggggaaggtggccctccgtcggcaggggctcgatggtggtgcgcccgccgaggtgggccctgaggtaggcggcgacgttggccggcacggagacgtcgcgggtggtctgcaccaccacgcacggcgcctgcaccatgcccagcacgccgcggaggtccgtcttgaacacgctctggcagacgtgcagcg

SEQ ID NO: 55058 - DNA, 745 bp, Triticum aestivum
  unsure (1)..(745): unsure at all n locations
  Clone ID: PAT_TA_55058
agtgagcagccatttcggcctctcttctaacatgagtaagctcaaaagatatacactccataataagatcttggatttgatacaacatagggagcatacacgatctattaacgttcctgctactccacaaactaatcaacatagcaagagtttccataatcaccttcagcaggttcaggtcgcaccctagatctgctccgtccccgcaagcaagagcttcagcagtgatgatattagggactatggagaggtataccatttgttccttgttgcaataacctgattacccctgtggctccttgttgattatccaaaattccaaattgaaagatggatcaacattcacctttacaaaacctacaggggggcgtttccacttaatgattctagtttcttctttctcctttgcatcagaatttgatgtttggatcatatctgatgccatctcccaggctcatcagcatgcttgtgagatgttcatggtagtctccccatggtatcttctatttctgagggtccagttcgtccacatgccgcanaggatagcacaacagagctcctgtggacaaaaagcattatcgaccatataattctttaagagattccaaaaacattgggcaaacaccaagcatgcaactgatgctcttttccccgtatttggcttnctctgaaactgcagattgcgtatggacgtgcaaaagcctgtgagaacgatctgactttttgagtataccaatgcatcatg

SEQ ID NO: 55059 - DNA, 576 bp, Triticum aestivum
  Clone ID: PAT_TA_55059
aaaaaaaggggacacacaaacacaattttaaacacaaaaagggggggggggaaaaaccccccccccggggggggggttaaaggcccccaaagaaaaaggggccccgctttaaaaacataggggggcaaagagggcgcctgggatttttccacacaccaccggttttaggggtacaacacacaagaaggggggtcaggaaaaaaaggacacacaggcgccccccagggggttccccacggggggggggggcacagccccttaagccctttggccagggacccctaaaaccaggaaaatgcccgggggcaagggggacccccctgggggggggggggcacaaaggggggggccctaaaaaaaacccaccaggggggcctggggaccccccagaggggccaaccccctggggtttgggaagggggggaaactttaaaagccgggggaaatccccaaaaaaagcctggggaggggaagcccccagaagagcagccccgcgcttttggggcacgggggggtcacaaaaagaacaacattcccgggggggaaaggggggggcttttcacccccccagggggg

SEQ ID NO: 55060 - DNA, 436 bp, Triticum aestivum
  Clone ID: PAT_TA_55060
aaaaacggttttgggggccatatgggataaatttagggggccgggcatttacatagcccccggtgggtttcaaaaacgagcttgctttttggagccctggggggccctgaacagggccatccccatttttttgggaacaaataaaaaagataaggggggaaggaaaccccaaagcaggggggggggggacaaaacgggaggggccctttatatatggcccggcgggagggacctgttaaggccttgccggactcctcaaaacccgggggtttgaaggggaaaaaactgaccccctgcccctgacccatggtggcaaatccgaggagggggccatccccggggggggccccctttttgaccccccccaccctggggatcaccgggggggggggggggcccccaaacatagggggtttccacattggccaataccggc

SEQ ID NO: 55061 - DNA, 409 bp, Triticum aestivum
  Clone ID: PAT_TA_55061
gcgcccccttttttttttttttgtttgttctttctcacaataggatcttctcaagtgtctttatcagagaacaaaacttgcccagtcattcgctctggatgcggtccaggtactttacgtaccaaggataaaaatctcagaattaaattggcctgcttacagtgtgtaaaggcacctgccgtcgtcactcctagccgttgggtcgaagttcttggcactctggtccgtgcatcctgccggcacaggcaaagtaccttgctgtgcccctttaccttctcctatgcatcaagagaaggtggctgcatatggagaatgtcctaaccgtacaaggaaccagtcttcatcttatcctgtttagtataacccaaagctttctggctcatgtaggtgtcagtaagctgcacactct

SEQ ID NO: 55062 - DNA, 189 bp, Triticum aestivum
  Clone ID: PAT_TA_55062
gaccgcactgacgatattgaacagagaaacaaatccaggtagcattttctcataacaagcattttaaattaaaccacaagcacgagcattcgcagagcggcgacctgatagacacactgaagccaagctagccatcccctaaccgccgaagccgtacagggtgcggccctggcgcttgagcgcgtacac

SEQ ID NO: 55063 - DNA, 604 bp, Triticum aestivum
  unsure (1)..(604): unsure at all n locations
  Clone ID: PAT_TA_55063
gaagtatattgcccttgaaaggatgggatttaatgaagttcaccaggcgaaatttaactaaactatgaggtatcaacggtgacctcgtacacatggcagccctggccggcgtcacctctgtcattgtcatcgtcgtcgtccttccaatgaccgaagggcgcgtacgggtcgcgacaaccctgatccgccaccgcctggagctcggccacaatgtcctggcggcaacggtcgcccatgaaagccgctccggcacgcccgaccctgcccttggcgagaacatggacagcgtgctcggactcgaccatcactattttgaagagatggtcgttgatctgacgccgacgttgggcggatgtcggtgtcgtcgtccgacacgtgtccttggcccaagccaacataagactggggtccgcgaggacccaatcccggcgtgcctgctcgactgccgccttgtcatcccatcatgctgcgcgaggagtagccaccctcgccaccacgtcaagaaggggaaagggaaggcgcccnncgcgtgctgacgactgggtcgggcgcctccaccatcttcacgggcccactggctcccggaccaatgaggggacgatga

SEQ ID NO: 55064 - DNA, 433 bp, Triticum aestivum
  Clone ID: PAT_TA_55064
aagcacccaaagcggggggggaaggaaaaatgtaactaaccccaacgaggggaacagccagaaacaagcccacaaaaaacgatcgggggggggccacaccccaaacagaaaggagccggcctgctttctggccccggcccacaggaaaataaaccaaactcaccaaaccacctaaggggggggggcaagaaccaaaaccaacaaaaactctggctggatgctaggaggaggaaaaagaaaaaccaacctattcttaaatcccccgggaaggcaaccccgggcaacggcccaccaattgttgcccagccgggggttgttgggaaggggggaaaaaacctttttaaagggaccccccgggggaaacaaaccccacaaaacggtgttagaaagacaaaccccccgccggggggacagcccatccaaataggtgggg

SEQ ID NO: 55065 - DNA, 423 bp, Triticum aestivum
  Clone ID: PAT_TA_55065
ggggaaaaaaaaaaaagccggaaaaatttttttttgggggatcggggcaaaaatgggcccaattggaaaaagggaaaaaaggggggggggaaaccctgggaaaaaaaaaaaaccccccggggggggaaaacccgaaaaccccgggggggtaaccaacccggggggaaaaaaaacccgggaaaaaaaaaaaaaaaaggggggggaaatggttttggggcctggggggaaaaaaaacgaaaacccccactttgcggggaaggggggggggttacccaagggggagccccacccccccaaggttttgggggaaatgaaccccccctttccggggggcgggggggaaccccttgggttaaagggcccaaaccccgttgaaaacccaaccgaagggggccaaccctttcccaaacccggaaggggggg

SEQ ID NO: 55066 - DNA, 462 bp, Triticum aestivum
  Clone ID: PAT_TA_55066
ggggtcttctatcccgggaaccttttttaacccaacaaacctccaattcccggggagggaaaccggccccaagaacaagaacccagaccccaaaccccccgaccaccaaactaggggcggaataacaagcaagcgttcaccccccccaactaattacctaattaggcccaaaaaacccccctttttcacgggaccccaaatcttcaagccctggaaagcttaactagggagccctatcccatgcctggaaccctacccatgccaacaacttaagtggtaacccgctaaccctaccccccttatgcatgcatgccctaattccaaggtgcttcaaatctcaaacccaccctacaaaacggagcttaccgcttgggtaaacttgaaccaacccccgatcatgggatcccgccccccgtgaaagaccaaacccacttcattttggcccccaaggaacccaagtcc

SEQ ID NO: 55067 - DNA, 425 bp, Triticum aestivum
  Clone ID: PAT_TA_55067
aagaaaaaaaatggggggattattgacgggggggactgggatttacattcaattacaaatgggggtacggggggaacccggacaaaaaaaaagggtggggcatattttgggatgccccacaggcttaaaaaaaccaagggactatttttggaaacaaaaaaagcaccccccaacaaaattccaaaaaaagggactggccaaaaaaacaaccctgtttttcctccaaaaaaaacggcaccacttggaaaccatttttttggggtatatatggggctggacccaaaaaagtttggtccatacttggggggaaaatgggaaacacccttccccttgggcgccctttcggaagcattgacccctttcttgaaaccactccaccaccaggcccgtaggggtgggcaatctggacctttttcgcctttttg

SEQ ID NO: 55068 - DNA, 379 bp, Triticum aestivum
  Clone ID: PAT_TA_55068
aaaaccaacaaatttcccgggtttacaaaccaaactcaactcaaacaaatttaatgggccaatcaaccacccccccttggggcggcccaagacgaaacaaacaaaatcttggggaaagcaggttcacaaaacccaccactttcacgggtccaaaagtttatccctcaccgaaaatcctttgccagcattagcccctgaggacccacactcaaaaaccccccctgggttctgggggtcggacccccccccaactggtgatcccaaaacacccaattcaggcaaagggaaaaacgtgggccccggcttttttggggccagcacaagcaatgccccctaaaatttaagggcattaagggcctgcctgatcccacccgtccgg

SEQ ID NO: 55069 - DNA, 335 bp, Triticum aestivum
  unsure (1)..(335): unsure at all n locations
  Clone ID: PAT_TA_55069
atcgcacatgacttacatttatttgattatattgatggccaagataaaatctcaaaatgcacgcggggattaccgcgggtgactttttataagatgttagaagacatcttgatgttcataaaaaaaaaatcagattctttttaaattgcatttactattctttcggatttactgtttatgtgggtgtattngagctcgaagcagattcatggcccttaccttctatatgtggggggaatataagagggccttgtttatgggggggcatgggaatggggatgctgggaatgatggaaatgggggggaatgggggggagatgaactgggggatgggg

SEQ ID NO: 55070 - DNA, 650 bp, Triticum aestivum
  Clone ID: PAT_TA_55070
gcatccaagttaaaagtgatatgttccgtcataattcacactacactgatgagttaaagacatggagctaaatcccattgtcatcacaccctacagcctgcatcaactgcgaaaagtcacggcaaccagccaaccatgttccatcggccatcacaacagcgaagttcatccaccaccaccaggataacaaaatgtacagcaggggccaggtttagcatctccgaagcagctcacagcggcccgaggaaatcaccagccagcgacgcaaggagctggaactggcggtcagcctccatccagcggaaccccatgaccttgaagcgcacggcggtgtccctctccagcttcgagtggtcgttcatgaacatggggttctcgccgcccatgtacttgtagtcgctcatcgacttctctgataggaagatgctttcgatcggcccagatttgaggaagacgccgtgcttcaggatcttctccacggagccgaccaagatctcccccttcataggcctctgggtgatgcaggtgaatgtgaccgggaaaagaacgtctccggtcagctcacgaaccttcccttcagagatcgtcttcagctcgtttacagcaatgtagtagccatgctccttggaggccttcctgttggtgacgtc

SEQ ID NO: 55071 - DNA, 456 bp, Triticum aestivum
  Clone ID: PAT_TA_55071
aaacaaagcggatcccgccctaaagcaaaattttccacgacattttattttccggggaaaaaaaaactatcctgggcatataaaaaacaaagcaggccccccccacgaaacggggggaaaaaaaacacccgggggaaaaagcaaacaatttaaattttcgaccttttccaaaagcaaaatttacataacgctgggggctagctagggttccggagcaaatcccactctctccccccaaaagcggggggcaagggctttttagggtggggaaccaaggcctggcagcatggggggaaagcctcggaagcatcaaaaattggggggaaaagaaagggggggagaaccccccccccattggcgggggcaaagggaaaggggtccccagggggggggggccccatcgggggctggtgtttggtgagcccctccatgaagcaagaaaatgctgaaaagggg

SEQ ID NO: 55072 - DNA, 636 bp, Triticum aestivum
  Clone ID: PAT_TA_55072
ctcaccggatctaacacaaatccatgatgcttcaagaacaaatttcagagcaaatataaagctcacgggatctaacatagatccatgattcttcaagagcaaatttcagagcaaatttaaagcataaaaagatttaagttgtcctattgaaaccataccaccatatcttcatttagtttctttggaaatctaaaggtctaaaaggatggtacatgtgaaaagctgtgaatccaaaacaaaaaactaaactaacttccaaacaaacatttaaagtttggaagccacaaaaaagcagctcaaatctctcgttgtagggcaggtacatgtccttaatcatctccgaaaaagacttcttggcattcttgggcaggtcggacatagcaatcgcttgagcccatatttcagtcttttttaatctctcgactgaagcaatggttgatcaacagcaggaacctgaacctcgggatgctagaccatatatctatggttaccctttttatttctcctgcctaacctgaagtagttatccgagacattcgacatacaccattcatgtatggagcctggagggaccctcttctccacttctctcgactcactactggcattgttgactcgcaccttgcatccgagcct

SEQ ID NO: 55073 - DNA, 451 bp, Triticum aestivum
  Clone ID: PAT_TA_55073
cgagccatgtcgggaaaatggacatacacatattcttatcttaggaacaaacaagaaagataaatggaaaaggaaaacccaaagcaatgtcagagttgacaaaaccgcaatggcactttatatgtggcccgtggtgagtgagctgtttaggccttgccggactcctcgcagcccgggggcttgaaggcaataaatctgacccactgcacctggcgcatgttgtcaaatccgatgatgcggacatacccgtcagggtactcctttttgacctcctccacctcgttgatcacctgcgtggcgtcggggcacccgaacataggcagcttccacattgtccagtaccggccatcgtattacccaggggatgcgttgtgctcacggaaaataaacccaaccttgctgaactcgaggcaaggcacccacttggagcggatcaggtaaccaacctgct

SEQ ID NO: 55074 - DNA, 503 bp, Triticum aestivum
  Clone ID: PAT_TA_55074
ggaaaacccaaggtcccgaagcgggagtttttttttggtggggaaaaaaaaaacgggcccaaaagggatgctcatgccattaaaaaaaaaacaggggccctaaggggaaccccgaaaaataaaccgactttttgggggaaaaaaaaactatttagctggggggaaaaaaaaaaggaaaaactacggaaatctacgtctaaaagctagctaaaaggggcatggcaaattgacaagcagatgtaaaaacaaagccctaaggggggtaaaaaagaacttccgttcctaaaaaaaacaagggtctactactgaggagctagcattggaggaaacattttaactgggaggggttgaaaaaaatttttggccctaaaaaatgggggggagctcaaacaaaaaatggatatggcaaaaattttccaaaagtctcactgggccgggggatcttaaaaaattggccacccctaaagccaaaaaattttgcttttggaccccagggttgaaag

SEQ ID NO: 55075 - DNA, 528 bp, Triticum aestivum
  Clone ID: PAT_TA_55075
aaagcgcgcaacgaggggatcatcaccctcatcaatcattcattggaaaggggcccgccgatcttttgttgctaacaggagaaaattttgatcacggcgacatggttatcatctgcgaaaaagggttctccccccaccccgaattttgccccggcctttttcgctactgctggtactagggctaagtgctaattctactgacttctacagctacttctactactttattatccttcctcctgctgctgctggtgcctccgtagccggcgttcttgaacagctcctgcttgatggcgtccgcgctgatcatctccctttgcatctcggagcaagaggcgtgcatggcgaaatcgttgaagcaactgacgacccactgctggatgtcaaggcccaacgtgtcgagggtgctcaccgtggacagcaacagccccggcttggcggcgcattaaatctccacccgggtgtcctcctccttgcgctccacctcgaacttgggggtgttcctggcgagcatctcgttggggttga

SEQ ID NO: 55076 - DNA, 717 bp, Triticum aestivum
  Clone ID: PAT_TA_55076
attagtaagtatagattcatcaaaaaatagctagcacactcgccatatgggtgattcatagctcgctatttgctcaacaatgcatgagagggtagaggtgcaccggaagacgtggctcagcatgtagcactagcggctgctctatgaagaggtcgtgcttggactcgctgagattgatggccgacaccccagccggtttggtccaggtgaagccatgtaggagcctgccaaagagcatgacactcatggttgttcctagtgatgccgcgatgcatccccgccgtccggtgctgaaggagatgaaccgcaattcgctctcagtaagcaccacattgatgttgtctcccatatggcgctctggcttgaagtggagcggttcatcccagacggttgggttccggcccagggccagccggctgaggatgacgttgctacccttgggtatgtggtagcctgcaacaatggtgtcagcaatcgcgacgtgcggaaggttgaagggagcgattgggtggaggcgaaatgcctcacgtatgcacgccttgagatagttgagctgcatgatgtctgactcttgcaccagtcgctcgcgaccgaccacccggtccatctcctccaccgccttggccagcaattctgggttgttcaccatctccgccagcgcccactccactgcgtttgacgggttatctatggccgctaatattatgcccttggact

SEQ ID NO: 55077 - DNA, 575 bp, Triticum aestivum
  Clone ID: PAT_TA_55077
aaaaaacaaccaggcatttacattactttggggggagcaatctactttccacacaaggaaaaaaaaaaaaagggggaaaaaaaaatgggggaaaggaaaaaactgggctgggctctccaaaaaaaaaaaatcacttgggaggggccaactatagggggccccgttgggggaaaacattaactgacaaaaaagccttcaccccccggatatggggcccaaaccccacttgaaaaaaaattttttttttgcccaaaaaaaaaaaatggggcgaaatctcgcaaaccatggggggaattgatttggaaaccatggaaacattggacgggggggacacccttgccctggtcccctgccaccattggtctgcctggttttaaataaaccttttccgggtgaaccaaactcgtttgaaaactctggcccccccaggcaagggagggagagggaaataaacaccggggtgggtttgctctacccattcggcctaagggggggattctgcatcgggggggacacttccattatgggacattttgggaaggcccgccttggtccaaacaaaacttggtccatta

SEQ ID NO: 55078 - DNA, 680 bp, Triticum aestivum
  Clone ID: PAT_TA_55078
gtaaggtcacacaactctagcagagtgaaggtcacgtagcaacagaatagcacgttacaaagcgagtctcgctcgcacgtacgtacacattatcttatcttacagatcctggtgcccggccagtgcagccactgcaagatggtcgggcaccgatcctctttatttattcttaacagaagctgctctgcttccggatcatcgcgtccacggcgtcgctgctcagcggccagatcacttggtcgcgatgaaaagcccccacttctgctcgccggcggagctccgcttcagcttcgcgctccagccgttgacgatgtcgtcgtagtcctcctgggtgaagtccgccaggaaggcctccttgttcttctcggtctcgcccagctccctctccaggaccctcaggaactggtcggtgcggtcttcggcgacgacatcgtggaaaccggcatcctcaagcatctttccataggtcttcacatcatggaggtcatagcctctctgcttgatgtacgcagcaaattcctctgatggtgtcccagggctcctgcagtagtcactgatcagcactttgcccccaggcttgagccacttgaagaagtttctgaacagagcaggtttgtcttgaatgtggaggatggtgtcacggctgtagatcacatcaaacgtgttctctgcgtattcct

SEQ ID NO: 55079 - DNA, 536 bp, Triticum aestivum
  Clone ID: PAT_TA_55079
gttctatctaatggcctctttatttctcattttttttatcttctcctaagggaacgaagggggcgggcaaaattttaaaaaaaagggaccaactccaacccgctattgacaaggcattgcctcctttgttaacaccccccgatccttagaggtggacggccccccccggaacaaaaaaatctaaaacccccgggtgtactcctccacaaagaactgggtcgacaaaggacaaaaccccacggccggcttccccgggggggaggggccgctcaataaaaggaggccccaaaaaaagttttgaaaggaacccactgccccccctgtaaaaaaaccgaaacgcccggaaaaaaagatcgcctctaacaagcctgtggatatccatgggggcccctgggaacccaacatgccctattggggcattgccgtccacatgagcctcacccattaacggagttacttgagcttgggataccggggaggcaaccccggggactcctggaacgccgacacccctgtcaaaaaaagaattggggggc

SEQ ID NO: 55080 - DNA, 434 bp, Triticum aestivum
  Clone ID: PAT_TA_55080
ctcggagcgaaggaacactcgatcatgctatcacccgccatgtttacacggggtcacccaccaaaacataaatcgagccccaaatcaaaaacttaactttacaaagctttcccaagcccgggtcccaggggacaaaaaagcaatggcgccttatgggttgtcctacaaccaagaaattattactctaaaacctttgaacaggggaaaggggggtaaaaaactcccttgaacgggcagatacatggatacaaaatcccagaagcctcgcttgggccaaaatttccttctccagtgaaataacacgccgggttacttgtttagtaaaatcaccataatttggtcttggcccaaaacaatattattccaaccccaacaacaaaggcccccggggaatccttccgaataaaggccaggaaactaaaatcctttgcctt

SEQ ID NO: 55081 - DNA, 549 bp, Triticum aestivum
  Clone ID: PAT_TA_55081
aataattatttttataattacacttgtaagtttctttttttttagaaaaacccatctgacataaatgttattatcagaggtacactggattccaacgtaaacaaccaacattatgttagccttccatatttaacaagctggggatctggcaagtatccatttgcaagcggctcggttaattatattcacttagacagcaaaatcgcgcccttcgaccgagcttaacacaagcttaataaatccactccattaggtgattgaaccatgatgcgttctccccaagaggcggactaaattgccttcaccaaacgcgaagacagaaccgggcaaaacaaccggtcctagctggcgtaccccaaacatgtataccacctggaattaccggtttaacacctggtggggatacccagtccctggggaaaaaaataccgcgagcacaatctttttcaatataaaaaccgggcacaaaaagaacaaaacctaaagtgctttaagggtccccttacaaacaaccaactactggaccggactggatattatcccccccag

SEQ ID NO: 55082 - DNA, 520 bp, Triticum aestivum
  Clone ID: PAT_TA_55082
caagattgaaatgattgtttttttagacatacccacataaattacagattcattgtaatacttgatagacgaaaccggcgggaactacaaactaccacgcttacatacagaaaagcatcggatagataagaatgcttctaaagaccactgggtaaactaattagactggtaagcaatagcggccactttgttattaggggactcagaggcgtttaaagttcattgggatacttggcctaccactggcatttgcccaaggatttcctaaagagcctcccccaaatggtgttcaggaatcacgccccaaaaattcgatggacaagccggatatcacacacacgaactccagctgaatgtacacggataacaccaggcggggatacacaatgctgatttaaaaagaatccttgagcacgatgtttttgaactaaatcatctcgcaataaatgaacataaacctaaagtgattaggtagacggcgttctaactaacctactacctggccggagcggacattatt

SEQ ID NO: 55083 - DNA, 505 bp, Triticum aestivum
  Clone ID: PAT_TA_55083
ggggcgggcggttttttaaaggggaacagggccaaaacattaaaattaccccgaaaaaaaaccccaatttttttggccgaagttaaacggggccaagctggaaaaaaaaaaaaaaacttttcccctggaaaaaatcccccaaaaggcaaacttaaaatttggcccccggaaaaaagggaaacccggagtctttttttttttcccccaaaaaaaaaaagggggggcaaaaaaaaattccatcccccgggcactggaacagggatgggcttctacttttaaaaaaaaggggcggggcaattccagttcccacaggaattatgggagggaacccaaaaatcccttaggggcccttggggggaaaaaaaaaaaacaagggctctttggggggaggttttaaaaaacgaatcacgggaagggggcccccaattaaggggtaatcaggaatttcccaaaattgccgggggttaaactggggctaaaaccgggggaaaaattcaccccccat

SEQ ID NO: 55084 - DNA, 373 bp, Triticum aestivum
  Clone ID: PAT_TA_55084
aaacgactccaaacattgacgacttttttttagttggggcaacaaacgggggggggggtccaacacaaccctaagaaacaaaggccacagggggggggcgggccaacaccccgggacggaaagaaccgaaccttaaacgggggccaaaacatctgggaacccacccccccgaccaaaaaccaggacccccgggaccgagcgagcggaaacaattaggcggacacgaaaaaacgggtcggggaacaaagacaacgggccccgggggggccccaccattcactccctccaagggcccgaaaacgaccccgggagggggccgccttaagccccgcccaccaaaccggaacacgggagggccttagggaaagggacc

SEQ ID NO: 55085 - DNA, 435 bp, Triticum aestivum
  Clone ID: PAT_TA_55085
gggggggggagggagccctaaaatttttttttggggttttggggtttctacaaaaaaggtacaaaatgttagggtccaacaaaaacaagaaaaaagggaccccggggtgttccggggtcgagtccaagttcaaaaaaacccccgcccggggggggggggcgggaaggaccccccaaaaaaagatctgggaaaagaggacctaaaggagggtccccaccctttctgggggccaaacccggaaaaaaacggggtttctaacccaaaaaaacgggaaaaaggggggaaaaaatttttttttttaaaaaaggcccgaaaccccaaggggggcgaaccaggggagggaggttttttggacttaccaaggggggggggggccccccggacaacccacccggggggaaacccccaacccaaaccgcccggggcgctgggggg

SEQ ID NO: 55086 - DNA, 281 bp, Triticum aestivum
  Clone ID: PAT_TA_55086
acaggctgaaaatgttactttatatgcaccaatgtaaccgctacatctatacatgtctatattggaggccttgcatgccttcagttttgcacccaaaccaaatattggagataacacaacactgtaactgcggttcgtacctctacatgttacagagagataaccaataaagggttagcaggagctgtccatgaactccacaagccactccttgaccggaactctattcggaatctacccagcggcgccatagatgggagccatgcccccactaataggcc

SEQ ID NO: 55087 - DNA, 228 bp, Triticum aestivum
  Clone ID: PAT_TA_55087
attccaatgagtaaagtttattaacagagaataaagcggggccagagatctatcaaggctactgtagttgagtccttattgtgcagatccaaacatcatggtaacatggggaccactcttgagcacatggacaagtaatcaactcacactgggcgcgcacatagcgcttatttcgttcaaatttgaaaaaaaaaaaatcacggaacccccggggtaccaggatacaca

SEQ ID NO: 55088 - DNA, 462 bp, Triticum aestivum
  Clone ID: PAT_TA_55088
ggaacaaaaaaggacccaacaaaaatgggctgttttttggggcacaccccccccccaggggggtctaaaacccaaaaattttgttaaaaaaagggggtaaaaagactccaatccggggccaccatttataaaaagggccccaccaaggttttccataaaggttttgcacaagggtaaaaaaacgtgggggctgtttttcacaaaggagcaaaaaaactcccacaaaaacaacaggggaacacaggaaacataaaatggcatgtttttaacactgggcataataagtaaaaaatcgccccctcaaaacaaatgatgatcatagccccttgaaactaatggccacttgcatttatgccccacccttttgtttttaaaaaaaaaagtaggccgttttggaccccaaaaatggagtccaacttctaaatgacccccctgttaaaaaagatgccccctaacctggtt

SEQ ID NO: 55089 - DNA, 174 bp, Triticum aestivum
  Clone ID: PAT_TA_55089
acatggcagcgtctctccatgcacatgacgggccgcgcggccaggcgcaccacacggcggcctgctgctcgtggccggctagccctgacacgctgtagctcatcacgagacccgccggcccgggcactagtgcccccatgcgagaccgcgctggactgaggaggctcgacggcg

SEQ ID NO: 55090 - DNA, 324 bp, Triticum aestivum
  Clone ID: PAT_TA_55090
atagttaaccagacagtttccatccacagagagctaagacatccattgccgcagtagtaccgcagactaaaaccaattaagcagacaagaatctccgtacctgggagaactaatcacaccaggttgtgcacagcggaccacaagatgcattatattggacgcgggacgctaatgaactaggactagtaatgccggcgaacgtggccacagtggcgacagggggctggacttgactcgatcgcttaggtgagctccaagcggatgccgaggtagagctggaagtccttgggcatcagggtgacgagccttggtctggaaggcgca

SEQ ID NO: 55091 - DNA, 287 bp, Triticum aestivum
  Clone ID: PAT_TA_55091
agcagaaatgacatgaggacggcagctgctatagggcatacataagcaagaactgcctgcgagcacaccagctgcatacccccaggatgatgctgactcaacggaagctacctcagacgcccagctcgcagatccaggggtgccccatgctgaaatccaccgtcccgttaacgggcaaagaggaggtccacccacaattgggcggcaaagaaactcccacaagccggcattcaaggacacaccatgagcccagaccccggtgggaccgacggaaaagataataaggc

SEQ ID NO: 55092 - DNA, 659 bp, Triticum aestivum
  Clone ID: PAT_TA_55092
gataccaatacatggcacaacgaggccaccattttattcgggaatatatatatctgtacatatgctactgtacatctctgcccggccaagatggccaagatggtaaggaacctgtgctcgaggtcgaagcggaggcggcggcggcagttcctgtttacagaagcagttcatgccgagcagcgttgctgctgccgccgcgccggttgcacaagctccagtggggcgagacctgagcccgtaaaccttactgggttcctctatcttcactagacactgtttctatcagctgtaagaatgttccccaactacataccggactcgacaagtggtaagcataactagaggggcatgtacagagtatacacaaggagagactggagggtggtgagcagtctatggagagccgaccgggagtttatgcgacaacttcgtcccgttttttccagtcaaggacaccaaaagaatgtcctcatcggttccaaaggatttgcgggcctcatctaaacttttcatgggcaccatttcacgctttctagaactggctggatcccttatctcaaactcgcaagcatcggcatcatagccacatattacaacataatgccccatgtaatctgaatcctcgtcaaactgttgcatatcatgcacatcattcatcc

SEQ ID NO: 55093 - DNA, 583 bp, Triticum aestivum
  Clone ID: PAT_TA_55093
gagtcataacaaatccgtgtttatataatacacacacttatacacttgacccacacacaaacaacatagcacgtgagtttggcccctcatccaatccgacgtgcgcaggaacagtaaaacacgacacatgaggaacgcatgcccgctccatagcacgtgagctgaacgtgctctacagcagcgccgccgacatggccgggcttgccgcgcccaccgctgtctcctccttcttgtcctgcgaaaggaacggtgcctcggcgttggcgtcggtacagtaaaaacacgggtgctgctcgaacccctgctcttccagcaccgccctggccttttccacgagctcccggttgctcagcggcgccgggtgcgccgccagcacgctctgcaccgggctgctgaacgccccgcatgccttgcctccgctggcctcgtacgccggcacgtccgcggaggtctcgttcgtctggcacccgctcagcaggataccctcgtccgggcgcggcggcgttggcgccggtgcgggcgtggtggacagggtgctgccgttgccgctgccgccgtgaacgtggaacttggcgctggcatc

SEQ ID NO: 55094 - DNA, 497 bp, Triticum aestivum
  Clone ID: PAT_TA_55094
ccttctcttgtttttcttggaagatcggcgtctatggcaatcaagccatgaggtacgggttccaaaaacgaaactctgccgggacaaaacccctcaagaaaatttccttgggctaacaaggtaaatacctggatggggatagtaaccattctcctagcatactgcagaataaatgccactggaaggctgtgcctattgaaaatcgaccaatacctgctcgatgtgaataccctccgaatattcgccgcaatccttaacaacgacacatgaggcggcccaccacctttccttgctttggcctaacacccaaccttgaaaatcccagcccacttccaaagagttccgtcactaaggacaatgaccaagttaacgtggcgcttatagacagagcaattcaccaggtttacgctatcaagttggtctgagatctcacttaccacacctatctgagcagtttgcttcaaaatcattgtcggaggaccacgaaggacctcgac

SEQ ID NO: 55095 - DNA, 666 bp, Triticum aestivum
  Clone ID: PAT_TA_55095
accattaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggccatcgtagtacccaggagatgcgttgtgctcacggaagatgaacccaaccttgctgaactcgaggcaaggcacccacttggagcggatcaggtagtcgacctgcttgaggagggcctccgtgctgagcggtggcaggtaagacagggtctcgaacttcttgatgccctcgatgggccacacctgcatgcacctgatccttccaccgttgctgacgctgccgaggc

SEQ ID NO: 55096 - DNA, 613 bp, Triticum aestivum
  Clone ID: PAT_TA_55096
gacatcacaaagtaccaaaacatatattatagtaccagcaaagtagctcacaaccaaagtcatagcagatcatacaatacaatacacagtcgagcactacggcgttaattacacattgaactgaatcatgtgcacgaagaccgacataaggcatcatcgatcacaacatgtgacaaatacaagcacacagattttttcttattgtggtaacttgaacaacttgatcgatcacttgatatactataagctagtaggagcgatcgagatgatcgattagccgaggcgcaggtcgtgggagccgccgtaggccatgccgtgcaggttgggctggctgggcaccacgcggaaggcgtacatgtcggccgccgagccgccgcccatcgccaccggtgccacgccatcccacccgcccgccgccacgccatcccacccgcccgccgccgggttgtccacgaacccgtacgccgggtcctcgcgcatgcccagctcctgctgcagattcttgtatgcctcctgggagtgcttcaccttcttcttgtaggtttcagtctgcgtggtgatcacatgatacttcctctggcgaacctccttgagagcggcatcgacattttgc

SEQ ID NO: 55097 - DNA, 484 bp, Triticum aestivum
  Clone ID: PAT_TA_55097
aaaagggcccccaaaaaaatgggggggaaattaaacatgcaaaaaattgtcctccaaaaaattgggtttggaaacaaactggtaaaacccaaatgggccttgttgggttggggaaagcttttggatacaaaaaaggggggaaagacttgggaacaacacttgggggaaaaaaaaaaacaaccgggtaaagcatgggccctaggggttgaactattttcgacaacataaaatttgaaacatgctttttaaaaagctttttcgaattttgccgccccaaattagcttttggtaatttttaaggggaaaactaatcctccttttgaactggcttggtgaacttgaggggtaggctaaaaatttcctaaaaagtttgttaattggtttttgaatgggcgaaaaattttttaaaaataaaaccatcaccccatttttttttgggaagggaaaacaaaattttttcctcgagctaatttttgggggaatt

SEQ ID NO: 55098 - DNA, 623 bp, Triticum aestivum
  unsure (1)..(623): unsure at all n locations
  Clone ID: PAT_TA_55098
gccctctnntttttttattatttatttattttatttatttttatttattttttatttttttattttttttttttttttttttttttttttttttaacacccacaaaaggaccatgggaggggacatttattaaattattattatttatggggggggggggtgataagtagtaaagcacaaataaaggacaatttttttgtttttattcaggggggggcagggttttttttttgggctaaaacgggaaattgaagggattcatcccagggtatatgccatcgggaagcttgggaatcctaacctttccggggggaaaaacgtccttttccgggtaggaaaaagggacgtcaaacttggcctgggacgggaagggactaaccgggactttttttttgggggggaccaccacgtaataaacaaactgggggttgggctcgttaacctggggcttaccccaaggggactcggaggggaccttaaaggtgacttccacctccgggtccataaacggcgggatcccgggggggacgggggtcttaaccccggccttgaacgaaaacctggcgtcccaagtgctcgtttgggtttgggggaacaacagggatagcttgaccttttttttt

SEQ ID NO: 55099 - DNA, 467 bp, Triticum aestivum
  Clone ID: PAT_TA_55099
gaacacaaaaattttcaaaaggggccttaaaaaccatatgtgtgagtgctccaccacaaaactcagaagatataaacgcggtgtaaaagcacatggggcgtatcttacataaaagagtatgtgacccacaataaaagtgaaggggctgtgtgtgaaaaaaaaacactcttataccccacttgggtctttaaaataggatgtgtgtggaaaagtggatctgttcacacggatccttgatgtgaaactcaaaccttttttgtgcccgtttgaggacgccagagacagaggcgcaaacaacacatgtgtttgcgagcgctttgggttcaaaaaacccacaccttttaacacaaatatgcagccacacagggcctcttgtgccctttcttgaaaaatttatacccgggcagactctcttcttgtgtgatttcccaatgtgtgcgcatagcacgaaaaatgtgtttacacag

SEQ ID NO: 55100 - DNA, 568 bp, Triticum aestivum
  Clone ID: PAT_TA_55100
atcttcaaaaggacggaaaaacctttattctccgcaagatcatatgtttgtattgaatcagcacaccttcttgcacgaaatgcacaaagattatgaaccttgcgcggcatatctgcataccgacactgacttgttcaagggcatatatggacaacacaagtttcgacatgggtaaaaaatgaaccgctccaatattgcgccggatccatggcccagaattcccatccaaaaaaacacgctacgcagattattattaatccagtgcgctctaattaccctttcagaaatgcactagtcacctgcttttcaccataacaaaaaaaggattcctttattctacagaaaagctcatacaagactccagcctgtcatcaacaacgttaaccctgaaaagttaacaaatttctggtgtataaccatacttgaacgtaaccatactacttcagggccagaaaccttaaatcatttaggataagatatcttttatgaagggttaacaaaggcaacttggacccaatgctgaccccccactttaatgatgcctcccaaaaatcaataaataaagggc

SEQ ID NO: 55101 - DNA, 590 bp, Triticum aestivum
  Clone ID: PAT_TA_55101
accttacacgagcaaaagactgcgggttttgaaacctgttcatcatcttattacagtcactaacccctaaaaggtggcgtgggaaaggcctatctctgaatttaccataaggttggacagacccctacaacacacgggctgaactactgagagggaaataacatgtaacatctaccgaagacataatttggttttttaagaatcccgcatgcacagaactaagctgagtggtggtgactttccccggccacaaaggcgcattactgctaggatcacactgccaaccaattgtttgttgttgtgtgtcatacaccgatcagtatcattctccaccctacatgccgtctaacgatgatccatgctggccattcagtgcacccactttctttgcagcctgctcaaatttcgaaccctttgacgtgtaaccactgcatctaccggtataacttgagatagagctagtggggcttgacctagtcctaaaacccgagcgtgcccatggaccatatcaggtccaacccgctgatggacttgcgcttcttcttcatgcacttggcgctcgcctctctggcgatgaagctgatgaactc

SEQ ID NO: 55102 - DNA, 626 bp, Triticum aestivum
  Clone ID: PAT_TA_55102
atctaaaacaccattcattaatatgaaaaaaaaacatgtttggacagagttgttattcgcaaagcaatgatctaaaattcaacattcacttttcacataatcacttgttgattccttactagtcacaacttaacataaatgcaagttaaggcagatgccactgaaaatctgatcattttatctccgcgactttgagctcttgttgcgcaacatccttcttatcatgttcttcaaccttcccttccagcttttttatcctcccatccctaaatgctagcttggcctccagttgaatcttgttcttccatgactactgggcaatcctctccttttcgtacacttgcacttgcaattcatctatcaaatggtgctgactggctcccctgcaacttttttaacttgagctttgccccctccatgaaaatttatttggagcttgcaggattatccttgagcgcagggaatatgggcggccaaatcatcttaagaggatggatatcacccaaacgcacttcttcttctgccatgacatacactttacgcaactgcatgcacttgacatctaattgaagtgcgcatcgacccatctccaagaacataaactcagcatggtcccccacatgctt

SEQ ID NO: 55103 - DNA, 579 bp, Triticum aestivum
  Clone ID: PAT_TA_55103
catagactgaaaaactaggtgttcgcataaataccacaaggggcggaaccaaaaaaaggacccacacaacattcataggactaacaggaaaagatccccaacagagcaaaaaaaaagcccccaaagacataaaaagaaacagcaggacaacccaaaaaggaacaagaagcgagaaagccaccagaaaaggagaaagaaagccaaaaggcaacaccccctccttccccccttccggcgggcgctgccagggggaaccggagaaacggcctcaacgcccccaattttcatcccagaacgagcaaaagccctgagagcagactgggccccaggcccagggggcgagggattgaggcccccaggggcacggagcttaatgggcaccgcggggagaccaagctccttgcaacggggagcaacctcctgagacgcaggcgtagcagcaaagggggacgaagcatcacgaacagcctgggccttcatgccaccagggatccggaccagggtttccctcccagacaaggcagccacagggatgaagggggcatcgaaggatgcaaagatgggagcaacgccaaaaac

SEQ ID NO: 55104 - DNA, 577 bp, Triticum aestivum
  Clone ID: PAT_TA_55104
aaaattaaagggaagaattgacccgcgggcaacaaatatgcttttttactcttgaaaaaaaaccaagaaaacgggaggccgggggggaagaaaaaggacgaaaccaaaaaaaaccccggcaagcccgaactgggggggaaagggccgggggaaaaacccacaaaagcaagggcaaatccaaaggggggggaaaagagcgaaccctaacataggattatgcaaaagaaaattgggggggaagaaaaaacaacaaaccctatttttgggcatggggcgccgccgtttttggaaaaaaaaacgccaaaaggcaggattttccccccggggcccctgggtgggggaatcccccggggcaaatggggaaaagctaatccccatggccggggggggcaaagaaagggaaagcacaaatgggcccggccagggttccccgccgaaacttgaatgacaaaaaaaagcccttgggcgggaggcaggggccccgctgggagcctcacaaggaagaggtctgaccgcgcccccagggaagatccccgcgggggggggcacactggaaagggaaacaggcccaggcgaa

SEQ ID NO: 55105 - DNA, 489 bp, Triticum aestivum
  Clone ID: PAT_TA_55105
ggattcccttcgacgtttactcaaatcactcaatgggggggcctgcataacatttgaacaaatcagaagagggtgtttcatggaagtttcctgaccacataacattcagagattcccacctactttatttatttacaaacaaaactttccctttccagcagcaccaaaatgggaggggggtttgttggcgatcacacactagttccttctatggatcttccctggtgggggcaacttgagctgctttactggattcttcttgaacccagcacattatgggcgaaaataggcccccgctgatagctttttctttttctgcagcaaaacaacattggcgcagtcaacaggcaccctttttttaccaatcacctccgaagccctaaaaatgttctgagggaaaaaatcctcccccaccggggaaatgccatctagctccaaaatgagaaaccccctggcggggctcggatcaacggcccaaccgaaataaaa

SEQ ID NO: 55106 - DNA, 693 bp, Triticum aestivum
  unsure (1)..(693): unsure at all n locations
  Clone ID: PAT_TA_55106
ggtattgtacaaatttatagactacccgtgtatatagacataatgtcgtaatgaatgatgatacccccatatttacctccacgagcttgcctcgtgtctgttctcatttatcgctcttgtacagtatagttacaattaatgcggtatccataacgctgcaaagcaacttgcagggatcaaccacgcgattaatgcctgcttcaacgcctcttggttgccggaggagtccaagcagaaggctgccatgtctcgcctggcgcactcgccttggcctttgcccaagggtcatccttcttttcgacctcatctttgatatttttcgcgcccgcatcggcctggacagttttgctgtcctgtcccgaggggctagcattggctggttgcagcaaaggtgccggagcagcctgtggtgcttccataacccgcggtttggcctcccatcgagcgtctgcctgagcagcaagtgtcttcattctcgcctggcggacgacgtcgtcctgctgttcttcaattgtcggaggttcctctcgtgtgtgtcgtaaccattgatgccacatcgggctaacctttacagaagaaagatgtgttgatcctggatattgaacaattcgccgncagcgctcacggcttctcggcgccgcgcacaagtcgaaactnccagtatgtgttcccttggagatcaaaacccatgag

SEQ ID NO: 55107 - DNA, 579 bp, Triticum aestivum
  Clone ID: PAT_TA_55107
agcatcggcggcgcactgggcttcctcgccccgcgccgtcgcggcgtgtccttcggcgcggcggtggggcgaaagaggccgtctctggcggtggtgcgggcggcgtactacgaggcggagctgtcggggtgatggcgaccataagtggggatgatgacctacttcgacccggaaaacgggaagccggtgccggcgacggtggtcgggttccgggaggggggcaacgtgctgacgcatgtgaagaccgtcgccaccgaccgctaccacgccgagcaggtcggattccacggcgtgcgcgaggacaagctcacccggccggagctgggccacctcggaaaggccagcacgcctgccattcatcacctgcaggatgttacgggtggtgggcgtcaactccttcgaccccggccaggcgctccagtacaacgagctcttcaaggagggcgacctacactacgtgtccgccaaatccatctgatagggatctcaaggtggaattaaaaggcacaacttcaagcgtggtctgatgacccacgggtactatagccacacagccctacgttatatcggtgcggggac

SEQ ID NO: 55108 - DNA, 513 bp, Triticum aestivum
  Clone ID: PAT_TA_55108
gtgaatcacagcacatacgcatggggggcgtttactacacaaacacgttatttaactcacacagagggagttcattcttactcacagctcacctattaagccactttggcgacaacgcctattagaaagctcacctcgcgacataaaacacctgaaggcatacccctagtactgatcccaaacaaaagggccctcaccctggtggaacgtaaaaccaaattaaccatacgcccttttaaagggaagaacaactctgaggggccttgacttaactctgcctcaagcatgccccacccacgtaccaaatgacgataatactcttggccaaccctaacttcaaccagcggccaatgcggcacatgacccaaacaacgctgggacacccttacaacatacacacagccctttgtaccttattaaggtaaccccctgggacaacacctgaaacttaaaaacttcataccacaccttgaaacctaacaggcaccagtgaacaaactggctagtgcgaaa

SEQ ID NO: 55109 - DNA, 633 bp, Triticum aestivum
  Clone ID: PAT_TA_55109
acaggaaatggccagccaaccaaaccaaccggcggcctactatatgtatgtgtctgtatttctctctctttctcccgtatagtacttactattcagcaaaatttaacttaatgaacaaacggcggctacgatctatctgtatgatggtgtgtacctattatgctacctgaaaagagaaaaaatcacttctggtagcagcagcaacttttggtaccaacccttgtatataaagctaattgatggacagtgctacggatgaaaatataaccatcaggatcatgtggcgtcgttcccgttttctgcaggtggagcatctggggtggcgttgttcccgttttctgcaggtggagcatctggggtggcgccggtcccgttttctgcagctggagcattcgaggtggtgtcgctcccgttttctgcagctggagcatttgaggtggcgtcgtctgtggtcagggtggatagactatcggacagtgagtttgcctcttcgctctcggacggtgctgctgttgaggcaccatcctccgagccaatgtcagaagttgcgtccgaagccatgctagatggctctgatgcttcagatatttcaggctgtggttgtctcagcaggctccaatacatgatgctagc

SEQ ID NO: 55110 - DNA, 710 bp, Triticum aestivum
  Clone ID: PAT_TA_55110
aaaaagatgctacagttttttgctttcaccgttttattattttgtgaaagagcaccacgtacgaacataatatgaccgaatgaaggtgatacgggatctagatccacactgatgtattacaatgaaccaagcgaatggcaatggaaaagctactttttaaataaattcatttcccctaaatttgcttggcttttaggccccttcctgtctggccgatctttgaacaatagcctctcattcctctaactggtttggtgactgaaaactatacttcccctgggaggtctgcttgtaaaactagggaacatatctcgcaaagttgacgatgattttcttgccttcaagggtgatgatgctatctggggggaactgaacaccctgaatatgcgtgtactttttggggcgagcagccatgacaagtacatcttcaatccatgccgggactcccagttcatcgcgcgggaagggaaaatactctatgaccaaactatgatatcttgcggccgtaaaagggataaacaagccctccaatattgactgtcctagaacttggagatagtaaactggagagcttttttcatgcatgacaccagaacgaacgcggataatctttcttgcaaatgcctctccaatgggctgtacacccatgcaaactccgaatattgagatggttggtccaaattacagaacagtctgtaatgatatacctg

SEQ ID NO: 55111 - DNA, 678 bp, Triticum aestivum
  unsure (1)..(678): unsure at all n locations
  Clone ID: PAT_TA_55111
agncnnggccgnnnccttttnnttttttnntttttttattatttttatttatttttatttattttatttttatttttattttttatttttttttttttttttttttttttttttacaagaaaccccgcccttctttttattattccccccccccaggagagggaaataaaaagcaaaggacggatcggcacaaaccaaaacaaaaaataggaccggcccggccggggggggaggccgaattaaatccagactttctgaactcccccccccctcctcgggagggaaacgggactgggttgccggcccaggctgaagagaataccacgggaagaaaatatgaccgggaggggggggtggaatcggattgggctgggggtatgaaactaaaggggcaccgaaagccaagggagtttacccgaccaccgagggctggatcgccacgccgcccgaggaaagaaaagcccccgctttctgggcccccccccacaacacagggagggcctcccggagggggggggggggatccagcgcgggaaccgagcccttcacccgatgggaagggccaaccaaaactggggggggggcgagccgcttgccagcccaaaaggagggcaccccgccctcaaaaaaaaaaaacttgcaaggggaggggtgggggaacctaagggccggccccat

SEQ ID NO: 55112 - DNA, 554 bp, Triticum aestivum
  Clone ID: PAT_TA_55112
cccacgcgtccggtcacttggctcggctccgctctctctccttcatcctcctccggtttctgatcgcgaccatgggaacccgcgggctcgccctgctgctcctcgcggcggtgctgctgcagaccctcctcccggcgtcccacgcggagggcctggtgcggatcgcgctgaagaagcgccccatcgaccggaacagccgcgtcgccacgagcctctccgaccgcgaggacctcctcggcggcggcggcgccaacaccctccgctccgaggaggagggcgacatcgtgtccctcaagaactacatgaacgcgcagtacttcggggagatcggcgtcggcacgccgccccagaagttcaccgtgatcttcgacaccgacagctccaacctgtgggtgccctccatcaagtgctacttctcaattgcgtgctacctgcacgcacgctgcaaggagcgggcgtgcaagacctacaaaaaaaatggaaagcctgctggcattcgaggcgagactggagggatgggtgggtgtggcgagggggatgggggggcagggggg

SEQ ID NO: 55113 - DNA, 483 bp, Triticum aestivum
  Clone ID: PAT_TA_55113
accacgcaccctatgcacgcttgcgacgtgccacgccttatggccttgggcgtctactaatcctgcgaccttgtgggaactctggaaggaataacaggcttgtgaacagagggtgcccatcttcttatgatgccacctcctctgttgagccatacaacagtgtcctgtccacccactctgtcctttatcacactgccaagcttacctcctcttgacattcaagccatttattacattatggcgccacttacttgacattgaccgcccaacatacacacaacctcaacaacgttggaaaactctgtcatctccactacttaactgctttcctgaagattcatgtttctccaaatggtgatgtgaacaaaatgcacaccaacctggtgctctacacaaggatccacattcatgctggcctactacaccccaccttctcagctgataaagctcaccatgatcaggtgtctctcgctaagatcacca

SEQ ID NO: 55114 - DNA, 609 bp, Triticum aestivum
  Clone ID: PAT_TA_55114
gttctaggtagcagctcaccgctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaattaaaaaaaaaaaaaaataaattaaaaaaaaaaaaaataaaaaaaaagggggggggggttttaaagggttcaatttttctaacccgggtttggaaaaatttttttttttttttggggcccccaatttaaattcctgggccctttttttcaaagcgtgtggtgggaaaaacccttggggtccccaattttttttttttggaaaaaattccttttttcggcggggggttttatacaaaaggggcccccccaattccccttcccaaaatttccccttctttatttgtaattgggaccccccttttccccgcctttttatctcgggggggggggttttttcccccggtggatctttttttttttggggcgcctttagggccctttttttgggttttctccctttttttggccacaattcttggggtttttcccacgtaaagtttaaagggggggccccttttggg

SEQ ID NO: 55115 - DNA, 797 bp, Triticum aestivum
  Clone ID: PAT_TA_55115
gcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatatacgttttaatggt

SEQ ID NO: 55116 - DNA, 238 bp, Triticum aestivum
  unsure (1)..(238): unsure at all n locations
  Clone ID: PAT_TA_55116
gcgaccacgcgtgcggacacctgtctctggctgcaacaccatggcccccactgggatgggtgactcggacaactacggcgcacccttacagggactaaagaagaccgtcgaactggccatgagtcgaacggtacaggagtatcgcgactgagtagtgttaggcccggcttggaggatcagngacatgcgtggcgaagtcgattgagggtatagaggagggcgagaccgtgggtaacct

SEQ ID NO: 55117 - DNA, 708 bp, Triticum aestivum
  unsure (1)..(708): unsure at all n locations
  Clone ID: PAT_TA_55117
ggcaagaggatgtcattcctccggcaagagccggcggcgccagcatggttcctctcgttggccttcctcggcaccctttacgcctctgcagtctcgttccggctcctcgcctacctcgcgctctgcttacgccggccgaaggacctccgccgccgctacggcgcctgggccgttgtcaccggcccgacgtccggcatcggccggtccgtcgctctggagcttgccagtcgaggcctcaacctcgtgctcgtcgacctcgacgccgacaatctccgggagatctccaacaccatcagatctcaccacgccgtgcagaccaagaccgtggtgttcgacctctcgctcgtttccaccgcccaaggtgacgaggcgctgcggcggctccgagaggccgtggcggggctggacgtgggagtgctggtgaacaacgccggggtggcgaagccgggcgcggtgtacctgcgcgaggccgacgtggaggcttgtgtgaggttgatgcgggtgaacctgtgggcggtgacggaggtgaccgccgcggtgctgcccgggatggtggagcggggcaggggcgccgtcgtcaacatgggctcagcctcgtcggaggccatcccctccttccccctctacaccatgtacgccgncaccaaacggtatgttgcgcagttctncaggagcctttacgttgagtacagaagcgaaaggatcgat

SEQ ID NO: 55118 - DNA, 376 bp, Triticum aestivum
  Clone ID: PAT_TA_55118
cccacgcgtccgcccacgcgtccgcccacgcgtccggctgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctggtgcacgcgcagagcatcctcgccatctgggcctgccaggtggtgctcatggacgccgaggagggctaccgattctacgtcggcccgctgttcgagatcgaagacccgctctaccccgggggaaggtgggaccccctgggcctgggcaaggacccggaggcctggggggagctgaaggggaaggagatcaagaa

SEQ ID NO: 55119 - DNA, 734 bp, Triticum aestivum
  Clone ID: PAT_TA_55119
aggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgccgtcgtcgtcatcgccccgtgtgtcccgtgtcgtgtcgtcgatctaataagagagtcgtgtgtcgtgtcttcccctggtccgtccgatgagatctccgtggttggtttaagagggttttaggtggac

SEQ ID NO: 55120 - DNA, 472 bp, Triticum aestivum
  Clone ID: PAT_TA_55120
gacgcacccacgccttcggcaggctatatacctacatagcacagccatgggcccccaccgagatggcctcgtcggccacctacgtcgctcctttacaggggctcaggtgcaccgccggcctccccgtcagccggcgctccaacggggctagcctgggcagcctcagcaacgccggaaggatcaggcgcatgcaggtgaggcccattgagggcatcaagaagatcgagactcctgtcctacttgccaccgctcagaactggaggccctcctcaagcaggaccactacctgatccgctacacggggccgccttgcctcgagttcaccagggctgggttcatcttccgcgagcacagcccatcccctgcctactatgatggccggaactgcacaatgcggaagctgcctatgttccgacgcacccaccccacacaagtgatcaacgatgcggatgaggtcatgaaggagcaccct

SEQ ID NO: 55121 - DNA, 637 bp, Triticum aestivum
  Clone ID: PAT_TA_55121
gaaaaccgcagtgaggtcttgattttattatgatttgtattgaatatgtactcttttacctttattttgcttgtttaattgtattaatactcaacctgtggcaccatttctacatttactgttattaacaattaatctgtggcaacttttttcaggaaaatcacaaggcaaagaagcacaaaaaggaaaagacggatgggggcaaaagagaaagaaaagaaaaggatcgtggttataggaaagataagcacaagaagaaacacaaaagagagaagcacaaagataggagagagaagaaagaaagagataaagacaaaagacaaaatttggaactgggaacccagaagaaggatgatcttgacaatagaagacccaaacaaatagtgcataatgaagcagtcaaatatagcaaacataaagaagagttggctacccaaatcacaggccaagaaggtcatgcaaaccgcaccaggagtaatactggcaagttgcttcctcgaagcatcgagtcctttggtgttgtaggttctaaagagaaggaaagaacttctatcagtagagtgaatgggaaatccggtcaaattgctcatcacaatcatgccagtgtaaagggaaagaataaaactagaatcttgag

SEQ ID NO: 55122 - DNA, 192 bp, Triticum aestivum
  Clone ID: PAT_TA_55122
tccgggcgaccccccccccagcacacatgagctcaagccttcaaagtcctaatctccgaggctgcactcaactcaaggatgacttactgtgccgaaccgccgctgaggcaccgcctgcaggcgcggcaacgggtgcgcggggctgcaccatcctaccatcttggattgcagtgccgaccgagacgccactcc

SEQ ID NO: 55123 - DNA, 596 bp, Triticum aestivum
  unsure (1)..(596): unsure at all n locations
  Clone ID: PAT_TA_55123
gcgcaaacctggcgtccatgaccggcctgtcgcagggcgtgcgtctcccaggcccgaccggcaggcgcgcncagcaggttaccgngagggcgnnnnnnnnggaggcgnaggccgncgnccgncgnncgnnncttgnnctnatggncagnnnagnnnnnnnnagngcgntcgttcaggtggtgcacgccgggaccgncgcgngcatttaggttngnccaccgncgncgctctccggnggactttccgncacggacaactnngacgaggcaagggactnngacctnnccctgaagaaccggttctacctgcagccgctggcaccggcggaggcgnnnggtccgggccaaggagttggcccaggacatcctcaacctcaagccgctcatcnacaagaagcaatggcccgtacgncatgaacgacctccggcttcaggccttctacctacgctatgacctcaagaccgtcatctcctncaagaccacccaagaggagaagaaggacctcaaggacctcaccggcaagctctttcgccacccttgacgggcttgacccatgccgccanaatcaagaagcccaccgaggccgaagaagtact

SEQ ID NO: 55124 - DNA, 361 bp, Triticum aestivum
  Clone ID: PAT_TA_55124
cggccccgaattccgggtcgcccccgcgttcgcgcagcgtccgagaattatggccttaatctgcaccgcagatgtatatattatctaacaactcatagcacggccggactccggagtgcccaatagctaacaggagctaggaccggactggagacaatggcgtacgagtcctcctttgcccgaggcgaatccctccccgcgcaccggccgcccctcgccttcacctcctacaggctgtggtacggtgccgtcttttcgagggcaattcggcgggtcgacgcgcgcagagcggcgagggcggcctcacagggcgccgtcaggacgatgccccgcttaagcagatccgaaggagccagagaag

SEQ ID NO: 55125 - DNA, 406 bp, Triticum aestivum
  Clone ID: PAT_TA_55125
ggggttggcttctcctccccactcagtcctcggttcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacgggccgatcccgcgggttcgggttcgtcaccttcgcgtcggacgaggcgatgcgccaggcgatcgaggccatgaacggtcaggacctgtacggtcgcaacatcaccgtcaacgaggcgcaaacccgtcgctccggcggaggaggcgagagcggctacagcggcgtaggtggcggatacagtggcca

SEQ ID NO: 55126 - DNA, 284 bp, Triticum aestivum
  unsure (1)..(284): unsure at all n locations
  Clone ID: PAT_TA_55126
tgtacgcctgcagctaccggctccggtactnccccggggtgcgacccatctgcgctccgctgnnacggatagtctgagtcagctgcaggatcaaactgtagctcttcgcacagattttggaggaacgatgatttgactgcagctcctagtatagcatcgcccctctggactcgttcctttgcgctctgggtggttctccaccttctgccgcgtttgggttccgttcgccctcctagggcagggcagttgggttcctgcatccccggttcctactttctttcctc

SEQ ID NO: 55127 - DNA, 402 bp, Triticum aestivum
  Clone ID: PAT_TA_55127
cccatccattccggttccacctcctcctccgctcgtctcctttcgacagcggccactcccgccatggccaccgcagcgcgcgccgtcgccgccgccgcgcgcccggtgcacccggtgttcctgtcgcggcgcctcccctgcccctccgcgcgccccgcgcggcctcgcgtcggccgcgccgtccgctgcatggcgcggcggcccgacgcctcgtactcgccgctgcggccggggcagggcggggaccgcgcgcccacggagatggcgccgctcttccccggctgcgactacgagcactggctcatggtcatggacaagcccggcggggagggcgccaccaagcagtagatgatcgactgttacatgcagaccctttccaaggtctttggggagcgaggtgga

SEQ ID NO: 55128 - DNA, 616 bp, Triticum aestivum
  Clone ID: PAT_TA_55128
cggacgcgtgggctgcactctcatccttgataattccttctctgaaagaggcttctggtgacaagtatgaaggacctgttgttcatgcagtcctcagttctctgatggatctagagcaagaaatacctggatcctgtgaggtattggttggcagaattctgcatcggctagggagctcgaaggattcatcgttgcaaagtctaaatgagacggcaatatcgatttttacaaagaaacctgagcccccctcggaagctggaagcaacaagaaacaagctagtacgccaccattggctgctcctaccgtaagccctctggcgaggttccttcttaccaggtggcagaaccaagtttcccaagacctgaactccgtttgatcgaagattcttccatgttttgattcggtgtataattaattttgagtgtacataacactttagaagaaaccccattctggtagatgttctcagcggcttgtgctgcccccatctgtttgttctatttgttttgttttactagaacaacatatctgctgcccattttctaatgtaactgctaccgccatacatgcatgacatctgagatgcacaaataacatatccaaattttgctggtt

SEQ ID NO: 55129 - DNA, 787 bp, Triticum aestivum
  Clone ID: PAT_TA_55129
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatatacgtttt

SEQ ID NO: 55130 - DNA, 620 bp, Triticum aestivum
  Clone ID: PAT_TA_55130
gctagccataagcagtgagtcagtgcatcgaccttcgaccagctatatatttgcatcgatctggtcatgccatcagcaatgctcccaaggctcgttgtcgtggcggcactggtcgcgctgatgtgcgccgtcgctgtggcccagaatgtacctgccgtcggcggtgcgccggtctgcgacggtgtcgatcaaaatgtcgtgaatgcgtgcttcgagagctgtggaaaaggtatgaaaattgccactgccgacaggactacttcggcgggtaataccaaggttcaagtggactgctgtgtagcctttggaggccactcgtgcatgtgccagatgaagaaggcgtggaaggctcagggcaaaagtgctcagaataatgtgcaatgcgtcagggaaaaggcatgctagtgagcttgtcgtgcatgcaagacctctagtttcgttggatatttgtgtttcttgcatgttggtttcaagcggttgatgtccacctgctccttgcttgcttttatttgcttgtgtgtgtcatgtgagtgtgttatgtttttctacgtatgagagtgtcagttgagtctttttcgttcgtaccaatcagaaataaatgtgggtggaatttcttgctt

SEQ ID NO: 55131 - DNA, 755 bp, Triticum aestivum
  unsure (1)..(755): unsure at all n locations
  Clone ID: PAT_TA_55131
cccacgcgtccgcacaaccacaagaaacgtcggggactcgccggcgatcgatccccatcactcgccggcgatcggtccagacacgaccaatggcagaaagcgcggcgatagcaccaccaccacaaccaatgacaccaccgcaaccaatggcagaaaacgcaacggaggcaccaccacaaccaatggcaccaccgcaacaaatggcggaaaacgcaacggcggcaccaccaccacaaccaatggcggaaaacgcaacggcggcaccaccaccacaaccaatggtggaaaacgcaacggtggttgtggtggtgccaccaccaccgccagacagcaccacaacattcctctgcctcatcctcgccttcttcctccctcccctcggcgttttcctcaagtacaaatgcgagattgaattctggatctgcctcatcctaacattcttggcctacgcgccgggcatcatctacgccgtctgggtgatcgtaaagtagagattgcgcccatgaacgttaggacaacagggatttgattcttctcttcgaatcccagacatagaagaaaagaaagacttcacagaggcaagaacaatttgggaaatcccagggggaaatgatgccgttggaatgtggcgactaaaggatttgtcgcctcaattntaggctatgtctctttttcaccttccatgttttggtgctgagagttggttattgttatctgggaaataacataacaggttgtgttgtcattgacatatc

SEQ ID NO: 55132 - DNA, 317 bp, Triticum aestivum
  unsure (1)..(317): unsure at all n locations
  Clone ID: PAT_TA_55132
cggacgcgtgggctcgcagaaacatcacaaacccctccctccctccccccctncccccctccctcgatccatcnacttctctccctgnccgcttcaccntgttcaactccggcccctttcccgtctctctcnccaatcccgcccgggagctgccgctgctcgtgttcgctgggccgtcgggggggtgcactctgttcttgatcgatctctattacctcgttctgcaaggccgtcgtggtactatgggctgcctgcgctagcgcgcgctgtaccgtctgctctccacggaccgagccgcccggcgactcatccgcgct

SEQ ID NO: 55133 - DNA, 754 bp, Triticum aestivum
  unsure (1)..(754): unsure at all n locations
  Clone ID: PAT_TA_55133
gaggaagcaggcattggtggcgctctactcgtttacatgcttcacccaagctggaagtagaatcgtgatgacaactcgggccaagatttgttcctcaacgttcaaagcagatgcaagcatcatcctaaatgggatcaaagacagggaggtcacggatctgctcaaccacattgccaatcttactactgatggtactgctgataataacagtgaccaaaggattcaggagctgataaacaagcaagtccccaagctgaagggatccccgttggcagccgtagagatcggtgaggaattgaagaaacaaaccacaagtgatgagattgagaggtgcaacatcttacacaaaattgaagatcatctgggcagtgtattacaggctcatctgttcacatatcgccttctgccaccgcacctgcaacgttgcctccagttctgcagcatattcccatacaactggaggttcgagcctgacaagttgaccaagatgtggatagctcatggtttcgttgaggatgcccggcaggctcaaagtgagagcatggaagatgtcgccagaggctacttcgagagtctggtggatcgctccttgttttccttggtccaagaagaangtgagccangagcaagggggacgacgacttatgtgatccatgagcagatccattggatgctacggctggcctctgacaagaactgcatcaacatctnctgccataacacagctnctagaagcatccctgcaacagttcgc

SEQ ID NO: 55134 - DNA, 723 bp, Triticum aestivum
  unsure (1)..(723): unsure at all n locations
  Clone ID: PAT_TA_55134
cctctcgctcccccactggatcccttccgtgccgccctgaaatctcctctcctctcatatctgctcccgaatcaaatcccccatcacctccgccacccccacctacccccaccgccggcgcgagccgcgagcacgggagcgcgagcggatcgatggccggcgcgggatcctcgtcgggcggcggcggggggagggagggcgactgggactacggcgggtgcggcaaccgcaactatgccttccgctccctgtacaaccgctgcaagcagctgcgcctcctcgtcgaccccaacaccccgcgtgactccaagtggctcccccgcgccggcgactggatctgcaacgatgcagatctcatctcctcttgttctgcgccggccagaccatgaacacttcaagcggaaggatgcatgatgggctggacgacaaggtggagatcctggacacacagaggggctaccaaaccggtgctgcagcaacaacgacttcgcagcccatacaggaggatgatacggtgtactactccattcttcatcgattctctgtccccttttacttgtagtacagcccgcccatctcagaatattctangacatcgaccgaactgtcatttatataccacgcgacgttcctgttcaaaaacagctatggatactatggctacacattgaacttgagctcatgaacacggaacggccaacattggatccaagtacaggaaga

SEQ ID NO: 55135 - DNA, 449 bp, Triticum aestivum
  Clone ID: PAT_TA_55135
attgcccatgatcaggcaaacggtaatgttttttacaacgggacaaacaaaatggagccactaaaaaagccccggggggaggaaaagagggagatgatcttggcgaaacacaagaacatcctcaccctttttcttgcttctctttcactcgctggaattttttcacctacaggctaaaccattatccacaagtcacaggaaagagggagaggagcaggggggggggggtgctccgctctgctcaattcatcccgatgcttctgaagtcgagcattggggtccggagccctatgaaactgctgcacttgcagtccgcgctcctggggagccccatcctgcagctggagcaaaggcccacaacggcctccctctttacccagggtttgggtgccaccatgggctcctccggggacggggggcttatgcaaaggtccaagttcaggtcccgg

SEQ ID NO: 55136 - DNA, 437 bp, Triticum aestivum
  Clone ID: PAT_TA_55136
ccccataatctcagtttatttatgggattcgcttcagtattagtccatacatacatatagccatatcagaaaagtactgccactgccctgcttttcatgtatataccattcctttctggaaaaaaataaatagattaactaccggggttttacatacaggaaaaaggaaaccatctccacaaaattgtttgacaaagggggcatttattgtactaaattcatcgccatcaaaaaattcaatatttttttggcatccaaaaatttggctaccctggtgtgattctgcaaacattttttagaatacaatatttaaaagcttggtttttgagggaggtcgcccaaccattcctttttccggattttaacacatgcaagcctggtggcacttttcattaaggggggggagatccttccaagaatttgttagtatctgggat

SEQ ID NO: 55137 - DNA, 534 bp, Triticum aestivum
  Clone ID: PAT_TA_55137
acccaaaaactcttagcatagcacaaaattaactagttcaccagggcaaatagccattaaaaaacaagcaaactattccaaaaaaagaccaactggttcgacactgaatttcaaggccaaaaaagggtctttggcaccggcacgaacccaagcactggtccgtttacttgaagcacttggcgtccagaaagggctgccccttgaacggggaaaggggctcgatcatgggttccaccccctttttctgggcctcggaagaaaggggaaccttgggccactcgtagaggtccatggaaaaaacccccttcatgacaaactcaggggtgtcctggccacggaagagccacagccccttgacctgggggggggcctcaaaaccaaacacgagccttttgccaaaaggatacttgcggaacaaatccatccggtggaggaaccccccgaccttggggaggggcacctacgacacgggggccccttcctgggacttgggggcacaaaaccacagagagtatccctctggggacccggggg

SEQ ID NO: 55138 - DNA, 503 bp, Triticum aestivum
  Clone ID: PAT_TA_55138
ccttgggcacaccaacaaccaccggttttacattccccaccaatttttccatagtagtttaatagtaataaacaaaaaaaaagaacagcaaacaatttcggggacgggtggctccaaacaaagcaggggccaaagcccccccgtcacctttttccgggccgtgttttggggtcaaccaatcatgaaaacaattttccgaatccttccatccttttccttttactgggagctcgttaatcgcgatcgctgaccgaaaaccccagccattttgcacgttgcctccaacaacttgccttgccggagcttgttttttctggagccggggacggggggcgccttcctgtccggggcggacaccggcgtggccggttttttgtcgtcctccggcaacaacacggggttaatgccctgcaccgaaatcctgccgtcggtgtaaatgtccgggtcaaaaaggtaggcggagccctccccctgcccaaacttgacggagccgtccgccttcc

SEQ ID NO: 55139 - DNA, 297 bp, Triticum aestivum
  Clone ID: PAT_TA_55139
ataagaagaacaaatcaaacttttccttggttcaattggtaaagaataaaatgaacacatgatcccccgcctctccagggcggggaattcaatctcaggggcgggcgcctttgaaaacccaacaccaatgcttttattcaacaccaaccatcaagggggggcatatttgaaatcaccgggtgggcgctagcctcacccctatggataccagaattaggctagaccggtttgggggactcgttggcggaccccctgtcaacgctgagggcttgcgacacggggggagttggccccccc

SEQ ID NO: 55140 - DNA, 318 bp, Triticum aestivum
  unsure (1)..(318): unsure at all n locations
  Clone ID: PAT_TA_55140
aaaaacaaacatatccccttttggtcaagggggataaaaaaaaagaaggccctttaaacgaaaggggccatcaaacaaaaatattcccgcttggggccaggcaaaactggcaaaacatttttggtttctagggaccatacatacccagcaccccggggaacctaaaaaactcaggggctaaaaagagctcccccctttttaccccgcaagggacttggagaggaagacacccctttacttgacccggaaccactttatggggccccttttggagcccctttggggggaaccgccaccncgcctgcacctgcggggggg

SEQ ID NO: 55141 - DNA, 234 bp, Triticum aestivum
  Clone ID: PAT_TA_55141
cggagcccccggaagtttggagcaaatttgcatcatcttacattcgggtgcaaaacatgatgacctagacctgtcctgtactcgtagcaaatttgcttcatcatgcaaaaatgaattggaagtgctcaattgcccttggctgaattttttacacgacgagacggtcaaggggtattacaaattgtagagcaaaaacacgtacaggaaacccaggtacacgagtccgtgctcgtc

SEQ ID NO: 55142 - DNA, 496 bp, Triticum aestivum
  Clone ID: PAT_TA_55142
acatagtactggtatgtaattgatacacaaaagaagatacatttggcatgttcagcaatcaggatcaaccacgtgcgcgagagcaaagcacctgctgtatccaaatacaaatcgaacaagaacaaaaacttaggaatggtgtgaaccatgcttttcaaggggcacaatacaaaaaatcgtgaagaatgagacggggcctatcctgatctttttcctgtacttggatccaaaggtggccgttccgtgttcatgagctcaagttcaatgtgtagccatagtatccatagctgtttttgaacaggaacgtcgcgtggtatataaatgacagttcgggcgatgtcctaaaatattctgagatgggcgggcgtgtctacaagtaaaagggggaggagaatcgatgaaaaaaggagtagtacaccgtattatcctcctgtatgggctgcgaagtcgttgttgctgcaacaccggtttgggagcgcctctgtgtgtccaggat

SEQ ID NO: 55143 - DNA, 300 bp, Triticum aestivum
  Clone ID: PAT_TA_55143
ggggtggggggataaaaaaaataacacaccgggggggttaatggggagccgggcctgcctcacaacctatggtcggccaaaaccagatcatttgggacgagaaatatgctttggggggaaagcaaagtcggggacaaaagggaagtttacaaatgacccctttacatagggccttggttaaacttggagattaaggcttggcgggccccctgaaaactggggggctgaaggggaaaaaaccgaccccctgcgcctgggccaggtggtggaaacccgtgaccccgagatagggcttagggg

SEQ ID NO: 55144 - DNA, 477 bp, Triticum aestivum
  Clone ID: PAT_TA_55144
gtctctaaatcatactgtgtgtgtgtatataatatatatgaaacactatttttggtcatggagtacgttctggcatcaggtgccgtttgatatcattttttacaggccgggttgggcgcgaggctggtgatccatgtctggtcagccaccacgggctcgtcgtcgtcgtttcggtgccacgtccacagggcgtgcgtcacgttcaccacctgcagcctgccatgcccgaagctggcctcccggaacaccgacgtcttgggctgcggctcgatgtacttctccgccagcccttcccgggtgccgccgtctcccatggtcacgtacaccggcccgcactggtccctcttgtcggcggacacgcccgcgaacctttcgtaagcgtgcacgtgccccgcgaacaccgcgtccacgcgggcgccgtaaagcaacgctttcatggcgtcgcgcatgccgtcgcccctcccctggtgccccttg

SEQ ID NO: 55145 - DNA, 231 bp, Triticum aestivum
  Clone ID: PAT_TA_55145
cttgaagattaacttttacttatcgaatcctacattttatttcttacattatagctgtgtggctcagtgtgtcgctaatagattcctaaagattacatctttcataggggaaatatttaaacatttgacatgagttgcttggaagccacaagcagaaaaattgcattattagggaacaagagtaaacttggatatagaataacgaagcgggaaaagtttagaatcagggag

SEQ ID NO: 55146 - DNA, 272 bp, Triticum aestivum
  Clone ID: PAT_TA_55146
ctctacacccccacttacatgtggaggggactaagcaaaaacttcccgagttttaatcctttccaaatgaccacaggggggtgtaaatcctgttaataaaccatgggtcatgggctcattcagagactttccgggagcatgatgcatgattttgtctgaaaaaaaaagcagaaatggttcctttttttacaaattcaagaaacaagctggggcctaaactggggaaaataaacagaaccaaactctgttgggggcttgaaggacccaaggat

SEQ ID NO: 55147 - DNA, 489 bp, Triticum aestivum
  Clone ID: PAT_TA_55147
aaaaaaaaaaaggggggggggggaccacaaaaatgggaccccccactatgggggggggaacaaaaagggggaacaggggggtggtactactttatggaaaaacccaaacccggggggggggggctaaaaacaaattaaagcccgccaggggggggggaaaaaaagaaaaaaaggggggggggataagctaaaattttaaaaaaactgggttccaggagaaaaaaaatttggggggaaggtcatttgggctttttaaaacaaaaaaactggtaaagggcatccaaacggaaaaggggctgaaaaaaggggggggtaatatcaccaaggggaaataacatacccccaccagaaagggaacaccatggggggtttttcccagggaagctactgggaaaatttcctgggggggggcctaaaacaactagggggagaaaaaaggggaaaagggggggtttttatggaaaaacccccttaaggttggccttttgg

SEQ ID NO: 55148 - DNA, 440 bp, Triticum aestivum
  Clone ID: PAT_TA_55148
ggggcaaggaaaaattttttagggcccaaaaccaaaaacggggcaaaaaaaaaaaaaagcttccggggctgcttttttaaaaggaaaaaccttccaaaaaagccccaggcttttttttgggaaaaaggggaaaaaacttttaaaaacaaaaaaaccgcccggtaccaaaaaagacccggggcccccatttttacaaaaaccacaaggcccgggggggggcccccggattttaaaaaattaaagaggggccccaacccccaaaaaaaagaattgggggaaaaaaaacccaatacttgaggggcccgggtaacaaaaggaaaacggggggatttttttttgaacaaaaaaactgggggatcgggcactggtttatccaaaaaaaacgggattgcgggaaaaggaaaaaaattggaaaaaacggttttgacccaagggaaacc

SEQ ID NO: 55149 - DNA, 274 bp, Triticum aestivum
  Clone ID: PAT_TA_55149
agaaacccaaacttttatttccctctccttggtccaaaggggatcatcttccatggggctgccgggaggggaagcaaagcaaaaaccatggcggggcaggggggaagaacaaaaacccctaacccaagaaaacttaagataaaccctgggattaaacacggggctgacaaataaaaaagacaagcccccggccctaagaaacccccgcttacccgaaccatttttttggttgtgggcccccaaaaaacaagggagcgacgccttttgggggccg

SEQ ID NO: 55150 - DNA, 554 bp, Triticum aestivum
  unsure (1)..(554): unsure at all n locations
  Clone ID: PAT_TA_55150
gaagctataaggattcagcgtctctttattcccatttacttagcgaaacagtttagcacccagttatatcatgaccccaacattcagaccaaccccctcccgctgtatatgttaattaatagattaagaattgctaacggtacaaaaataattactaactagtgcaaccgcaaggaaccgagcgcttctgaggatctactatcgttcaaatgtccttccctagctcaaccttcttcaccaaccttagcgtgttgtgcaagatggagtcaagtattccggccaccgtgaaaactccaccaataatagcacagacatttgtgatgaagtgggagaatgatttgggaagttcagtcaccaggaccctgcatgggagaaggctcaaaatggaatttcacaacaggaacatagaagctgtgcaccaagctgctgtgtgctgngtattcatattcttcaagcactttcaactcctttgcgtatctcagcgtaaccggctcagtctttacaatttggtggtaatgcctaatagtaacattttgattgacatcaccatgctt

SEQ ID NO: 55151 - DNA, 507 bp, Triticum aestivum
  Clone ID: PAT_TA_55151
cccacgcgtccgcccacgcgtccgcccacgcgtccgaagggccgtggtggctctactggctacgacaacgccgtggcgctacccgccggaggcagaggagacgaggaggagttggccaaggagaacgtgaagaacgcgtcctcctccacgggcaacatcacgctcagcgtcaccaagagcaagccggagaccggcgaggtgatcggcgtcttcgagagcgtgcagccgtcagacacccgacctcggcgccaaggcgcccaaggatgtcaagatccagggtgtgtggtacgcgcagctcgagtctaactagagcagagcagaagtgaagatactcatcttgtgtgcatgcgtacgtgggttgatcggtggagaggaaacaatcgaggcaacaatgtgtgtttgtgtgtgtatctagtaatctaaacccagggtgtcggtttatattttagcttctgttattgtttcttcctcgcctactcatgatattgatcccccatgaatgttcac

SEQ ID NO: 55152 - DNA, 307 bp, Triticum aestivum
  Clone ID: PAT_TA_55152
ggggagcgacatgttccactaaaaaaaacaacccaggaagcaggcgatcatccgtttgttattcccaactttgaaaaaaataagacaaactaactaatctcgacgagaatgggttcatccctcgcgaaggcttcgggccttaccatgacaagggcccccctttttcagtcacacaaactaagagccagcggcacttgggaatgcaaaacgagctaaggcggggaccctagaacccatcaatcaagcccgggctgggactgatgatccccaccacaccacaccatcccattgggcttttcgccctcct

SEQ ID NO: 55153 - DNA, 319 bp, Triticum aestivum
  unsure (1)..(319): unsure at all n locations
  Clone ID: PAT_TA_55153
gatnttcacccgttgcaatgtatgggcccttttgctagtccgtattgaaaaatttaaaaagacttttacgtactatttaggaactggggcgagcagttttgatttcaaaaggatgatggagttcgaagtcgggtgaaacaatgcggccaacggtttcttcatcgtctttaaaaagccatccaactctgtgaggtccacgggggggttcgtgggcgggccccactcgaacttaagcacgggtgcagccaagaaacactttttgggggccattggagaacccccggccggggaaaatttatcccccgcgccggaacgggat

SEQ ID NO: 55154 - DNA, 548 bp, Triticum aestivum
  Clone ID: PAT_TA_55154
aactcacaacaaacaatatattggccttttttacaaaatcctaaaacaaactaatgcaactggaatctctccatagtccatatataatcaacatcgatctaatcaatgaagcaaccaacaaaattactacaatcaatgaacattcgatcagtaaaacctaggaccaagattattagcagcagctgggcgtccactcatagcgggagaagcaagatcataattcccatagggaaattcaccggcgtcgtagctcccgagcttgccctgctgaggcggaacactgccggcgggcaccgcggagctcggcaactgcaaaccctttgccggctcaccgaagttttgggcgccaacgacaccacctagggctctcatcatgatcgcctgctgctcatggagggtgacgtcgtaactttttcttcccatcatcccgccatgcggcgccgtattcataagcatgtgctgccaggaggagccccttgttgccgggactgagctggccatggcgggggacgtttgcgcgttgcttgtggcgttggtcaaactgtagt

SEQ ID NO: 55155 - DNA, 643 bp, Triticum aestivum
  unsure (1)..(643): unsure at all n locations
  Clone ID: PAT_TA_55155
acatcaataataacaatcagaaacttgatatcattataatgtacaacacgagttttctagatgtgtggtacatgagtcaaaagtttgggtatagatgtatgtataatgtgtagtttgctatgagaaaacccatccaaacccttcttctccattggggctatcgacttcaccctgtcttcaatgcctttatcgccttttgtatctccaaggtgattggtgagtctacgcttcccgacgatatctttcggtgcaccttctgtaggtgtagcttgagtgagctactgctgaggccagcattcttaccacaaatggggcacactttcattgaggcctcttgtgctgcgactccatgggaggtctaccgtgcaacgtttttttcaagaaccagcaagactttagcaaatccgtcattggggtgcgcacgtcggtgcaccttctttagcattgtccatgcttctagaagagtacaattttttttaagaatcaggtaagcaagaacaacagttggatttcgacttttttccttcaaaaaattgcactagaactttgcccgggagngtgctcaacaaaatcaatgaaatcacatgcatcttgggaggaaatcgggggatttcccgattttcatcattatttattgagaagt

SEQ ID NO: 55156 - DNA, 415 bp, Triticum aestivum
  unsure (1)..(415): unsure at all n locations
  Clone ID: PAT_TA_55156
aagggaacaaaaggccatagttaaaagggaataattttggtccccaaaaccaggggataatggggcctctaactgggggggccagggggtgaatagtaaggacagcaatggtactcaaactcaaggaaaaggcaaaaacaataaaggcagaatatgttttttttgggaatttttgccttaatcttacttttatggacaacttattgggccctaaaaaatgcccaaataaactagggaaaatgggccacttttcttggtgacattttaacaaacaggcacgattgagtcaataagaacaataaggggggcaaggttaaccttggggatcaaattgaactcgcaggggaacaatggtaaatgcttgagacatgggataagaggggcttttttctttaggctcanaattttaaaagtt

SEQ ID NO: 55157 - DNA, 484 bp, Triticum aestivum
  Clone ID: PAT_TA_55157
ggggggcctgatacttgtttataatcgtttttggaaacaggggggggcatacaaaattaagctcaacacattattttattggttttcgatctggaacagggggcaacaaaaggggggcgaacacatggggaaaggagcaacgaacacatgcggaagcagcaacagtagacaccccggggcgggtagctattcataaaaagcctggggggatgatgctgacaaaaaacttaatgaatgttgttgcagttgaccttggggttgattgggaaaaaaacggaaaccccccccttgccggggatggggggggggtttcccatgctgatgcccttgaacaaacccgccaggtttttgagggagaggcaccccccctggcggtggggcgagggggaccccttgccgttcaagggccccaaccccggtgagaaccccgggaacggggccgagggcctccccgtcccgattaaaatgcacggcgcgatggggg

SEQ ID NO: 55158 - DNA, 355 bp, Triticum aestivum
  Clone ID: PAT_TA_55158
aaaaccatctgttcggatcaatactttgcatcgttgattgctaacattcacaggaggtagcctcgcaaattacaaagacgtgcatgcaaacaaagacccggccctgtgttacacgtagatgctctcttagccggggaaagccctggtgtttgaaacgagaaggaccccgcccccgaggaagccggcgagggtgaccgcccaataaaaaagcccggtcgttccgccggcgtaacggtcaccaaactcaaaccattcctctggcgtgtaaattgggctgaagccgtcgacgttggcaccgtacttagcaacaaactggtacccgcccttcttggcgaccttcctgccgttggcgtcg

SEQ ID NO: 55159 - DNA, 488 bp, Triticum aestivum
  Clone ID: PAT_TA_55159
ggacaagaggacccccgacgaaaaccggccttttttttttccgccatttgaattgggtggtaaacgaatggactggtcacaattttgaaattaaagaatagactatggggcctaaaaaggatacaaaggggtgaaacattgctctctacatgataaaactatagggcgggggagaacttcagcaaccaagtggaggtcaggtcagggcggggatttcccaagttcaacaaatccgatcctggttcggaaacccgcgctccaaacacctggcaggggcttaatggttactggctcacagggtaaccttttttttggggttggcacccaatccggggggttttaacagatccatttaccccaagggctttattcattactccagggcccaactgataaaacttctgattttattttaaaaaacacaacctccgatacagggggggggggactagcattatagattcagggcctcaatttggacaaaatct

SEQ ID NO: 55160 - DNA, 367 bp, Triticum aestivum
  Clone ID: PAT_TA_55160
atgggaaaaataatgctaatttataaggtcgggacagcttttccccagaagtacgcttattgggggagacgcagcaaaccacctagaggtaatagttaattcaggaggcaatagcctggcggggtgcgttacagataccaaacgacaaactgacagtcagaacaaattccacagatgggatagcgacaggaaatcatgttttcactcggacagcagcgcgcccttttccagagaattctcctcccgccgccatgcgaggagggtggggagcttgccttcctttgccaagaggggggctgtgcacactcctcggcctcgaagcaggggaagaccggcctggagaaacccggcagagacaggaaccttt

SEQ ID NO: 55161 - DNA, 328 bp, Triticum aestivum
  Clone ID: PAT_TA_55161
ctcctaaagggaaaaatgtttcaagatggcttgcccttttagtcatgggacccaacgataactcattaccccgaaacattgtgccggatatacaagggcaagactttttcttattatggaatccccctcactattttttcagacctaaacaagactggtatcatgggcaaaaattttttcaaaaaaacttctttgctcctcttaagattactgccggttattttttttgccatccgaactgggaccctggagtttcttatgaacagacctttttttttatacaacaacttttctctaacctgggctacttgacctttcactcacctgg

SEQ ID NO: 55162 - DNA, 99 bp, Triticum aestivum
  Clone ID: PAT_TA_55162
agataccagaccatcttaacttcagtgattatctacacgtacatgacagtagttcgggtggcatatgtttgcaagacataagcttatccaatatccagt

SEQ ID NO: 55163 - DNA, 447 bp, Triticum aestivum
  Clone ID: PAT_TA_55163
ggggggctaataacacaggggtcccccccccaaaaaaaaacattggcttcattactaatttcggacgggcccgaaaaactggaacaacccactggggccgatgtttacatttgggtagacccatttaaactaggtttattggacggggaacaccctaaacaatatacaagaggcaataaaaataggtggggcgtcctccaattcaagaaaataaagaaaatatttgggccaggggcttgttttttttggcaaaaactaataaaccgattctttttggagggcgactctgaccaaggaaaatctcctaaagaattttctttgggacagttatgcccaaatatgataaaacaaattgggggggttagggcctaaacacttgcggtcgtttgtcttgccccaagtaaatttcctaggcgaacccttttaaaaaatctcgcggacccgggg

SEQ ID NO: 55164 - DNA, 378 bp, Triticum aestivum
  Clone ID: PAT_TA_55164
ggggggggccccctaggggtataaaaactttttaggggggaaattaaaagaacaaaaagactataactcgcgggaaaaaacgaggggagaaaaaccaccaaacccaggccacaaaggacaataaaaaattaaaaagggcaggggcttgccaaaaaaaaaaaaaaaccacgtttgaaccaatggggggacctccaaaaacaaattgctccaaaaaaatttaatttggaaacgcacccatcccccctaaatgttgaaaaaaaaggggaaagaaaaagggggaacttagccccacccgaggaaaaaaccgtttgaaacaaaccgaaaacggtggggcaaagcgcccccaataaaaaaaatggggccacaggaaaaaccgag

SEQ ID NO: 55165 - DNA, 361 bp, Triticum aestivum
  Clone ID: PAT_TA_55165
gggaaccgggggcccaaacccggggccttggccaaacgaaccaattttttttttgggggggacctttttaaacaaacccaccggtttggcgggccccgggccacctaaaaaatagggggaaacccaacttggcttaaaaaaaaacccgggtaaaaagggggggggggaaaaaaagcccctagggctaaaaaaaaaaaaaaaacgggggggggggtcagccttttatggggggcggtaaaggttaaaaacccggggattttggaaggcccttttttcgaaaccccccccggaataagaaaagaaaaaaatttttaccgcggacccccctaaagcgaaagaaccggccctactccgggacccg

SEQ ID NO: 55166 - DNA, 207 bp, Triticum aestivum
  Clone ID: PAT_TA_55166
attcaaatattttcaagcatatagtctacagaaccaagcacaagtttccacgatcccacaagttaaactactatcagattccactaccaccagatgtgacaggttagttatcacgtctcgagcacgtattaaattgtggggggtgaagcttgaagtgtataagtaccctttgaaaaaagtctgcagtacgatcacacacaatgccag

SEQ ID NO: 55167 - DNA, 514 bp, Triticum aestivum
  unsure (1)..(514): unsure at all n locations
  Clone ID: PAT_TA_55167
ccagccaacagcagagaggaagcgtcgtgggtgaaccgtgagtacatgattaagcccgttgggcccccccgggcgggncaaagccccgccgggaaaccccccttgggaaggttttccccccgggaaaagggcccccaaaagtggggcccaaggcgcccaatgcccccaaaaaatattttttttttttttttcaaaaggggcccccaagggggggcccccccccggtgtattttttttttccccgcgggaaaaaaaaaaacccccctttttttttttttaaaaaaaaaagagggcgccccccaaataaattattggtgatggggtgcggctccccccccccaacaaaaaaaaaaaattatttctccccccccccccgttatttttttttttttttttttttttggtttgggggggggcgccccccccccccccaaaaggggaggggggggggggggggggggtgtccctcccctctttttttttttttttttttaattttgatggggtggggggg

SEQ ID NO: 55168 - DNA, 587 bp, Triticum aestivum
  unsure (1)..(587): unsure at all n locations
  Clone ID: PAT_TA_55168
cccacgcgtccggaacttgcaatgcagggtcttgatccgcttaccacagccggcctgttcgcggaggcgcgttgcgtgggcgagaagaaggtgaacggcgaggactgcttcatcctgaagctgtcggcggacccgcagacgctgaagctgcggagcgaggggccggcggagatcatccggcacgtgctgttcggctacttcagccagcgcaccgggctcatcgtgcacatcgaggactcgcacctgacccgcatccagccgcactccggcggcgacgccgtgtactgggagaccaccatcagctcgtgcctggaggactaccgcgccgtggagggcatcatgatcgcgcacgccgggcggtccgccgtgacgctgttccggttcggcgaggcggccatgagccacaccaagacgcggatggaggaggcctggagcatcgaggaggtggccttcaacgtgccggggctgtcggtggactgcttcatcccgccggccgacatcaggtccggctccgtgggcgaggcctgcgagctgccgncgcacggngaccgcgccaagtccaccggcgtgcaccccgcccgcgtcgc

SEQ ID NO: 55169 - DNA, 470 bp, Triticum aestivum
  Clone ID: PAT_TA_55169
agggactagaacagggaatgccataacatttttgggtcccggatagagaaaccatgctgaaagttggaaaattaacaaaaaaatggagatcaacaatttttagccgggaactccacaaaaagatcaggccaccacatttatttgtactatcaaaggagttttaactaaaaacagacgcattgacccagaaccattctttaaaaagagggaacaagttgagggtaacacaaaagggaatacgccggagggtaacttttgggaactaaaggtttttggtctttgggatctttaacaggacccttttttaaaagatgggataatacttttttaattcgatcaaggccttcttaccaaaaagcataaccttggcatcgtacttctcatacgaaagctgggacagtgtacagcaccacaaaaactatttttggcaattgtcaaaaagttgcagcagctcccaagaacaaaaagaa

SEQ ID NO: 55170 - DNA, 263 bp, Triticum aestivum
  Clone ID: PAT_TA_55170
agaaaaaccattcgaatacaggagtaaaaccattccaaaagttttttacttagggggggaaaacacagtatatactttccgtccattttttccatcaaagctggtctcgacctgtaacaacaacaacacactggctgggtaaggggccctcaagctggtcaaggggctactagcactctccctccataggtagataattagataaatagctcgccgacggatcaatagcgccttgagcagcttgaccacacactggctggcta

SEQ ID NO: 55171 - DNA, 296 bp, Triticum aestivum
  Clone ID: PAT_TA_55171
ccagatggacaatttttttacggtactctttacatccgccttgtgcacacaggcttgcacagacttgaaagggttacttttaaccacacggcacgtaaaccatgtgcacgcacgcacactggtaactataatcagcggtactaatccacgcgctgctaggcgttggggccccacatggagaggaacatgacggtgcggagcgactcctcctgggccgcccgcctccgccgctccttggccgccttcctggccagcggcgccttcgcccgcgccgactccgccggcgccctgccggc

SEQ ID NO: 55172 - DNA, 488 bp, Triticum aestivum
  unsure (1)..(488): unsure at all n locations
  Clone ID: PAT_TA_55172
aaatgattcacaactttattgcaccaaaaataatactactaattaggccatggatacccaaaaccagttgatgcaagtttcaattccatgtagcggcttatacaacaggcacattacatattatgggtttggaggtgcacaaaacanataaataaatactcgccaattgtctaatttcacaaatcagagtgcgcacaatgagcggttctctagctatggttatgtgattgttattattaatcaagaatcaagatgaacaatgcactccgaccgcttgaatccaatccatanttttgcctccggtaactgctcttgtggaaattgtgagagctgaacccgtttcgaaccgtttgctagccgcttgcatggaaaatgttggttagctgcagcgaactcattcagaaccttggntttttattgcaccaatcaacatatcttggcatccnaatgcatgtacattcttcaaatttgggcactggagtagcagc

SEQ ID NO: 55173 - DNA, 299 bp, Triticum aestivum
  unsure (1)..(299): unsure at all n locations
  Clone ID: PAT_TA_55173
tctgatagcgtaacagctgtacggatgtacacgtcggtgtagcgtcgattctgttcaagctggacgtggctgcacgtaactcccacccttgagcctgaccgtgtgcgtctctatcacacgaacgtatcgcgcttggagtcgcaacctcggatacgacactcacgttactcaccacttggcagtgacacaatgagcaacagggattactganagagagagtatgtacagcgagtgtctacgagaagatcttccaagctggtcgcgctctaatctacgagctatcactagtaatgaacgag

SEQ ID NO: 55174 - DNA, 317 bp, Triticum aestivum
  Clone ID: PAT_TA_55174
gggaaaaaaacaaacagaccaggcgtttcattcattcgcacctaagcaacccaccaaggcgagggagatagaacaacttcaatatataatacaaccaaagaccaatttttccctggggaaaaactggacacaaggccttgaggcacacttcatgcagaccagactcgacaacgccacccaaacaccaaccccttggcatgggtttgcgcccacaatattacagaccagatccaagtagtcaggttagccattacaaccgaaacacgtttgaaacaaaacggagggggctccaaacggatgaggcactagcagggaac

SEQ ID NO: 55175 - DNA, 391 bp, Triticum aestivum
  unsure (1)..(391): unsure at all n locations
  Clone ID: PAT_TA_55175
ttttnttttttttttttttttttttttttttttttttttttttttttttttttttttttttttttttttttttggagacaaacaagggccaggcaataagcttggatttaagagggggcaaataatcggggggcgtccccctttctcataaagcttacacaagggccccaaaacccattgggctattagaacaaaagggggggctaaggagaaataagggcctcacaccacaaaactgggttcggaacaaaaagagaggataattgggggggcatttaatgcgcatgacccggggaacagaacatcaaatgacaaggaaaaagagggaaagaaaaactctgaactttttagcacttgaggcccctgcaaaccatttcccagaggaggaggg

SEQ ID NO: 55176 - DNA, 538 bp, Triticum aestivum
  unsure (1)..(538): unsure at all n locations
  Clone ID: PAT_TA_55176
gattgaaattcagtattaaatttcaaacttagctatacaaaaaaaactgtatgcaaacagcagtcatatagcaccaaaaaacagcagtaatttaacaatacaaattcagtaccacttgattgaaattcagtattaaatactatctcacgagttccatgctagaacagataatcatcatgatcaccaccatgtacaaaatattttctaaggagcttccatgctagaacagattatcatggtcagccgtcaagagctgggtgaaactcataatattattgcactcttgaagcaccaaatttacttctttgttgtgggcatacttctcgacttctacttgaggcggcacaccatcttttttcttttgttgcacaccatccttcttcctttggggcttttctccctgntttgttggtcctttagttactctgtgcttccccttggagtacttatcaagcgcaattgtctatctcctaaagttctttgactgaacctcttttttcttcagccgtgcagattctaagcaactcatttacttgct

SEQ ID NO: 55177 - DNA, 481 bp, Triticum aestivum
  unsure (1)..(481): unsure at all n locations
  Clone ID: PAT_TA_55177
tggccctaaatttaacatactggttgatttcatcataataatgggcttttttgcgagtaaaacagtctaaatcaatggttccaaaatgttacggacagacagctttgattccttgtcaggcggcaacttttccagctccaaatttttaaacggcaagacacatgacgactaagaggcgatttgctccttatcctcatgacccaacgcaggccctcccccttgagcatgaggtcgaacgccatgttgatctggaagaagggcaccctgtgcctgataaacttttccagcttccgctccttcctcatgtacatttcgaccactttccggtggtcggtgtgtggtttgtaattccccgnagtgccctttcaggccctcttcttgacgaagttcattgggtggaacaccccctccttttgcgggacacccaccaagacccgcaccgcccacccttattggacacattctaaggcggcgatcatgg

SEQ ID NO: 55178 - DNA, 413 bp, Triticum aestivum
  unsure (1)..(413): unsure at all n locations
  Clone ID: PAT_TA_55178
aacaggggagaatcttttgattcaaccaaaacacaacccccccaattttacgattaccattacaaagcaaatcctacaattatcagaaagttttcaagacactcaacatttgacagttactggcaccaacattggagagtcgactgacaaccataggtaagagcaaaaatactggaaacagcatagattttagcatacagtgcgattagcacttgacctttttcagcccttgtgcaaagtacaagaaagttggatcagcagctccctccttgtagtaagcgaacaccacgccgccattaatatgcatgctcttgccaacaaaaaactgaagggtccttggaccttggtaaaaagaatctttgngggcggactcaacatttctttttgaaagcgatttaggtcattccccttta

SEQ ID NO: 55179 - DNA, 476 bp, Triticum aestivum
  unsure (1)..(476): unsure at all n locations
  Clone ID: PAT_TA_55179
gcgagaaactacactaaatccttgacaccaccagattgggtgttcttctctcggaggctttgcagagtgcattttacaaaacactaagtcaagatcgtgcacgtcactgcacctgtctatggcgagtgatatgcgcaagtgcgccggcggaaactttcagccggtccccacacaaccgtacgatgcaaccgctggaagccgtcagatctgtccctgcttngtcctcctcctgactcgtttctttccaaaacaattggagcgcccgagtgccaccacacctcgccatagccatgaaggtaaactgaccgagctcgaaacacaaccacttcgccgggactcgccggcgctcgccgcactcgcagaatctnctcccccgttgtcgccgtcgaaggaacaacccattcaaacaaattttggatgcattatgggcacctctgggtgcccgtcgaagggagaaaagcccctcccagcaatta

SEQ ID NO: 55180 - DNA, 677 bp, Triticum aestivum
  unsure (1)..(677): unsure at all n locations
  Clone ID: PAT_TA_55180
tgaatttagggtgaccactatagnaagnagcctatgacccgtcgcatgcaccgccgtaccgtaaggccttggnatnccctctagnagccggcgcgcncnccttttttttttatttatttatttattttttttttatttttttttattttttttttttttttattttttttattttttttttttttttttttttttttttttttttttttttttttaaaaaaaggaaaaattccagggaaaacccccccccgggcaaaaaaataaaaaggcgggtagacccccccccttattgggattaccggggggggaccctagtccccgaagcttttttgggtcttataggccccccggcggggccgaaaccatttccggaaacaaaaggggggcccccccccccccggaggggcggggggggcccccccccccctagggggcctcagcgggggcccccctttttatttagcgggaaaccccagccggagatatagggcgaacacatgttcccaccgagcccccccctaccggaggcagccacccccttgcgcggccctggaggggaaagggaccaacccccctatttgggggccccgagggcattgagtttggcgagggagcggccccaaggagggggggaggcccccccctcgagaccaaaatccttaggggagaggggcccc

SEQ ID NO: 55181 - DNA, 420 bp, Triticum aestivum
  Clone ID: PAT_TA_55181
gaaaccaaatggaacatttttgagccagaaatctcatgtgcacatggagttccaccattaaagggggggtttccctaaaaaaaatacaaaaaccggcgtcttagcccgggtcatgggggggcgggcagacctcgagtttccacaaaagctagcacggactaatttctctggtatatatatacatgaaaggagcgcgaacaaaggggggggcaccgatccctggtggcccgcggggacccccgccggtggcccggagtatcaaataactggccagctgaacgaagtgcgggggggatacatcggaaaacccaaaagttataatatcttgtagaccaccaaccgagggactggtgccggaattgggcaaagttgggcgacaaccccttttgggcacgccgggagcttcccctgggggggccc

SEQ ID NO: 55182 - DNA, 380 bp, Triticum aestivum
  Clone ID: PAT_TA_55182
aggaaaaaaattactattcattaattgcccgaacaagggggggaggcccattacacgtacacatcggcgtcactagagtacaagaaaaagttgacaggtcactcacgcatacggacgcatgcatacctgggggaaaaatatatttgcacccacagggggggcgcaagggacagacatgggcaccaacacccagggacccagtactgaaataacacacgcaagcaacttcattttattatttaataacctagtattggatggacactccatcaacggagacattaagctccacccaagcgcgtccttgcatgcccgtgggaaggggtttatattgaactagttgacattgttgcagttgggggagactgctggaggggaag

SEQ ID NO: 55183 - DNA, 219 bp, Triticum aestivum
  Clone ID: PAT_TA_55183
gacaaaggtttctttggtttttcttcatttcttttttttttatgccgggaaggtaacagaggtgcgtcgagttacaacattaaatatttccacggaatgaccaaagaagccatacattcaggggctttcctttttttacctgaggggccacaataccataagtacaggggggttcacagaaaacctggtgggccacaatttgtcaaaaatgctataatt

SEQ ID NO: 55184 - DNA, 389 bp, Triticum aestivum
  Clone ID: PAT_TA_55184
accaaaaggcgtcttgcttgctttcaaaacttctggtacataaatgaaatgggtttgaaaaaacaacttgctgctatttttgctacataaatcagctcggccgaaattcatgattgacaaaagtggcatgtctgttggatgcaggggtttctgattggcatatgcctggccatgtaccccatccactccaaggaccagccattgggcatctgggaccctcgggcaacagttgtttgcattacccggagtcgtaatcgcatactttgctgaccaccaactgccccagttcgtgaccagaaacaaaaagctgaaacaagtgggcgaacccgcagtccccaccctgaaggacggactggggggatacctcgcccacccgaacttcttcgggg

SEQ ID NO: 55185 - DNA, 468 bp, Triticum aestivum
  unsure (1)..(468): unsure at all n locations
  Clone ID: PAT_TA_55185
ttttnttgatcatccggtcaagacggaggttagaaactaaacaccctttagtaggtgttgacagaaaattgatcatccagtacaagtacgatgcctacacggcaatgcaactttatttgtcatgtgaccaaaatcgattcctacaccaatggcacaagcatctggtgccttctctataccacccaaatttaagaagatgctcgccgttattggaagatgctgctcactgagcgcgcacggggaacatgccagatagtttctgctacaaggtttgccatggagagcaccgtgaggctgaaggaagcatttgtcctttggtagcaagatggagttcgtaactatgacttcctcaagaatccccccaagaagcctttcaattgcgggggggttgaggacagcatgtgtgcaacaaggataaacagcctttggtccctccggttttaacaatgcgtggtccggtagtgattg

SEQ ID NO: 55186 - DNA, 383 bp, Triticum aestivum
  unsure (1)..(383): unsure at all n locations
  Clone ID: PAT_TA_55186
aacaggggagaatctcttggttcaaccaaaacacaaccaccccaatttcacgattacctttacaaagcaaattcnacaattatcaaaaagtgtttaagacactcaacatctgacagttactgacaccaacattggagaggcgactgacaaccatagataaaagcaaaaatactgaagacaggatagattttagcatacagggcgattagcacttgaccttttttagcccatgtgcaaaatacaggaaagttggatcaacagctccctccttgaagtaagcgaacaccacgccggcatcatcatggatgctctcgccaacaagagacttgaggggccttggacgttggtaagaagatacttttgtggcggactcaacattcttc

SEQ ID NO: 55187 - DNA, 616 bp, Triticum aestivum
  unsure (1)..(616): unsure at all n locations
  Clone ID: PAT_TA_55187
gtgcattgtggtgttgcagcaatcaatgactttgcttcaagttatatgtgtcagtctttgccctttggtggcgttaaagacagcgggtttggaagattcgctggtgtggaaggcttgcgggcctgctgccttgtaaaggcagtcgtagaagacaggtggtggccatatgtgaaaacaatgatccccaagcctattcagtatcccgtctcggagaatggatttgcattccagcagctgctcgtcgagactctgtacggcatcagcgtgtgggacaggctgcagtcgctcgtgaatctgttaaagatgatctcggagcagaagtctcctataaccaggaggaaaagccggtgagcagggacaaaatgtttggcacaatgttctattgtatcagtttgctctgatgatgttcctgttggtgggctagtcttttggctgtcgtccccaaggcgcaagtttggtggggatcaggttcagagcaaggtagcatgtttctgaatgtaaaacgccctttagaactattgcttatcctagaaagtgaagatggcaatcgacgatgtaagccctggatttgattntcacctgcatgaatgtaaatgtttggtatgtttgctgggaa

SEQ ID NO: 55188 - DNA, 466 bp, Triticum aestivum
  unsure (1)..(466): unsure at all n locations
  Clone ID: PAT_TA_55188
acgtgaccatttctttgttaccaaaacgtgcatacgcaagcacacgacagctggccgtatgctcacaaaattcgatccagggaggtccggggctcgccggaagcaagaaaaaatggtatcaccgtggggattgcactcccagatacgcaaaatcgtccaggctgacatatgcattgctaaactcaatctcggagcaattgcttgctggcggtggcgacccaacagcaagcaaggcttccgtctcctcggaactcttttggccccacggatgctgggcaagcagacgccctccttagcccccccagctcttctgcaacctcgcgcatggagggtctcctctcgcttgccatctccaggcactgctttgctatctctgccacctgctcaaacacctcgatgctctggctcgtccacgatctggggcgtccactattctcgtcncaacttgcttcgccctccgcggcga

SEQ ID NO: 55189 - DNA, 178 bp, Triticum aestivum
  Clone ID: PAT_TA_55189
aaaaaaagggcggcgcgatattggctttgctttaacattcagacagggtagttttccaaacttcacaacgaagcaactggggcaaaactttagggactggaattcaaaacacccggggcaaatgtctgaagttttgaactctaaaccgaatcttcacaaagttcagtccccactaaac

SEQ ID NO: 55190 - DNA, 574 bp, Triticum aestivum
  Clone ID: PAT_TA_55190
aaaaaaaaaaagggggggggtttttttacccaccccccaaaatttttccattaaaagggggaaaaaccataaggtgctcacaaaaactttggcgggggggaaaaaacaacccaccgccgggggaacttgttaaaataaaaaaaaccccccccaactaaaaaaaatttggtttaaccaaacaaaaatcctccctttccggggaaaaaatttccctttttttttaaaaaaggaaaatttttttttcccaacaaagggggttttttttttccaccctaagggggtttttttccccactggaacccaccaaccccccgttggaaaaaaaaaaaactgggggcccggaaaaggttttcccacccccggggccaaaaaaaaaacctttctcccttaaaaggttaagtttggcccgggttttgaaaacaaagtttaaaaaaaacaaggggggggggtcttgggaaactcccccctttctggcccaaattttttgggcccccccaaaaaacctttttgggccatgtgccctttggaggaaaaacctcccaaaaatgtttccttttctaaaaaaaaaaaagaa

SEQ ID NO: 55191 - DNA, 498 bp, Triticum aestivum
  Clone ID: PAT_TA_55191
gataataactataaggaaaatatctaagacaaagacacaagagaaagaatcccactaggtggagggatacacatgtggcaatccaaacagaacaaattcaagcattacccagcagacagtggacacaaactaagaaacaacatgctacatgatacaatgacaaagtagtcattttatttatgtacaggtcacacaagaacaacacacagttggaaactatatcatatattcatatcaggcagttcatgtgagcgctctaagcaggcacgggaaagctcggctcggtccaattggttgggtcgatgacgatgcatggatcattcttcttgaactcagccaccatttttccacaactggggcagtagtgctgtttgtgccagaagcagtccatggaggggcacaagagggacacgcccagaaagaatggcattatgcaagccacaactgatgcgacgctcgctttcgaccggacggaggtgacggcggggtcgccgcagg

SEQ ID NO: 55192 - DNA, 478 bp, Triticum aestivum
  Clone ID: PAT_TA_55192
atctaggaaaaaaaaaggatctaccgggtggaactcgaattgggggggcttccatacttaaaaaggggggggtgggtaaggactccatttggaagggggggggaaaatttaattaccttggggaggaaaaacgggccctttgttaagaggttggacaaagggttttaaagccactcgattaggggggggaccagggggatttccccaaggggggcctaaaggtcctccaccaaattggaaaaaaaaaacgcccccaaagatttggggcagaggggggatatgccaaaaatgaaaaccacctgaaggtaccgggataacaccggggaggggtacccaggcctgggggaaaaaaataccggggggaccatttttttaaaaaaaataatggggcaataaataaacaaaacctaaagggattgtgggggtccccttttaacttacctactacgggaccggggggggtatgaactcccccaaa

SEQ ID NO: 55193 - DNA, 310 bp, Triticum aestivum
  Clone ID: PAT_TA_55193
aataaaaggggccggtcatatacttagccaccgatggcattttcatacaaacatgctttttcgaggcatggggggccatagacatggacatacacattatcttaggaacaaattaaaaagaataatgggaaagggaaacccaaagcattggcggagttgacaaaactggaaggggactttatatatgggctggcggggggggactgtttagggcttgccgagctccccgcagcccggggggttgaagggaataaagctgacccactggacctggggcatgttgtcaaatccgatgatgcggacaatccgc

SEQ ID NO: 55194 - DNA, 469 bp, Triticum aestivum
  Clone ID: PAT_TA_55194
agactgttaaagtcaggcactgagtgcctttcatctaaaaaactagtgttaaactgagtaaatttgctaacaaatcatgtcaagcaatagacaatgaatgcataataccttgctcgaaacaagaaaaaatgcagcagagttgctgcagtataattcacttgtggcgccttacaaaggggtcgccgacatgaaaaatgaaactattcttgaattgtgaactgttgttgactaataaatcagtaaatcgctagagaggcacctcagcgttgggatcagactgagcatcgaggtagtgcacaaggaacagccgtgcacggttaacggctgcaaagtagagacagatgtgctcctcgaggtcggcgagctggcgtaacaagctaggatggttcttcctgagctgccgcaccacctcttcgatggggtggggctgccccctcccgcgctcaagccctagccttaccaagatctt

SEQ ID NO: 55195 - DNA, 206 bp, Triticum aestivum
  Clone ID: PAT_TA_55195
aatctaaaaaaacatacgggaactgctaactggaacggaaaaaaactgggtacattataacggccgtttaaaaaaacaaacagggaaacctaaaggggttaacaggttcctccaagcaaacaataaaaaattgcagcatttgcttggctccaacctcttaaaaagcattacataagaagggtttccaaaacaaacaagcttttatc

SEQ ID NO: 55196 - DNA, 702 bp, Triticum aestivum
  Clone ID: PAT_TA_55196
cagcacgaaaccaacatttattcaggactccacgttggagcggaaaaacccccaaaattcgccttattcgggcgttacatagtttcacagcgcagataacagggtcattcctctatcttcctgatcatctcgtttccctaatgttcaaagtataacggctcactctacacgtgcccataaggaagtacccatgtctataacatattcccagcacatacacacaaaaccatacaagaacaagctgcttatgttgcttggcggatcattcattcttcttctcgaattttgccttgtcagcgccactgtacggagcaacgtgatacgcgtactgctggagaactgagaaaatgaccatttccaggataatcaacacattctggattgcctcctggatgtgctccacgtccagccagaaatggtgagattgaatgacccctacaccagccaaaacatccaacgcacagccctgccagaaagagaaaaagactatccctttgatgcacaagaacttagcaagaggcttgtgaggggccagctccttagcaaacaagtgattgaatatgaccaaggcatataatgccatggagactgaaaagtaagtttaattgggaaggtccagctgacccagctggggtacaaccccaagagcttgaagtgcaataattcagaaggagcatactggcctaccaacacaaatggcca

SEQ ID NO: 55197 - DNA, 292 bp, Triticum aestivum
  Clone ID: PAT_TA_55197
ctcccaaaaatataaaaaaatataaaatttctttaaccaactgatacaaaggggggaaaggtccaccaatatatgggccagaacggataaaaatagcgctctaaaaaatgatttcccagataagaaagcagggccatgtaaaccagccccccagggggttttccctgaggaaaagagggttcggcaaatttctccaaataaatagagctttaagcctttttaaagccccaacaaaaaagaggggcccccccgcgtatagctgagggctcaattggggaaatacaaaaaccca

SEQ ID NO: 55198 - DNA, 301 bp, Triticum aestivum
  Clone ID: PAT_TA_55198
gaatgggcaagatgccacacgggggggggttagttttttccttttattataaaataatttatttgaaaaagaggagcgggtagagatgctcactaaaaaaaaatgtcgcaaacaaacatgccagttttttttatttccgtcaaacataagacgcccgaccagctagctgggcgcggccggtcctataatcaaacgacccgggggcaaaacgtgatgccatcggcaataaggagcctcacggggtcaacccgcgtgtcggcgagaatattggcgttaaaccccctagtggagtcccgttttt

SEQ ID NO: 55199 - DNA, 321 bp, Triticum aestivum
  Clone ID: PAT_TA_55199
cggagaaacctggaatttggaatttgtgactgttacaacttttcggaaccgttgagacttgatgccaggtgttattctgatggcttgtacagttttgtaagtatataggcctcgttagagtctgactggaagtcgtaaagtaaaaggtatgtaggaaaactagttcgcttgtggatctatggaggtgaaacaagagcgcaacttcctgatcgtgcttgtaaatatagtagtgtacttgaattctaagcatttagatatgtaccagtatacattccccatgttccgcttatcttaccaataatgcatttgaattgccgtgcc

SEQ ID NO: 55200 - DNA, 162 bp, Triticum aestivum
  Clone ID: PAT_TA_55200
ggcttctcgccttccccaccaaatttccgccgaagcagaaaagcattcgtctcttcgtcttcgtcgagggaatcaacaaccatgggcggtggcaacgcgcagaagtccaagatggcgagggagaggaacctcgagaagctgaagggcggcaaggggagccag

SEQ ID NO: 55201 - DNA, 621 bp, Triticum aestivum
  Clone ID: PAT_TA_55201
cgtgagcatgccctccttgctttcactcttggagtgaagcagatgatctgctgctgtaacaagatggacgccaccactcccaagtactcaaaggcccgttacgaggaaattgtcaaggaagtctcttcgtacctgaagaaggtcggctacaaccctgacaaggttccctttgttcccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaagcctggtatggttgttacctttggtcccactggtctgacaactgaggtcaagtccgttgagatgcaccacgagtccctcctggaggcgcttcctggtgacaatgttggcttcaacgtgaagaacgttgctgttaaagatctgaagcgtgggtttgttgcatccaacttcaaggatgaccctgccaaagaggcagccaacttcaccttccaagtcattatcatgaaccaccctggtcag

SEQ ID NO: 55202 - DNA, 614 bp, Triticum aestivum
  Clone ID: PAT_TA_55202
ccatggatggacgcatgcaggaaggagtacttcgagatcccgtgggtgaacgtgcgcgccaagctggacccgacggtggtggagcgcaccgtgatcccgcacgcggactacctcaccgacgccaaggtagtgacggccaaggcggtcggcgtcgatgactccgtcgttctcacctccatcggtcgtaccgtcggctacgacttcctggtcatcgccacgggccgcacctgcacccgcccccagagccgccccgagcgactcgagatgttccaccgcgacaaggaccggatcgccgccgcgagctccgtgctcatcatcggcggcgggcccatcggggtcgaactcgcggcggagatcatcatggacagccccgacaagcgcgtcaccctcgtccacggcgggcctcggctgctcatggtgatgagcccccgcgcgtcggccaaggcgctcgagtggctccggtcgaagaacgtcaccgtgctgctggaccagaccatcgacgtagacctcgccggcaccggtgatggtcacgacggacagcgcgacttcacgacgtccgccggggagacggtgtccgccgactgccacttcgtgtgcacgggccggcccgtcgc

SEQ ID NO: 55203 - DNA, 580 bp, Triticum aestivum
  Clone ID: PAT_TA_55203
gcaccacacctctccccgtccaagtagcagcaaccaacggcatccatggcccccaaggcggagaagaagccggtggcggagaaggccgagaagaccacggcggggaagaagaccaaggccgagaagcggccaccagcgtccaaggagggcggcgagaagaaggggaagaagaagaacaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctggcgcgctacaacaagaagcccaccatcacgtccagggagatccagacctccgtccgccttgtcctccccggcgagctcgccaagcacgccgtctctgaggggaccaaggccgtcaccaagttcacctcctcttagatagcctgctcttgtgtcttctctgaatgtgttgacttctcgtggctgtttgatgaatccatttgtactctgtagttagatgttcagaacgcaccattttgtattttgcgaggacaca

SEQ ID NO: 55204 - DNA, 497 bp, Triticum aestivum
  Clone ID: PAT_TA_55204
gaaaaaaaaaatatttttttttttaaagcaggggggcccaaaaaatttatgttactggaaaaacatccctttttggcccccacaaaattacattttttaaaacttttttttggcgggaaaaaatattttttggggggggggttttttttggtggttgggggggagaacaatttggtttggtttcaccccttttttttggaaaatccttggacaggaaatttggccactgggtggggcccccgttggaaagctcttccaccgggttgccccgtttaaacacgggcgccgggcccatgccgggcccgatgcaaatgggcacccccccgaatttggagtccctgccccggggctttttttttttaaaaaggggggaaaagccccgggcccctgttggcccaagagggggccccatagggaggggtcctccgttcacgttcacctttgaccgggggagggccaatttgttgcaacaataaacaaattgggggggaaaggcc

SEQ ID NO: 55205 - DNA, 710 bp, Triticum aestivum
  unsure (1)..(710): unsure at all n locations
  Clone ID: PAT_TA_55205
aatcgccaaattgcaatatttttattcaatttcactttcttcttttgtctccttccaaatccaaggcacaacatgatatgacagaccaatgtactgcgctatcgaacttctatttcttcatggcaacttgtagtccggagtagccaaagcacggcacacaatcatccatgcttcagcaactttctatcctcaagctactaccatctctctcacaaattcatctcaaactacacgaacatcctagttttggagaggaccagtgacagaacactcgaactcactacaccccattcaggagaatgcttatgtagacaaagtaggactgtcaaccgcgagcgccatcgtgttgagtccattgtcgacataaacagttgaaccagtgattgcagatgccaacggagacaccaagaatgctgctgcgttccccacttcctctgccaagagttccttctgcaatggtgcgttaacataagagtactcgatcatcttctcgatgaatccaatagcctttgcagctctgctccccaatggacctgctgatatagtgttcactctgattttgccctttcggcctgcttcaaaagcaagaactcttgtatcactttcaagtgctgcctttgctgaactcatgccaccaccatagnccagngattgtncctttccgaagcaatgtaggtcaaagagatactagcacctnctggattcatgat

SEQ ID NO: 55206 - DNA, 579 bp, Triticum aestivum
  Clone ID: PAT_TA_55206
gacacaaccttagtataatttatactttgataggaagggatagttttttttagtaataatttgcttcaccttttacagtatcaacaacatatgtatcactccacacgagcaagagatcagatcgatctgacgagagcctgatgaatcgatgtcgttggaccgtttccgcaccagcacattaattcgaaccgctcgatcaggattccccgttcctactaccttttatccccatcatccttcgcgtccgcgacacgtagaggtcccgtggcttgacgacgccggggatgtggccgacgagcgacatgaacggcagctccgacaccgcgtcgcggcggccaagcgtgacggtgatggcggccttcgaggccttgtatcggtgcagcttatgctccggcccggcggacctgagcagcagacgcaggttccgggacaccaccatggcgtgccgctgcgccaggtacccctgcttcgcctccggcacgtcagtgatgtcgccgatggcgaacacgttcttgagcctgcccacgcgcaggtgctcgtccaccaccagcctgcccttggcgtcaatgtattctccga

SEQ ID NO: 55207 - DNA, 523 bp, Triticum aestivum
  Clone ID: PAT_TA_55207
gggccccggcatattttccacaaaagggggggggggggggggcccaaaacaaaccccgttccagttaagcccaagacaggggggggttttccttccttaggggaaaacaaaaatttggggggccccccccctttaaaaaaacattcaaaaacaacccttcactgaacagtcattgggagaatttggggggcaaccccaggggcccggggaaaaaactttttaacgggggtccccacttcccccaacgggttctaaaaaaattcctgggaaggctgcatcgacaaaattgcagcccccctaacattaagctttttctctgggccaataaccaaaagggggcccgggtccaaaaaaaaccctttaccaaggggcttggaaggggtcctatcaacagggaatgggaaaagtcccccccggggaagaaaggccccctttttttcactctttttaaaacccatctgagtttggagctgtttgaccttcccggggggctagaacatccgggtttggaactttacaaaag

SEQ ID NO: 55208 - DNA, 554 bp, Triticum aestivum
  Clone ID: PAT_TA_55208
ggaacaaaaggggggcccagagggccccgggggccgctttaccccgggacaggagggccccagctttttccggggggcccccgaactaacgggaaaaaacccccggggcccgggtttttacaaaggggcccccccccccccgataaaaaaagcaatggggcccttgacatttttggccggggcgaaacttccccggcgcgggggacattgcccctggggacaactaagcttcctggggccccccccataaaccccggggaaaaaaggggccgcccccctttaggcattttggccggggggaaaaaaaaaaaaggccccccttcggccacaatgtcccaaaacgggaggggccccgccggcccccaaaccccttaattggggccagggccccccccaaacagcccccggaaaaaagccccgccccgaacggggtccccattttttttacttttgggtttccccccccggggaccccccgggctaaaaaagggggggggggcccccaaaacaggggaccagacgagctttttggggggggagccaaaaaccccccc

SEQ ID NO: 55209 - DNA, 470 bp, Triticum aestivum
  Clone ID: PAT_TA_55209
gggccaggaaaccacctaagaaaaaaaattcaaagggggcccgaaacctttggttccggggggaaaaaaaagggacaaaattattttcggaccgggaaaaaaacccaaatttaagggaggggtttgtttcccagggaaaaaattggacccaccaagggggggggggagaaaggaggaaaaaccattggcggagggcggaaaaaaaaaagggggacgttttttctttttaaaaaaaaaaaggggaaaagtacccaacgaggggagcccgcctaccccccccgggggaaccaccgggtcaaaaaaaagcttttgggcggggtcgaaagcccagccatgctctcgctgaacggcccaaaaaatttcctttggaccccgaaaaataaccccaggacgttccggggggcgcgggcctttttggggtggaacccccggaggcttgggaggtgggcttcccgaaagcctcccccctc

SEQ ID NO: 55210 - DNA, 447 bp, Triticum aestivum
  Clone ID: PAT_TA_55210
gggcccaaaacaaagggtttttgggaggatatggggcctgggggttaggggtctaccccatgattcaaaatgggggaaaagggaaagtccaccccacccacatcccgggtgttttaggggaaaagcccccccacccgctgggaaaaaaaaaccaacgggggatataaaccccccccaggggaaccatcggggccccccctaaacaaaaaaaaaatttccgaaaaaactaccccggggtgccttttgggcccgacattgccccccccaaaaaaaacaacggggccccacaacccttggtggtttgccccccactttttaaggactgctccaaaaaaggggggaaaagtttacttgaaaaaaaccccacccccccaaggggccctttctggaaaaagattttcccattgaaggaaccaccgaacaacccggaaaatgggccccgggatt

SEQ ID NO: 55211 - DNA, 450 bp, Triticum aestivum
  Clone ID: PAT_TA_55211
aaacggggggggggccaaaatttatggggggggacagggaaaattaaatgggggggggggacccctggccccattaaaagggggggaaaattgggggggccaaaacaacaaaacttggtgttagctagggaaaggggacccctcgaaaaacccaagccgggcttttttggtttaaaaattaattcttaaaaggaaaacctgggtttctagttgggctcttcggcccgggggggttaaaaaaaaagaaaagggggggggggtttctgccctaaaaaatggggggggggggggggggtaccctccgtaggggggggggtactggggacccggtttcgggaaaaaaccccggtttgggggggggggggcccccccctaaaaacccaacggcccccggggggacccaaatatacccacctgggggggcaattggaaaaatcttggggcccccaa

SEQ ID NO: 55212 - DNA, 499 bp, Triticum aestivum
  Clone ID: PAT_TA_55212
ccccccaaatcctgaaacatttgggtcctcgcaaattacaaaagggggcgttctgaacatttaactacagagtccaaatggtttcatcaaacagccccgagaagtcaacccattcagagaagacccaagagcgggctttttaagagggggggaacttggggacggccttggtcccctaaaaaacggggtgcttggcgagctcgccggggaggacaaggcggacggaggtctggatctccctggacgtgatggggggctttttgttgaaccgccccagtttggcggactcgccggcgagcttttcaaaaatgtcgttgatgaaggagttcatgatggacatggccttggaggaaatgccaatgtcggggtgcacctgcttcagcaccttgaagatgtagatcttggacgtctccacgctctttttgggcttcttcttccccttcttttcgccgccctccttggacgctgggggccgttttttggccttggtttttttccc

SEQ ID NO: 55213 - DNA, 520 bp, Triticum aestivum
  unsure (1)..(520): unsure at all n locations
  Clone ID: PAT_TA_55213
cgacctcacgcgtccgcggnactcgtggngaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttagaggaccaaagttaacgcccgggggggggggaggtaaaagtttttttttggggcccccaaattcaaattagggggggggggtttaaaaacggggggaggggaaaaccccgggggtccccaaattaaatggcttggaaaaaaacccccttttgcccggggggggtaaaagcaaaaaggcccccccggaccccccttccaaaaagtggcccacccaaaaggggaaagggacccccccttttaggggcctttaaagcggggggggggggggggttccccgcaggggaccccttaccttggcaagcccctaaggccccgttctttgggttttttccc

SEQ ID NO: 55214 - DNA, 610 bp, Triticum aestivum
  Clone ID: PAT_TA_55214
cgcgtgcgggtggcggctgtccggtgttcggctccggggcagcgtccttgcttgcggcggaggcggtcttcggcgtgcgtcgcggcgtctggtcgcggtggtgggtgcaccgtcgcggtgcgcgaggtcgtagtcgtcgggcctgttcggtcccgatccgatctgggatccgcaggcggcggttggcgcgggcggtggaggaaggctcggctcctctggtgcgcgtcctggaggcctcctgcagcgtcttctccggctaggtgccgtggtggtttaggctggagcttcggtcggtcggctgccgatctggtagcttgtccggcgagttggggtggggtggcggccctccctccctgctcggggctcttctgtggcgctgcagcagcagtgggttgctggatctggcctgtttcggccgtgttcggctcgtcggcgtctagccggcggcgaggattgtggtggcttctgcttggtcatggcgcgatggcttcgtgggaggtgtgcgggtcagcggaggtgctatgcgtggaggtgtgggtgttgggtgttgcttccggcgaaagcttgccgcgctcttgccggccgatggcgtccgtgtctgtgggcgtcg

SEQ ID NO: 55215 - DNA, 558 bp, Triticum aestivum
  Clone ID: PAT_TA_55215
tcaggattctacatggcatggaacattggagcgaatgatgtggcaaatgccatggggacgtcggtagggtctggtgctttgactctccggcaggcggtgctgactgcagctgtgctagagttctctggcgcattccttatgggcacccatgtcaccagcaccatgcagaagggcatcctcgtcacatctgtcttccaaggaaatgattctctgctctttgctggattgctgtcctccctcgctgctgctggtacatggttacaggttgcttcctcttatggctggcctgtgtcaactacccattgtattgttggggccatggttggttttgggctggtatatggaggggtcaatgcagttttctggagctccttggctagagtatcttcgtcatggcttatttctccactgatgggtgctgcagtctcatttcttgtttacaagtgcatacgcaggtttgtgtacagcgcaccaaatccaggtcaagctgcagctgcttctgcacctattgcagtttttactggtgtcactgcaatctcgtttgccgctttccctctc

SEQ ID NO: 55216 - DNA, 269 bp, Triticum aestivum
  unsure (1)..(269): unsure at all n locations
  Clone ID: PAT_TA_55216
tcgacccagcgtncgcgagtcttttgaccggacctcttaagaaaagccggcgtgagtagagttagctttacgttaagttggagtcaaggagggaggggttgatcgtctttgaaggttcggtccgagaagcccgttcagagacggatgcttgagtttcagttaggttcagagtcatttcctggatgttgttaagtttgtttgcggattatgggcgctagagtattggttatttgctgggcattatgccgggagattaaagatttccgccc

SEQ ID NO: 55217 - DNA, 668 bp, Triticum aestivum
  Clone ID: PAT_TA_55217
acagcaggctaggaactgcagcacattattattgtcgcggttgagttctcaggtctgtctaaatacaagaacacacttataaattgcaaacactagaacagtgtctcgttcaagaacacacgaataaattgcaaacactagaacagtgtctcgttttggccagaacagcacggctagggattcatgcctcttatggtacgttcatcacctggatggactgcagcatgtcggagagggcgatcaccaggtcaccgggcttgatcatgcctctcgccttgagcagggagaaagtacggttcaggttactctccatgtcgtcggagaaagtgaggcggaaggggatgaggccccattggaggttcagtcgtctcctcatggatgtcgagttcgtgaaggcgaagattgggcagtcagggcggcaccgtgaaagcagggaggccatatggccacccttcgtgtagacgaaaacggcatccacttccaacttgttagccattttagcagcagaaatgcagatctcttctgatattttgtcagcgaaagaagacgaaacgtcctcaagttctagtggctcatggtgcttctcctccctccaccatctttcaatccttaagctaacactactgaggacactgagtgccttgtccggatatctacccattgctgac

SEQ ID NO: 55218 - DNA, 587 bp, Triticum aestivum
  unsure (1)..(587): unsure at all n locations
  Clone ID: PAT_TA_55218
actgttcatgatctgcacctgggcaccgaataacggacaactgacaacatctttttttgtttctaaatgaacaacattcacacatagcccatccaatattcaacaacacttttggcagcagagacaaatgtacgtttgccaatttctattttctcctccttcactcgtcttcgtcatcgctttcaaaaacaacgcccttccggcgatgaacagtcgcaggctgtttcctcggcggggaatcctcgtccgagtccacctccctgcgcctttggctcccgcccactgctgactctctcttccgctttggttcctggattccttcatctgacataggctccgggtcttcctcatattcatcctcctcatccagctcttcccttccaccggtgggcgagtgctcaatgtcctcgccttcagtttcatactctgactcctccctttcactctcagagtactcctggcgtctcgccaggcgagaaggagggacggatggtttgcgaggaacacctctgctcatattcgacttctttgcgttaattatacgccttttacctagtgcttcagcctncaagtcatcctcaaaacga

SEQ ID NO: 55219 - DNA, 558 bp, Triticum aestivum
  Clone ID: PAT_TA_55219
ggggggaacccggggggttcaatccgggcttttttataaaaaaaaatgggggtttttttggggcacacaaccggggggggcgccacaactaaaagggaaaagggcccccccttgaaaaaaagccttactggggtggattttcagggaaaaaaggaaagcaaaagggcaaaggggataaaaaacggaaaaggaacaaaatcccccgggtgaaaaaatcagccccctcctcggcccatttaaaaagacgcacgatcctttgtaatccttgaaaaaccagaatccgccatgaccacccccgccgggggccgtaataaaataaaacccttccggggaggggccctgaaaaaccggggctcccgccggggaggggccttgcattggatgcttccggggaacaacctggggggggtggggctcccggggggaaccaaccttgtttggagcccccccattggtgctatacccctcaaacaaaagaaatcgggcaaaaaccctcgccgttggtgaaacttttcgccgccgttagttaattgccggcaaaacaccatgtttggattt

SEQ ID NO: 55220 - DNA, 589 bp, Triticum aestivum
  Clone ID: PAT_TA_55220
ggcgcgtcgcagcacccatgatcaaatgtatagccttaggagaatttaggcctcacggcaaatattgcagcgcgcatgatcaagctagtcttggcagaattttagccctcacaacaataagctcacacatatacactatattcttcactgcattgatttcgtaggctacagccttgatgttaaatcaccacccggaaacatcggctgaagaacctcttgaggcgacaagatccaaatggacttgacgatgatcacaaactcctcccatgggtcatcaccgacaaataggaagtcgccctcataatcctgctagatacatttccaacccatactctgtcgatcttcgagtcgcccttccatgccaaacatgtgggccaaagcttgattcagttctccatattcagagaacctaccaatgtcaatggaacggcttatagccccacgtttgtgcacctgagttaatggcatcctctggcaaaggggcaaggcgccgagggtttctgagcacgggcggggcggagggagattcggctgccgagcagaagagagcagagggcggaggagccaaagtgtggtggtacagatcaac

SEQ ID NO: 55221 - DNA, 470 bp, Triticum aestivum
  Clone ID: PAT_TA_55221
cccgcccatttttttttccccggggggggaaccccgggaaacgggaaaaaaccggaagggttcccaatttttttggttcccaaaaaaaggggccaaaacttggggggaaaaatttttgaaaataaaaaaaaccagggggttaaaaaccggttaaaatttttaataaaaaaaactgggggggaaagggggggccccccaaaaaaaaaaaagggggaaaacccggggggttttttttgggggggggggggggaaaaaacccccccggggaaaaaaaaaaaaaacaggggggccccggaaagcccccaactttaatttaaacccttccaaaaaccgggccttaagggggcccggaacccaactttttgggggtaataaaactcccaaacggccttaaaaaagttttgggggagaaagaaacccccctttgttcaaaggggggccctccccccctaagggaaaaatttggaaaa

SEQ ID NO: 55222 - DNA, 551 bp, Triticum aestivum
  Clone ID: PAT_TA_55222
gcatgtaatttatttgttttttttttctattcacagggcaaaactgactggattatattatgcaaagaaacaaatcttttaaggaaaggaaaagaaattctttaaaaaaacaaaccctttatggaagggaaacaaaaacactcggctcagaaacaaacagaatggactacaacaacgcatcattacgggggggagcaaaaaacaactaaaaaagggctgaaggccaaacccaagggtgataggaagggaagccggcttgctgggatgggtgaggtcgcctggtaatccaacaactgaaaggggggggcaatgaagtctgtcctgaacgtcggcatggaattgtttgggcggggggatggccacccccccatcaccataaaaaaaaattgactggccgagtatgaggggagagcaaactgagaataactcctctccctaagccagtgaggggcagccctcaaaacaaagaattacggggcaagccccccaccataaaattgctccgaccgaacaaacaagaactgaacatttaacatgccatacccaggggg

SEQ ID NO: 55223 - DNA, 541 bp, Triticum aestivum
  Clone ID: PAT_TA_55223
gctcttcctctaccacactcagtacctggcgatacgcgggtccagtcctcgctccgcaacggtacggcttgtgtttgctctcctacatgctggagttgtcctcgtctattacctgtgcttcctcaggccactaacgtggaccacaaaccaccagtccatgcctaccgccttctgccaactgctaccatgtaagcggctgcagaagcatcccaggcacacgatacaggacgatgccgcggcttcccattacacagcttaggatgaggcgacggcttcccacgacacgatcgaggacgcaacggccgctacccaggacacgctggacagaagcggcagcggctacccaggccactgtgtacgcggcaggagctacccgcgcctccgtggaagaagatgccgcgtctacccacgcggtggcggaggccgcagctatcccggacaccgcggtggcggcggcggtggttaccccggacacggaggaggcggaggcggcactggatgtcaatggagctgctgcggtcacgggtaccatggctgccgc

SEQ ID NO: 55224 - DNA, 519 bp, Triticum aestivum
  Clone ID: PAT_TA_55224
cccaagcgtcaggcccaatcagctgagcgaggagacccttggccagtctcaaggaagtggttcagtctcttgcacaaggacaggcgagtggcatgctcaccaccaaagagtcttggtaccgtgatgcgctcctttggacaagaccctctcgatgcatgagctgcatgacatgatcaaagaggtgaatgcggacggtcaagaccaactcggatttgccataggtactgaacctgatggctcgtaagaagaatgtcaccggttcacaagaggagctcacagaggagttacgagtgctccacaaagaccagagccgtgtcatctatgcacgggaactacgtcaggtgatgaccaaccttggagagaagtcttgcgaggaggagctggtggagatggtaccagaggatgacggggatggtgacggacagatcaactacgacaagttaatcaaggctatcatggcccagtgaggaacaaccaccctggggaataactctttctattgtcagagaataatgaacc

SEQ ID NO: 55225 - DNA, 341 bp, Triticum aestivum
  Clone ID: PAT_TA_55225
gttaaatacccatcctcggattaaagaagttgtgaattttgaacttccccgaaagcataagtaggaggaagatgaaccatcagagttgctgaccatctctagtatcttagatatggtgtaccctgcaaggaccttgatgttgttgctttgtttaggtgaaaagcgtgcaggcacatggtatacagcccatctttcctgatgctcctcaaaacatgggacggagcgagtgatccttcatctatcgagttttggtcccatttcaagcagttttaatgatgcacgtggatttcgtgcaagcctccaatgatgtccaaatagcaataatactatctggttacatt

SEQ ID NO: 55226 - DNA, 475 bp, Triticum aestivum
  Clone ID: PAT_TA_55226
agagcgttgcggattaactcgagttggatcatcaccaaccatgtcgcgctgcggaagcaactgcgggtgcggatccggctgctagtgcggcaacggctgcagagggtgcaagatgtaccctgagatggacgaaggatgtgaacacacgccttccagaccctcatcatgggcagtgagccccctacaaaggcaccccagtcgttagaagccgcctgcgacaacagatggtgcaagtgcggacccaactgcacctgcaacccgtgcacctgcaagagatccatgaggcctcagtcaaatcacatcaaggagatagcatggatagacctgatgaacgagcgagtagtacttatgcatgaatcgaaagcgtgtgtgatcgttttaaattgccacccaaaataagacgagatctatgcaatcgtatatagctagttaatagattatccatgccccttgtggcttgtaccatgagctgcgt

SEQ ID NO: 55227 - DNA, 699 bp, Triticum aestivum
  unsure (1)..(699): unsure at all n locations
  Clone ID: PAT_TA_55227
cacccactccgccgagaaacagcaacagccacagccacacgcccacgcgcacacaccagatcgtcgacagcgatggcaaaggcagcggcagcgggaacgagggaagagatggtctacatggcgaagctggcggagcaggccgagcggtacgaggagatggtcgagttcatggagaaggccgccgccgccatcgacgccaaggtattctacctgaagatgaagggagactaccatcgctacctcgcggagttcaagtcggccgccgagcgcaaggatgccgctgactccaccctcggtgcctaccaggccgctcaggacatagccatgaaggagctgccaccgactcaccccatcaggctgggcctcgcgctcaacttctccgtgttctactatgagatcctcaactcgcctgatcgtgcgtgctcgctcgcgaaacaggccttcgatgaagccatcgctgagctggattccctcggagaagattcctacaaggacagcaccctgatcatgcaacttctccgtgacaatctcaccttgtggacctctgatatgcaggatgacgctggcgatgaaatgagggattcaagcaagcctgnagatgagcagtagtgaagggtcctagctactgccctctttctctcttaccttcgggtagttatgatgcttgtacaaggaccattttcgtgtgtcctttgttgc

SEQ ID NO: 55228 - DNA, 552 bp, Triticum aestivum
  Clone ID: PAT_TA_55228
atctgatccaatccagtccccctccgatctcaccgggaaacctccgatcgaagcaaagccaaggctctctcgtcctcctcctcaagatgcagatctttgtgaagaccctcactggcaaaaccatcacccttgaggtcgagtcttctgacaccatcgacaatgttaaggccaagatccaggataaggagggtatccctccggaccagcagcgactcatcttcgccggcaagcagctcgaggatggccgcaccttggctgactacaacatccagaaggagtccaccctccacctggtgctcaagctccgtggtggcatgcagattttcgtcaagaccctcactggcaagaccattaccctcgaagtcgagtcttctgacacgatcgacatcgtcaaggcgaagatacaggacaaggagggcattcccccggaccagcagcgccctcatcttcgccggcaagcagctagaagatgggcgcacccttgctgactacaacatccagaaagggtgcaccctccacttggtgctcaagcttcgtggtgggatgcagatt

SEQ ID NO: 55229 - DNA, 359 bp, Triticum aestivum
  Clone ID: PAT_TA_55229
cccatgcgtacggcctgaccttgtgttgggggggggtcaccggagcaaggagcaggcaggagcccaggagcaacactggcgaaggcgcggtggagcgggctgacgagcaggagcagcacgggcgcgccaaccctgctacagccgccggcctgtccggacggtacaggctggcgatgtggggggaggggggccctatggaccggagcacgcgcccatgagaccggtgcgagaggcagcctcgacccacccacctggagcgatcctaggcaggacactacgactacgaccacgagtggctgcacaccgcgaaggagaactcctggcggggcaaggagtagacgagatccccccgtagatga

SEQ ID NO: 55230 - DNA, 256 bp, Triticum aestivum
  unsure (1)..(256): unsure at all n locations
  Clone ID: PAT_TA_55230
agaagaggnncngaagaccgagcnnagccgnnnnagcggccagaagaaaaacccagggaagggnancaggnncanncgnncgganncgcagggggggggggggggcaacncaaaaagcaagcgcnacnnccacaaccgccngaagccggcaaagcgnngcnggacagcaanggacaggaagcagcacaagaaggacanacangcngaggcngccaagaagaggcgccggaccaccaagaagccgggccgacgggcg

SEQ ID NO: 55231 - DNA, 591 bp, Triticum aestivum
  Clone ID: PAT_TA_55231
ccagtggagtacaggggaagaccgggaccaacagaacaaagaaccaggttatggggcctactcccgtgagggagtacacctaagccacaggtgaaaagaccagacatacttctacgacctaagaactatggggaaatccgtcctgaaaaaaaggggccagaagggtcgatatttgactaaagtggggggggttgtttcacagggtggacgattttaatttggcccaaatgaccttgacgaactagttgtaccggagctggatttcgaaatgcacgcccgcctctgggaccatatgttataactactactgggaaagacttcttcccgaggtaggaaataacatgacgtgatgtccgctagagagaagaagcagatcaggcccttgtctaacacacagaacgtgctggttgagctgcaggggcgattaccagtccttcttcgcaccaccccttgaggctcaggaactgtgggaaaattaaggcgatggggactgtcccattcacccacaatcaaatgcccaagggcctatggctggtccgtttctgtcctagggagcgcattatggttgcaacttgcaaggtggggatgctg

SEQ ID NO: 55232 - DNA, 504 bp, Triticum aestivum
  Clone ID: PAT_TA_55232
gggggggccaaacccaccacccaggcccaaaaaaaaaaaaacggggttgggttaacaaacaaacaaaagggggggcccggcccccccaaacccggggggggcaaaaattattttttttggaaaaagaaaaaagtttaaaaccgaaaattaatggttggttgcccaaatttatgcaaaaaccattcctgcctgggtgcatgccgccccaaaaaaatttaaaccaccttaacaaaacggggaaaatccatccccggggccccccccccctaaaaaaagaattttctggaaaactcaacgggccccgccattttggggaccgggccccccccggggcacaaacttttgtaaaccttgcccaccttaaaaacaaaaacgggggcccttgggggcaccctccaagcctttttcccccccttaaccccccttgccccccggggtttgtttatttaaaaaaccttaaggaccatttggataacccccaaggggaaaccaaagacctttggg

SEQ ID NO: 55233 - DNA, 669 bp, Triticum aestivum
  unsure (1)..(669): unsure at all n locations
  Clone ID: PAT_TA_55233
tcgcgatctagaaaacctcctccgtccgtccattgcctcccccagccgcgcatcatccatccatccgtcccagtgcgccatggcgctcatgctcagcccggccgcgaccttcctccccgtcgccaccggcaagcccaccgccaccgccggcgccatgcgaagcctcctcttcaccaccaccagcggcaccgccagcggccaccggagcagcaggaaggtggtggcgatggcggacatcctgggggacttcggcgcgcgggacccgttcccggaggagatcgcgagcaacttcggggagaagacgctgggcaacgtggacacgctgcaccgcatcctcatccccacgctctccgtgctctccctctcccgcgtcccgctcgaagcccacccggcgccgctctccgaggaggacgcccgcaggctgctcttcaaggtcgtcggatggcgcctcctcttccccggcaagggcgactccgacgtgctcaagctcgagtgcgtctggaaggtccgcgaccaggcctgcggcgacgagctcatcgccaggatcggcaaggcgctcgacggcgccggccatgcccncgncgcgctccttttngagccgccaaccaagtcagggcacagctctgcacgccctccgtaggtgggctgagcgccaacgacttcatcatc

SEQ ID NO: 55234 - DNA, 673 bp, Triticum aestivum
  Clone ID: PAT_TA_55234
atcaccagaagtcgctgtatttacatattgccacctctgttcctaaatatgaacgttttggcagtttaaattaactgccaaaacatcttatattttggaaccgatgtactagtactttgtaattcatccaccatacattctgcattcagaaacagaactgcgccaactctgaatgctaagtgcttacccactgaccccctttctgaagcaagctacatacagttaactattccggtcagctatgtactggtaagacagtaggaggtttacaccaggctaaacttgcatgacactacccaattcgacatctgcagcgttcatgtaatagagaaaggtgcttttgcatgccgagggtcattcattctcctggaagcatggagcaagccactcttaaccagggtgttgtgtgtgtcatgcttgctcatgctgcacaaggctcactttctcgctaactccacatctcgccgcgcgcatcctaatgctgatgaccaaaggcagtgagcgtgcaaaaaccagcaaccataatgctgaagcctttgaagttgaaccggcgttgtttctgaaaggaaccatgctgtcaagggagtgaagatgagtggagctaatatgctggcaaaagaactaattcccgatatacacccttgagcaattccctgctcatttgatccaacac

SEQ ID NO: 55235 - DNA, 108 bp, Triticum aestivum
  Clone ID: PAT_TA_55235
ctaacacaatgcccacttttttttggtcatcacaggtctgaagagagggccgaaatccttattcacagcaggtttactgaactggcaacaccaacccggacccgtggg

SEQ ID NO: 55236 - DNA, 138 bp, Triticum aestivum
  Clone ID: PAT_TA_55236
agataggtgagcccattgattagataaagaaaaatagagaatgcatagtcacagtagtagctacagtgtcagagcgcccagaatcgaaggaaaaacacatgacgaggttacacttcaaagtctcaggactatgaggaa

SEQ ID NO: 55237 - DNA, 350 bp, Triticum aestivum
  Clone ID: PAT_TA_55237
ccccccaaccatgaaagattttattcctattaaattaagccgggtttgggccggttatccattcggaattattacaaaaaaacttcccgcccaaaaatcaagttcaatggtagcaaaaaaactgggggaaaaaattctttggtttcaagaactttttgaggaggcccatcatttcacttccagggaaccgcccaagggaaccccttggcaaaaaaatttcgggggattcacacactttaaccccggtaaaaactttacactttttatggttgggtgcccctgggtttgaaacaatggggaaaatttgtgcgggcctaaccgaaggcggtgggaaatcagaatgggggggg

SEQ ID NO: 55238 - DNA, 314 bp, Triticum aestivum
  Clone ID: PAT_TA_55238
aagccgacaccggtgaggtttttttcttggatttagttacaaaattactaaggggccaatgttggtaccatccaagactttgctaacactggcggaaaatggtagcattaacatggccggcatggagcgagattcataagtcggtcttgataacagggagtgctataccaaattaagcgcagcacattcttatataggtcttggaagctgaacacctggcaccagataggaggggaaacaacatgtgagaaagcaggagcgctcacatgcccaagcctcaccagtagagagaccgctgaggcggaggatccata

SEQ ID NO: 55239 - DNA, 338 bp, Triticum aestivum
  Clone ID: PAT_TA_55239
ggatggcctcacccccaatagatccatgaaatggtacatatatataattattattataactagtgaggaggagtcataagtgaatagatcactaaataaaggacagtatgtatctccttattcagatggagaacaggtcttctactcatggtctcatactgcatattgagaggtactgcatgccagtgcatatccctattgagatgcttgctaagcctcacctctccggtgggcagagcatcctctctcagagaaggataatgggactccacacttgcctctgtgagacgatggcacttctatgcgactttctccaggattggcaccacccacgtcat

SEQ ID NO: 55240 - DNA, 530 bp, Triticum aestivum
  Clone ID: PAT_TA_55240
cccacgcgtccgcccacgcgtccgctcctccgctccgggatccatccacctagggttctgcggctgaccggagtcaaggccatggcgcggaagatgctcaaggatggggaggcgcccctcgtcgccgacgacggcgggacctacgactacgacctcttcgtcatcggcgccggcagcggcggcgtccgcggctcccgcaccgccgccggattcggggccaaggttgcgatctgcgagctcccgttccaccccatcagctccgagtggctgggaggacacggcggaacgtgcgtgatacgtggctgcgtcccgaagaagattctcgtctacggagcgtctttccggggggaattcgatgacgccaagcaattcgggtgggagatcaacggggacatcaactaccactggaaaaaggtgctggaaaataagactcaagaaattgtgagattaaatggagggtgcaagagaatccttggtgggtctggtgtgacgatgatcgaaggggcaggagtatagtggatgctcatact

SEQ ID NO: 55241 - DNA, 513 bp, Triticum aestivum
  Clone ID: PAT_TA_55241
cccacgcgtccgcccacgcgtccggcaggctgtgatctatttttatcactactctctagattgttattgtctgctaggctagtttatgaggcggtttctacaaagttgttatttcaattctaacttgtgctaccttttttttttaatgctgactcagcattgaaagtatagtgaggtctgatttattaatggttatattcattaccattttaatcttttcttgggatattatttagggtgcaccgtaccctggagcttaacacactgaagcccgctgagtacctttccttcatgcgccagggaccagagtaagtagtttatttccgtggttatagacagataagtctatattgtgactgttatgctgcagcttaaggtatgatctgttatatctggtgtattcgtcacacctagctctggaagatctatatgcaattcaatttacccgctgcaaagtgttttgctttctaaggatgttcatgcctatgctgcaacctgcaaaatatgtatcta

SEQ ID NO: 55242 - DNA, 381 bp, Triticum aestivum
  Clone ID: PAT_TA_55242
cagcgccgccgcccatggctgccgccgcccccgccgccgccggaacagggggccaggccctcggccggagcagcttctcgcgcgccgcctcatcgaagaccgcctcctcctcctcctcccccaccgcctccggcgtcaagctcggccccaacggcgccgccttcgtctcctccggcatccccgacctcgacaggattctgggtggcggtttcctccttggctcggtcgtgatggtcatggaggactccgacgcgccgcaccacctcctcctgctccgggccttcatggcgcagggcgtcgtgcacaagcagcccctgctcttcgccgcgcccatgagggagccccgctcgttcctgggcgcactgcctgcttcgggggcgt

SEQ ID NO: 55243 - DNA, 215 bp, Triticum aestivum
  Clone ID: PAT_TA_55243
gccagggtagaagcccgagtacgtgggagggcagcccacacgggtgggcgaggtggtgctggctcgccctgacgcaggttgtgcgcgcgaggctgcacgagctgtcgtacttagcgccggccggggctcgaccggagacgggcttctgcaagctcgctcgggcctcctcacccccatcggtggggggatcggctctgccgggtagggcgacctgc

SEQ ID NO: 55244 - DNA, 494 bp, Triticum aestivum
  Clone ID: PAT_TA_55244
cccacgcgtccgaatttatccctcctcaccgggggcgcccttggtgtgcatgggcgccgcggcgccatgacgaccacagctgctgccatgaacgtggctgtcacgcagctatgtggccggggtcgccggcgcaggtcggccgcgctgcgccacgatcaccggtgggcgcgcctgctccgcctcgccgtggccaccagggccgagcgccttgtctgggaccagctgctcgcctgctcctcctgcggagggggcggcggcgcccgctaccgccggctcggcccgtcgcacggaccggacgtgctgacccccctcgccatggacgacgacgccggcgcccacgcccacgccgacgccgacgacgacgcggcagatgtctaggacgtggtcgggctcaaggtcagcctgctcggggatcgccagatcggcaagaccagcttgatggtttaattatgttggggatggggaggagccgaacgggggccttgaaatgacgg

SEQ ID NO: 55245 - DNA, 141 bp, Triticum aestivum
  unsure (1)..(141): unsure at all n locations
  Clone ID: PAT_TA_55245
atccggactgttttcgtgtacttccgtgtgaatttagacggcaagttttttcctctttactataaaaaanacaatgacttgcttacccgtgatctggctggcaactttgaaggtatcatacaccaccgttctgttgtcagt

SEQ ID NO: 55246 - DNA, 255 bp, Triticum aestivum
  Clone ID: PAT_TA_55246
cccacgcgtccgcccacgcgtccgcggacgcgtggggccgcccttttttttttttttttttttttttttttttttttttttttttttttttagaaaccgggggggtgagtttttgatccctggggggggatcttttatttgatctgggtctaataatgttatgggggcggatccatcctggattggatcggattttgttaaatacctgaaatgctacaaatctgctattaatatattgggctatgttgaactttc

SEQ ID NO: 55247 - DNA, 792 bp, Triticum aestivum
  Clone ID: PAT_TA_55247
gtgcattttgattgaaggggatgtcagcattgacactttcagcattgattccttatctccagccccctcaatgtattgggtctttttgtccacaaccagccttacaccagtatttgatatattttgttggactatacatgattgctttaggggctggaggtatcaagccatgtgtttcgtccttcggtgcagaccaattcgatgataccgatccagttgagcgaacaaagaaaggcgctttcttcaattggttttatttctccataaatattggttcattgatctctggcactgttcttatttgggtacaagaaaaatatggatatggcattggatttgcaatccctacctttttcattgccttagctatcggaagcttttttctaggctcagaggtatacagatttcagatacctggaggaagcccgcttacaagagcatgccaggtagttgttgcagccatttacaagcgaaatgtggacttgccagttgatagttctcttctctatgagtgtcgtggcaagagatcagctattgaggggagccgtaagctggagcacagcagtgaattcagttttcttgacaaatcagcagtcgttttgcggagtgaatgcggcggttttcacaatccttggaggctttgcactgtcacacagattgaagagctcaaaatattaatggaggatgtttccaatctgagcaacgggcatttgtgttcttcactgtctgcgctcagattcatcaatgttcatagagcaaggaatggcactcaacaaccaaggtggatcattt

SEQ ID NO: 55248 - DNA, 195 bp, Triticum aestivum
  Clone ID: PAT_TA_55248
ctaaaaaggtcagataaagacagttcacatagtattacaactgcgacgctacgcgtacgacggattccatatgattcccgtcggatctcccagctgacccgggggatcccatacatcgttgtagtcttttgtggttaggaggaccgttgggcgtcagatcaaaagtgggatacgcatatctattattgcttgcac
